United States Patent 7,939,087 (NUCLEIC ACIDS AND PROTEINS FROM STREPTOCOCCUS GROUPS A & B) - sequence listing, part 2

SEQ ID NO: 588 - protein, 83 aa, Streptococcus agalactiae
MKDRKFGMDKNNLEDLTGKKILRNGFGGLRLEYGTIFLDVGLFTYIVLILSIFFFLVERWFLGALTFVLHVPLLLLGIWCGER

SEQ ID NO: 589 - DNA, 627 bp, Streptococcus agalactiae
atgataaagatttattttggaaaagatataacacttaaccaagctattcagtcgcgattggatagctatcagattgactatcaagcattctcaagcaaagatatagatgctaaaacactgatggaatggctattcaggtcgaccgatatatttgaattactaagcactaagatgttgaaatacaagctgaatacacaaattaccctcagtcaatttgttcgaaagattttaaaagatgtcaatagcaccttgaagcttcccattgttgtgacagatgaggttatttattcgaacatgtcccctgactatgtgacagtactcttgccaaaagaatatcggaaaattaaaagaattcagctgatgaggaagatggagcagttagatgagggacgtctattctggaaaaactttgagtcactacgtaagcaatctgagctacgttggtttgaactgaatgagttactgtttgctgatatgtccgacgatttaggagaaatcaaaaaagctaaagaccgtttctttagctacaagaaaaataaacaggttccgcctgatgacattatcgaaaaaatcctcaagatatttttggttgaccgagaagactttttcaaaaaatctgtgttggat

SEQ ID NO: 590 - protein, 209 aa, Streptococcus agalactiae
MIKIYFGKDITLNQAIQSRLDSYQIDYQAFSSKDIDAKTLMEWLFRSTDIFELLSTKMLKYKLNTQITLSQFVRKILKDVNSTLKLPIVVTDEVIYSNMSPDYVTVLLPKEYRKIKRIQLMRKMEQLDEGRLFWKNFESLRKQSELRWFELNELLFADMSDDLGEIKKAKDRFFSYKKNKQVPPDDIIEKILKIFLVDREDFFKKSVLD

SEQ ID NO: 591 - DNA, 1062 bp, Streptococcus agalactiae
atgtgcacatctgaagtgcatttactacacccgttttttggcaagtttggctggagcaaaatgaaaatggtccgactccgaaggggtcggcttggggctactcccccaagaatgtcattttacgtaggcctttgcgcagacaaaaaaatcggcgccgttaggcgaccgccaaaaagaaaggaggtttgtttgaaattaaaagtcagcttagacaatatcactatgacagcctatatcaaatctaaaaagtatttagctatgaaacaactcatagaaacccatttagctattactgttcaaactgcgatgactgacatgtttcgagccaccactggggatggaatccacgttgtgctccatatgaattatgacaaacaaaaaggacaagaccgcaaggctcgtccatttcgcttggagtttaatcccaataaactccgtttagttgacagtgaaattatagatactattataccatttcttgaagatatttcaatatcacgtgctgatttagcttttgatctatttgaggttgattgtagtgagtttgtgctcgaaaaaaagggcagaccaaccgcaaccaaggaatttcgttctagtactggaacgttagaaacaaaatatctaggtgctccacgttctgaaaaacaagttaggctatataacaagaaaaaggaacaactccaaaatggtactgataaagataaagactttgcaagtcaatttaagcactggtggcgcttggaatttcaattaagaagccgttcaattgatgagatattcgaggttattgatactattatttttaaaccattcaatcttaaaggcttatctattgagacccaaatctatctaactgctcttattcacgataaaaatatctggaaaaaactccatagaaatacaagagcaagatacaaaaaaattttagaaactcatcaaacatcagatactgattatttaggtttgctgaaagacttgttgaagcatgaaagaccaagactagaaaatcagctcgcttattatgggggtaggatagacaaaaatagctttcaacccttttgt

SEQ ID NO: 592 - protein, 354 aa, Streptococcus agalactiae
MCTSEVHLLHPFFGKFGWSKMKMVRLRRGRLGATPPRMSFYVGLCADKKIGAVRRPPKRKEVCLKLKVSLDNITMTAYIKSKKYLAMKQLIETHLAITVQTAMTDMFRATTGDGIHVVLHMNYDKQKGQDRKARPFRLEFNPNKLRLVDSEIIDTIIPFLEDISISRADLAFDLFEVDCSEFVLEKKGRPTATKEFRSSTGTLETKYLGAPRSEKQVRLYNKKKEQLQNGTDKDKDFASQFKHWWRLEFQLRSRSIDEIFEVIDTIIFKPFNLKGLSIETQIYLTALIHDKNIWKKLHRNTRARYKKILETHQTSDTDYLGLLKDLLKHERPRLENQLAYYGGRIDKNSFQPFC

SEQ ID NO: 593 - DNA, 474 bp, Streptococcus agalactiae
ttgttgaaaattcagtattatcaaggagttacgaggtcaaaaatgagaataaaagattatgctgatagtctaggagttagtagccaatctatctataaacgcatacgctctccaaaatataaagaaaggttgaaaggtcatttataccgagacaaccaaaaggttgaaaatcttgatttgataggcattaaaatacttgaagattatcattttgagaatgatgtcattgaactggaaaaaacgctgggtgatattcaagaagaattcgagcaagaaaagaagggaatgcaatatcggatagatagactagctgataagttaactcctttacttgaggataaccaaaacttggtacaaaaaaattatgagttactcaactatgttcggagcttggaacgacagaagctattgctgattattgctttagctgtcatggtaatcactttattagtggcaatatggcttgccatcttt

SEQ ID NO: 594 - protein, 158 aa, Streptococcus agalactiae
MLKIQYYQGVTRSKMRIKDYADSLGVSSQSIYKRIRSPKYKERLKGHLYRDNQKVENLDLIGIKILEDYHFENDVIELEKTLGDIQEEFEQEKKGMQYRIDRLADKLTPLLEDNQNLVQKNYELLNYVRSLERQKLLLIIALAVMVITLLVAIWLAIF

SEQ ID NO: 595 - DNA, 1254 bp, Streptococcus agalactiae
atgagttatgttgttgctagaatggctaagtacaagtcaggtcagttgacggctatttataatcataatgaacggatttttaaaaatcactcaaataaagaaattgacgttgagaaatctcaccttaattatgaactgacaaatcgagaccaggcacaaaattatcacaaacaaataaaggagcacatcaatgaaaatcgcttatctactcgtggagtccgtaaagatgctatactctgtaacgaatggattattacttcagataaaacgttttttgactcgttagatgagaaacagacacgagagttttttgagacagctaaagattattttgctgaaaaatatggtgatgctaatattgcttacgctagagttcaccttgatgaaagtactccgcatatgcatttaggtatcgtgccaatgaaaaatggtaagttaagttcaaaagcactgtttggaaataaagagaaacttgtagcaatccaagatgaacttcccaagtaccttaatgagcatggctttaacctacaacgtggcgaaataggcagtaagaaaaaacatttggaaactgctgaatttaaagaaaaacaacgattactggataacgctgatagaaaactagctgataaacatgaagaattgaaagcacttgatgataagatttcaaatgttaacgatacaatagctgataaagaaagtaggcttaaagaattggaagcgaaagaatgggatgctgttggcgatttgaagcagtatgaattagagaaacagtcactagctgaaagcattgaagacataaaagacattgaactattacaacttgatagaattcaaaaagaagatttggtaaaacaaagctttgatggcaaattgaagatggataaagaaacctataatagactatttcaaactgcttcgaaacatgcatctagtaatgctgagttaaaaagagacttggttaaagcccagtcgcagaacaatcacctttctagagaattactcaatcaccgtaagacagctgaaaaaaatatcaaattaagtcaagaaaacagaaaattaaaggacaaagtaaaaatgcttgatgaacaagtgaaaattctgaataaaagcctctctgtttggaaagaaaaagctaaagaatttatgcctaaacaggtttatagagaaacattatcaatcataaacactctaaatcctattggtttagctaaaacagcaatcagacaagttaagaagatggttgatagtaatagt

SEQ ID NO: 596 - protein, 418 aa, Streptococcus agalactiae
MSYVVARMAKYKSGQLTAIYNHNERIFKNHSNKEIDVEKSHLNYELTNRDQAQNYHKQIKEHINENRLSTRGVRKDAILCNEWIITSDKTFFDSLDEKQTREFFETAKDYFAEKYGDANIAYARVHLDESTPHMHLGIVPMKNGKLSSKALFGNKEKLVAIQDELPKYLNEHGFNLQRGEIGSKKKHLETAEFKEKQRLLDNADRKLADKHEELKALDDKISNVNDTIADKESRLKELEAKEWDAVGDLKQYELEKQSLAESIEDIKDIELLQLDRIQKEDLVKQSFDGKLKMDKETYNRLFQTASKHASSNAELKRDLVKAQSQNNHLSRELLNHRKTAEKNIKLSQENRKLKDKVKMLDEQVKILNKSLSVWKEKAKEFMPKQVYRETLSIINTLNPIGLAKTAIRQVKKMVDSNS

SEQ ID NO: 597 - DNA, 6177 bp, Streptococcus pyogenes
atgtttttaaaacaccaagatgtgaaacaaaaaaattggagaatgcgtaaggtcaaaaaagtctttgttagttcatgtatgcttttaacagtgggcctcggagttgccgtacctactggattcagccaatctaatggcgtgatggttgtaaaggctgcggaagtgccggcgacagatttatcacgtcaggcgtctgattcggagagggtagatgaatcgtctttattgcagaaagaaaacttatcagtagattcatttaaattagaaaatttaaatggatgggaagctgaaaatgatacagcaggtaatttggggaaatttaaagatccagatagttcgggctatcaaaatattttgacatcatctggaaagaatatcagtgtagctgttgctcccaaaggttcaggtaaaatgaacattaaagtaactaaaagatcaaattttcagggtggatattatgtaggtggtcttagaactcaaactccggtattgaagttaaatgatgtttatcgatattcttttacaactaaaaaattatcaggaaattcttcagagttcaaaacgagagttaagcccgttgaatctaataataaactagggaaagagcttgttattagggtggataataaaaatgtatctactaagcatgattggcttccagacatctctgatggaactcatactgtggacttcactggtcttgataaaaaattatctgttgctttcagattttctccaagacaaacttcgaatgttgtttacgaattttctaacataaatataaaaaacattagtcctgcatcagtgccggctattccttcgaaagttttagagggaaccagcgtcttgtcgggtactgcaatatcttctggagatacattagaaaaaagaaaatcgtttgatggcgatatcctaagagtttataaagatagcaaaatcattgctagaacagtaataaaaggcaataagtgggatgttaaactttcaaagcctcttattgcaggtgaaaaattagattttgagattttgcatccgagatctcaaaacgttagtaaaaaaatttcaaaacaagtcgaagctaaaccatttgatccagcttcctataaagaaaaagttatagccaaattaaagccggtttatgaagctactagtgaaaaaatcacaaatgatgcttggttggatgaaaatgcgaaggatttgcaaaaacaaaaattagaagaacaatatatttctggaaaagtagcgatatcagaggctggaactaaacaagaagctatagatgcagcatataataaatattcaagtcaaacagatccagactctcttcctagtcagtataaacaaggtaataaagaaaatgaacaagaaaaagggcgtcaagatttaatccagactcgtgatctgacgttgaaagccattcaagaagacaaatggctaacagagcaggagaaaacaattcaaaaagaagaagcattaaaagcttttgaaactggtatagaaagtgttaatcaaacagtatcattagaacagttgaagcaacggttaatagtgtataaagcttctgaaaaagattcagagaaaaaagaatatcctgagtcaattcctaatcagcatattccagggaaagaaaaagaagttaaagctgctaaacaagaagaacttaaaaaattacatgacacaactcttgaaaaaatcaatcaagataaatggttgacgccagaccaacaagctgaacagttaaaacaagcggaagttacttttaaaaaaggccaagaagcaattaaaagtgctcagactttaactcagcttgagacagacttagctgattatgtttctgagaatgaaggtaagggaaattctattcccgataaatacaaatctggcaataaagatgatttggtaaataaggctgaagttaaacttaaggaagctcacgaagctactaaacaagcaattgaaaaagatccatggttgagtccggaacagaaaaaagctcaaaaagaaaaagccaaagcaagactagatgagggcttgaaagctcttaaagctgcagatagtttagagattcttaaagtgacagaagaagctttcgttgataaagaaaaaaatccagattcaattccaaatcaacataaagctggaactgctgatcaagctagaaaacaagctttagatagtttagataaggaggttcaaaaagagttagagtcaattgataacgataatactctaacaactgatgagaaagcagctgctaagaaaaaagtcaatgacgcttatgatgtagctaagcaaacagctatggaagccaattcttatgaagatttgactactattaaagatgagttcttatctaatttacctcataaacaaggaacgccgcttaaagatcaacaatctgatgctattgcagaattagagaagaagcagcaagaaattgaaaaagctattgagggtgataaaacattaccaagagacgaaaaagagaaacaaattgctgactctaaggaacgcttaaaatctgacacgcaaaaagttaaagatgctaaaaatgctgatgctattaaaaaagcatttgaagaagggaaagtgaatattcctcaagcacatatcccaggtgatttgaacaaggataaagaaaaacttcttgcagaattgaagcaaaaagcagatgatactgaaaaagctattgatgttgataaaactctgacagaagatgagaaaaaagagcaaaaagtcaaaacaaaagctgaacttgaaaaagctaaaactgatgttaaaaatactcagacacgtgaagaactagataaaaaagttccagaacttaagaaagctattgaagacactcacgttaaaggtaatcttgaaggtgttaagaataaggctattgaagatcttaaaaaagctcatactgaaacagttgctaaaataaatggtgatgatacccttgacaaagctactaaagaagctcaagtgaaagaagctgacaaagctttggcagcaggtaaagatgcgatcactaaagcagatgatgctgataaagtaagtacagctgttacagagcacacaccaaaaattaaagcagcacataaaactggtgaccttaaaaaagctcaagtagatgctaacacagctcttgacaaagcagctgaaaaagaacgtggagaaatcaataaagatgctacactaacgacagaagataaagcaaaacaactgaaagaagttgagacagctcttactaaagctaaagataacgtgaaagctgctaagacagcagacgctatcaatgacgcacgtgataaaggcgtagcaacaattgatgccgtccataaagcaggtcaagacttaggtgctcgtaagtcaggtcaagtcgctaaacttgaagaagcagctaaagcaacgaaagacaagatttcagctgatccaactttgacaagcaaagaaaaagaagagcaatctaaagctgttgacgctgaacttaagaaagcgatagaagctgttaacgcagctgacacagctgacaaggttgacgatgctcttggtgaaggtgttacagacatcaagaaccaacacaagtcaggtgactctatcgacgctcgtcgtgaggctcatggtaaggaacttgatagagtcgctcaagaaactaaaggtgcgattgaaaaagaccctactttgacgactgaagaaaaagctaaacaagttaaagacgtagatgccgctaaagaaagaggcatggctaagcttaatgaagctaaagatgctgatgctttagacaaagcttacggtgaaggtgttacagacatcaagaaccaacacaagtcaggtgaccctgtcgacgctcgtcgtggattacacaacaagtcaatcgacgaagtggcgcaagcaactaaggacgctatcacagcagatacgactttgactgaagctgaaaaagaaacacaacgtggcaatgttgataaagaagcaactaaagctaaagaagaacttgctaaggctaaagatgctgatgctttagacaaagcgtacggtgacggtgtaaccagcatcaagaaccaacacaagtcaggtaaaggtcttgacgttcgtaaagatgagcacaagaaagctcttgaagctgttgctaaacgtgtcactgctgaaattgaggctgatccaaccttaacaccagaagtgagagaacaacaaaaagcagaggttcaaaaagagcttgaacttgcgactgataagattgctgaagctaaagatgcagatgaagcagacaaagcttacggtgacggtgtcacagcgatcgaaaatgcccacgttattggtaaaggtatcgaagctcgtaaagaccttgctaagaaagaccttgctgaagctgctgctaagacaaaagctctcattattgaagacaaaacgcttactgatgatcaacgtaaagaacagttattaggtgttgatacagagtatgctaaaggtatcgagaatattgatgcagctaaggatgctgcaggtgttgataaagcatatagtgacggtgttcgtgacatcctggcacagtacaaagaaggtcaaaaccttaatgatcgtcgtaatgctgccaaagaatttcttcttaaagaagcagacaaagtgacgaaactaatcaatgatgatccaaccttgactcatgaccaaaaagttgatcaaatcaacaaagttgaacaagctaagttagacgcaatcaagtctgttgatgatgctcaaacagctgatgctatcaatgatgctcttggtaagggtattgaaaacatcaacaaccaataccaacatggcgatggcgttgatgttcgtaaagcgactgccaaaggcgatcttgaaaaagaagctgctaaagtgaaagctcttattgctaaggatccgaccttaactcaagctgataaagacaaacaaacagcagcggttgacgcagctaagaatacagcaattgcagcggttgataaagcgacaacaactgaaggcattaaccaagaacttggtaaaggcatcacagctatcaataaagcttaccgtccaggtgaaggtgttaaagcacgtaaagaagccgctaaagctgatcttgaaaaagaagctgctaaagtgaaagctcttattactaacgacccaaccttaacaaaagctgataaagctaaacaaacagaagctgttgctaaagcccttaaagctgctatcgcagcggttgataaagcgacaacagctgaaggcattaaccaagaacttggtaaaggcatcacagctatcaataaagcttaccgtccaggtgaaggtgttaaagcacgtaaagaagccgctaaggctgatcttgaaagagaagctgctaaggttcgtgaagctatcgctaacgacccaaccttaacaaaagctgataaagctaaacaaacagaagctgttgctaaagctcttaaagctgctatcgcagcggttgataaagcgacaacagctgaaggcattaaccaagaacttggtaaaggcatcacagctatcaacaaagcttaccgtccaggtgaaggtgttgaagcacataaagaagctgctaaagctaatcttgaaaaagtagctaaagaaactaaagctcttatttcaggagaccgttacttgagcgaaactgaaaaagcagtccaaaaacaagctgttgagcaagctcttgcgaaagcacttggtcaagttgaggctgctaagacagttgaagctgttaagttggcagaaaaccttggtactgtagctatccgttcagcatatgttgctggtttagctaaagatactgatcaagcaacagctgctcttaacgaagcgaaacaagctgctattgaagctcttaaacaagctgcggcagaaacacttgctaagattacaactgatgctaaattgactgaagctcaaaaagctgaacaatcagaaaatgtatcattagcgcttaagacggctattgcgactgttcgttcagcacaatctattgcgtctgtgaaagaagcaaaagataaaggtattactgctatccgtgcagcctatgtgcctaataaggcagtcgcaaaatcatcgtcagcgaaccatcttccaaaatcaggtgatgcaaactcaattgttcttgttggcttaggagttatgtctcttcttttaggtatggtgctttatagcaagaaaaaagaaagtaaagac

SEQ ID NO: 598 - protein, 2059 aa, Streptococcus pyogenes
MFLKHQDVKQKNWRMRKVKKVFVSSCMLLTVGLGVAVPTGFSQSNGVMVVKAAEVPATDLSRQASDSERVDESSLLQKENLSVDSFKLENLNGWEAENDTAGNLGKFKDPDSSGYQNILTSSGKNISVAVAPKGSGKMNIKVTKRSNFQGGYYVGGLRTQTPVLKLNDVYRYSFTTKKLSGNSSEFKTRVKPVESNNKLGKELVIRVDNKNVSTKHDWLPDISDGTHTVDFTGLDKKLSVAFRFSPRQTSNVVYEFSNINIKNISPASVPAIPSKVLEGTSVLSGTAISSGDTLEKRKSFDGDILRVYKDSKIIARTVIKGNKWDVKLSKPLIAGEKLDFEILHPRSQNVSKKISKQVEAKPFDPASYKEKVIAKLKPVYEATSEKITNDAWLDENAKDLQKQKLEEQYISGKVAISEAGTKQEAIDAAYNKYSSQTDPDSLPSQYKQGNKENEQEKGRQDLIQTRDLTLKAIQEDKWLTEQEKTIQKEEALKAFETGIESVNQTVSLEQLKQRLIVYKASEKDSEKKEYPESIPNQHIPGKEKEVKAAKQEELKKLHDTTLEKINQDKWLTPDQQAEQLKQAEVTFKKGQEAIKSAQTLTQLETDLADYVSENEGKGNSIPDKYKSGNKDDLVNKAEVKLKEAHEATKQAIEKDPWLSPEQKKAQKEKAKARLDEGLKALKAADSLEILKVTEEAFVDKEKNPDSIPNQHKAGTADQARKQALDSLDKEVQKELESIDNDNTLTTDEKAAAKKKVNDAYDVAKQTAMEANSYEDLTTIKDEFLSNLPHKQGTPLKDQQSDAIAELEKKQQEIEKAIEGDKTLPRDEKEKQIADSKERLKSDTQKVKDAKNADAIKKAFEEGKVNIPQAHIPGDLNKDKEKLLAELKQKADDTEKAIDVDKTLTEDEKKEQKVKTKAELEKAKTDVKNTQTREELDKKVPELKKAIEDTHVKGNLEGVKNKAIEDLKKAHTETVAKINGDDTLDKATKEAQVKEADKALAAGKDAITKADDADKVSTAVTEHTPKIKAAHKTGDLKKAQVDANTALDKAAEKERGEINKDATLTTEDKAKQLKEVETALTKAKDNVKAAKTADAINDARDKGVATIDAVHKAGQDLGARKSGQVAKLEEAAKATKDKISADPTLTSKEKEEQSKAVDAELKKAIEAVNAADTADKVDDALGEGVTDIKNQHKSGDSIDARREAHGKELDRVAQETKGAIEKDPTLTTEEKAKQVKDVDAAKERGMAKLNEAKDADALDKAYGEGVTDIKNQHKSGDPVDARRGLHNKSIDEVAQATKDAITADTTLTEAEKETQRGNVDKEATKAKEELAKAKDADALDKAYGDGVTSIKNQHKSGKGLDVRKDEHKKALEAVAKRVTAEIEADPTLTPEVREQQKAEVQKELELATDKIAEAKDADEADKAYGDGVTAIENAHVIGKGIEARKDLAKKDLAEAAAKTKALIIEDKTLTDDQRKEQLLGVDTEYAKGIENIDAAKDAAGVDKAYSDGVRDILAQYKEGQNLNDRRNAAKEFLLKEADKVTKLINDDPTLTHDQKVDQINKVEQAKLDAIKSVDDAQTADAINDALGKGIENINNQYQHGDGVDVRKATAKGDLEKEAAKVKALIAKDPTLTQADKDKQTAAVDAAKNTAIAAVDKATTTEGINQELGKGITAINKAYRPGEGVKARKEAAKADLEKEAAKVKALITNDPTLTKADKAKQTEAVAKALKAAIAAVDKATTAEGINQELGKGITAINKAYRPGEGVKARKEAAKADLEREAAKVREAIANDPTLTKADKAKQTEAVAKALKAAIAAVDKATTAEGINQELGKGITAINKAYRPGEGVEAHKEAAKANLEKVAKETKALISGDRYLSETEKAVQKQAVEQALAKALGQVEAAKTVEAVKLAENLGTVAIRSAYVAGLAKDTDQATAALNEAKQAAIEALKQAAAETLAKITTDAKLTEAQKAEQSENVSLALKTAIATVRSAQSIASVKEAKDKGITAIRAAYVPNKAVAKSSSANHLPKSGDANSIVLVGLGVMSLLLGMVLYSKKKESKD

SEQ ID NO: 599 - DNA, 468 bp, Streptococcus agalactiae
atgacagataaaaaaattgtttattactttgaccatgacttatcaaaaaaagatatgggaggagtaggacctacctacaccggtaaaaatcttttattcctactttggtggacatattcttatgtggcagaagacaatttagacattgatacgtcattgtttgaagtcccagaattcaatgatttttacaataatggtctagagctttatcgtataaaaaatgaactagctaattacaatatcagatttggatatgaggttaatccaaaagatagtacaaagatgctgataggtattttgccaactgatgaagaagattatgttaagggatatagaaattttattgctgatatttccaatcctgacacacgttacgcaatctatcatcgactaattaaaaccatggacacaatgctaccgattgaacaaattaatgtttataaaagccttgcaaaaggtaataaaaag

SEQ ID NO: 600 - protein, 156 aa, Streptococcus agalactiae
MTDKKIVYYFDHDLSKKDMGGVGPTYTGKNLLFLLWWTYSYVAEDNLDIDTSLFEVPEFNDFYNNGLELYRIKNELANYNIRFGYEVNPKDSTKMLIGILPTDEEDYVKGYRNFIADISNPDTRYAIYHRLIKTMDTMLPIEQINVYKSLAKGNKK

SEQ ID NO: 601 - DNA, 333 bp, Streptococcus agalactiae
ttggactataagaaatatcagattatctatgctcctgatgttttagagaagttaaaggaaattcgtgattatatttctcaaaactattcctcgacatcaggtcagcacaaaatggagcaaatcattagtgacatagaaaaactcgaggttttccctgaagttggttttgatgccgatgaaaaatatggttcaaaaatcagtaagtaccacagcactagaggttataccttaagtaaagattatattgtcctataccatatcgaggaggaagagaatagggtcgttattgattacttgcttcctactcgaagcgactatatgaaattgtttaaa

SEQ ID NO: 602 - protein, 111 aa, Streptococcus agalactiae
MDYKKYQIIYAPDVLEKLKEIRDYISQNYSSTSGQHKMEQIISDIEKLEVFPEVGFDADEKYGSKISKYHSTRGYTLSKDYIVLYHIEEEENRVVIDYLLPTRSDYMKLFK

SEQ ID NO: 603 - DNA, 333 bp, Streptococcus pyogenes
ttggactataagaaatatcagattatctatgctcctgatgttttagagaagctaaaagaaattcgtgattatatttctcaaaactattcctcaacatcaggtcagcgtaaaatggagcaaatcattagcgacatagaaaaactcgaggttttcccagaagttggttttgatgccgatgaaaaatatggttcaaaaatcatccattatcacagcactaaaggttataccttaagtaaagattatattgtcctataccatatcgagggggaagaaaataggatcgttattgattacttgcttcctactcaaagcgactatataaagttattcaaa

SEQ ID NO: 604 - protein, 111 aa, Streptococcus pyogenes
LDYKKYQIIYAPDVLEKLKEIRDYISQNYSSTSGQRKMEQIISDIEKLEVFPEVGFDADEKYGSKIIHYHSTKGYTLSKDYIVLYHIEGEENRIVIDYLLPTQSDYIKLFK

SEQ ID NO: 605 - DNA, 285 bp, Streptococcus agalactiae
atggttacagcagaaaaaaatagagctgtcacattccaagctaacaaagaattggtaagcgaagcaatgacagtattaaacaagaaaaatttaaccttatcatctgctttaagattattccttcaaaatgtcgttgtcacaaatgaggttgacttattgacggaagaggagctagagaaagaaaaacttttcaagcaatttcaagctgaaatcaacaaaaatattgaagatgttcgtcaagggaaattttatacctctgaagaagtgaggtctgaacttggacta

SEQ ID NO: 606 - protein, 95 aa, Streptococcus agalactiae
MVTAEKNRAVTFQANKELVSEAMTVLNKKNLTLSSALRLFLQNVVVTNEVDLLTEEELEKEKLFKQFQAEINKNIEDVRQGKFYTSEEVRSELGL

SEQ ID NO: 607 - DNA, 285 bp, Streptococcus pyogenes
atgactacagtaaaaaaaaacagagcggttacctttcaagctaataaagaattggtaagcgaagcaatgacagtattaaacaaaaaaaatttaaccttatcatctgctttaagattattcctacaaaatgtcgttgtcacaaacgaggttgacttattgacggaagaggagttagagaaagaaaaacttttcaagcaatttcaagctgaaatcaacaaaaatattgaggatgttcgtcaagggaagttttatacctctgaggaagtgagggctgaacttggacta

SEQ ID NO: 608 - protein, 95 aa, Streptococcus pyogenes
MTTVKKNRAVTFQANKELVSEAMTVLNKKNLTLSSALRLFLQNVVVTNEVDLLTEEELEKEKLFKQFQAEINKNIEDVRQGKFYTSEEVRAELGL

SEQ ID NO: 609 - DNA, 291 bp, Streptococcus agalactiae
atgatgtcacaaattaaactaacacctgaagaactccgtatttcagcacaaaaatatacaacaggatcacaatcaattacagatgtgttaacagttttgactcaagaacaagctgttattgatgaaaattgggatggtacagcatttgatagctttgaagcccaattcaatgaattatctccaaaaatcacacaatttgcacaattattagaagatataaatcaacaattattgaaagttgcggatgttgtcgaacaaacagactcagatattgcctcacaaattaataaa

SEQ ID NO: 610 - protein, 97 aa, Streptococcus agalactiae
MMSQIKLTPEELRISAQKYTTGSQSITDVLTVLTQEQAVIDENWDGTAFDSFEAQFNELSPKITQFAQLLEDINQQLLKVADVVEQTDSDIASQINK

SEQ ID NO: 611 - DNA, 558 bp, Streptococcus agalactiae
atggtatttacatataccgagaaagaacttcgtgaattcaatattggagataatgtatattcagttaaccccgattatgcagaaaaaaatcattcaactgtcataacggatttaccccagaaagataacgaaacaaatattattacaacagaagatagaaaaaaatttaaggtattaaaaacttctcctgacgatatgtctggctatcagggtatggcagttgcaccaattatcaagggtaaagtagattataacagtgttgcagttatatccgccgcaacggattcaagtaattataaagatttaattggcgcagtttcatctgctcaaccacatcaaagttcgactcagttaaaatcagctgataaatttttaaaagacgtacagtcacatgacaaatggactgtgactcagctttcaggctattctcaatctgcatatatgttaaaattaggtgctcaatatcatatcccgactacagtatttaatggatggtttaggtatagcactttaaatgaagatgaaaaaaattcatggctaagcatcctgaatattttg

SEQ ID NO: 612 - protein, 186 aa, Streptococcus agalactiae
MVFTYTEKELREFNIGDNVYSVNPDYAEKNHSTVITDLPQKDNETNIITTEDRKKFKVLKTSPDDMSGYQGMAVAPIIKGKVDYNSVAVISAATDSSNYKDLIGAVSSAQPHQSSTQLKSADKFLKDVQSHDKWTVTQLSGYSQSAYMLKLGAQYHIPTTVFNGWFRYSTLNEDEKNSWLSILNIL

SEQ ID NO: 613 - DNA, 678 bp, Streptococcus agalactiae
atggctaagcatcctgaatattttgtgaattttcgacataaagaggataatgtaacttggtggaacgattttaataaactagatgataaagattatggtaccgtgaaatgggtaaatggtaaaagtcataaaatagagagttggaaatttactgatgatggtaagttaaaagatgaaaaaggtaacatcgtaaatcctaagtcaccagctgttcagtctgttctttatgaagaagttcattttcaaaaagctaaagctaaattaaaaaaatctggaggcaaacttagtcatagtgaaaaagtatatttagattctgaacaggctatatttattgctaacggtttaaccacggcatctcaaacagcttctgatgatatcaagaagaatgctgaattagttaaagaaaaagcatcagaactatttgcaaaaactaaagtgatgcctcctggtataacagatttaagtccggaagaattagctgatacatatagtgagggcggagttagagaggacaccatagtaacaccaattgaaactttctttgatgaaaaagttactaatgcacaagagattacaacttcatatattaatcttcaaaaacaaattgaatctggtgtccaaaaattgctagaagaggactccaaattagcaggagaatttaaggaatggtcacagtac

SEQ ID NO: 614 - protein, 226 aa, Streptococcus agalactiae
MAKHPEYFVNFRHKEDNVTWWNDFNKLDDKDYGTVKWVNGKSHKIESWKFTDDGKLKDEKGNIVNPKSPAVQSVLYEEVHFQKAKAKLKKSGGKLSHSEKVYLDSEQAIFIANGLTTASQTASDDIKKNAELVKEKASELFAKTKVMPPGITDLSPEELADTYSEGGVREDTIVTPIETFFDEKVTNAQEITTSYINLQKQIESGVQKLLEEDSKLAGEFKEWSQY

SEQ ID NO: 615 - DNA, 384 bp, Streptococcus agalactiae
atggtcacagtactagatcaaaatgaaaacaaaattaatagtctaaaaataaacctagggaaattggaagataattatcatcgcgaaaatatggagatagaagataaattatatagccttgaggataaaaagaacgagttagagacttatttacaagaagtctatgaagagacaagtcaccttttgagacaaaatgattcagatggttcgacttttatgagtttaaatcgaataattgaaagttatcaaatggaattaattgatgaatatgaaaactataaacagactatcattgtccaagaggaaaatagtcggacacagtttctaaaagaccgagtaaaattagaaaatgacatttctagtttagaaggaagaaaatactac

SEQ ID NO: 616 - protein, 128 aa, Streptococcus agalactiae
MVTVLDQNENKINSLKINLGKLEDNYHRENMEIEDKLYSLEDKKNELETYLQEVYEETSHLLRQNDSDGSTFMSLNRIIESYQMELIDEYENYKQTIIVQEENSRTQFLKDRVKLENDISSLEGRKYY

SEQ ID NO: 617 - DNA, 279 bp, Streptococcus agalactiae
atgagtttaataggcgctgtattgaaaggaaccaaagaagacaaagaattcaaaaagcaaattcaaagagctttagtaaggattgtctatgcccctgaaatagtagaagaagctgattctattaagatgacttatagtgacaagattgataatgtttctgagacggccaaatcatcaattaaaacgatagcaaatcaaatagattcaggacttgtaggacaatttggggaaaaagtaaaggcacaggtagatttaaataaaggtagttatgatgattta

SEQ ID NO: 618 - protein, 93 aa, Streptococcus agalactiae
MSLIGAVLKGTKEDKEFKKQIQRALVRIVYAPEIVEEADSIKMTYSDKIDNVSETAKSSIKTIANQIDSGLVGQFGEKVKAQVDLNKGSYDDL

SEQ ID NO: 619 - DNA, 96 bp, Streptococcus agalactiae
atgaaggataacaaagtttattatttacattttggtaaagcaatagataaaaatgaagctaaaaatgataagtatctcaatcaaattataaataat

SEQ ID NO: 620 - protein, 32 aa, Streptococcus agalactiae
MKDNKVYYLHFGKAIDKNEAKNDKYLNQIINN

SEQ ID NO: 621 - DNA, 105 bp, Streptococcus agalactiae
atgatggaggaattttgtatggtaagtactcaatatatgaaagtaaccttacgagaaaaattcccagataaattaacatatgttgatttagaagaacttgtgata

SEQ ID NO: 622 - protein, 35 aa, Streptococcus agalactiae
MMEEFCMVSTQYMKVTLREKFPDKLTYVDLEELVI

SEQ ID NO: 623 - DNA, 99 bp, Streptococcus agalactiae
gtgaatgtgactcctcaagaaaaatgtcggaagaagacctttgctttttgtcggattacctctttcaaaaggatagttgggaaattagtgactatattt

SEQ ID NO: 624 - protein, 33 aa, Streptococcus agalactiae
MNVTPQEKCRKKTFAFCRITSFKRIVGKLVTIF

SEQ ID NO: 625 - DNA, 858 bp, Streptococcus agalactiae
atgtttaaatatgtccctatttttagggaatttcgacttaatcgacagttttctcttaaacaggttgcttcaaatgaactttctgtttctcagttatcacgatttgagaggggtgaatcagatttatcattaacaaaatttttaggggctttagaggcaattgatttatcaattagcgaatttatggatagagtaaataaatatcaaaaatctgatcagatatctttaatgtctcagatggctcaatatcattatcaaagagacgtagctgggttagaaaagatgatttctgtggaagaaggtaaactaaaaaaggatagttcagatatacgttgtcgtttaaacatagttctttttagaggaatgatatgtgaatgtgactcctcaagaaaaatgtcggaagaagacctttgctttttgtcggattacctctttcaaaaggatagttgggaaattagtgactatattttgattggaaatctttaccggtattacaacacaaggcatatttgccaacttgttaaagaggttatcaatcaaaaggaatattatcgagatatttatacaaaccgcaatgttgtcgaagcaaccctcctaaatgtggtagagacactaatagaacggcgcgctctagaagaagcaacgttttttctagagaaagttgaagcacttttaaataatgagcggaatgcttatcaccgtattattttactctatgaaaaaggatttcttgcctatgctaaaggggatagtcgaggaatacaaagcatgaagcaagctattttttgcttccaagcaattggttctaaacatcatgttgaaaattttcaggaacactttaatagggtaacaagatta

SEQ ID NO: 626 - protein, 286 aa, Streptococcus agalactiae
MFKYVPIFREFRLNRQFSLKQVASNELSVSQLSRFERGESDLSLTKFLGALEAIDLSISEFMDRVNKYQKSDQISLMSQMAQYHYQRDVAGLEKMISVEEGKLKKDSSDIRCRLNIVLFRGMICECDSSRKMSEEDLCFLSDYLFQKDSWEISDYILIGNLYRYYNTRHICQLVKEVINQKEYYRDIYTNRNVVEATLLNVVETLIERRALEEATFFLEKVEALLNNERNAYHRIILLYEKGFLAYAKGDSRGIQSMKQAIFCFQAIGSKHHVENFQEHFNRVTRL

SEQ ID NO: 627 - DNA, 879 bp, Streptococcus pyogenes
gtgaaagtgggaaaaatggaaaaagaactcggaaaaaccttaaggcgattacgtaagggtaagcaggttagcatttcttttttagcagatgaatacctgtccaagtcacaaatttcaagatttgaacgaggggaatcagaaatcacctgcagtcgcttgcttaatcttttggataaactgaatattacgattgacgaatttgtttcggctcattccaagacgcatacgcattttttcacgctcttaagtcaggcgagaaaatgttatgctgagaaaaacgtggttaaattgaccaaactgttgaaggattatgcccataaagattatgaacgaacgatgattaaagctattcttttttctattgactcctcaattgcacctagtcaagaagaattgactcgcctcacagattatttatttaaagtggaacagtggggatattatgaaatcattcttctggggaattgctcgcgcttcatgaattacaataccctatttttattgactaaggaaatggtagcatcttttgcttattcggaacaaaataaaaccaataaaatgttagtgactcagttatccattaattgtctcattatcagtattgaccattcttgctttgaacatagtcgctatttgattaacaaaattgatcttttgctgcgagacgagctcaatttttatgaaaagactgttttcttatatgtgcatgggtattataaattaaagcaggaagaaatgtctggagaagaggacatgcggcaggccttgcagatttttaagtatcttggagaggactcattgtattatagttataaggaacattaccgtcaaatagtgctgggaggtaagggggatgaggactggtctgaggcagattta

SEQ ID NO: 628 - protein, 293 aa, Streptococcus pyogenes
VKVGKMEKELGKTLRRLRKGKQVSISFLADEYLSKSQISRFERGESEITCSRLLNLLDKLNITIDEFVSAHSKTHTHFFTLLSQARKCYAEKNVVKLTKLLKDYAHKDYERTMIKAILFSIDSSIAPSQEELTRLTDYLFKVEQWGYYEIILLGNCSRFMNYNTLFLLTKEMVASFAYSEQNKTNKMLVTQLSINCLIISIDHSCFEHSRYLINKIDLLLRDELNFYEKTVFLYVHGYYKLKQEEMSGEEDMRQALQIFKYLGEDSLYYSYKEHYRQIVLGGKGDEDWSEADL

SEQ ID NO: 629 - DNA, 1179 bp, Streptococcus agalactiae
atgaatattaatggtataaaattactatctagtcgagcagtcagtaaacttggtgatgtgttttatgattatggaaatagtacttggattgcttcgatgggtggtctaggacaaaagattttaggtatttatcagatagtagagttgttggtttctattgtcctcaacccttttggaggcgccttagctgatcgctttcaacgaagaaaaattttactaataacagatgctatctgtgctatcatgtgtttcttactttcttttattggagatgataaagtaatggtgtatggtctaatagttgctaatgctatcttagcggtttccaatgctttttcttctccggcttataaatcttatattcctgaaatagtagataaagctgatatcattacctataatgctaatctggaaaccattgtgcaaattattagtgtaagttcccctgttttaggtttccttatttttaataattttggtattaggattactttaattgttgatgcgattacttttttgatctctttcctgtttctttatgctattaaagtggaaagggtacagctttcaaaacaagaaaaggtagcgataaaaaatattttagctgatattgcagatggatttacttacatcaaaaaagaaaaagaaattatgttttttctaattattgctgctttattaaacactttcctagcaatgttcaattatcttttaccttttactaactccctattaaaaacttcaggtgcttatgcaacaatacttagtatatcagctatcggatcaattattggagcgcttattgctagaaaaattaaatctagtattaattctatgctatctatgctagtattcagtagtttgggagtcatagttatgggattcccatctctatttgaattaccgatatggataccttacagtggtagttttctttttaatagtcttctgacaatgtttaatattcattttttcagtcaggtacaaatcagggtcgatgaagcgtatatggggcgtgtgatgtcgactatatttactattgctattatgtttatgcctataggaacactatttatgactatcttttcatttgccttatcaaatgttagctttattgttataggatgtgccattgctatattgggaggattaggatttagctatagtaaaaaacaattt

SEQ ID NO: 630 - protein, 393 aa, Streptococcus agalactiae
MNINGIKLLSSRAVSKLGDVFYDYGNSTWIASMGGLGQKILGIYQIVELLVSIVLNPFGGALADRFQRRKILLITDAICAIMCFLLSFIGDDKVMVYGLIVANAILAVSNAFSSPAYKSYIPEIVDKADIITYNANLETIVQIISVSSPVLGFLIFNNFGIRITLIVDAITFLISFLFLYAIKVERVQLSKQEKVAIKNILADIADGFTYIKKEKEIMFFLIIAALLNTFLAMFNYLLPFTNSLLKTSGAYATILSISAIGSIIGALIARKIKSSINSMLSMLVFSSLGVIVMGFPSLFELPIWIPYSGSFLFNSLLTMFNIHFFSQVQIRVDEAYMGRVMSTIFTIAIMFMPIGTLFMTIFSFALSNVSFIVIGCAIAILGGLGFSYSKKQF

SEQ ID NO: 631 - DNA, 1206 bp, Streptococcus pyogenes
atgaacaataggaaaaaaaatattcaatatttagtgtatagtaaagttatatatcgaattggcgatgttatgtttgattttgctaacaatacttttcttgctgggcttaatccagcgtctctatcattagttgcagtatatcagtctctagaaagtgtcataggtgttctatttaatttatttggtggagtcattgcagacagtttcaagcggaaaaaaattattattactacaaatatcttatgtggcacagcttgcttagtactctcgttcctaacaaaagagcaatggttggtttatgccattgtactaactaatgttatcttggcatttatgagtgctttttctagtccatcctataaagcatttacaaaagaaattgttaaaaaagatagtatatcacaacttaattcattgctagagacaacaagtactgtaatcaaagtaacagttcctatggtagcaattttcttatataagctacttggtatacacggtgtattactattggatggactatcatttctaatagctgctttactaatttcctttattttacctgttaatgacgaagtggtgataaaggagaaggtgacaatcagagaaatatttaacgatttaaaaataggatttaaatacgtttacagccataagtccatctttattattaccgttctttctgcacttgttaatttttttctagccgcttataatttattgttgccctatagtaatcaaatgtttggagaaatttcaactggactttatggcacttttttaacagcagaagcaattggtggatttattggggcaatattaagtggttttgtgaataaagaattatcaagtatgagattgatattgtttctatctttatcaggactgatgttaatgttagctcccccattttatattatgtttcataatgcaattattttagctttgtcaccagctttattcagtttatttctttccatctttaatattcaatttttttctcttgtccagaaagatgttgataacgattttttagggagagtgtttggtattatctttacaataactattctttttatgcctattgggactggctttttctcggtggcattaaatcctaacaatagctttaatctttttattattggttcgtgcattactacattgtcattagtatttagaatattatttaaaaagtataatattcgt

SEQ ID NO: 632 - protein, 402 aa, Streptococcus pyogenes
MNNRKKNIQYLVYSKVIYRIGDVMFDFANNTFLAGLNPASLSLVAVYQSLESVIGVLFNLFGGVIADSFKRKKIIITTNILCGTACLVLSFLTKEQWLVYAIVLTNVILAFMSAFSSPSYKAFTKEIVKKDSISQLNSLLETTSTVIKVTVPMVAIFLYKLLGIHGVLLLDGLSFLIAALLISFILPVNDEVVIKEKVTIREIFNDLKIGFKYVYSHKSIFIITVLSALVNFFLAAYNLLLPYSNQMFGEISTGLYGTFLTAEAIGGFIGAILSGFVNKELSSMRLILFLSLSGLMLMLAPPFYIMFHNAIILALSPALFSLFLSIFNIQFFSLVQKDVDNDFLGRVFGIIFTITILFMPIGTGFFSVALNPNNSFNLFIIGSCITTLSLVFRILFKKYNIR

SEQ ID NO: 633 - DNA, 468 bp, Streptococcus agalactiae
atgggaatcgcaaatgtcatccaaaccattccttctttagctatgatctctatcattatgttaggtctagggctaggtattaaaacagtagttgcaactgtctttctttattctcttctgccaatcatcacaaatacttacactggtattagaaatgttgactccgacttactagatgctgctaaaggaatgggcatgactaagcgtcaacgtttatttatggttgagttaccactatctatttccgttatcatggctggacttagaaatgcccttgttgtagcaattggtattacagccattggtgctttcgtcgggggaggcggacttggagatatcatcataagaggaactaatgcaacaaatggtggtgctattatcttagcaggatctcttccaacagcccttatggcaattttctctgatttaatcctaggcggtatccaacgcatgcttgaaccaagaaaa

SEQ ID NO: 634 - protein, 156 aa, Streptococcus agalactiae
MGIANVIQTIPSLAMISIIMLGLGLGIKTVVATVFLYSLLPIITNTYTGIRNVDSDLLDAAKGMGMTKRQRLFMVELPLSISVIMAGLRNALVVAIGITAIGAFVGGGGLGDIIIRGTNATNGGAIILAGSLPTALMAIFSDLILGGIQRMLEPRK

SEQ ID NO: 635 - DNA, 1560 bp, Streptococcus pyogenes
atgcttttgtggtcaatttatttggaggtgatgagcatgcctagtttgtttgtaactttccaaaaccgttttaatgaatggctggcggctctgggggaacacctgcaaatttcccttttatctcttatgatcgccttgctaataggtgtgcctttagcagcccttctcagtcgcagcaaacgttggtcagacattatgttacaggtaacaggtgtttttcaaaccattccctcactggctttgcttggtcttttcatccctttaatgggaattggaacgttgcctgcagtgacagctttagttatctatgcgatttttccgattttacaaaacaccatcacaggattaaatggtattgacccaagtctcgtggaagcaggaatagcttttgggatgaccaaatgggagcgattgaaaacatttgagattccaattgccatgcctgttattatgtcaggtgtgcggacgtcagcagtcatgattatcggcacagctactttagcttccttgataggagccggtggacttggctctttcatcttattagggattgatcgtaataatgctaacctgattctgataggggctatttcttcagctctgctagctattattttcaatagtttgttacagtaccttgagaaagcttccttgcgacggattatgattagttttggaattaccttacttgcactgctagcatcgtatactcctatggcgcttagtcagttttcaaaaggaaaagatacagtggttattgccggtaaattgggagcagagcccgatattctgattaatctctataaggaattaattgaagaccaatcagatataagtgttgagttgaaatctaattttgggaaaactagcttcttatatgaagcccttaaatctggagatattgatatgtatcctgaatttacaggaaccataacatcaagtcttttacgcgacaaaccacctttgtctaatgaccctaagcaggtctatgaggatgctaaaaaaggcattgctaagcaagataaactgacccttctcaagccatttgcttaccaaaatacgtatgctgttgctatgccagaaaaattggctaaggaatatcagattgaaaccatttctgatttaaaagcgcatgctgatactttaaaggccggttttactttggaatttaaggacagagcagatggctataagggaatgcaatctcaatatggattacagctatctgtggcgacgatggagccagctcttcgttatcaagcaattcaatcaggagatatccaagtaacagatgcttactctacggatgctgaaattacgaaataccatttgaaagttttaaaggatgataaacagttgtttccaccttatcagggagctcctttgatgaaaacttccttattaacaaaacatccagaattaaaaggcattcttaatcaattagcgggaaaaattactgaaaaagagatgcaggacatgaactacgaggtatctgttaaaggagcagatgctaataaggtcgctcgagattatctgttgaaaacaggcttaatccagaaa

SEQ ID NO: 636 - protein, 520 aa, Streptococcus pyogenes
MLLWSIYLEVMSMPSLFVTFQNRFNEWLAALGEHLQISLLSLMIALLIGVPLAALLSRSKRWSDIMLQVTGVFQTIPSLALLGLFIPLMGIGTLPAVTALVIYAIFPILQNTITGLNGIDPSLVEAGIAFGMTKWERLKTFEIPIAMPVIMSGVRTSAVMIIGTATLASLIGAGGLGSFILLGIDRNNANLILIGAISSALLAIIFNSLLQYLEKASLRRIMISFGITLLALLASYTPMALSQFSKGKDTVVIAGKLGAEPDILINLYKELIEDQSDISVELKSNFGKTSFLYEALKSGDIDMYPEFTGTITSSLLRDKPPLSNDPKQVYEDAKKGIAKQDKLTLLKPFAYQNTYAVAMPEKLAKEYQIETISDLKAHADTLKAGFTLEFKDRADGYKGMQSQYGLQLSVATMEPALRYQAIQSGDIQVTDAYSTDAEITKYHLKVLKDDKQLFPPYQGAPLMKTSLLTKHPELKGILNQLAGKITEKEMQDMNYEVSVKGADANKVARDYLLKTGLIQK

SEQ ID NO: 637 - DNA, 984 bp, Streptococcus agalactiae
atgcttaaaaaatcgcactttttacagatatttacactttgcttagccctcttaacgatttctggttgtcaattaaccgatactaaaaagtctggtcataccacaattaaggttgctgcccaaagttctacagagtctagtattatggcaaatattatcaccgaattaattcatcacgaattaggatacaacacaactttaataagcaatcttggttcctctacggttactcaccaagctttgctccgtggtgatgctgacattgctgccacacgttatacaggaacagacatcacagggactcttggtttaaaagctgttaaagaccctaaagaagcttctaagattgtaaaaactgaattccaaaaacgctacaatcaaacttggtatcctacttatggtttttctgatacttatgcattcatggttactaaagagtttgccagacagaataaaatcactaagatctctgatcttaaaaaattatcaacaactatgaaggcaggggttgatagttcatggatgaatcgcgagggagatggatacactgatttcgctaaaacatacggttttgaattttcacatatttaccctatgcaaattggcttagtctatgatgcggttgaaagtaacaaaatgcaatctgtattaggctactccactgacggtcgtatttcgagctatgatttagaaattttaagggatgataaaaaattctttcctccttatgaagcctctatggttgtcaacaattctatcatcaaaaaagatcctaaactaaaaaaattactccatcgactcgatggtaaaatcaatttaaaaacgatgcaaaaccttaattatatggtagatgataaacttttagaaccttcagttgttgccaaacaatttttagaaaaaaaccattattttagrrgarrwwaawwaawkraammaawkaawwmyttccmammatttwtyywmywmytycmammwwawkgkwrk

SEQ ID NO: 638 - protein, 328 aa, Streptococcus agalactiae
  MISC_FEATURE (1)..(328): Xaa = Any Amino Acid
MLKKSHFLQIFTLCLALLTISGCQLTDTKKSGHTTIKVAAQSSTESSIMANIITELIHHELGYNTTLISNLGSSTVTHQALLRGDADIAATRYTGTDITGTLGLKAVKDPKEASKIVKTEFQKRYNQTWYPTYGFSDTYAFMVTKEFARQNKITKISDLKKLSTTMKAGVDSSWMNREGDGYTDFAKTYGFEFSHIYPMQIGLVYDAVESNKMQSVLGYSTDGRISSYDLEILRDDKKFFPPYEASMVVNNSIIKKDPKLKKLLHRLDGKINLKTMQNLNYMVDDKLLEPSVVAKQFLEKNHYFRXXXXXXXXXXFXXFXXXXXXXXX

SEQ ID NO: 639 - DNA, 633 bp, Streptococcus agalactiae
atggtcaatttcttatcacagtatggcatgcaaatattagtaaaaacatgggaacaagtctatatctcattctttgctatagcacttgggattgcaattgctgttccattgggtgtggtcttaacacgttttcccaaagtagccaaaattatcattgctatagctagcatgttacaaactataccaagtttagccttattagctttaatgattccattgtttggaattggaaaaatcccagctatcgttgctttatttatttattccttgcttcctatactaaggaatacttatataggtatgaataatgtcaatccaacacttaaagattgtgctaaagggatgggaatgaaacctattcaatctatatttcaagttgagttacctttagctactccaattattatggctggtattcgcttgtctactatttatgttattgcttgggctacattggcttcttatataggtgcaggtggacttggtgatctcatttttagcgggttaaatctttttcagtccaaattaattctagggggcacaattcctgttattatcctgtcacttattatagattatcttttaggattactggaaacagctctaacgcccagaacaacaagaagggaggct

SEQ ID NO: 640 - protein, 211 aa, Streptococcus agalactiae
MVNFLSQYGMQILVKTWEQVYISFFAIALGIAIAVPLGVVLTRFPKVAKIIIAIASMLQTIPSLALLALMIPLFGIGKIPAIVALFIYSLLPILRNTYIGMNNVNPTLKDCAKGMGMKPIQSIFQVELPLATPIIMAGIRLSTIYVIAWATLASYIGAGGLGDLIFSGLNLFQSKLILGGTIPVIILSLIIDYLLGLLETALTPRTTRREA

SEQ ID NO: 641 - DNA, 1143 bp, Streptococcus agalactiae
atgggccaagaacctatcatcgaatatcaaaatatcaataaagtgtatggggaaaatgttgcggttgaagacattaaccttaaaatttaccctggtgattttgtttgtttcatcggtacgagtggatcaggtaaaacaacattaatgcgtatggttaaccatatgttaaaaccaacaaatggtactctattatttaagggaaaagatatttctactattaaccccattgaattaagacgcagaattggatatgttatccaaaacattggtttaatgcctcatatgaccatttacgaaaatatagttcttgtaccaaaattattgaaatggtcagaagaagctaaaagagctaaagcaagggaacttattaaattagttgaattacccgaagaatatttggatcgctaccctagtgagttgtctggcggtcagcaacaacgtatcggtgtcattcgcgctcttgcagcagaccaagatattattttaatggatgagccttttggagctctggatcctattactagagaaggtattcaagacttagtcaagtctcttcaggaagaaatggggaaaactatcatcttagttactcatgatatggatgaagccctcaagttagcaacaaaaattattgttatggacaatggtaaaatggtccaagaagggacacccaatgatctcttacatcatcctgctactagtttcgttgaacaaatgattggagaagagcgtctccttcatgcgcaggctgatattactcctgttaaacagataatgttaaataatcctgtttcaataactgctgaaaaaacactaactgaagctattacactaatgcgccaaaaacgcgttgactcacttctagtaaccgataacggtaaattaattggttttattgacttagaatctctaagcagtaaatataagaaagatcgacttgtttctgatatcttaaaacatactgatttttatgttatggaagacgacttacttagaaatactgctgagcgtattttaaaacttggtttaaaatacgctccagttgttgaccatgagaataacttaaagggcattgttactcgtgcatccctagttgatatgttatacgatattatttggggcgatactgaaacggaggatcaa

SEQ ID NO: 642 - protein, 381 aa, Streptococcus agalactiae
MGQEPIIEYQNINKVYGENVAVEDINLKIYPGDFVCFIGTSGSGKTTLMRMVNHMLKPTNGTLLFKGKDISTINPIELRRRIGYVIQNIGLMPHMTIYENIVLVPKLLKWSEEAKRAKARELIKLVELPEEYLDRYPSELSGGQQQRIGVIRALAADQDIILMDEPFGALDPITREGIQDLVKSLQEEMGKTIILVTHDMDEALKLATKIIVMDNGKMVQEGTPNDLLHHPATSFVEQMIGEERLLHAQADITPVKQIMLNNPVSITAEKTLTEAITLMRQKRVDSLLVTDNGKLIGFIDLESLSSKYKKDRLVSDILKHTDFYVMEDDLLRNTAERILKLGLKYAPVVDHENNLKGIVTRASLVDMLYDIIWGDTETEDQ

SEQ ID NO: 643 - DNA, 726 bp, Streptococcus pyogenes
atgatacgttttaataatgtttctaaaacttttggtcagacaaaggttttgcaagagcagacctttcaaattaatgatcgtgaattttttgtgctggttggccccagcggatcgggcaagaccacacttttaaaaatgattaattgccttattgaaccaagctctggagatattttactaaataacgtcccacagacagagttagatttacgtgagatgaggctatctattggatacgtattgcagcaaattgctctgttccccaatctcacagtagctgaaaatattgcgattatccctgagatgaagcaatggtcagctgaagaaattagacaaaaaactgaagaattattggataaggtgggcctacctgctaaagattatcttgatcgttacccaagtgatttatcgggaggtgaacagcaacgtattggtattgtacgtgctatcatttctcatcctaaaattctattgatggatgaaccattttcagccttagatcctatttcacgtaaacaattgcaagagttaatgttgagtcttcacaaggaatttgacatgacgattgtatttgtgacacatgatattgatgaggccattaaattaggagaccgcgtagctattttaaatgagggagaaattgtgcaactggatcgcccagaaatgattaagacccaccctgctaatgcttttgtggtcaatttatttggaggtgatgagcatgcc

SEQ ID NO: 644 - protein, 242 aa, Streptococcus pyogenes
MIRFNNVSKTFGQTKVLQEQTFQINDREFFVLVGPSGSGKTTLLKMINCLIEPSSGDILLNNVPQTELDLREMRLSIGYVLQQIALFPNLTVAENIAIIPEMKQWSAEEIRQKTEELLDKVGLPAKDYLDRYPSDLSGGEQQRIGIVRAIISHPKILLMDEPFSALDPISRKQLQELMLSLHKEFDMTIVFVTHDIDEAIKLGDRVAILNEGEIVQLDRPEMIKTHPANAFVVNLFGGDEHA

SEQ ID NO: 645 - DNA, 111 bp, Streptococcus agalactiae
ttgatgggcacgagtggactcgaaccaccgacctcacgcttatcaggcgtgcgctctaaccacctgagctacgcgcccaagctattgcttggtttttactttcttataaag

SEQ ID NO: 646 - protein, 37 aa, Streptococcus agalactiae
MMGTSGLEPPTSRLSGVRSNHLSYAPKLLLGFYFLIK

SEQ ID NO: 647 - DNA, 495 bp, Streptococcus agalactiae
ttgatatataaaatttatattctaagaaaagagaacatgatgagaaaatatataaaatggttaattcccatatcaatttttgggatgatacttggaggctgtcaaatgaatagtgaacataaaattcagtcaaacgaagtaaaaaatagcaagcaatcagaagtgaagaaagataaaaaaatgacaaaaaaagaacaattagcctatctcaaagagcatgagcaagaaatcatagattatgtaaaattacataacaaccaaattgagtccgttcaattcgattggtcaagtgtaaaagtagaacaaagcgggaatggaactccacaagggggtgattataatctttcactgagaggaaagtttaatcatctacaaaattcaaaattaatagttgatttttatttagctcataaaaatgatatcccaaatatcaaatcaatgggaatgctaaataagccgtatatacataaaaatggtatttggcacatttatgaa

SEQ ID NO: 648 - protein, 165 aa, Streptococcus agalactiae
MIYKIYILRKENMMRKYIKWLIPISIFGMILGGCQMNSEHKIQSNEVKNSKQSEVKKDKKMTKKEQLAYLKEHEQEIIDYVKLHNNQIESVQFDWSSVKVEQSGNGTPQGGDYNLSLRGKFNHLQNSKLIVDFYLAHKNDIPNIKSMGMLNKPYIHKNGIWHIYE

SEQ ID NO: 649 - DNA, 804 bp, Streptococcus agalactiae
ttgagtaattggaacttagataattttgataacttacatagctctttagcagaaagtgcatataatagtcgacctaattcatttcctgaattatttgagactgactcagtaacagaagtaaaattttctcaaccctcagaagataacaaaggtcaaatcacacagggtggcactaacctccccaatgatggtattgtctacctgcaaccagataagtccttaaaatctattgatgaaaatgtaaaggtcctcattccagatgtcaatggaggctatcacactgagcattatgttactcattcttatcaaaaaggtgtgcttactgacgataaggcaggttttaatgcttactacctgtcagatactgaaaaaatagatagcactacaaagcacacttatctagccattcgtggtagtgatgggattggtctagatacactaaacgattgggttagtaacaatgcaatgtttgctgtctctaacaagtatattccacaagcgaaattggctaataaggctatgaaagaaaaaattgccgagctaaaaggaaaagcgcctggagctattatagatgttactggtcactcactcggtacgattgtatcttctcaagcagttgttaatcttagctatgcagaattggagaatgttggtcaagtagtccttttcgatggccctgatgtatcaagaagcttggaaaaaatggaaggcatttctgctaaaaaaatccaagaagctgggaagcatgttacctactatgtcaatccctttgatatagttagtatgcttaatcgtgaaaagcca

SEQ ID NO: 650 - protein, 268 aa, Streptococcus agalactiae
MSNWNLDNFDNLHSSLAESAYNSRPNSFPELFETDSVTEVKFSQPSEDNKGQITQGGTNLPNDGIVYLQPDKSLKSIDENVKVLIPDVNGGYHTEHYVTHSYQKGVLTDDKAGFNAYYLSDTEKIDSTTKHTYLAIRGSDGIGLDTLNDWVSNNAMFAVSNKYIPQAKLANKAMKEKIAELKGKAPGAIIDVTGHSLGTIVSSQAVVNLSYAELENVGQVVLFDGPDVSRSLEKMEGISAKKIQEAGKHVTYYVNPFDIVSMLNREKP

SEQ ID NO: 651 - DNA, 348 bp, Streptococcus agalactiae
atgctctatatggcaacgcaattagcagaatcagatgtttcagaaaaagtctctgcaacaaaaaaacatattagtgaagctaaggatacgattgtagaaatatcgacatccactatttcatcagctgaaataatggctatgcaccttgaccaatcagaagttgatgctctggtttcagatataaaaatgtcaacagtttggaatgatggcgtagagacttctgattatgaagcacttgatcactataaaacaaaaatgaccacatttacgaccaatttggtaacagttgcacaaaatttaacagctcaagatgagcaactagctggtgatattgtcacgaacttatcc

SEQ ID NO: 652 - protein, 116 aa, Streptococcus agalactiae
MLYMATQLAESDVSEKVSATKKHISEAKDTIVEISTSTISSAEIMAMHLDQSEVDALVSDIKMSTVWNDGVETSDYEALDHYKTKMTTFTTNLVTVAQNLTAQDEQLAGDIVTNLS

SEQ ID NO: 653 - DNA, 270 bp, Streptococcus agalactiae
atgtccaaagaattgaaattgcccttgaatgaaatgttgaaagaacaagaaagaatagctattaaggcaatagttgctacagcaaaaagcactattacggatactggaacaaatttaaaagcaactttagagtcagatgcccaagacctaaaaaactatgcatccacctataacgccaatatcacggatggtcttgaaggccagtcagctcaagcagcatctgatttcttgacacaacttccaaaaccagagttagataatccagtcaat

SEQ ID NO: 654 - protein, 90 aa, Streptococcus agalactiae
MSKELKLPLNEMLKEQERIAIKAIVATAKSTITDTGTNLKATLESDAQDLKNYASTYNANITDGLEGQSAQAASDFLTQLPKPELDNPVN

SEQ ID NO: 655 - DNA, 348 bp, Streptococcus agalactiae
atgatagatacaaaaaaactgcaagaactcgatcaagaatatgatcaaaatctcagaaacatttatcgtaacagagagcaactagaagatgactttcacttgtttatggcaagaacagacagcctaaaagagtctgtctatcaagcaactttaggacaaggttgggaattaccccaagaagctcatgcacacctatataatatggatgataataaggatacattcatatcagaattcaatgaatatatggaaaagcttgaagaaaaggaaatagatcttcgaagagtttataatgatagagtagatgaattgtatcagaaggctaagcaaaacgaagcaaaaaaagga

SEQ ID NO: 656 - protein, 116 aa, Streptococcus agalactiae
MIDTKKLQELDQEYDQNLRNIYRNREQLEDDFHLFMARTDSLKESVYQATLGQGWELPQEAHAHLYNMDDNKDTFISEFNEYMEKLEEKEIDLRRVYNDRVDELYQKAKQNEAKKG

SEQ ID NO: 657 - DNA, 96 bp, Streptococcus agalactiae
atgaaaattatgaaagaattagacaatataggaattaaccgtaagaatctttttcgggatcatgataatatagcaaaatatctaattgaaaaagta

SEQ ID NO: 658 - protein, 32 aa, Streptococcus agalactiae
MKIMKELDNIGINRKNLFRDHDNIAKYLIEKV

SEQ ID NO: 659 - DNA, 591 bp, Streptococcus agalactiae
ttgggagattttatgaacaataaaaacaaatggactataattttacttatttttactatcatcgtaattgatgttagcttactatttggcgggaatcgtttaagtttaccaatcaaattattaattttattagtaaccagtatagcagaattttgttcgatttttataatgataaaagttccgactcctcaaaaatataagaaagaaccatttggattaaaagcaaaattttattctattgtactctttctctcgactattctttatacaattgggatatggaatgtgacgccagcttccccatacaatgttaaagaatcaattcttggagttggcattttaatacaagtagttttcttcatttattttctattaaaaaaaattaacgaaagtcccgatgaacgcttttatagtaatttagcattgtcagcttctttgatgtttttgatatcaataatgttattaattcttatagctatttaccttaatatatatggaacgttagagttaaaatcaggctacctttatattatggtaggtttattattactaatgtttgctgttacatattactttcttgagggacggaga

SEQ ID NO: 660 - protein, 197 aa, Streptococcus agalactiae
MGDFMNNKNKWTIILLIFTIIVIDVSLLFGGNRLSLPIKLLILLVTSIAEFCSIFIMIKVPTPQKYKKEPFGLKAKFYSIVLFLSTILYTIGIWNVTPASPYNVKESILGVGILIQVVFFIYFLLKKINESPDERFYSNLALSASLMFLISIMLLILIAIYLNIYGTLELKSGYLYIMVGLLLLMFAVTYYFLEGRR

SEQ ID NO: 661 - DNA, 216 bp, Streptococcus agalactiae
atggggaaagaaacaaaaattatcagttctttaaaacaggttagagaagatatcggaatgactcaacaagagttagctattcggataggtgttaggagagaaacaattggtcatttagaaaataacaggtataatccttctctagagatggcacttaaaattgttaagattttcgacatgaagatagaagatatttttcaattaaggaaagaggat

SEQ ID NO: 662 - protein, 72 aa, Streptococcus agalactiae
MGKETKIISSLKQVREDIGMTQQELAIRIGVRRETIGHLENNRYNPSLEMALKIVKIFDMKIEDIFQLRKED

SEQ ID NO: 663 - DNA, 558 bp, Streptococcus agalactiae
ttgaataaattttttttagaatcagagagacttattataaggccactagaagaaagtgattatgatagttggtatactagttttatgaatcgtggaccatctttaactccatttgatgatgggatacttgatatgtctatgtgtgacattaattggtttaaaaatttagtaaatttacaaaggaaagaatgggaaagtgacatagtatatatatttggtgtttttctaaaaagcggtgagcacgtaggaatgttaaatattgttacccttgcaagagcagatatgcaatggggagaattgggatatgtttttcataatcaattttggagtaatggctatgcatttgagtcaatcttggcattacttaatagtacttatgaaaaattgggttttcatcatattgaagcacagattactcctgggaatgaacgatcggaaaagttggttagaagattgggattaacctatgagacaactcgaaaagatttttcatttgagaatggaaaatggacagataaactgatttatagtataaatttacataataataatttagaa

SEQ ID NO: 664 - protein, 186 aa, Streptococcus agalactiae
MNKFFLESERLIIRPLEESDYDSWYTSFMNRGPSLTPFDDGILDMSMCDINWFKNLVNLQRKEWESDIVYIFGVFLKSGEHVGMLNIVTLARADMQWGELGYVFHNQFWSNGYAFESILALLNSTYEKLGFHHIEAQITPGNERSEKLVRRLGLTYETTRKDFSFENGKWTDKLIYSINLHNNNLE

SEQ ID NO: 665 - DNA, 576 bp, Streptococcus agalactiae
atgaataatttggatacactatattgtaaattagcaatgtgcaacacagtactaacggaaagattacgactccagcctgttgaattaactaatgtaaatgattttttagaattttcatctgattctgaaacagtattctatatgcaacgttataaagctaataccgtagaagaagcacaagtcgttttagcaaatgtttgtatgaaatcaccattaggaatttatgcaatgattgaaaaagaatcacagaagatgataggtattattgaattagaaatcagagatgaattttctgcagaatttggttatattttaaataaaaattataatggaaaaggttatatgacagaagcttgttcaaaattgatgtcaattggatttgaacatctagacttggaaagaatttatgctagatttgacattaataataaaaaatctggaaatgttatggaacggataggtatgaaaaaagaaggcgagcttcgtcatcttgcaaaaaatccaaaaggtgagtggaaaacaagagcgtattattctattttaaaagaagaatattttaataaagttaatactaaa

SEQ ID NO: 666 - protein, 192 aa, Streptococcus agalactiae
MNNLDTLYCKLAMCNTVLTERLRLQPVELTNVNDFLEFSSDSETVFYMQRYKANTVEEAQVVLANVCMKSPLGIYAMIEKESQKMIGIIELEIRDEFSAEFGYILNKNYNGKGYMTEACSKLMSIGFEHLDLERIYARFDINNKKSGNVMERIGMKKEGELRHLAKNPKGEWKTRAYYSILKEEYFNKVNTK

SEQ ID NO: 667 - DNA, 540 bp, Streptococcus pyogenes
atggatatttggacaaagcttgcagtgtttgctttttttgagactccgaaagtaatattacggccttttcgctatgaagatcattgggatttttacagcatggttaacgacactaaaaacctttattatgtttttccagaacaaaaaactaaggcagcaagtgactatcttttagtacatagttttataaagtttcctttaggtcagtgggcaatagaagataaagcaacccaccaagtaataggttctattagaattgagcattatgatgctaaaacgcgttgtgctgatattggctattttttaaactatgccttttggggacaaggaattatgacagaagtcgtaataaaacttgtttatttatcttttcacgaatttggtctcaaaacgttgcgtattataactcatttagaaaataaggccagccagaaagtagctaaaaaagcaggttttcaactaaaaacctgttttaaaggaagtgatcgtaatactcataaaatctgcatttataaaatgtaccaactaactaatgatagg

SEQ ID NO: 668 - protein, 180 aa, Streptococcus pyogenes
MDIWTKLAVFAFFETPKVILRPFRYEDHWDFYSMVNDTKNLYYVFPEQKTKAASDYLLVHSFIKFPLGQWAIEDKATHQVIGSIRIEHYDAKTRCADIGYFLNYAFWGQGIMTEVVIKLVYLSFHEFGLKTLRIITHLENKASQKVAKKAGFQLKTCFKGSDRNTHKICIYKMYQLTNDR

SEQ ID NO: 669 - DNA, 678 bp, Streptococcus agalactiae
gtgggtgatgtcgttgaaaattttacggaaggtaaaaatccgaagattgatacacttaatgggaaaacagttagaatagaaaaaataaatccagatcattttgaagacttatttcaagtttatggagaattgtctactgaagatagtttaacttatatatcttttagcaaatttaatagtaagaatgaatttgatgtctttttccaaactctattaaaatcagaagatccttattatttagctattgttgataataatactggtaaagtattagggactttttcattaatgcgtattgatacaaaaaatagagttgttgaaatgggatgggtggtttattcatcaaaactaaaacaaacaaggatagcaacagaagctcaatatttggttatgaaatatgtttttgaagaactctgttaccgccgttatgagtggaaatgtgatagtttgaatgcaccatctaataattctgcaaaacgacttggttttacttttgaaggaacttttagacaagctgtcgtatataagggtcgtaacagagatacaaattggtattctattttagataaagagtggccagagaaaaaaacacggtttgaaaaatggctagatgattcaaactttgctgtaaatgggtatcaaatcagatcactatcaagcattgagcagaagacaaaa

SEQ ID NO: 670 - protein, 226 aa, Streptococcus agalactiae
MGDVVENFTEGKNPKIDTLNGKTVRIEKINPDHFEDLFQVYGELSTEDSLTYISFSKFNSKNEFDVFFQTLLKSEDPYYLAIVDNNTGKVLGTFSLMRIDTKNRVVEMGWVVYSSKLKQTRIATEAQYLVMKYVFEELCYRRYEWKCDSLNAPSNNSAKRLGFTFEGTFRQAVVYKGRNRDTNWYSILDKEWPEKKTRFEKWLDDSNFAVNGYQIRSLSSIEQKTK

SEQ ID NO: 671 - DNA, 945 bp, Streptococcus agalactiae
atgataaaaacaaagtttagtgatccactggaacaattagccaaaaaaaggaaaaggaaaacattattcaagaccgtagtattggcattaataactgtactattagtagttggaatagcttttaaagggtttacatatttaacttcaaaaaatggtcaaaaaacatatcataactttgaactactttctgaaatagcatatccaaatatttcctatgatagtctctattaccagccaagcggtcagtttactggtaaagtacatgctgatagatttaaagatatcgatggggttcaaattccatattctagttttgaagaaaattatagtatctcaggtacttttggcacaaatgctgatgaaaaatcagaaaagaatggcttgtatgatcgaggtactagacaaaaagttccacaatttttcaataaaaatgttaagtataaaaaaggagaagccaaaacaactccaacaaatgatttaaaatatgtaaataaattgaataatgatcttattgaaattgcaataacttttgataagtcctatagttacaaagaaataaaaacaatgataccaaataatataaaacaaaattggttatggataggtacaagcacagaattagatacatcatattggccaacaaagtatcaattcggtacagatcctgaaactttgaatacaccacaaatattcatagataaaataaaagaaaacttaaaaggtaactcaaaagtatactttaataatataaatatctactcagatttagaaaagtatgccaaaaaatacgacaaggtaaataatagcgacaaattaaaattttcgggaataatattaacaggtaaagccgaaaactttaaacaacttaaagaaaaagaatgggtacatgcttcaagtataggggcaaacatagaatataagccctattataaattagataaagaa

SEQ ID NO: 672 - protein, 315 aa, Streptococcus agalactiae
MIKTKFSDPLEQLAKKRKRKTLFKTVVLALITVLLVVGIAFKGFTYLTSKNGQKTYHNFELLSEIAYPNISYDSLYYQPSGQFTGKVHADRFKDIDGVQIPYSSFEENYSISGTFGTNADEKSEKNGLYDRGTRQKVPQFFNKNVKYKKGEAKTTPTNDLKYVNKLNNDLIEIAITFDKSYSYKEIKTMIPNNIKQNWLWIGTSTELDTSYWPTKYQFGTDPETLNTPQIFIDKIKENLKGNSKVYFNNINIYSDLEKYAKKYDKVNNSDKLKFSGIILTGKAENFKQLKEKEWVHASSIGANIEYKPYYKLDKE

SEQ ID NO: 673 - DNA, 162 bp, Streptococcus agalactiae
atgatgaaaaaatatataaaatggttaattcccatatctattattgggatgttactagtaggctgtcaaatgaataggggacctaaaagtcagtcaaacgaagtaaaaaatagcaagcaatcagaagtgaagaaaggtaaaaatatgataaaaaagaacagt

SEQ ID NO: 674 - protein, 54 aa, Streptococcus agalactiae
MMKKYIKWLIPISIIGMLLVGCQMNRGPKSQSNEVKNSKQSEVKKGKNMIKKNS

SEQ ID NO: 675 - DNA, 606 bp, Streptococcus agalactiae
atgaaaaataatattattttttctattgaacagtatattaatgaccaagagatgccaaaaggaaaacaaaaagttattttatccgctatagagctctttgcctcacaaggcttccatggaacttccactgctcaactagctaaaaatgcagaagttagccaagcaactatatataaatattttgaaactaaagacaagcttttggtctttattctcgagttaatcgtacaaactattggacgccccttctttacagaattatctacattttctactaaagaggaactaattcatttctttgtacaggaccgttttaaatttattgaaaaaaataatgatctcattaaaatattgatgcaagaattattaatcaatagtgaaacatcaactatttttactaagctaataaattcaactgatccaaacattactaaaattttcaactgtttaagtgaaggaaattcgttgaataaaatggaaatacttcgagcagtaatcggacagttcattactttctttattcaattatatatccttaatataaagcctgaaaatctagaggaagaactaaaacaaatagaaaaacaaatattaaaattactgagc

SEQ ID NO: 676 - protein, 202 aa, Streptococcus agalactiae
MKNNIIFSIEQYINDQEMPKGKQKVILSAIELFASQGFHGTSTAQLAKNAEVSQATIYKYFETKDKLLVFILELIVQTIGRPFFTELSTFSTKEELIHFFVQDRFKFIEKNNDLIKILMQELLINSETSTIFTKLINSTDPNITKIFNCLSEGNSLNKMEILRAVIGQFITFFIQLYILNIKPENLEEELKQIEKQILKLLS

SEQ ID NO: 677 - DNA, 192 bp, Streptococcus agalactiae
atgccgtatgataacatatatccaaatacaatatcactacgtttaacaggagttgcaaggagtcgatcaagtgtaccagaagtacgctcttttaataaagccattccagaaattaaaaaaacaaagaagaagaccataaatcccattagtattggtatcatttttgcaaaaaagcctgtatttttatttccg

SEQ ID NO: 678 - protein, 64 aa, Streptococcus agalactiae
MPYDNIYPNTISLRLTGVARSRSSVPEVRSFNKAIPEIKKTKKKTINPISIGIIFAKKPVFLFP

SEQ ID NO: 679 - DNA, 1095 bp, Streptococcus agalactiae
atgagaattattgcaataactgaaaaggttataaaagaactgtttcgtgataaaagaacacttgctatgatgtttttagcacctattttaattatgtttttgatgaatgttatgttttctgcgaatagtaatacaaaagttaagattggaactattaacgttaacacgaaggtcgtttcaaatttagataatattaagcatattcaagtgagatcatttaaatttaactcatctgctaaaaaagcactcaaatcaaataaaattgatgctcttatttcggaggacaataaatcttatactgtcttctatgcgaatacagattcttcaaagacgactttaacaagacaagcttttaaaaccgctgttaatacaatgaacagtaaggaactgatttcgcaagttaaaattttagctaataagaatccgaaactagcacaatccttacaaactcgctccaaatatatcaaagaaaaatataattacggaaataaaaatacaggcttttttgcaaaaatgataccaatactaatgggatttatggtcttcttctttgtttttttaatttctggaatggctttattaaaagagcgtacttctggtacacttgatcgactccttgcaactcctgttaaacgtagtgatattgtatttggatatatgttatcatacggcattctagcaattattcaaacgatagttatcgttttatcaactatttggctactagatattcaagttgtaggtagtatttttagtgtcatcattgtcaattttattttggctctggttgccttatcattaggaatcttaatgtctactctagcaaaatcagaatttcaaatgatgcaatttattcccttaattataatgcctcaattattcttttcaggaataatccctctagaaaatatggcaagttgggctcagacagtcggtaaaattctaccgctctcctactctggtgatgcacttacaaaaataattatgtacggtcaaggattacctaacgtttcttcaaatcttctggtacttcttctatttttaattattttaaccatcgcaaatatctttggactaaaacgataccgtaaagta

SEQ ID NO: 680 - protein, 365 aa, Streptococcus agalactiae
MRIIAITEKVIKELFRDKRTLAMMFLAPILIMFLMNVMFSANSNTKVKIGTINVNTKVVSNLDNIKHIQVRSFKFNSSAKKALKSNKIDALISEDNKSYTVFYANTDSSKTTLTRQAFKTAVNTMNSKELISQVKILANKNPKLAQSLQTRSKYIKEKYNYGNKNTGFFAKMIPILMGFMVFFFVFLISGMALLKERTSGTLDRLLATPVKRSDIVFGYMLSYGILAIIQTIVIVLSTIWLLDIQVVGSIFSVIIVNFILALVALSLGILMSTLAKSEFQMMQFIPLIIMPQLFFSGIIPLENMASWAQTVGKILPLSYSGDALTKIIMYGQGLPNVSSNLLVLLLFLIILTIANIFGLKRYRKV

SEQ ID NO: 681 - DNA, 1116 bp, Streptococcus pyogenes
atgatttgttttataaaaactctatttgttaagataaagcgcaaaaaaacaagttatgtgacattctttttaatgcctattttaacgacacttttggctttatctttgagtttttcaaataataatcaagctaaaattgggatattagataaagataatagtcagatatctaaacaatttattgctcaactaaagcaaaacaaaaagtacgacatttttaccaaaatcaaaaaagagcatattgatcactaccttcaagataaatctctagaagcggtattgactattgacaaagggttctcagataaagtgttgcaaggaaaatctcaaaaactcaatatacgttcgattgctaatagcgaaattacagagtgggtaaaggcacagaccaattatctattggaaaattataatattataggggatgtggctctaggtaacgaagatacttttaatagaattctccaaaaaaaccaacagttaaattatgatgttaagcaagtaactttgacagaccgatcacgtagcaaagcagtatcttccacaacgacaggatttttgcttattctaatgttaggtagtacgagcgtgatttacagtggtattttggcagataaatctagtcagttataccatcgattaatgttatcgaacttatctcgttttcgctatatgttgagttacgtctgtgtaggatttgttgcttttacgattcaaattgtcattatgctgagtttgttaaaagtatttaatattagtttttttgttccgacatcacttcttttgattatttttttcctttttagtttattagcgataggctttggcctgctgattggagctatcacacaaaattcccaacaaagtagccagttagctaatcttattgtaatgccgacttcaatgttggctggctgtttatggccattgtctattacgccttcttatatgcaagcaattggtaagttattaccacaaaattgggttttatcagccatagctatttttcaaagtggagggaccttatctcaggcttggccatacttgttagctctaatgggaacagcactagctttgattagtttttcaagtttattattaaaacctaccaaacta

SEQ ID NO: 682 - protein, 372 aa, Streptococcus pyogenes
MICFIKTLFVKIKRKKTSYVTFFLMPILTTLLALSLSFSNNNQAKIGILDKDNSQISKQFIAQLKQNKKYDIFTKIKKEHIDHYLQDKSLEAVLTIDKGFSDKVLQGKSQKLNIRSIANSEITEWVKAQTNYLLENYNIIGDVALGNEDTFNRILQKNQQLNYDVKQVTLTDRSRSKAVSSTTTGFLLILMLGSTSVIYSGILADKSSQLYHRLMLSNLSRFRYMLSYVCVGFVAFTIQIVIMLSLLKVFNISFFVPTSLLLIIFFLFSLLAIGFGLLIGAITQNSQQSSQLANLIVMPTSMLAGCLWPLSITPSYMQAIGKLLPQNWVLSAIAIFQSGGTLSQAWPYLLALMGTALALISFSSLLLKPTKL

SEQ ID NO: 683 - DNA, 642 bp, Streptococcus agalactiae
ttggaggtgtttaaaggcgaaataattggattaataggaccctctggagcagggaaatctaccttgattaaaactatgcttggcatggaaaaagcagataagggaacagctcttgttcttgatactcaaatgccagatcgtaatattttaaatcaaattggctatatggctcaatctgatgccttatacgagtctttaactggcttagaaaatttattattctttggaaaaatgaaaggtattcaaaaaactgaattaaaacagcagataactcatatttctaaagtagtagatctagaaaaccaacttgataaatttgtctcaggttactcaggaggtatgaaaagacggctttctctagccatcgccctacttggaaaccccacagttttaatcctagatgaacctaccgttggaattgatccatccttgaggagaaaaatctggcaagagctaattaatattaaggatgaaggacattctatctttattacaacccacgttatggatgaagcagaattaacaagtaaggttgcactactattacgtggaaacattattgcctttgatactccattacatttaaaaaaacaatttaatgtgagtactattgaggaagttttcttaaaagctgaaggagaa

SEQ ID NO: 684 - protein, 214 aa, Streptococcus agalactiae
MEVFKGEIIGLIGPSGAGKSTLIKTMLGMEKADKGTALVLDTQMPDRNILNQIGYMAQSDALYESLTGLENLLFFGKMKGIQKTELKQQITHISKVVDLENQLDKFVSGYSGGMKRRLSLAIALLGNPTVLILDEPTVGIDPSLRRKIWQELINIKDEGHSIFITTHVMDEAELTSKVALLLRGNIIAFDTPLHLKKQFNVSTIEEVFLKAEGE

SEQ ID NO: 685 - DNA, 921 bp, Streptococcus pyogenes
atgagttttgtacaattaacaaatgttgtcaagtcctacaaaaacggcaagaaagctgtcaatgatgtttccttgtctattgaagcaggtaatatttatggtttgttaggaccaaatggtgctggtaagtctaccttgattaatcttatcttaggcttgatccctttgagttccggtaaaattactgttttagggcaatcccaaaagactattcgaaaaataagttcgcagataggttatgttcctcaagacattgctgtttatccagacctaactgcttatgaaaatgtagaactatttgggtcactttatggcttaaagggagctcagcttaaaaaacaagttctaaaaagtttagaatttgtggggctacactcccaagctaagcagtttccaagtcaattctcaggaggaatgaagagacggttaaatatcgcttgtgcgctagttcattcacctaaattaatcatttttgacgaaccgactgtagggattgatcctcaatcacgtaatcatattttagagtcgattcgtttgctaaacaaagaaggtgctacagttatttatacgacccattatatggaagaagtagaggctctttgtgattatatttttattatggatcatggtcaagttattgaagaaggacctaaatttgaactggaaaaacgttacgttgcaaatctagcaaaccagattattgtaactctaacagattcacgtcatttggaactggcagataagcctgattggtctttgatagaagatggagaaaaactcatgttgaagattgataatagtgatatgacatcagttgttcatcagctcacacaggccaatattacttttagcgagattagacataaccatttgaatttagaagaaattttcttacacttaacaggtaagaagttacgagat

SEQ ID NO: 686 - protein, 307 aa, Streptococcus pyogenes
MSFVQLTNVVKSYKNGKKAVNDVSLSIEAGNIYGLLGPNGAGKSTLINLILGLIPLSSGKITVLGQSQKTIRKISSQIGYVPQDIAVYPDLTAYENVELFGSLYGLKGAQLKKQVLKSLEFVGLHSQAKQFPSQFSGGMKRRLNIACALVHSPKLIIFDEPTVGIDPQSRNHILESIRLLNKEGATVIYTTHYMEEVEALCDYIFIMDHGQVIEEGPKFELEKRYVANLANQIIVTLTDSRHLELADKPDWSLIEDGEKLMLKIDNSDMTSVVHQLTQANITFSEIRHNHLNLEEIFLHLTGKKLRD

SEQ ID NO: 687 - DNA, 105 bp, Streptococcus agalactiae
gtgagtaaacactcactcactgagagaggagcaaaaagttatcatgaaaaaagtcatcgatttaaaaaaactacaaaaagcatatgcctcagaaaccgttttaaa

SEQ ID NO: 688 - protein, 35 aa, Streptococcus agalactiae
MSKHSLTERGAKSYHEKSHRFKKTTKSICLRNRFK

SEQ ID NO: 689 - DNA, 387 bp, Streptococcus agalactiae
atgaaggctcaggcgattgtcacaagccaagggagaattgtttctttggatattgcagtgaactattgccacgatatgaagttgttcaaaatgagtcgcagaaacatcggacaagctgctaaaatcttggcagacagtggttatcaagggatcatgaagatgtattcacaagcgcaaactccgaggaaatcaagcaaacttaagccactaactcttgaagataaaacctataaccatacgctatccaaagagagaatcaaggttgagaatatttttgccaaagtaaaaacgtttaaaatattttcaacaacctatcgaaatcgacgcaaacggtttggattacgaatgaatttgattgctggaatgatcaaccgtgaactaggattt

SEQ ID NO: 690 - protein, 129 aa, Streptococcus agalactiae
MKAQAIVTSQGRIVSLDIAVNYCHDMKLFKMSRRNIGQAAKILADSGYQGIMKMYSQAQTPRKSSKLKPLTLEDKTYNHTLSKERIKVENIFAKVKTFKIFSTTYRNRRKRFGLRMNLIAGMINRELGF

SEQ ID NO: 691 - DNA, 381 bp, Streptococcus agalactiae
atgaattatgaagcaagcaaacaattaactgatgtacgatttaagcgccttgttggtgttcagcgcactacttttgaagagatgttagctgtgttaaaaacagcttatcaacgtaaacacgcaaaaggtggccgaacccctaagttaagcttagaagatctcctcatggctactcttcaatacatgcgagaataccgcacttatgaacaaattgcggctgattttggcattcacgaaagcaacttaatccgtcgaagtcaatgggttgaatcaactcttattcaaagtggttttacgatttcaaaaactcatcttagtgctgaggatacggtgattgtggatgcaacagaggtaaaaatcaatcgtcctaaaaaaatcaac

SEQ ID NO: 692 - protein, 127 aa, Streptococcus agalactiae
MNYEASKQLTDVRFKRLVGVQRTTFEEMLAVLKTAYQRKHAKGGRTPKLSLEDLLMATLQYMREYRTYEQIAADFGIHESNLIRRSQWVESTLIQSGFTISKTHLSAEDTVIVDATEVKINRPKKIN

SEQ ID NO: 693 - DNA, 669 bp, Streptococcus agalactiae
atggataaactgaaaaaattacaaaaagaaaatacgctattagaaggaagaattgataactctaataaccaaacctatacagatatgattgtctatttgcgaggtgctagcattagcccctaccatcaggagctcattcgaaatgatattgtcaatatgttattagaagcacaagagcgacaagcaagtttagttagtgtatttggagaagataggcatgactttataaaccaagttattaaatctacacctaaaatctctaagaaagaagaaacattacaacgttgggatttagccattttactactaactatccaaatgattatctttttaggaggatatctcattactgaagcacttcaacagtcagtaccagatctaatccctattactctattagatgttctttttgcaatctttatcagtattattgctgtcaagatagctgataccataatatatgctacatataacttcgataaatcgaaagaaaagaaatatttctttcgatatatatttctaattctttcgcttatcatagcttatatccttataggaaaatattatcatcttcctttcattaatatccccctttggatttatttaattatactgggacttagcttctctcttcatatcattgttaaaaaatacctgaataaacattat

SEQ ID NO: 694 - protein, 223 aa, Streptococcus agalactiae
MDKLKKLQKENTLLEGRIDNSNNQTYTDMIVYLRGASISPYHQELIRNDIVNMLLEAQERQASLVSVFGEDRHDFINQVIKSTPKISKKEETLQRWDLAILLLTIQMIIFLGGYLITEALQQSVPDLIPITLLDVLFAIFISIIAVKIADTIIYATYNFDKSKEKKYFFRYIFLILSLIIAYILIGKYYHLPFINIPLWIYLIILGLSFSLHIIVKKYLNKHY

SEQ ID NO: 695 - DNA, 711 bp, Streptococcus agalactiae
gtgagtatgaaaatagataaaaaagaacttttagcacttattgctagtattattttattaatttttgcttctgttacgtttttcttatttaaagatcatggcactactcaaatggatactgtagaaagcagtgttaaccatgtcagtgattctcaattaactgaggcacaagatatgttagataaatttgagaagaaaccttcagaaaaattattgaaggatgtcgaacttgctttaaataaattgtccaattcttctaaaaaagaagctttgcaaaaacgttttaagaaagcaaaagataagtatcttaaagacgaagcagataagaaagctaccaaagatgctacagatttagtagaaattctagaacaagccccttcagaagaaaatgtgttaaaagctgaagcagcagtcaataagttaactgtcaaagaatctaaagaagctttacaaaaacgtattgatactgttaagacacaatatggtttgattgggaatcaaactccctctagttcagtagctgaaactacagaacaagggacagctaatcctgctagtcaggatacttctagttacgttaatcagaatgtagcaccaacttatgagcaaccgcaagcgaataatacaccagttactccaggggttaacaatactgttccgactccaggaactggtactgtacctgctactaatgggacaggtgttgctcag

SEQ ID NO: 696 - protein, 237 aa, Streptococcus agalactiae
MSMKIDKKELLALIASIILLIFASVTFFLFKDHGTTQMDTVESSVNHVSDSQLTEAQDMLDKFEKKPSEKLLKDVELALNKLSNSSKKEALQKRFKKAKDKYLKDEADKKATKDATDLVEILEQAPSEENVLKAEAAVNKLTVKESKEALQKRIDTVKTQYGLIGNQTPSSSVAETTEQGTANPASQDTSSYVNQNVAPTYEQPQANNTPVTPGVNNTVPTPGTGTVPATNGTGVAQ

SEQ ID NO: 697 - DNA, 720 bp, Streptococcus pyogenes
atggctacgatgaaacaatatcataaaggagattccatgactaaatcacaaaaagaggcgctttattggatgttgagtgttctaactatcactctaataggtggctcctgccttatttttggatcccaccctcaaacgcaagataaggtagctaaacattctaaaagtgctgctagtttactaaaaaaagcagttaaagcagttaatgacgctgatcgtttagccactgcagctgctatccaagaagcccagaaagctgttgataaattagcagaatcttctaagaaaaaaacgctacaagaacagctaaacgttgccaaagcaaagcaagagcaagaagatgcagctactcaagcagttaaagctgctgaggagactctcaatcaaaatcttaaagatatcgcccaaaaagcagttaacgacttaagtaacaaaggtaaaaaagccgctttacaatctcggttagacgctattttaccagcgaaacccattattgatgaatttccaagacaaagtggagaaataacagataactcttactggacacctttcccaggagacgtctcagatacttatgataattcccagtcacctactttagacccaagctcagaatcttcagcttcagatgttacaccacaacctagtcatcctgatccaattccacctcagacctcttcagaaccttccgactcaggagacaagcaatcatcaaaagag

SEQ ID NO: 698 - protein, 240 aa, Streptococcus pyogenes
MATMKQYHKGDSMTKSQKEALYWMLSVLTITLIGGSCLIFGSHPQTQDKVAKHSKSAASLLKKAVKAVNDADRLATAAAIQEAQKAVDKLAESSKKKTLQEQLNVAKAKQEQEDAATQAVKAAEETLNQNLKDIAQKAVNDLSNKGKKAALQSRLDAILPAKPIIDEFPRQSGEITDNSYWTPFPGDVSDTYDNSQSPTLDPSSESSASDVTPQPSHPDPIPPQTSSEPSDSGDKQSSKE

SEQ ID NO: 699 - DNA, 165 bp, Streptococcus agalactiae
ttgcccgctactgccgcaactgatttagacgcctcttctagtcgctttgtatctgaagttagggttgtcggcaagaaagatgtgactccagtagatagtaagccagcactcattcgcaaaattccttctgaatcacaatccataacatcagcgccagcaaaacca

SEQ ID NO: 700 - protein, 55 aa, Streptococcus agalactiae
MPATAATDLDASSSRFVSEVRVVGKKDVTPVDSKPALIRKIPSESQSITSAPAKP

SEQ ID NO: 701 - DNA, 939 bp, Streptococcus agalactiae
  misc_feature (1)..(939): n = a, c, g, or t
atgagagtgaatggggggaagaagatgacgaagtacatcaaggctgaccgattcttttatgctgatcatgtaaaggaaaacggttatttagaaataaaagataatcactttggtaaatggatagaaaatatttctggacaagaggagattttagattattcaggttatcaaatagcacctggtttagttgatacacatattcatggttttgctggcgctgatgttatggattgtgattcagaaggaattttgcgaatgagtgctggcttactatctactggagtcacatctttcttgccgacaaccctaacttcagatacaaagcgactagaagaggcgtctaaatcagttgcggcagtagcgggcaaagaacaaggagcaaaaattcaaggcatctattttgagggaccatattttactgaggaatataaaggagctcaaaatccgatttatatgagaaatccaaacttggaagagtttgctcaatggcagaaggctgcaaaaggcttgattacaaaaattgctttggcaccagaacgtgagggagttgaggaatttgtctcagcaatcacaaagcaaggtgttacggtagctttaggtcattctaatgggacatataaagaagctaaaaaggcagtgaaggcgggtgcctcagtttgggtacatgcgtataatggtatgcgtggtttgacacaccgagaaccaggtatggttggtgcggtttataatttacctaatacctatgccgaactcatttgcgatggtcatcacgttgatcctgttgcttgtgacattttaatgacacaaaaaggccataatcatgtggcattaataacagattgtatggcagctggaggtgcccctgatggagattatatgttaggggaattgcccgtggttgtgtctaatggaactgcgcgtttgannnnnttaattaat

SEQ ID NO: 702 - protein, 313 aa, Streptococcus agalactiae
  MISC_FEATURE (1)..(313): Xaa = Any Amino Acid
MRVNGGKKMTKYIKADRFFYADHVKENGYLEIKDNHFGKWIENISGQEEILDYSGYQIAPGLVDTHIHGFAGADVMDCDSEGILRMSAGLLSTGVTSFLPTTLTSDTKRLEEASKSVAAVAGKEQGAKIQGIYFEGPYFTEEYKGAQNPIYMRNPNLEEFAQWQKAAKGLITKIALAPEREGVEEFVSAITKQGVTVALGHSNGTYKEAKKAVKAGASVWVHAYNGMRGLTHREPGMVGAVYNLPNTYAELICDGHHVDPVACDILMTQKGHNHVALITDCMAAGGAPDGDYMLGELPVVVSNGTARLXXLIN

SEQ ID NO: 703 - DNA, 1146 bp, Streptococcus pyogenes
atgacatgctatcttaaagcagattgtttttattacccaacagaggtgagaccggctggctacctaagtcttcatgatggtgtttttggggagtggacagaaattgttccggcagatgcgcaaatcattgactacaccggttatcaaattgcaccaggtcttgtggatacgcatatccatggctatgcgggagctgatgtcatggataattctgcccaagggattcatcaaatgagtgaaggactattagcaacaggagtaacgtcttttttaccgacgaccttaacttctacctttgagcagttagaaaaagtatcagggactattgcttcagttgctgatcaggtaaaaggtgctaaaatacaaggtatctactttgaaggtccttattttaccgaagaatataagggtgctcaaaacccaagttatatgaaaaccccacgcttggaggaatttgatgcttggcaaaaagctgctaaagggctcatcaaaaaaattgcccttgctcctgaacgtgatggtgtcaaagaatttgtgtctgcagtgacaaaacaaggcgtaacagtggccttagggcattcaaacggtacttatcaagaggctaaagaagctgttcaagctggtgctagtgtttgggttcatgcttataatggcatgcgaggattgacccaccgtgaaccaggaatggtgggagcggtttataatcttccaaatacttacgcagagttgatttgtgatggccaccatgtctcaccaattgcttgtgatattttgatgcagcaaaaagggcatgatcatgtagccatgattacggactgtatgcgagcaggtggttcaccagatggtgattacctcttgggggaattctctgtggttgtggcaaatggcactgctcgtcttaaagagagtggaaacttggcaggatctattttgaaattaaaagatggccttagaaatgtagtggcctggggaatcgcaactccggcagaagccattcatatggcaacttatgtgccagctgtttctgtcggtattgacgacgtatgtggtcaaatcaaagctgggcatgcggctgactttattgttcttgataaggatttaacacttgttgcaacctatttaaatgggcaaaaagcttttgatgcc

SEQ ID NO: 704 - protein, 382 aa, Streptococcus pyogenes
MTCYLKADCFYYPTEVRPAGYLSLHDGVFGEWTEIVPADAQIIDYTGYQIAPGLVDTHIHGYAGADVMDNSAQGIHQMSEGLLATGVTSFLPTTLTSTFEQLEKVSGTIASVADQVKGAKIQGIYFEGPYFTEEYKGAQNPSYMKTPRLEEFDAWQKAAKGLIKKIALAPERDGVKEFVSAVTKQGVTVALGHSNGTYQEAKEAVQAGASVWVHAYNGMRGLTHREPGMVGAVYNLPNTYAELICDGHHVSPIACDILMQQKGHDHVAMITDCMRAGGSPDGDYLLGEFSVVVANGTARLKESGNLAGSILKLKDGLRNVVAWGIATPAEAIHMATYVPAVSVGIDDVCGQIKAGHAADFIVLDKDLTLVATYLNGQKAFDA

SEQ ID NO: 705 - DNA, 771 bp, Streptococcus agalactiae
  misc_feature (1)..(771): n = a, c, g, or t
gtgaatagagaggttactatgtcaatagaatcagattttttccggaaaaaacgttttattttttcatcgcttgaggagtttggatttatcaaatctgaccaagagtatatctattgtcaaacatttatggataatgactttaaagctattatcacgatttcattggatggaaagatagctggtaaggttattgattcggcacttgaagaagaatatttaccgcttcgagcagcaaattataatggttcgtttgttggcgaagtacgatcggcttatatggctatattaggtgatatttcagattcttgttgtaaggacttattatttaccaaagatcaaagtaatcgtttagcggagaagatagctaaaacttttgaagattcagttgattatccatttgcgaagcacccacaatatgcttcctatcgtgtgtcaggtaaatggtatgctctgctttttccattgaagatggggaaactagaaaatgttccagctcaactgtcagaagatgaggttgaagttttgaatattaaagtcaatcctcaagatatggaaatacttttacaaaaagaaggtatttatccttcttatcatatgtctaaaaagacttgggtatctatcgttttagacaatactttgtctgatatagaaatttttaaattggtatcagatagtcgtaagcttgtttctcacaataaaaaatcaaattctgagccagagttttggattattcctgctaatcctaaattttacgatcnnnnnttaattaat

SEQ ID NO: 706 - protein, 257 aa, Streptococcus agalactiae
  MISC_FEATURE (1)..(257): Xaa = Any Amino Acid
MNREVTMSIESDFFRKKRFIFSSLEEFGFIKSDQEYIYCQTFMDNDFKAIITISLDGKIAGKVIDSALEEEYLPLRAANYNGSFVGEVRSAYMAILGDISDSCCKDLLFTKDQSNRLAEKIAKTFEDSVDYPFAKHPQYASYRVSGKWYALLFPLKMGKLENVPAQLSEDEVEVLNIKVNPQDMEILLQKEGIYPSYHMSKKTWVSIVLDNTLSDIEIFKLVSDSRKLVSHNKKSNSEPEFWIIPANPKFYDXXLIN

SEQ ID NO: 707 - DNA, 1077 bp, Streptococcus pyogenes
atgagtttagcaactgactattttagccgacagacccccatagttgaaaagctaatggcttacggttttgagaagcgagacaacggttatttctataacgaacggtttatggaaggggaatttgaggcgcagcttaggattgatgaggctggcaatatctgggatcgggttattgattgtgacttggaggaggattatttgcctttacaacaagcagcctggcaaggaacctatactgggcaggttagagcggcctatttggaacttttggagcgcttatcagtagcctgttttgaagccactccttttcagtcaatgcaagctaatagacttgctaagcatatcaccaaagaatggtctgacccaatggactatccttttgaaaagcacccagaccttgcaacctatcgggtagggggcaaatggtatgctatgattttttctctcttggctgataaattagaccagataccagagagattagtaggacagacatgtgaagtgatgactgtcaaagttaatcccaaggctttccctcagttactgcagcaagaaggcatttacccagcgtatcacatgtcaaagaaaaactggattagtattattttggatgataaggtaacagatgataagctttggacgttagtgactcaaagtcgtcaactagtcaacccaaacggtctttctaatcctaatggtcctgattattgggttattccagctaatttgaaatactatgacattgatgcagaatttgcagccaatgatgtgattttatggacccaaaaagctggtattgccgtgggagactacgtgctgatttatataacagccccagtcaaatccattcgctatgtctgccaagttctagaaactgatatacctaacgagggttatcgtaaaaatcctaacattgacaaactcatgcgtctccgaaaatgccaacagtacaaggatggtctcttgtcttttgaccttatgaaaaaacatggcgtagctgcagtgagagggccaagacgattaagccctcaattaattgcatttttaaaggaaaaagagtattttaaagagaacaac

SEQ ID NO: 708 - protein, 359 aa, Streptococcus pyogenes
MSLATDYFSRQTPIVEKLMAYGFEKRDNGYFYNERFMEGEFEAQLRIDEAGNIWDRVIDCDLEEDYLPLQQAAWQGTYTGQVRAAYLELLERLSVACFEATPFQSMQANRLAKHITKEWSDPMDYPFEKHPDLATYRVGGKWYAMIFSLLADKLDQIPERLVGQTCEVMTVKVNPKAFPQLLQQEGIYPAYHMSKKNWISIILDDKVTDDKLWTLVTQSRQLVNPNGLSNPNGPDYWVIPANLKYYDIDAEFAANDVILWTQKAGIAVGDYVLIYITAPVKSIRYVCQVLETDIPNEGYRKNPNIDKLMRLRKCQQYKDGLLSFDLMKKHGVAAVRGPRRLSPQLIAFLKEKEYFKENN

SEQ ID NO: 709 - DNA, 1206 bp, Streptococcus agalactiae
ttgcgagacttcactagaaagagatttattcccatgacccagtttaccacagaattacttaacttcctagctcaaaaacaagatattgatgaatttttccgttcgtctcttgaaactgccatgaatgaccttctccaagtggagctatccgccttccttggctatgaaccatacgataaggcaggttacaacaccggtaatagtcgtaatggtgcttatacacgtcgatttgagaccaagtatggtgttgttaatttgttgatccctagagatcgaaacggggagttcagtccagccttaatcccaagttacggtcgtcgagacaatcatttagaagaaatggttatcaagctttatcgaactggagtcacaacacgtgaaatcagcgacatcattgagcgtatgtatggtcatcattacagtccagcaacagtatctaatatctcgaaagcgacacaggaaaacgtggctagctttcatgaacgttccttagaagctaactataccgtattatatcttgatgggacttaccttcctctgagacgtggtacagttagtaaggaatgcatccacattgcactaggcgtcacatcatatgggcataaggctatccttggatatgacatcgcacccaatgaaaacaatgcttcgtggtcagaccttctagaaagatttaagggtcaaggtgtacaacaagtctctcttgttgtgagtgatggttttaatggacttgatcagcttatccagcaagccttcccaatggccaaacaacagcgttgccttgtccatattggccgaaatattgcaagtaaggtgaaacgagcagatcgtgctctaattttggagcagtttaaaacaatttatcgcgcgatcaatgtagaggaagcaaagcaagccttagatagctttatcaatgagtggaaaccacactacaagaaggtaatagagaccttagaatcaatcgaaaatctattgatcttttatgaatttcctcatcagatctggggaagtatctactcgaccaaccttattgaatcacttaacaaagaaatcaaacgtcaaaccaaaaagaaagtcgtctttcccaatgaagaatccctagaacgctatctcgtcacactatttagtgattacaacttcaagcaaggacaacgaatccacaaaggttttggccaatgtacggacacacttgaaagcctatttgat

SEQ ID NO: 710 - protein, 402 aa, Streptococcus agalactiae
MRDFTRKRFIPMTQFTTELLNFLAQKQDIDEFFRSSLETAMNDLLQVELSAFLGYEPYDKAGYNTGNSRNGAYTRRFETKYGVVNLLIPRDRNGEFSPALIPSYGRRDNHLEEMVIKLYRTGVTTREISDIIERMYGHHYSPATVSNISKATQENVASFHERSLEANYTVLYLDGTYLPLRRGTVSKECIHIALGVTSYGHKAILGYDIAPNENNASWSDLLERFKGQGVQQVSLVVSDGFNGLDQLIQQAFPMAKQQRCLVHIGRNIASKVKRADRALILEQFKTIYRAINVEEAKQALDSFINEWKPHYKKVIETLESIENLLIFYEFPHQIWGSIYSTNLIESLNKEIKRQTKKKVVFPNEESLERYLVTLFSDYNFKQGQRIHKGFGQCTDTLESLFD

SEQ ID NO: 711 - DNA, 420 bp, Streptococcus pyogenes
atgactcagtttaccacagaattacttaacttcctagcacaaaaacaagatattgatgaattctttcgctcctctttagaaatagctatgaatgacctcttgcaagttgaactatcagcttttcttggttatgaaccttatgaaaaagaaggttacaacacaggtaatagccgtaatgggacttattctcgtcagtttgaaacaaagtatggcttagtcaatttaatcatcccaagagatcgaaacggcgagttttcaccagttttattaccatcttatgctagacgagaggaccacttggaagagatagtgatcaaactctatcagactggcgttacgacacgcgaaatcagtgacattattaagcgcatgtatggtgaccacttgtttctgagtggaagcctcgttacaaaaaggtta

SEQ ID NO: 712 - protein, 140 aa, Streptococcus pyogenes
MTQFTTELLNFLAQKQDIDEFFRSSLEIAMNDLLQVELSAFLGYEPYEKEGYNTGNSRNGTYSRQFETKYGLVNLIIPRDRNGEFSPVLLPSYARREDHLEEIVIKLYQTGVTTREISDIIKRMYGDHLFLSGSLVTKRL

SEQ ID NO: 713 - DNA, 861 bp, Streptococcus agalactiae
atgttttcgagcgattttggatttgagataattaatgttgacgacctatccttgcaagaggagagatttttaccttcagaattgctggcttatgcacgtgatgaaaatgagtcttctttcgtacgtgatattgaggggcatttggcacttgtttaccagcttttggatacgcaaggtcacgttgatgatgttcgtcatgtgccgagagtgataccagtgactctatttttgaaagaagatggcttgtttgtattagctaatcataaaaatattaaccttgtaaaaaaagcacttaatcgtgttgaaaaggtagattctccgaaacacctcttattatcattagtgactgctttctcaaagcaatattttgatgttttagatactatttctgaagaaagagataaactaatcaatgatttgcgtaaaagaccaaacaaatcgaacttggcaaggctggcaaatttacaaagtggaacagtacacttaatgatgggaactaagcaaaattttgaaatgctgaccgatttacaaaacattgagcaagataaagagaacactagaaatgaaaagatgcaacttcaagatgctattattgaagcaagacaattatctaacatgtgttccttaaattcacaggttttccaagaactttcttcttataataatgtcctcagcaataaccttaacgacaatgtaactactttaacaattatttccattggtatttccattattgctatggttaccagtttttatggaatgaatgttaagttgccttttgatagtgtggatgctgtctgggtattgattattttaattacgactatcattactattatgctctctattgttatgtacatt

SEQ ID NO: 714 - protein, 287 aa, Streptococcus agalactiae
MFSSDFGFEIINVDDLSLQEERFLPSELLAYARDENESSFVRDIEGHLALVYQLLDTQGHVDDVRHVPRVIPVTLFLKEDGLFVLANHKNINLVKKALNRVEKVDSPKHLLLSLVTAFSKQYFDVLDTISEERDKLINDLRKRPNKSNLARLANLQSGTVHLMMGTKQNFEMLTDLQNIEQDKENTRNEKMQLQDAIIEARQLSNMCSLNSQVFQELSSYNNVLSNNLNDNVTTLTIISIGISIIAMVTSFYGMNVKLPFDSVDAVWVLIILITTIITIMLSIVMYI

SEQ ID NO: 715 - DNA, 942 bp, Streptococcus pyogenes
atgaaacaaatgtttctttcatcggcaattgaattcaaagaaatagaaacattcgagccaggagcttggattaaactggttaacccttcccaagaagagtctatgaagatcgccgatcaatttaacattgatatttctgacttgcgcgcccctttggacgtggaagaaacctcacgtattgccgtagaagatgattataccctaattatcgtagacgtcccgatatacgaagaacgtaacaataaaagttactatattactatgcctttaggcattattgtaacggaaaatgctgttatcacaacttgtctgcatgacatgacccttttcgatcattttcacaaccgccgggtcaaaaatttctataccttcatgaagacacgttttgtttttcagattctatatcgcaacgccgagctctttctgactgccttgaggaccattgatcgccaaagcgaacgtttggaagctcagcttgaagcagctactcgaaatgaagaacttatcgacatgatggaacttgaaaaatccattgtctacttaaaggcttccttgaaattcaacgaacgcatcgtcaagaaattatccagctcaacaagctctctcaagaaatacattgaggacgaggatttgctagaagataccttgattgaaacccaacaggcgattgagatggctggcatttatgaaaatgtcttgaatgccatgaccgaaaccactgcttctattatcaacaataaccagaacaccattatgaaaacactggccttgatgaccatggctttagatataccaactgtgattttctccgcctatggtatgaatttccaaaacaactggttaccactaaatggcctagaacatgctttttggtatatcaccttgattgctatgctccttagttcctttgttgtgatttactttattagaaaaaaatggttc

SEQ ID NO: 716 - protein, 314 aa, Streptococcus pyogenes
MKQMFLSSAIEFKEIETFEPGAWIKLVNPSQEESMKIADQFNIDISDLRAPLDVEETSRIAVEDDYTLIIVDVPIYEERNNKSYYITMPLGIIVTENAVITTCLHDMTLFDHFHNRRVKNFYTFMKTRFVFQILYRNAELFLTALRTIDRQSERLEAQLEAATRNEELIDMMELEKSIVYLKASLKFNERIVKKLSSSTSSLKKYIEDEDLLEDTLIETQQAIEMAGIYENVLNAMTETTASIINNNQNTIMKTLALMTMALDIPTVIFSAYGMNFQNNWLPLNGLEHAFWYITLIAMLLSSFVVIYFIRKKWF

SEQ ID NO: 717 - DNA, 957 bp, Streptococcus agalactiae
atgtcaaaggtaaggtatggtgttgtgtcaacggcaaaggtggcgcctcgttttattgaaggagtccgcttagcaggaaatggtgaagttgtggctgtatcgagtcgaactcttgagtctgcgcaagcttttgccaacaaatatcatctcccaaaggcttacgataagttagaggatatgttagcagatgagtcaattgatgtgatttatgtggcaacaattaatcaagaccattataaagttgctaaagcagctctgttagcgggaaaacatgtgttggtagaaaagcctttcacattgacttacgaccaagcgaatgaattattcgctttggcagaaagttgtaatctgtttttgatggaggcacaaaaatcggtatttattccgatgacacaagtgattaaaaaattacttgcctctggtgaaataggagaagtgatctccatctcatctacaacagcctacccaaacattgaccatgtaacatggtttagagaacttgagttaggtggaggaacagtgcattttatggcgccctacgccctgtcttatttacaatatctatttgatgcgactataactcatgctagtgggactgcgacttttccaaaaggtcaaagcgatagtcaatccaaactactcttgcaattatcaaatggggtcctcgtagatatcttcttgacaacacgtctaaatttaccgcatgaaatgattatttatggaactgaaggtcgtctaatcattccacatttttggaaaaccactcatgcaaaattggtgagaaatgatactagtgcgcgaacgattcaagttgacatggttagtgattttgagaaagaagcttatcatgttagtcaaatgattttagaagggcaaagggtaagtcatatcatgacgcctcagttgacgctgtcaggtgttaagattatagaagacttataccgttcatgggggaaa

SEQ ID NO: 718 - protein, 319 aa, Streptococcus agalactiae
MSKVRYGVVSTAKVAPRFIEGVRLAGNGEVVAVSSRTLESAQAFANKYHLPKAYDKLEDMLADESIDVIYVATINQDHYKVAKAALLAGKHVLVEKPFTLTYDQANELFALAESCNLFLMEAQKSVFIPMTQVIKKLLASGEIGEVISISSTTAYPNIDHVTWFRELELGGGTVHFMAPYALSYLQYLFDATITHASGTATFPKGQSDSQSKLLLQLSNGVLVDIFLTTRLNLPHEMIIYGTEGRLIIPHFWKTTHAKLVRNDTSARTIQVDMVSDFEKEAYHVSQMILEGQRVSHIMTPQLTLSGVKIIEDLYRSWGK

SEQ ID NO: 719 - DNA, 957 bp, Streptococcus pyogenes
atgaaattagcggttttggggacaggtatgattgttaaggaagttttgcctgtcttgcagaaaattgatggtattgatttagttgctatcttatcaacagttagaagtttaacgacagctaaagacctcgctaaggcacatcacatgcctctagctacgagtaaatatgaggctatcttaggcaatgaggagattgacacggtttatattggactgccgaatcacctgcattttgcctatgctaaggaggcccttctagctggcaaacatgtcatttgtgaaaagccctttaccatgacagcaggagaattagatgaactggtggtaatcgctagaaaacgaaaactcattttgttagaagcgattacgaatcagtacctgagtaacatgacctttatcaaagagcatcttgaccaacttggcgatatcaaaattgtagaatgcaattattcacaatattcttcacgctacgatgccttcaaacgaggtgatatcgcgccagcttttaatcctaaaatgggtggtggagctttacgtgatttaaacatctacaacattcattttgtggtagggttatttggtcgccctaaaacggttcaatatttagccaatgtcgaaaaaggcattgacacctcaggcatgcttgtcatggactatgagcagtttaaagtggtgtgtatcggggccaaagactgcactgcagaaatcaaatcaaccatccaaggtaacaaagggtcactggcagtgcttggagcaacaaataccctccctcaggttcagttaagtctacacggtcacgaaccacaagtgattaaccacaacaagcatgaccaccggatgtatgaagagtttgtcgcttttagggacatgattgaccaaagagactttgagaaagtgaatcaggctttggaacatagccgagctgtcatggctgtgttggagcgcgctgttcattcg

SEQ ID NO: 720 - protein, 319 aa, Streptococcus pyogenes
MKLAVLGTGMIVKEVLPVLQKIDGIDLVAILSTVRSLTTAKDLAKAHHMPLATSKYEAILGNEEIDTVYIGLPNHLHFAYAKEALLAGKHVICEKPFTMTAGELDELVVIARKRKLILLEAITNQYLSNMTFIKEHLDQLGDIKIVECNYSQYSSRYDAFKRGDIAPAFNPKMGGGALRDLNIYNIHFVVGLFGRPKTVQYLANVEKGIDTSGMLVMDYEQFKVVCIGAKDCTAEIKSTIQGNKGSLAVLGATNTLPQVQLSLHGHEPQVINHNKHDHRMYEEFVAFRDMIDQRDFEKVNQALEHSRAVMAVLERAVHS

SEQ ID NO: 721 - DNA, 2649 bp, Streptococcus agalactiae
atgtcaaaagaactatcaccaaaatacaatcctgccgaggttgaggaaggccgttatcaaacttggcttgaccaagatgttttcaagccatcaggggatactgaggctaagccttattctatcgtaattccaccaccaaacgttacgggtaaattgcacttgggtcacgcttgggatacaactctacaagatatcattattcgtcaaaagcgtatgcagggctttgatacactctggcttccaggtatggaccacgctggtatagccactcaagctaaggttgaggagcgccttcgtgagcaaggcatttcacgttatgatcttggtcgtgaaaaattcctagataaagtttgggaatggaaagacgagtatgcagcaactattaaatctcagtggggaaaaatgggtctttcggttgattatagccgtgagcgttttacccttgatgagggactttcaaaagcggtaagaaaagtctttgttgatttgtacaataaaggttggatctatcgtggggagttcatcattaactgggatccagcagctcgcacagccctttcagatattgaagttattcacaaggatgttgagggtgctttctatcatatgaattatatgctggaagatggctcacgcgccctagaagtagcaacaactcgtcctgagactatgtttggagatgtggctgtagcggtaaatccagaagatgcacgttacaaggatttgattggtcaaaatgttatccttcctatcatcaataaacctattccaatcgtcgctgatgaacacgctgatccagaatttggaacaggtgtggttaagattacgccggctcacgaccctaatgactttgctgtaggtcaacgccacaacttaccacaagttaacgttatgaacgatgatggtactatgaatgaacttgcggatgaatttaatggtatggatcgtttcgaagctcgtaaggcagtagtcgctaaattagaatcgttaggaaacttagtaaaaattaaaaaaacgactcattctgttggtcattcagaacgaacaggcgttgtggttgaaccacgtttatctactcaatggttcgtcaagatggatcaattggctaagaatgccattgccaaccaagatacagaagacaaggtagagttttatccaccacgatttaacgatacttttatgagctggatggaaaatgtccatgactgggttatctctcgtcaattatggtggggacaccaaattcctgcatggtacaacgtcaatggtgagatgtatgttggagaagatgccccagagggtgacggatggacacaggatgaagacgttctagacacatggtttagttctgctttatggccgttttcaacaatgggatggccagacaccgaagcagctgacttcaaacgctacttcccaacgtcaaccttggtaactggatacgatatcatcttcttctgggtatcgcgcatgattttccaatcccttgaatttacaggacgccaaccattctcaaatgttcttattcatggactcatccgtgatgaagaaggacgtaaaatgtctaaatcactcggcaacgggattgatccgatggatgtcattgagaaatatggtgcggatgcccttcgttggttcctctcaaatggttcagcccctggtcaagatgtgcgtttttcatacgaaaaaatggatgcttcgtggaatttcattaataagatttggaacatttcacgctatatccttatgaataacgaaggtttaacgttggatcaagccagagaaaatgtggaaaaagttgttaatagtcaagttggaaatgtaacagaccgttggattctccacaatttaaatgagactgtgggtaaagttactgaaaactttgacaagtttgaatttggtgttgctggtcacatcctttacaactttatctgggaagaatttgctaattggtacgttgagttaacaaaagaggttctttatagtgacaatgaagacgagaaagtcatcactcgctctgttcttctttataccttagatcaaatcttgcgtcttcttcatccaatcatgccatttgtgacagaagaaatttttggacaatatgcagaaggatcaattgtccttgcaagttatccacaagttaacgcgacatttgaaaatcaaacagctcacaaaggcgttgaaagcttgaaagatttgattcgttcagtgcgaaatagcagagcagaggtcaatgttgctccatctaaaccaatcactatcttggttaagacaagtgacagcgaactcgaaagcttcttcaaagacaatagcaactacatcaaacgcttcacaaacccagagacgcttgaaatcagctcagcaattgccacaccagaacttgccatgtcatcagtcatcacaggtgcagaaattttcctcccacttgctgacctccttaacgttgaagaagagttggcacgacttgaaaaagaacttgctaaatggcaaaaagaactagatatggttggcaaaaaactcagcaacgagcgctttgtagctaacgctaaaccagaagtcgtccaaaaagaaaaagataaacagaccgactaccaaactaaatacgacgcaaccatagcacgtattgaagaaatgaagaagttggtgagg

SEQ ID NO: 722 - protein, 883 aa, Streptococcus agalactiae
MSKELSPKYNPAEVEEGRYQTWLDQDVFKPSGDTEAKPYSIVIPPPNVTGKLHLGHAWDTTLQDIIIRQKRMQGFDTLWLPGMDHAGIATQAKVEERLREQGISRYDLGREKFLDKVWEWKDEYAATIKSQWGKMGLSVDYSRERFTLDEGLSKAVRKVFVDLYNKGWIYRGEFIINWDPAARTALSDIEVIHKDVEGAFYHMNYMLEDGSRALEVATTRPETMFGDVAVAVNPEDARYKDLIGQNVILPIINKPIPIVADEHADPEFGTGVVKITPAHDPNDFAVGQRHNLPQVNVMNDDGTMNELADEFNGMDRFEARKAVVAKLESLGNLVKIKKTTHSVGHSERTGVVVEPRLSTQWFVKMDQLAKNAIANQDTEDKVEFYPPRFNDTFMSWMENVHDWVISRQLWWGHQIPAWYNVNGEMYVGEDAPEGDGWTQDEDVLDTWFSSALWPFSTMGWPDTEAADFKRYFPTSTLVTGYDIIFFWVSRMIFQSLEFTGRQPFSNVLIHGLIRDEEGRKMSKSLGNGIDPMDVIEKYGADALRWFLSNGSAPGQDVRFSYEKMDASWNFINKIWNISRYILMNNEGLTLDQARENVEKVVNSQVGNVTDRWILHNLNETVGKVTENFDKFEFGVAGHILYNFIWEEFANWYVELTKEVLYSDNEDEKVITRSVLLYTLDQILRLLHPIMPFVTEEIFGQYAEGSIVLASYPQVNATFENQTAHKGVESLKDLIRSVRNSRAEVNVAPSKPITILVKTSDSELESFFKDNSNYIKRFTNPETLEISSAIATPELAMSSVITGAEIFLPLADLLNVEEELARLEKELAKWQKELDMVGKKLSNERFVANAKPEVVQKEKDKQTDYQTKYDATIARIEEMKKLVR

SEQ ID NO: 723 - DNA, 2646 bp, Streptococcus pyogenes
atgacagaactatcacctaaatacaatcctgccgaggttgaggcaggtcgctatcaaaaatggcttgatgcagatgttttcaagccatcaggagaccaaaaagcaaaaccgtattctatcgtgattccaccgccaaatgtgactggtaagttgcacttgggacatgcttgggacacaacacttcaagatattatcattcgtcaaaaacgcatgcagggctttgatacgctttggcttccagggatggaccatgcaggaattgcgacacaggctaaggtagaggagcgtctgcgcgagcaggggatttctcgttacgaccttggtcgtgacaaattcctagacaaggtctgggagtggaaagacgaatatgccactacgattaaagagcagtggggcaaaatggggctttctgtggactacagccgtgagcgcttcacccttgatgagggcttgtcaaaagcagttcgcaaggtttttgttgacctctacaaaaaaggctggatttaccgtggtgaattcatcatcaactgggatcctgctgccagaactgccctttctgacatcgaggttatccacaaggatgttgagggagctttctatcacatgaactatatgttggaagatggctcacgcgcccttcaagtggcaacaacgcgaccagaaaccatgtttggagacgttgccgttgccgtaaacccagaagatcctcgttacaaagatttgattggcaaaaatgttattttaccaatcgtgaataaattgattccaatcgtgggtgacgagcatgctgaccctgaatttgggactggagttgtgaaaatcacgcctgcccatgatcctaacgatttcgaggttggtcaacgccataatctaccacaagtgaatgtcatgaacgatgacggtaccatgaatgagttagctggcgactttgcaggcatggaccgttttgaagctcgtcaagctaccgttgctaaacttgaagaacttggcgccctagtaaacatcgaaaaacgtgttcactcagtaggtcactcagaacgttcaggtgcagtcgttgagcctcgtctatccactcaatggtttgtaaaaatggatgagcttgctaaacaagctatggacaaccaagaaacagatgaccgagtagatttctacccaccacgtttcaacgataccttcctccaatggatggaaaatgtccatgactgggtaatctctcgccaattatggtggggtcaccaaattcctgcttggtacaatgcagaaggtgagatttacgttggcgaagaagcaccagaaggtgatgactggactcaagatgaagatgttcttgacacttggttctcatctgctttatggccgttctcaactatggggtggcctgacacagatgtagaagatttcaaacgttatttcccaacctcaaccttagtaacaggttatgacatcattttcttctgggtgtcacgtatgattttccaatcgcttgaatttaccgggcgtcagccattccaaaatgtcctgattcacggtcttattcgtgacgaagaaggacgcaaaatgtctaaatcattggggaacgggattgatccgatggatgtcattgagaaatatggtgccgatagcttacgttggttcctctcaaacggctctgccccaggacaagacgtgcgtttctcatacgaaaaaatggacgcctcttggaatttcattaataaaatttggaatatttctcgctatatcctcatgaataatgaagggttgacattggaagatgctgaaagtaatgtggctaaggtagctgcctcagaagctggaaatgtgactgaccagtggattctccacaatctcaatgaaaccatcgctaaagtgacagaaaactttgacaagtttgagtttggtgtggcaggacacattctttacaactttatttgggaagaatttgccaactggtatgtggaattgaccaaggaagtgctgtatagcgacaacgaagctgaaaaagttatcacgcgctctgtccttctttatactttggacaagattttacgtctccttcacccaatcatgccatttgtaacagaagaaatttacgctcaatatgcccaaggttctattgtgacggtggactatcctgtggttcgcccagcttttgaaaatgaagctgcgcataaaggtgtggaaagtttgaaagacctgattcgtgcagttcgtaatgcgcgcgctgaagttaacgtggcaccatcaaaaccaatcaccattttggtgaagacagcagatagtgaattagaagactttttcaacagcaatatcaactacatcaaatgcttcactaaccctgaaaaattagaaatcagctcagccattgctgcgccagaactggctatgaccagcatcatcacaggtgctgaaatctacttgccactagcagatttgcttaacgtggaagaagaacttgctcgcctagataaagaactggctaaatggcaaaaagaactggacatggtcggcaaaaaactcggcaacgaacgctttgttgccaacgccaaaccagaagttgtccaaaaagaaaaagacaaacaagctgactaccaagctaagtacgacgcaacccaagaacggattgcagagatgaagaaaattaaatca

SEQ ID NO: 724 - protein, 882 aa, Streptococcus pyogenes
MTELSPKYNPAEVEAGRYQKWLDADVFKPSGDQKAKPYSIVIPPPNVTGKLHLGHAWDTTLQDIIIRQKRMQGFDTLWLPGMDHAGIATQAKVEERLREQGISRYDLGRDKFLDKVWEWKDEYATTIKEQWGKMGLSVDYSRERFTLDEGLSKAVRKVFVDLYKKGWIYRGEFIINWDPAARTALSDIEVIHKDVEGAFYHMNYMLEDGSRALQVATTRPETMFGDVAVAVNPEDPRYKDLIGKNVILPIVNKLIPIVGDEHADPEFGTGVVKITPAHDPNDFEVGQRHNLPQVNVMNDDGTMNELAGDFAGMDRFEARQATVAKLEELGALVNIEKRVHSVGHSERSGAVVEPRLSTQWFVKMDELAKQAMDNQETDDRVDFYPPRFNDTFLQWMENVHDWVISRQLWWGHQIPAWYNAEGEIYVGEEAPEGDDWTQDEDVLDTWFSSALWPFSTMGWPDTDVEDFKRYFPTSTLVTGYDIIFFWVSRMIFQSLEFTGRQPFQNVLIHGLIRDEEGRKMSKSLGNGIDPMDVIEKYGADSLRWFLSNGSAPGQDVRFSYEKMDASWNFINKIWNISRYILMNNEGLTLEDAESNVAKVAASEAGNVTDQWILHNLNETIAKVTENFDKFEFGVAGHILYNFIWEEFANWYVELTKEVLYSDNEAEKVITRSVLLYTLDKILRLLHPIMPFVTEEIYAQYAQGSIVTVDYPVVRPAFENEAAHKGVESLKDLIRAVRNARAEVNVAPSKPITILVKTADSELEDFFNSNINYIKCFTNPEKLEISSAIAAPELAMTSIITGAEIYLPLADLLNVEEELARLDKELAKWQKELDMVGKKLGNERFVANAKPEVVQKEKDKQADYQAKYDATQERIAEMKKIKS

SEQ ID NO: 725 - DNA, 618 bp, Streptococcus agalactiae
ttgtggcgatatgcgctttggtttactgcgaagcgagtgggagaaaaaaagaagatgaatattattatcatcggagcacaagcttctgggaaaatgacaattggtcaggaaatcgcaaaacagacaggcatgaccttattccataaccatgattctatagattttgttttacgcttcatgccatggtctccagatagtattgctctaacggagtctattcgctttaaattttttgaaacgtttgctaagactggtcaagaaatgatttttactattgtaattgatttcaatgattcaagagatgtagtatttctagaaaagattcaaatagtttttcaatctcacaaccaagaggtattatttgtagaattagaaacagagctaagtgagcgtctcaaacgaaatcgcacagaaaatcgcctcaagcataagccttcaaaacgtgatatcaaatggtcagagagcgatatttgttcaaccatggattacgctatctttaatcctgaagtagccccagaagcgcttacatattatcataaaatcaataatacttgcttaactgctactgaaacagcatatcttattattcaaaaaataaaccaaatcaaggagaaaaac

SEQ ID NO: 726 - protein, 206 aa, Streptococcus agalactiae
MWRYALWFTAKRVGEKKKMNIIIIGAQASGKMTIGQEIAKQTGMTLFHNHDSIDFVLRFMPWSPDSIALTESIRFKFFETFAKTGQEMIFTIVIDFNDSRDVVFLEKIQIVFQSHNQEVLFVELETELSERLKRNRTENRLKHKPSKRDIKWSESDICSTMDYAIFNPEVAPEALTYYHKINNTCLTATETAYLIIQKINQIKEKN

SEQ ID NO: 727 - DNA, 582 bp, Streptococcus pyogenes
gtgggaggagcagaaacaaaaatgaaccttatcatcattggtgctcaagcgtcgggcaagatgaccattgggcaagaagttgccaggcagacaggcatgactttgtttcataatcacgattctattgactttgttttacggtttatgccttggtctcaagagagcactgccttgattgaacgtatccgttttgctttttttgaaacctttgctaagacaggtcaagacatgatttttactattgtaattgacttcaatgatccaaatgatgtagcaatgcttgaaaagattcaggctgtttttcagtcttatgaccaagaggttctctttgtcgaattaaaaacagatatagaggaacgtcttaaacgcaatcgcacagaaaatcgtctcaaacataaacctcttaaacgcaacatcgagtggtcagaacaagatattcaatccacgatggcatatgctgtttttaatccagaagaaccacccaaaacgctcacgcattaccaaaaaatcaataatacccagctcaccgctgctgaaacagcgcagcttattatccaaaaaatgactcatatcaaggagaac

SEQ ID NO: 728 - protein, 194 aa, Streptococcus pyogenes
VGGAETKMNLIIIGAQASGKMTIGQEVARQTGMTLFHNHDSIDFVLRFMPWSQESTALIERIRFAFFETFAKTGQDMIFTIVIDFNDPNDVAMLEKIQAVFQSYDQEVLFVELKTDIEERLKRNRTENRLKHKPLKRNIEWSEQDIQSTMAYAVFNPEEPPKTLTHYQKINNTQLTAAETAQLIIQKMTHIKEN

SEQ ID NO: 729 - DNA, 582 bp, Streptococcus agalactiae
atgattaagatacttggagaaatcgtagataaccagctacctgttgtggaaacgaatcgtctgttgttgcgtcaacgcaagttagaagatgctaaggagatatttgaatttgtcaaacttgatgaggtgagttatccagcaggttttccggctgttaaaagcttggaagaagagataacctatattcaagagatttatccaactaatcttgaaaaagaaaagttaccctctggttatgctattactctaaaaggcgatgataaggtaattggttcagtagattttaaccatcgccacgaagatgacatttttgaaattggctacctgctccaccctgattattggggacaaggcattgtgccagaagcagcttcagcccttgtggagataggtttcacactgctaggactacataagattgagctgggatgctatgactataataagcaaagtcaggcggttgcgcgcaaattaggttttactttagaggctaatattcgtgatcgaagagatgcccaggggaaacgttgtggcgatatgcgctttggtttactgcgaagcgagtgggagaaaaaaagaaga

SEQ ID NO: 730 - protein, 194 aa, Streptococcus agalactiae
MIKILGEIVDNQLPVVETNRLLLRQRKLEDAKEIFEFVKLDEVSYPAGFPAVKSLEEEITYIQEIYPTNLEKEKLPSGYAITLKGDDKVIGSVDFNHRHEDDIFEIGYLLHPDYWGQGIVPEAASALVEIGFTLLGLHKIELGCYDYNKQSQAVARKLGFTLEANIRDRRDAQGKRCGDMRFGLLRSEWEKKRR

SEQ ID NO: 731 - DNA, 177 bp, Streptococcus pyogenes
ttgcataaaattgagctgggttgctacgactacaacaagcaaagtcaggcagtggctcgcaaattaggctttaccttagaagccaatgcccgtgaccgtaaggacgttcaaggtcgccgctgtggcgacatgcgttttgggttactgagaagtgagtgggaggagcagaaacaaaaa

SEQ ID NO: 732 - protein, 59 aa, Streptococcus pyogenes
LHKIELGCYDYNKQSQAVARKLGFTLEANARDRKDVQGRRCGDMRFGLLRSEWEEQKQK

SEQ ID NO: 733 - DNA, 696 bp, Streptococcus agalactiae
ttgaaacaaaacgagttgcggatgttatcatccgaatttgggtggtaccgcggaaatcgtaacacgaaattcgtccctgtcagaattgacagggattttttgtatttaggagtgaggagattgaagtatatgcagattctagaagatttcgatggcaaagcattaccaaaactagaaacggatcggcttatcttgcgtcagcgaacggtgggggatgtcccagccatgtttgattacgtttgcttggaagaggttgcctatccagcaggactcagcccaatagcttctttagaagatgagtacgattattttgaaaatcgctactatcaaaatctggaaaaggcaaaattaccatctggttatggtattaccgttaaaggaagtgatcgtattatcggatcctgcgcctttaaccatcgccatgaagacgatgttttcgagatttgctatctgcttcatcctgactactggggtcatggctatatgacagaagctgtcgccgctttgattgaagtcggttttacccttctcaatctccacaaaatcgaaatccgctgctatgattacaataagcaaagccggcgcgtggcagaaaaactaggattcacccttgaagctaccattcgtgatcgtaaggataatcaagacaatcgctgtgtcaatttgatatatggtttgctgaggagtgagtgggag

SEQ ID NO: 734 - protein, 232 aa, Streptococcus agalactiae
MKQNELRMLSSEFGWYRGNRNTKFVPVRIDRDFLYLGVRRLKYMQILEDFDGKALPKLETDRLILRQRTVGDVPAMFDYVCLEEVAYPAGLSPIASLEDEYDYFENRYYQNLEKAKLPSGYGITVKGSDRIIGSCAFNHRHEDDVFEICYLLHPDYWGHGYMTEAVAALIEVGFTLLNLHKIEIRCYDYNKQSRRVAEKLGFTLEATIRDRKDNQDNRCVNLIYGLLRSEWE

SEQ ID NO: 735 - DNA, 300 bp, Streptococcus agalactiae
atgggatttcaaaacacctctaagttaatttattctagcaaaataaggctactttcgcaaggtaaatcaaattattttgcaaaaacaacaccattatcaactaactgtttaatagctgctggaccaataccttttagtgctaaaacatctgcttcacttactttcgcaaatgcttcaaggctgacaaggccagcttcttttaaaacatcttgtttattagcagttaaaccttctaaaagatcgactgcctttggcgcttcaggagccgtctttttcggtaatgcgacttcttgtaaagtt

SEQ ID NO: 736 - protein, 100 aa, Streptococcus agalactiae
MGFQNTSKLIYSSKIRLLSQGKSNYFAKTTPLSTNCLIAAGPIPFSAKTSASLTFANASRLTRPASFKTSCLLAVKPSKRSTAFGASGAVFFGNATSCKV

SEQ ID NO: 737 - DNA, 330 bp, Streptococcus agalactiae
atgaggagaaagcattatacaatggcaaagcgtattaaaccgaataaaaaaagagagcttttgaaagctaaagggatcaattggaaggatgttcgactatctcaaactttacaagaagtcgcattaccgaaaaagacggctcctgaagcgccaaaggcagtcgatcttttagaaggtttaactgctaataaacaagatgttttaaaagaagctggccttgtcagccttgaagcatttgcgaaagtaagtgaagcagatgttttagcactaaaaggtattggtccagcagctattaaacagttagttgataatggtgttgtttttgcaaaa

SEQ ID NO: 738 - protein, 110 aa, Streptococcus agalactiae
MRRKHYTMAKRIKPNKKRELLKAKGINWKDVRLSQTLQEVALPKKTAPEAPKAVDLLEGLTANKQDVLKEAGLVSLEAFAKVSEADVLALKGIGPAAIKQLVDNGVVFAK

SEQ ID NO: 739 - DNA, 393 bp, Streptococcus pyogenes
gtggcaaaacaaaaaaatcgtaaaaaagcattgaaattagaaatgaagcgtaatggcttgttaaaaaaagcaggtcaagtttttgataaggcagttgaaagtgttgaaacagctgtggataaaaccatttctgctggtaaaaatcttgtggaaaaaggcagccaaacagttgaaaacctgacagcaagcaaggaaagacttactcttgatgagtttgcagggcagccagttgtagctggtatccgctctgaccttgtcgaaaccctatatgcagaaggcatccattcagcgcaagcttttaaggagtggacagaaaaagacctccttgctcttaagggcattggtccagcaacggttaaaaaattggtcgaaaatggtgcaagctttaaaaaa

SEQ ID NO: 740 - protein, 131 aa, Streptococcus pyogenes
VAKQKNRKKALKLEMKRNGLLKKAGQVFDKAVESVETAVDKTISAGKNLVEKGSQTVENLTASKERLTLDEFAGQPVVAGIRSDLVETLYAEGIHSAQAFKEWTEKDLLALKGIGPATVKKLVENGASFKK

SEQ ID NO: 741 - DNA, 252 bp, Streptococcus agalactiae
atgtcatacgaacaagaatttttaaaagactttgaagagtggttacaatcgcaaataagtatcaaccaaatggcaatggacagtgcaaagaaagttttagaggaagataaggatgagcgagcagcagatgcgtatattcgttatgagagtaagttagacgcttatcgctttttgcaagggaaatttaataactatcataaccaaaaatctttccatgatttgcctgatggtctttttggacaacgtcattat

SEQ ID NO: 742 - protein, 84 aa, Streptococcus agalactiae
MSYEQEFLKDFEEWLQSQISINQMAMDSAKKVLEEDKDERAADAYIRYESKLDAYRFLQGKFNNYHNQKSFHDLPDGLFGQRHY

SEQ ID NO: 743 - DNA, 252 bp, Streptococcus pyogenes
atgtcttatgaaaaagaatttttaaaagattttgaagactgggttaaaactcagattcaagtcaatcagctagccatggcaaccagtcaagaagttgcccaagaagatggcgatgaaagggctaaagatgcctttattcgttatgaaagtaagttagacgcctacgaatttttactaggtaaatttgacaattataaaaatggtaaagcctttcacgatattccagatgagttatttggagcaaggcattat

SEQ ID NO: 744 - protein, 84 aa, Streptococcus pyogenes
MSYEKEFLKDFEDWVKTQIQVNQLAMATSQEVAQEDGDERAKDAFIRYESKLDAYEFLLGKFDNYKNGKAFHDIPDELFGARHY

SEQ ID NO: 745 - DNA, 246 bp, Streptococcus agalactiae
atgtccccgttaggaatgattaaagatgaaggtttattcaataccattaaaatcatcagccggggactgaaaaatgaacgatgccctcatccaaaattaataaatgttttggaaagaaaacttgaaattatccttggtgatcagaaacatatccttgaaaaagatagccttattagcctctctccacaagaaacacaccatttaagagctattgaaaatagtaaatttctccaaatagaattagac

SEQ ID NO: 746 - protein, 82 aa, Streptococcus agalactiae
MSPLGMIKDEGLFNTIKIISRGLKNERCPHPKLINVLERKLEIILGDQKHILEKDSLISLSPQETHHLRAIENSKFLQIELD

SEQ ID NO: 747 - DNA, 303 bp, Streptococcus pyogenes
atgattgaaaatctctctcaattggtgcaatatcatgatcatcaggtggctagccgatccttgagccgtctactgggattatctcaatctattgttttatatgccatggcccaaggagaaagcattagtcaagagactagtccaagagataaagtaatacttgttttagaaggtcagctcattttcgatttagaggatcaaaaacaggtcctaactcaagaaagtctcatagccatacctgcccaaaaagtccatcatttagaagctaaaaccgattgtaaactattacaagtgcttttagat

SEQ ID NO: 748 - protein, 101 aa, Streptococcus pyogenes
MIENLSQLVQYHDHQVASRSLSRLLGLSQSIVLYAMAQGESISQETSPRDKVILVLEGQLIFDLEDQKQVLTQESLIAIPAQKVHHLEAKTDCKLLQVLLD

SEQ ID NO: 749 - DNA, 297 bp, Streptococcus agalactiae
ttgcttgaactaaaatttcaacaagaaagaatgctgaaaggtttgcatataaaaaatacagatcaattgattttttatgactataggtttggtatgatatcaaatgatgctgttaacaaattcttggcaagctcattggaaaaattagaaatagaatctaagatgtcatcaacaggtgctagacatacttatggaagttatttgttggctaacggagtagatatttgggcggttgcaaaattaatggggcataaagatatcaaacaattaatagaaacatatggtcatttgcttctg

SEQ ID NO: 750 - protein, 99 aa, Streptococcus agalactiae
MLELKFQQERMLKGLHIKNTDQLIFYDYRFGMISNDAVNKFLASSLEKLEIESKMSSTGARHTYGSYLLANGVDIWAVAKLMGHKDIKQLIETYGHLLL

SEQ ID NO: 751 - DNA, 369 bp, Streptococcus agalactiae
atgaaaaagaaattattaggattgatgattttagctatatctacagtatttttagttgcttgttcgactaattcgttaaatgtaaagtattataaagtatatgatggtgaaaaaatgttagttttagaaattaatgatgaatcaggaatttatcataatgaaggaaactttgtagtaactaatattgatactaaaagtaaaagttttgtacttaaaggtgggtctgctaagtatactgttttatatgatgttaaaagtgatggtaaattgaatgttgatttagggaacttttattataatgcttctggtaaggagacatattataaagaaggtagcaaggctttagaaaaagcattaagagataaagaa

SEQ ID NO: 752 - protein, 123 aa, Streptococcus agalactiae
MKKKLLGLMILAISTVFLVACSTNSLNVKYYKVYDGEKMLVLEINDESGIYHNEGNFVVTNIDTKSKSFVLKGGSAKYTVLYDVKSDGKLNVDLGNFYYNASGKETYYKEGSKALEKALRDKE

SEQ ID NO: 753 - DNA, 291 bp, Streptococcus agalactiae
atgtcaacagtagcagtaagagttgatgatcaattaaaagatgatgctacagaactttttcaatccttagggttggatatgagcacagcagtaaaaatgtttttgattcaatctgttaaaactcaaagtattccttttgaaataaaaaataaatcatctgtttctgatgaagaatttcaaaatttggtagaaacaaaattaaagggaatacgagttaaggctagtgatccagaaagtgtaaatgcgttttttggagatgaagatttttcagaatatgaggaatattttaaa

SEQ ID NO: 754 - protein, 97 aa, Streptococcus agalactiae
MSTVAVRVDDQLKDDATELFQSLGLDMSTAVKMFLIQSVKTQSIPFEIKNKSSVSDEEFQNLVETKLKGIRVKASDPESVNAFFGDEDFSEYEEYFK

SEQ ID NO: 755 - DNA, 312 bp, Streptococcus pyogenes
atgtcgttacaaaaaaggaggataaccatggctaaaacgggaactttgaatttacgagttgatgattcagtaaaaagtgcggcagatgatattttgaaacgcttaggtattcctatgtcaactgcgattgatatgtttttgaatcagattattttgactgggggtatcccatttgatgtttctctacctgaagcgcctcaacgagttaatgttgattacatgagtcaggagaagttttatgataagcttatcaccagctttgaagatgcgaaaacttgcaaccctcaggatgtcgggaaattctatttccaa

SEQ ID NO: 756 - protein, 104 aa, Streptococcus pyogenes
MSLQKRRITMAKTGTLNLRVDDSVKSAADDILKRLGIPMSTAIDMFLNQIILTGGIPFDVSLPEAPQRVNVDYMSQEKFYDKLITSFEDAKTCNPQDVGKFYFQ

SEQ ID NO: 757 - DNA, 1176 bp, Streptococcus agalactiae
gtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatggtaaaggaaataaactaccagcaacaggtgagaatgcaactccattctttaatgttgtagctttgacaattatgtcatcagttggtttattatctgtttctaagaaaaaagaggat

SEQ ID NO: 758 - protein, 392 aa, Streptococcus agalactiae
MTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNGKGNKLPATGENATPFFNVVALTIMSSVGLLSVSKKKED

SEQ ID NO: 759 - DNA, 1137 bp, Streptococcus pyogenes
atgcgtagagcagaaaataacaaacacagccgctattccattcgcaaactgagcgttggggtaacgagtatagcaattgcgagtctctttttaggaaaggttgcctatgccgtagatggcatccctccaatctctcttactcaaaagactacagccactacatcagaaaattggcatcatattgataaggatggccttattcctttaggtataagcttagaagctgccaaagaggaatttaaaaaagaagtagaagaatcacgtttatctgaagcacaaaaagaaacgtataaacaaaaaattaaaactgcaccagacaaagataagctattattcacgtatcatagtgagtatatgacagccgttaaggatcttccagcgtctactgagtctactactcagccagttgaggcacccgtgcaggagacacaggcatcagcttcagattcgatggtgacaggtgattcaacatcagttacgactgattctcctgaggaaaccccatcttcggaaagtccagtggccccagctttatctgaggctccagctcaaccagctgagagtgaggaaccttcagtagcagcatcttctgaggaaaccccatctccatcaactccagcggccccagaaactcctgaagaaccagcagctccatctccatcacctgagagtgaggaaccttcagtagcagctccttctgaggaaaccccatctccagaaactcctgaagaaccagcagctccatctcaaccagctgagagtgaagaatcttcagtagcagctacgacaagcccgtctccatcaactccagctgaatcagagactcagacgccaccagctgttactaaagactctgataagccatcttcagcagctgaaaaaccagcagcctcttcacttgtttcagaacaaaccgttcaacaaccaacttcaaagagatcttctgataaaaaagaagagcaagaacagtcttactctccaaatcgctcattgtcaagacaggttagggcccatgagtcaggtaagtacttgccttcaacaggtgaaaaagcacagccactctttatagctactatgactttgatgtctctatttggcagtcttttagtcacaaaacgccaaaaagaaactaaaaaa

SEQ ID NO: 760 - protein, 379 aa, Streptococcus pyogenes
MRRAENNKHSRYSIRKLSVGVTSIAIASLFLGKVAYAVDGIPPISLTQKTTATTSENWHHIDKDGLIPLGISLEAAKEEFKKEVEESRLSEAQKETYKQKIKTAPDKDKLLFTYHSEYMTAVKDLPASTESTTQPVEAPVQETQASASDSMVTGDSTSVTTDSPEETPSSESPVAPALSEAPAQPAESEEPSVAASSEETPSPSTPAAPETPEEPAAPSPSPESEEPSVAAPSEETPSPETPEEPAAPSQPAESEESSVAATTSPSPSTPAESETQTPPAVTKDSDKPSSAAEKPAASSLVSEQTVQQPTSKRSSDKKEEQEQSYSPNRSLSRQVRAHESGKYLPSTGEKAQPLFIATMTLMSLFGSLLVTKRQKETKK

SEQ ID NO: 761 - DNA, 219 bp, Streptococcus agalactiae
  misc_feature (1)..(219): n = a, c, g, or t
gtgactgttaaggttgtcgatccacgtacagatgccgataagaatgatacagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgaaacttacccannnnnt

SEQ ID NO: 762 - protein, 73 aa, Streptococcus agalactiae
  MISC_FEATURE (1)..(73): Xaa = Any Amino Acid
MTVKVVDPRTDADKNDTAGKDQQVNVGETPKAEDSIGNLPDLPKGTTVAFETPVDTATPGDKPAKVVETYPXX

SEQ ID NO: 763 - DNA, 1401 bp, Streptococcus agalactiae
atgtatagagctatacagaataaagtaaaggagaatattatgtttagaaggtctaaaaataacagttatgatactttacagacgaaacaacggttttcaattaagaagtttaagtttggtgcagcttctgtactaattggtattagttttttaggaggttttactcaagggcaatttaatatttctacagatactgtgtttgcagctgaagtaatttcaggaagtgctgttacgttaaacacaaatatgactaaaaatgttcagaatggtagagcatatatagatttatatgatgtgaaaaatgggaaaatagatccattacaattaattacgttaaattcacctgatttaaaagctcagtatgtcattaggcaaggcggcaattatttcacacaaccttctgaattgactactgttggtgcagctagtattaattatacagtattgaagacagatggaagtcctcatacgaagcctgatggacaagtggatattgtaaacgtttcattgactatttacaattcttcagctttgagagataaaatagatgaagttaaaaagaaagcggaagaccctaaatgggacgagggaagtcgcgataaagttttgataagtttagatgatatcaaaacagatattgataataatcctaagacgcaatcagacattgccaataaaataactgaagttactaatttagaaaaaatactagtacctcgaatcccagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatactgtagatgtgactgttaaggttgtcgatccacgtacagatgccgataagaatgatccagcaggtaaagatcagcaagtcaatgtaggtgagacaccgaaggcagaagattctattggtaacttaccagatcttccgaaaggtacaacagtagcctttgaaactccagttgatacggcaacaccgggagacaaaccagcaaaagttgttgtgacttacccagatggttcaaaagatctg

SEQ ID NO: 764 - protein, 467 aa, Streptococcus agalactiae
MYRAIQNKVKENIMFRRSKNNSYDTLQTKQRFSIKKFKFGAASVLIGISFLGGFTQGQFNISTDTVFAAEVISGSAVTLNTNMTKNVQNGRAYIDLYDVKNGKIDPLQLITLNSPDLKAQYVIRQGGNYFTQPSELTTVGAASINYTVLKTDGSPHTKPDGQVDIVNVSLTIYNSSALRDKIDEVKKKAEDPKWDEGSRDKVLISLDDIKTDIDNNPKTQSDIANKITEVTNLEKILVPRIPDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDTVDVTVKVVDPRTDADKNDPAGKDQQVNVGETPKAEDSIGNLPDLPKGTTVAFETPVDTATPGDKPAKVVVTYPDGSKDL

SEQ ID NO: 765 - DNA, 1203 bp, Streptococcus agalactiae
gtggtaactcatatgattgattttctactgttgaaatcattacacagtcttctaggtctaactattactgtttgtgatcaaaatttttctgttatcagagagtataaatccgagaaaactatttcacttttttacaatcattaccttattttaagtaactttagtaaaactcaacatgattttttatttcattatggctctttaggagaactttttcttgtccaccatattcaacaatattatattatcatcggtccctggcgtagcaatgttattgaccctttacttcttaagaaaaagctgactgaaacacaaatcaatgctagtgaacaagactactttattgatagactatcccaattacctttcttctcacttagtcaaatccgagaattactaatagtaaccaattattgtctaactggggttgtgaaagataaattatcagagcccttacattactacacgaaagggtggagcaactcctttgatctagataaaattaagcaattttctaaacagaatatgagttcttacaaatatcagtatcattttgaaaataatattctaaaagctgttaaatcaggtagtgaatttcttttgaaagaaacagtggaacaatttagcaattctatcgtacctataatcagtggagatgaattgcgatctgaaaaaaactactccatcatgatttatgatcgtctctcacaggctaccatccaagcaggacttgatatcgaaacagcttatcgagcacgagatcgttttataaaagaaaacgagtcaactataagtctaaatgaagttttaaaattacgtgatactgctatcttattctatactcaacaagttcattctttaaaaaaacatctcgaaacccctcattctcaaactattgtcgcagtgattcgatatcttgaaaataatctaaatcgctttattaaaacagaagaaatagctaaagaatgtcacatgagtgaatcgaagttacgaaaactatttaagcaagaaaaacacatcactattcaacaatattttctaaacttaaaaatcgaagctgctaagcaattactagatgaaaataagaaagtagaagaagtttccaatttacttggattttccacttcttctaatttttcaaggacatttaaaaaaatagtgggaattagcccactagaatataagcaaaagcctaagacaata

SEQ ID NO: 766 - protein, 401 aa, Streptococcus agalactiae
MVTHMIDFLLLKSLHSLLGLTITVCDQNFSVIREYKSEKTISLFYNHYLILSNFSKTQHDFLFHYGSLGELFLVHHIQQYYIIIGPWRSNVIDPLLLKKKLTETQINASEQDYFIDRLSQLPFFSLSQIRELLIVTNYCLTGVVKDKLSEPLHYYTKGWSNSFDLDKIKQFSKQNMSSYKYQYHFENNILKAVKSGSEFLLKETVEQFSNSIVPIISGDELRSEKNYSIMIYDRLSQATIQAGLDIETAYRARDRFIKENESTISLNEVLKLRDTAILFYTQQVHSLKKHLETPHSQTIVAVIRYLENNLNRFIKTEEIAKECHMSESKLRKLFKQEKHITIQQYFLNLKIEAAKQLLDENKKVEEVSNLLGFSTSSNFSRTFKKIVGISPLEYKQKPKTI

SEQ ID NO: 767 - DNA, 531 bp, Streptococcus agalactiae
gtgtcctatatggtaaaagatagacaaattcagaaaacaaaagtagcgatttataatgcttttataagcttgctacaggaaaatgattattctaaaataacggttcaagatgtaatcggacttgcaaatgtaggaagatcaactttttactctcactatgaaagcaaagaagtgttactcaaggagctctgtgaagacctttttcaccacttatttaagcagggtagagatgttacgtttgaagagtatttagttcatatcttaaaacattttgaacaaaatcaagatagtatcgctacgttattattatctgacgatccctattttttattacgctttagaagtgaattagaacacgatgtttaccctagattgcgtgaggagtatattacaaaggtggacattcctgaagatttcttaaaacaatttcttttatccagttttatcgagaccttaaagtggtggcttcatcaaagacagaaaatgactgttgaagatttactaaaatattatttaactatggtagagagg

SEQ ID NO: 768 - protein, 177 aa, Streptococcus agalactiae
MSYMVKDRQIQKTKVAIYNAFISLLQENDYSKITVQDVIGLANVGRSTFYSHYESKEVLLKELCEDLFHHLFKQGRDVTFEEYLVHILKHFEQNQDSIATLLLSDDPYFLLRFRSELEHDVYPRLREEYITKVDIPEDFLKQFLLSSFIETLKWWLHQRQKMTVEDLLKYYLTMVER

SEQ ID NO: 769 - DNA, 528 bp, Streptococcus pyogenes
gtgtccgatatgacaaaagacagacaaatcaaaaaaacaaaaacagctatctatagtgcttttattgctttattacaaaaaaaagaatattcgaaaataactgttcgagatatgattacacttgctaatgtagggagatcaaccttttatgcacattatgaaagcaaagaaatgttactaaaagaactctgtgaagaactttttcatcatttgtttaggcaaaaaagaaatgtgacttttgaggactatttggtacatattttaaagcattttgaacaaaataaagacagcattgcgacgttgttactttctaatgatccctattttttattaagatttaaaaacgaactagaacatgatgtttaccctaacttgcgctgcaagtatatcgacaaaacgactattccagaagtattcctaaaacaatttgttctatctagttttatagaaaccttaaaatggtggctccatcaaaggcaaaggatgtctgcaaatgaactattaaagtattatttagagctcataaaa

SEQ ID NO: 770 - protein, 176 aa, Streptococcus pyogenes
VSDMTKDRQIKKTKTAIYSAFIALLQKKEYSKITVRDMITLANVGRSTFYAHYESKEMLLKELCEELFHHLFRQKRNVTFEDYLVHILKHFEQNKDSIATLLLSNDPYFLLRFKNELEHDVYPNLRCKYIDKTTIPEVFLKQFVLSSFIETLKWWLHQRQRMSANELLKYYLELIK

SEQ ID NO: 771 - DNA, 183 bp, Streptococcus agalactiae
atggaatctggaacaccatctaaaaaaagtttcagggttgatagtaatttaggaagtgctttagataagatgaaagtagatatggcaactgataataatggatcaaggatatacaacggtttccaatttaagataagagatataacaataatagctaaccaccctagaatatcttccaaaaaa

SEQ ID NO: 772 - protein, 61 aa, Streptococcus agalactiae
MESGTPSKKSFRVDSNLGSALDKMKVDMATDNNGSRIYNGFQFKIRDITIIANHPRISSKK

SEQ ID NO: 773 - DNA, 861 bp, Streptococcus agalactiae
atgacatcaaacaaaaaagtggctatcgcttttatattaaatatcagcttttccgtccttgaattcatctttggaagtctattcttctcaggagctatcttagccgatgctgttcatgattttggtgatgcaatagctattggcatctcagctactttagaaaaaaaatctaagaaagatgaagatacgatattttcattaggttataaacgttttagccttttaggagctcttatcacaagtctaattcttataagtggatctatcttagtcatgatagaaaatatcccaaaattgtggcatcctactcctgttaattatcacggcatgtttattctagctgtcatcgctattatcattaatggtctagctagttttattctccattctggtcaaagtaaacatgaggaaatattaagccttcattttttggaagatattctagggtggttagctattattgttatatctcttatcttaaattggaaaccgttgtatatccttgatccattattatcagttgccatatctactttcatcttatctaaagcacttcctaaattactatcaaccctgaaactttttttagatggtgttccagattccatagattacgctgcattacatgatgaacttaagggactttcgcaagtaagatctatcaatcaactcaatatctggtcaatggatggtattgataatcgagcaatcattcactgttgcttaaatcaattgatatctgaaaaagattgtaaaagagctattcgaacgatttgccaacattataagataaacgatgttactgttgaaatcgattattctttaagagaacatcaaaatcattgcaaaccattaaaaaac

SEQ ID NO: 774 - protein, 287 aa, Streptococcus agalactiae
MTSNKKVAIAFILNISFSVLEFIFGSLFFSGAILADAVHDFGDAIAIGISATLEKKSKKDEDTIFSLGYKRFSLLGALITSLILISGSILVMIENIPKLWHPTPVNYHGMFILAVIAIIINGLASFILHSGQSKHEEILSLHFLEDILGWLAIIVISLILNWKPLYILDPLLSVAISTFILSKALPKLLSTLKLFLDGVPDSIDYAALHDELKGLSQVRSINQLNIWSMDGIDNRAIIHCCLNQLISEKDCKRAIRTICQHYKINDVTVEIDYSLREHQNHCKPLKN

SEQ ID NO: 775 - DNA, 873 bp, Streptococcus pyogenes
atgccagcaagtaaaaaagtcaccattatttttatattaaatcttagtttttccctcattgaatttatttttgggacattattcttttcgggtgctattttagcagatgctgtccacgattttggagatgccattgctattggtatctcagctatcttagaaagaaaggctgttaaaaaagagagtccaaatttttcactaggctataagcgatttagccttttaggagcgctaacgacaaatctaatacttattagcgggtcattattagtaatgattgaaacgataccaaaattatggcatcctactattgttaattatgacggtatgttcgttttagctatttttgcaattataatcaatggatttgctagcttcatcattcactctaaccagacaaaaaatgaagaaatattaagccttcactttttagaagatatccttgggtggttagccattatcatactgtcactgatcttaaaatggaaaccttggtacattcttgatcctttattatcaattgccattgcttcttttatattatctaaagctcttccaaagttagtagcaactgctaacatttttttagatggtgttcctgattctatagactattgcactttgcaccatgaactcagccaacttcctcatatagtgtctgttaatcagcttaatgtttggtcgatggatggtattgatcatagagcaactatacattgctgcttgagagaatctaccactgaaaaacattgcaaaaaatctattagactgatttgtcaaaggtacaatataaactcagtcactgtggaaatcgatacttctttaaacgaacaccaacatcactgttcttctctttctagtattgaagtcaac

SEQ ID NO: 776 - protein, 291 aa, Streptococcus pyogenes
MPASKKVTIIFILNLSFSLIEFIFGTLFFSGAILADAVHDFGDAIAIGISAILERKAVKKESPNFSLGYKRFSLLGALTTNLILISGSLLVMIETIPKLWHPTIVNYDGMFVLAIFAIIINGFASFIIHSNQTKNEEILSLHFLEDILGWLAIIILSLILKWKPWYILDPLLSIAIASFILSKALPKLVATANIFLDGVPDSIDYCTLHHELSQLPHIVSVNQLNVWSMDGIDHRATIHCCLRESTTEKHCKKSIRLICQRYNINSVTVEIDTSLNEHQHHCSSLSSIEVN

SEQ ID NO: 777 - DNA, 852 bp, Streptococcus agalactiae
atgacagatacaatgatattaaatgacaatcataaaataccaactttaggtttaggtacgtggatgatagataatgatagggtagctcaagttgttaaagatgctatcgaattaggctaccgccatattgatactgcacaagcatacaacaatgaaaaaggtgtcggtgtagggattaaagagtctggtattacacgtgaatctttatttgttacgactaaaattgccgctgaacataaagattatgaaagtgctacaaaatcaattgatcaatcactagaagctttagggcttgattatattgatttaatgattattcatagtccacagccttggaaggaatggcgtgaaacagataaacattttgaccaaggaaatttagaagcttggagagctttagaggatgctcaaaaatctggtaagatgaaatccatcggtgtctcaaactttttagaaaaagacttagaaaatatcttaaaaaatggtcatgttaaacctgctgtcaatcaaatcttagctcacatcggaaatacacctttcgacttgattgattactgtcaaagtaaaggtattcaagttgaagcctattcaccaattgcacatggacaagcattgaaatctgatggtattcaaaaaatggctgaaaaatatggggttagtgttgctcaattatgtattcaatatttactacaattaaacctgatcgttttaccaaaggcttctagtaaagaacatttacagtctaatctagactttgactttgtaattagtgacgaagatatgtcgatattaaaatcacttatgtttgacgattatggggaattttctaacttccctgtttttagtggaaaa

SEQ ID NO: 778 - protein, 284 aa, Streptococcus agalactiae
MTDTMILNDNHKIPTLGLGTWMIDNDRVAQVVKDAIELGYRHIDTAQAYNNEKGVGVGIKESGITRESLFVTTKIAAEHKDYESATKSIDQSLEALGLDYIDLMIIHSPQPWKEWRETDKHFDQGNLEAWRALEDAQKSGKMKSIGVSNFLEKDLENILKNGHVKPAVNQILAHIGNTPFDLIDYCQSKGIQVEAYSPIAHGQALKSDGIQKMAEKYGVSVAQLCIQYLLQLNLIVLPKASSKEHLQSNLDFDFVISDEDMSILKSLMFDDYGEFSNFPVFSGK

SEQ ID NO: 779 - DNA, 840 bp, Streptococcus pyogenes
gtgatggtaacaacagtaaaaatgacaagtggctatgagattcccgttttaggatttggaacttaccaagcagccgatggtgaggaagcttaccaatctaccttagcagccatcaaggctggctatcgtcatattgatactgcagctatttataaaaatgaagaaagtgtgggtcgtgccatcaaggattctggggttctacgagaagacttatttattacaactaaactctggaatgacgcccatagttatgaaggggcaaaagacgctttagctgcttctcttgaccgtcttggtctggattatgtggatctctatcttatccattggccaaacccaaaagctctgcgtaacacttggaaagaggcaaatgcccaagcatggcaatatatggaagaggcggttgaagcagggcttattaaaagcattggcgtcagcaattttatggtgcatcatctagaagctcttcaagagacagctaaaataactccagcaattaatcagattcgattagccccaggttgctatcaaaaggaagtggttgattattgtaaggcaaatgagattttattggaagcttggagtcctctaggacaaggggagatttttgataatgagactatgcagcagttagctaataaatatgacaaaacagtggcacaagttgccttagcttggtcgctggcagaaggttttattcccttgccaaaatcggtgcatgatgagcgcatcaaggaaaatatggctatttttgatgtgagcttgacacaagaagataaaaaaacaattcgctatctctcaggaatgtcagcgattcctaaccctgatactacaagtttt

SEQ ID NO: 780 - protein, 280 aa, Streptococcus pyogenes
VMVTTVKMTSGYEIPVLGFGTYQAADGEEAYQSTLAAIKAGYRHIDTAAIYKNEESVGRAIKDSGVLREDLFITTKLWNDAHSYEGAKDALAASLDRLGLDYVDLYLIHWPNPKALRNTWKEANAQAWQYMEEAVEAGLIKSIGVSNFMVHHLEALQETAKITPAINQIRLAPGCYQKEVVDYCKANEILLEAWSPLGQGEIFDNETMQQLANKYDKTVAQVALAWSLAEGFIPLPKSVHDERIKENMAIFDVSLTQEDKKTIRYLSGMSAIPNPDTTSF

SEQ ID NO: 781 - DNA, 102 bp, Streptococcus agalactiae
gtgattttgttattgttccctttacacatggctgtggccaatgtccgtcttgtaaggctggatttgatggaaattgtacaaatcatcaagctgcaaaaaatg

SEQ ID NO: 782 - protein, 34 aa, Streptococcus agalactiae
MILLLFPLHMAVANVRLVRLDLMEIVQIIKLQKM

SEQ ID NO: 783 - DNA, 1035 bp, Streptococcus agalactiae
atgaaagtagctacatttattgaacctggcaaaatggttataactgatacaccaaaaccagtcattgaacaagagacagatgctgttatcaaaattgttagagcctgtgtttgtggttcagacttgtggtggtatcgtggtatttcaaaacgtgaaagtggttcttttgcaggtcatgaggctattggtatcgttgaggaagttggtactaaagtaactgacgtgtcaaaaggtgattttgttattgttccctttacacatggctgtggccaatgtccgtcttgtaaggctggatttgatggaaattgtacaaatcatcaagctgcaaaaaatgtaggataccaaggtcaatatctacgttatactaatgcaaactgggcattggttaagatcccaggacaaccttctgattatgataatgagactcttaactctctgctcaccttatcagatgtaatggcaactggttatcatgctgcagcaactgcagaagttaaagaaggtgacacggtagttgtcatgggagatggtgctgttggactctgtggtgttatcgctgctaaaatgttaggtgctaaccgtatcattgcaatgagtcgtcacaaagataggcaggaactagcattgacttttggtgcaacggatattgtcgaagaacggggtgacgaagccgttaaacgtgttttagatttaaccaatcaagcaggtgccgatgctgttttagaatgtgttggtacagagcagtctgttgatacagctacccaaattgctaggcctggtgctgtcataggacgtgttggtatcccacaaaatccagacatgaataccaataatttattctggaaaaatatcggccttagaggtggcattgcttctgtaacaacatttgataagtctgtccttttagatgctgttctaactcataaaattaacccaggcttagtttttacaaaatcctttgtattagatgatattcaaaaggcttatgaagcaatggataaacgtgacgctatcaaatccttagtgattgttgac

SEQ ID NO: 784 - protein, 345 aa, Streptococcus agalactiae
MKVATFIEPGKMVITDTPKPVIEQETDAVIKIVRACVCGSDLWWYRGISKRESGSFAGHEAIGIVEEVGTKVTDVSKGDFVIVPFTHGCGQCPSCKAGFDGNCTNHQAAKNVGYQGQYLRYTNANWALVKIPGQPSDYDNETLNSLLTLSDVMATGYHAAATAEVKEGDTVVVMGDGAVGLCGVIAAKMLGANRIIAMSRHKDRQELALTFGATDIVEERGDEAVKRVLDLTNQAGADAVLECVGTEQSVDTATQIARPGAVIGRVGIPQNPDMNTNNLFWKNIGLRGGIASVTTFDKSVLLDAVLTHKINPGLVFTKSFVLDDIQKAYEAMDKRDAIKSLVIVD

SEQ ID NO: 785 - DNA, 1089 bp, Streptococcus pyogenes
atgaattggttgattacctctcaaccttataagaagttaaatatgaaagcagcaacttacctttcaaccggaaatctacagctcatagacaaaccaaaaccagtcattataaagcctacagatgctatcgtccagttggtaaaaaccactatttgtggaactgatttgcatatcttaggtggggatgttcccgcatgtaaagaaggaacaatccttggtcatgaaggaattggaattgttaaggaggtcggtgatgcggttactaactttaaaatcggagataaagtgattatttcttgcgtcacatcatgtcatacctgttattattgtaaacgaggcctttcgtcacattgtcaagatggcggttggattcttggccatttaattaatggaacacaagcagaatatgtccatatcccacatgcagatggtagtctctatcatgctcctgatacgattgatgatgaggcacttgtcatgctttctgatattttaccaacttcatatgaaattggtgtcttgccatcacatgtcaagcctggagataatgtttgtattgttggtgccggtccagtaggactcgcagccctactaaccgttcaatttttctctccagccaatattattatggtcgacttatctcaaaatcgccttgaagcagctaaaacatttggagccacacacacgatttgttcaggaagtagtgaagaagtcaaggctatcattgacgatataaccaatggacgtggtgtcgatatttccatggagtgtgttggttatcccgcgacatttgatatttgtcaaaaaattatatcagtaggtgggcatattgctaacgttggggttcatgggaaaccagttgatttcaacctggatgaattatggattaaaaatatcaccttaaacactggacttgttaatgccaatacaactgaaatgctactaaatgtcttgaaaactggaaagattgacgcaacaagacttattacacatcattttaaactttcagaagttgaaaaagcttatgaaacctttaaacatgctggtgcaaataacgccttgaaagttattattgataatgatattagc

SEQ ID NO: 786 - protein, 363 aa, Streptococcus pyogenes
MNWLITSQPYKKLNMKAATYLSTGNLQLIDKPKPVIIKPTDAIVQLVKTTICGTDLHILGGDVPACKEGTILGHEGIGIVKEVGDAVTNFKIGDKVIISCVTSCHTCYYCKRGLSSHCQDGGWILGHLINGTQAEYVHIPHADGSLYHAPDTIDDEALVMLSDILPTSYEIGVLPSHVKPGDNVCIVGAGPVGLAALLTVQFFSPANIIMVDLSQNRLEAAKTFGATHTICSGSSEEVKAIIDDITNGRGVDISMECVGYPATFDICQKIISVGGHIANVGVHGKPVDFNLDELWIKNITLNTGLVNANTTEMLLNVLKTGKIDATRLITHHFKLSEVEKAYETFKHAGANNALKVIIDNDIS

SEQ ID NO: 787 - DNA, 393 bp, Streptococcus agalactiae
atgcaagaaacaactaagtctatctttcctaagggtgaaaaaaatccatatggtgaattctttattgggcaatcctatctcgcagcattagcaaaatctccagatgggaatgtttcagttggaaatgtaacctttgaagcaggctgtcgtaataattggcatgttcatttggacggttatcaaatccttctcgttacagaaggttcaggttggtaccaagaagaaggaaaagaagcagtgtcattaaaaccaggcgacgttatcgttacagataaaggtgttagacattggcatggtgctaaaaaagattctgaatttgcacatattgcgattacagctggtaagagtgagttttatgaagctgttagtgatgaagaatattcaagactaggt

SEQ ID NO: 788 - protein, 131 aa, Streptococcus agalactiae
MQETTKSIFPKGEKNPYGEFFIGQSYLAALAKSPDGNVSVGNVTFEAGCRNNWHVHLDGYQILLVTEGSGWYQEEGKEAVSLKPGDVIVTDKGVRHWHGAKKDSEFAHIAITAGKSEFYEAVSDEEYSRLG

SEQ ID NO: 789 - DNA, 315 bp, Streptococcus agalactiae
atgaaagaaaaacaaacagccggacgtcgtcaattagaagaatttgcacctgaatttgccagatataatgatgatattttatttggtgaggtttgggcaaaagaggatcatttaacagataaaacacgttctattattactatatctgccttaattagcggaggaaatcttgaacagttagagcatcatcttcaatttgccaaacaaaacggagttactaaagaagaaattgctgacattatcactcacctcgctttttatgttggatggccaaaagcttggtcagcctttaataaagctaaggaaatttggata

SEQ ID NO: 790 - protein, 105 aa, Streptococcus agalactiae
MKEKQTAGRRQLEEFAPEFARYNDDILFGEVWAKEDHLTDKTRSIITISALISGGNLEQLEHHLQFAKQNGVTKEEIADIITHLAFYVGWPKAWSAFNKAKEIWI

SEQ ID NO: 791 - DNA, 282 bp, Streptococcus agalactiae
atgcttactattcaagaaatgaaagatacaacctttgaattacaagaaaattttagaaggttaaattatcctattaaacaagttgctaaagacttgcaacttaatatcagtgaagttgaatctcttttaagtcttgatgttacttatcctggagatgtttgtatgctgagagattatctagaagatatgttgaaaaaagagggtaaagaagtttatccattttctagattagcatctcattcagcaaatcgttggtacccttatgagacaccatggcgttat

SEQ ID NO: 792 - protein, 94 aa, Streptococcus agalactiae
MLTIQEMKDTTFELQENFRRLNYPIKQVAKDLQLNISEVESLLSLDVTYPGDVCMLRDYLEDMLKKEGKEVYPFSRLASHSANRWYPYETPWRY

SEQ ID NO: 793 - DNA, 429 bp, Streptococcus agalactiae
atgctatcatttcaaattgttgaaaagccagcaatgatacttgctggagtaactttagaaaatgtaaagtcaaatcaagaaggtatccagcaagccattggcatttgtaaaacacaacctgattttcgtttcgattacagtgccacttatcaagtagagacaagtgtccaagccccaaaagggttagaaattattaggatcccaagcgctacctatgcagtcatttctgttaaaggtccaatgccatcgagtcttcaagaaacatggcgaaaaataatacaaggattttttcaagagaataatctaaaaccagctaactcgccaaacttagaaatttattcatctcaacatccacaagatactgattatcaaatggaaatttggcttgctatcgcagatattactaataactcgaaaacaaacttaatc

SEQ ID NO: 794 - protein, 143 aa, Streptococcus agalactiae
MLSFQIVEKPAMILAGVTLENVKSNQEGIQQAIGICKTQPDFRFDYSATYQVETSVQAPKGLEIIRIPSATYAVISVKGPMPSSLQETWRKIIQGFFQENNLKPANSPNLEIYSSQHPQDTDYQMEIWLAIADITNNSKTNLI

SEQ ID NO: 795 - DNA, 387 bp, Streptococcus agalactiae
atgattacacaagaaatgaaagagattattaatagtcagttagcaatggtcgcgacggttgatgctaaaggtcaacccaatattggcccaaaacgttctatgcgtctctgggatgataaaacgtttatttataatgaaaatacagatggtcaaactcgtattaacattgaagataatgggaaaattgaaattgcctttgttgatcgtgaacgtcttttaggttacaggtttgtgggaactgctgaaattcaaacagaaggtacttattacgaagcagcgaaaaaatgggcagaaggacgcatgggggttccgaaagcagttggtattattcatgtcgagcgtatttttaatttacaatctggtgctaatgcaggtaaagaaatcact

SEQ ID NO: 796 - protein, 129 aa, Streptococcus agalactiae
MITQEMKEIINSQLAMVATVDAKGQPNIGPKRSMRLWDDKTFIYNENTDGQTRINIEDNGKIEIAFVDRERLLGYRFVGTAEIQTEGTYYEAAKKWAEGRMGVPKAVGIIHVERIFNLQSGANAGKEIT

SEQ ID NO: 797 - DNA, 399 bp, Streptococcus pyogenes
atgataacacaagaaatgaaagatcttattaataaccaattagcaatggttgcgacggttgatgccaaaggtcaacccaatattggtccaaaacgttctatgcgtctctgggatgataaaacatttatttataatgaaaatacagatggtcaaactcgtattaacattgaagataatgggaaaattgaaattgcctttgttgatcgtgagcgccttttaggttacaggtttgtaggaactgctgaaattcaaacagaaggtgcttattacgaagcagcgaaaaaatgggcacaaggacgcatgggggtaccaaaagcagttggtattattcatgtcgagcgtatttttaatttacaatctggtgctaatgcaggtaaagaaataaacagtgaaagtaac

SEQ ID NO: 798 - protein, 133 aa, Streptococcus pyogenes
MITQEMKDLINNQLAMVATVDAKGQPNIGPKRSMRLWDDKTFIYNENTDGQTRINIEDNGKIEIAFVDRERLLGYRFVGTAEIQTEGAYYEAAKKWAQGRMGVPKAVGIIHVERIFNLQSGANAGKEINSESN

SEQ ID NO: 799 - DNA, 3165 bp, Streptococcus agalactiae
atgacaaaaaaacatcttaaaacgcttgccttggcacttactacagtatcagtagtgacatacagccaggaggtatatggattagaaagagaggaatcggtcaaacaagaacaaacccagtcagcttcagaagatgattggttcgaagaagataatgagaggaaaacaaatgtttctaaagagaattctactgttgatgaaacagttagtgatttattttctgatggaaatagtaataactctagttctaaaaccgagtcagtggtaagtgaccctaaacaagtccccaaagcaaaaccagaggttacacaagaagcaagcaattctagtaatgatgctagcaaagtagaagtaccaaaacaggatacagcttcaaaaaaggaaactctagaaacatcaacttgggaggcaaaagatttcgtaactagaggggatactttagtaggtttttcaaaatctggaattaataagttatctcaaacatcacacttggttttaccaagtcatgcagcagatggaactcaattgacacaagtagctagctttgcttttactccagataaaaagacggccattgcagaatatacaagtaggctaggagaaaatgggaaaccgagtcgtttagatattgatcagaaggaaattattgatgagggagaaatatttaatgcttaccagttgactaagcttactattccaaatggttataagtctattggtcaagatgcttttgtggacaataagaatattgctgaggttaaccttcctgagagtctcgagactatttcagactatgcttttgctcacatgtctttaaaacaagtaaagttaccagataacctaaaggtcattggagaattagctttttttgataatcagattggtggtaagctttacttgccacgtcacttgataaaattagcagaacgcgctttcaaatctaatcgtattcaaacagttgaatttttgggaagtaagcttaaggttataggagaagcaagttttcaagataataatctgaggaatgttatgcttccggatggacttgaaaaaatagaatcagaagcttttacaggaaatccaggagatgaacattacaacaatcaggttgtattgcgcacaaggacaggccaaaatccacatcaacttgcgactgagaatacttacgtcaatccggacaaatcattgtggcgtgcaacacctgatatggattataccaaatggttagaggaagattttacctatcaaaaaaatagtgttacaggtttttcaaataaaggcttacaaaaggtaagacgtaataaaaacttagaaattccaaaacaacacaatggtattactattactgaaattggtgataacgcttttcgcaatgttgattttcaaagtaaaactttacgtaaatatgatttggaagaaataaagctcccctcaactattcggaaaataggtgcttttgcttttcaatctaataacttgaaatcctttgaagcaagtgaagatttagaagagattaaagagggagcctttatgaataatcgtattggaactctagacttgaaagacaaacttatcaaaataggtgatgctgctttccatattaatcatatttatgccattgttcttccagaatctgtacaagaaataggacgttcagcttttcgacaaaatggtgcgcttcaccttatgtttatcggaaataaggttaaaacaattggtgaaatggcttttttatccaataaactggaaagtgtaaatctctctgagcaaaaacaattaaagacaattgaggtccaagctttttcggataatgcccttagtgaagtagtcttaccgccaaatttacagactattcgtgaagaggctttcaaaaggaatcatttgaaagaagtgaagggttcatctacattatctcagattacttttaatgcttttgatcaaaatgatggggacaaacgctttggtaagaaagtggttgttaggacacataataattctcatatgttagcagatggtgagcgttttatcattgatccagataagctatcttctacaatggtagaccttgaaaaggttttaaaaataatcgaaggtttagattactctacattacgtcagactactcaaactcagtttagagaaatgactactgcaggtaaagcgttgttatcaaaatctaacctccgacaaggagaaaaacaaaaattccttcaagaagcacaatttttccttggtcgcgttgatttggataaagccatagctaaagctgagaaggctttagtgaccaagaaggcaacaaagaatggtcatttgcttgagaggagtattaacaaagcggtattagcttataataatagtgctattaaaaaagctaatgttaagcgcttggaaaaagagttagacttgctgacggatttagtcgagggaaaaggaccattagcgcaagctacaatggtacaaggagtttatttattaaagacgcctttaccattgccagaatattatatcggattgaacgtttattttgacaagtctggaaaattgatttatgcacttgatatgagtgatactattggcgagggacaaaaagatgcatatggtaatcctatattaaatgttgacgaggataatgaaggttatcataccttggcagttgccactttagctgattatgaaggtctttatattaaagatattttaaatagttcccttgataagattaaagcaatacgccagattcctttggcaaaatatcatagattaggaattttccaagctattcgaaatgcagcggcagaagcagaccgattgcttcctaagacacctaaggggtacctaaatgaagtcccaaattatcgtaaaaaacaagtggagaaaaatttaaaaccagttgattataaaacgccgatttttaataaggctttacctaatgaaaaggtagacggtgatagagcggctaaaggtcataatataaatgcggagactaataattctgtagctgtaacaccaataaggtccgagcagcaattacataagtcacagtctgatgtaaatttacctcaaacaagttctaaaaataattttatatacgagattctaggatacgttagtttatgtttgcttttcctagtaactgctgggaaaaaaggaaaacgagcaagaaaa

SEQ ID NO: 800 - protein, 1055 aa, Streptococcus agalactiae
MTKKHLKTLALALTTVSVVTYSQEVYGLEREESVKQEQTQSASEDDWFEEDNERKTNVSKENSTVDETVSDLFSDGNSNNSSSKTESVVSDPKQVPKAKPEVTQEASNSSNDASKVEVPKQDTASKKETLETSTWEAKDFVTRGDTLVGFSKSGINKLSQTSHLVLPSHAADGTQLTQVASFAFTPDKKTAIAEYTSRLGENGKPSRLDIDQKEIIDEGEIFNAYQLTKLTIPNGYKSIGQDAFVDNKNIAEVNLPESLETISDYAFAHMSLKQVKLPDNLKVIGELAFFDNQIGGKLYLPRHLIKLAERAFKSNRIQTVEFLGSKLKVIGEASFQDNNLRNVMLPDGLEKIESEAFTGNPGDEHYNNQVVLRTRTGQNPHQLATENTYVNPDKSLWRATPDMDYTKWLEEDFTYQKNSVTGFSNKGLQKVRRNKNLEIPKQHNGITITEIGDNAFRNVDFQSKTLRKYDLEEIKLPSTIRKIGAFAFQSNNLKSFEASEDLEEIKEGAFMNNRIGTLDLKDKLIKIGDAAFHINHIYAIVLPESVQEIGRSAFRQNGALHLMFIGNKVKTIGEMAFLSNKLESVNLSEQKQLKTIEVQAFSDNALSEVVLPPNLQTIREEAFKRNHLKEVKGSSTLSQITFNAFDQNDGDKRFGKKVVVRTHNNSHMLADGERFIIDPDKLSSTMVDLEKVLKIIEGLDYSTLRQTTQTQFREMTTAGKALLSKSNLRQGEKQKFLQEAQFFLGRVDLDKAIAKAEKALVTKKATKNGHLLERSINKAVLAYNNSAIKKANVKRLEKELDLLTDLVEGKGPLAQATMVQGVYLLKTPLPLPEYYIGLNVYFDKSGKLIYALDMSDTIGEGQKDAYGNPILNVDEDNEGYHTLAVATLADYEGLYIKDILNSSLDKIKAIRQIPLAKYHRLGIFQAIRNAAAEADRLLPKTPKGYLNEVPNYRKKQVEKNLKPVDYKTPIFNKALPNEKVDGDRAAKGHNINAETNNSVAVTPIRSEQQLHKSQSDVNLPQTSSKNNFIYEILGYVSLCLLFLVTAGKKGKRARK

SEQ ID NO: 801 - DNA, 3024 bp, Streptococcus pyogenes
atgaagaaacatcttaaaacagttgccttgaccctcactacagtatcggtagtcacccacaatcaggaagtttttagtttagtcaaagagccaattcttaaacaaactcaagcttcttcatcgatttctggcgctgactacgcagaaagtagcggtaaaagcaagttaaagattaatgaaacttctggccctgttgatgatacagtcactgacttattttcggataaacgtactactcctgaaaaaataaaagataatcttgctaaaggtccgagagaacaagagttaaaggcagtaacagagaatacagaatcagaaaagcagatcacttctggatctcaactagaacaatcaaaagagtctctttctttaaataaaacagtgccatcaacgtctaattgggagatttgtgattttattactaaggggaatacccttgttggtctttcaaaatcaggtgttgaaaagttatctcaaactgatcatctcgtattgcctagtcaagcagcagatggaactcaattgatacaagtagctagttttgcttttactccagataaaaagacggcaattgcagaatataccagtagggctggagaaaatggggaaataagccaactagatgtggatggaaaagaaattattaacgaaggtgaggtttttaattcttatctactaaagaaggtaacaatcccaactggttataaacatattggtcaagatgcttttgtggacaataagaatattgctgaggttaatcttcctgaaagcctcgagactatttctgactatgcttttgctcacctagctttgaaacagatcgatttgccagataatttaaaagcgattggagaattagctttttttgataatcaaattacaggtaaactttctttgccacgtcagttaatgcgattagcagaacgtgcttttaaatcaaaccatatcaaaacaattgagtttagaggaaatagtctaaaagtgataggggaagctagttttcaagataatgatctgagtcaactaatgctacctgacggtcttgaaaaaatagaatcagaagcttttacaggaaatccaggagatgatcactacaataaccgtgttgttttgtggacaaaatctggaaaaaatccttctggtcttgctactgaaaatacctatgttaatcctgataagtcactatggcaggaaagtcctgagattgattatactaaatggttagaggaagattttacctatcaaaaaaatagtgttacaggtttttcaaataaaggcttacaaaaagtaaaacgtaataaaaacttagaaattccaaaacagcacaatggtgttactattactgaaattggtgataatgcttttcgcaatgttgattttcaaaataaaactttacgtaaatatgatttggaagaagtaaagcttccctcaactattcggaaaataggtgcttttgcttttcaatctaataacttgaaatcttttgaagcaagtgacgatttagaagagattaaagagggagcctttatgaataatcgtattgaaaccttggaattaaaagataaattagttactattggtgatgcggctttccatattaatcatatttatgccattgttcttccagaatctgtacaagaaatagggcgttcagcatttcggcaaaatggtgcaaataatcttatttttatgggaagtaaggttaagaccttaggtgagatggcatttttatcaaatagacttgaacatctggatctttctgagcaaaaacagttaacagagattcctgttcaagccttttcagacaatgccttgaaagaagtattattaccagcatcactgaaaacgattcgagaagaagccttcaaaaagaatcatttaaaacaactggaagtggcatctgccttgtcccatattgcttttaatgctttagatgataatgatggtgatgaacaatttgataataaagtggttgttaaaacgcatcataattcctacgcactagcagatggtgagcattttatcgttgatccagataagttatcttctacaatagtagaccttgaaaagattttaaaactaatcgaaggtttagattattctacattacgtcagactactcaaactcagtttagagacatgactactgcaggtaaagcgttgttgtcaaaatctaacctccgacaaggagaaaaacaaaaattccttcaagaagcacaatttttccttggccgcgttgatttggataaagccatagctaaagctgagaaggctttagtgaccaagaaggcaacaaagaatggtcagttgcttgaaagaagtattaacaaagcggtattagcttataataatagcgctattaaaaaagctaatgttaagcgcttggaaaaagagttagacttgctaacaggattagttgagggaaaaggaccattagcgcaagctacaatggtacaaggagtttatttattaaagacgcctttgccattgccagaatattatatcggattgaacgtttattttgacaagtctggaaaattgatttatgcacttgatatgagtgatactattggcgagggacaaaaagacgcttatggtaatcctatattaaatgttgacgaggataatgaaggttatcatgccttggcagttgccactttagctgattatgaggggctcgacatcaaaacaattttaaatagtaagcttagtcaattaacatctattcgtcaggtaccgactgcagcctatcatagagccggtattttccaagctatccaaaatgcagcggcagaagcagagcagttattgcctaaaccaggtacgcactctgagaagtcaagctcaagtgaatctgctaactctaaagatagaggattgcaatcaaacccaaaaacgaatagaggacgacactctgcaatattgcctaggacagggtcaaaaggcagctttgtctatggaatcttaggttacactagcgttgctttactgtcactaataactgctataaaaaagaaaaaatat

SEQ ID NO: 802 - protein, 1008 aa, Streptococcus pyogenes
MKKHLKTVALTLTTVSVVTHNQEVFSLVKEPILKQTQASSSISGADYAESSGKSKLKINETSGPVDDTVTDLFSDKRTTPEKIKDNLAKGPREQELKAVTENTESEKQITSGSQLEQSKESLSLNKTVPSTSNWEICDFITKGNTLVGLSKSGVEKLSQTDHLVLPSQAADGTQLIQVASFAFTPDKKTAIAEYTSRAGENGEISQLDVDGKEIINEGEVFNSYLLKKVTIPTGYKHIGQDAFVDNKNIAEVNLPESLETISDYAFAHLALKQIDLPDNLKAIGELAFFDNQITGKLSLPRQLMRLAERAFKSNHIKTIEFRGNSLKVIGEASFQDNDLSQLMLPDGLEKIESEAFTGNPGDDHYNNRVVLWTKSGKNPSGLATENTYVNPDKSLWQESPEIDYTKWLEEDFTYQKNSVTGFSNKGLQKVKRNKNLEIPKQHNGVTITEIGDNAFRNVDFQNKTLRKYDLEEVKLPSTIRKIGAFAFQSNNLKSFEASDDLEEIKEGAFMNNRIETLELKDKLVTIGDAAFHINHIYAIVLPESVQEIGRSAFRQNGANNLIFMGSKVKTLGEMAFLSNRLEHLDLSEQKQLTEIPVQAFSDNALKEVLLPASLKTIREEAFKKNHLKQLEVASALSHIAFNALDDNDGDEQFDNKVVVKTHHNSYALADGEHFIVDPDKLSSTIVDLEKILKLIEGLDYSTLRQTTQTQFRDMTTAGKALLSKSNLRQGEKQKFLQEAQFFLGRVDLDKAIAKAEKALVTKKATKNGQLLERSINKAVLAYNNSAIKKANVKRLEKELDLLTGLVEGKGPLAQATMVQGVYLLKTPLPLPEYYIGLNVYFDKSGKLIYALDMSDTIGEGQKDAYGNPILNVDEDNEGYHALAVATLADYEGLDIKTILNSKLSQLTSIRQVPTAAYHRAGIFQAIQNAAAEAEQLLPKPGTHSEKSSSSESANSKDRGLQSNPKTNRGRHSAILPRTGSKGSFVYGILGYTSVALLSLITAIKKKKY

SEQ ID NO: 803 - DNA, 2163 bp, Streptococcus agalactiae
atgacacaatcagatgcatatctctcgttgaacgcgaagacacgctttagagatcgcacaggtaattatcattttacttcggataaagaggctgttgaacaatatatgatagaacatgttgaacctaatacgatggtgttcacatcactaattgaaaagctagattatttggtttctaataactactatgaatcggaccttctaaaacaatataaccttgagtttatttgccaaatttttgagcatgcatacgctaagaaatttgcttttctaaattttatgggggctttaaaattttataatgcttatgctcttaaaacagaagacaatcgttattatttggaacactatgaagatcgtgttgtaatgaatgctctgtttttagctgctggtgatgaaaaagctgcctatgacctagtagatgacatgctagcaaatcgctttcaaccagcaacacctacctttttaaatgcagggaaaaaacgtcgtggtgaatatatctcttgctatttgttgcgcattgaagacaatatggaatctatttctcgtgctattagtacaagccttcagttatcaaaacgaggtggtggggtagcactttgcttaaccaacttacgggaatttggtgctccaataaaaggtattaaaaatcaagctactggtattgtacctgtcatgaaattactagaagattcgttttcttacgccaatcaattaggacaaagacaaggagctggtgcagtttacttacacgctcaccatcctgaagtattaacgtttttagatactaaacgtgagaatgccgatgagaaaattcgaattaaatctctttccctaggacttgttattcctgatattacttttgaattggctaaggcaaataaagatatggccttgttttcaccgtatgacattgagcgagtatatggtaaaccaatgtctgatatctctatcacagaagaatatgaaactttattagccaatgcggatattcgtaaaacctttattagtgcacgaaaactatttcaaacgatagcagagcttcattttgaatctggttatccttatatcttatttgaagatactgtaaatgctaaaaaccctcacaaaaaagagggacgaattgttatgtctaatttatgttctgagattgcacaagttaatacagctagtcaattttcagaagacctgactttcactaaggttggacatgatgtttgttgtaatttaggttctattaatattgcgcgtgctatggatcaagcggcggattttgaaaaattaattgctaatagcattagagcccttgatcgtgtatctcgaacttctgatttagatagtgctccatctattaaaaaaggtaatgcagctaatcatgctgttggtttaggtgctatgaatttgcatggatttttggcgactaaccatatttattacgattctcaagaggctattgattttacagattgcttcttttacgctatggcttattatgcctttaaagcttctaaccatttagcaaaagaaaaaggaacctttgagggcttctcggaatcaagttatgctgatggcagttatttctatcaatataccgaacaaaactttgagccaaaaacacagcgtgttaaaaatctactagctgagtatggtctgactctaccaagccaagaggattggagaaagcttgtgcaaagtattaaagagataggattagctaatgcgcatttattagctgttgctccgacagggtcaatcagttatctttcttcttgtactccgagccttcaaccggttgtatcacctgtcgaagtacgcaaggaaggagcactggggagggtttatgtacctgcttataagattgatgcagataattatgtctactacaaaaaaggagcttatgaagtgggatctgaggcgattatcaatattgcagctgccgctcaaaaacacattgatcaagctatttcgttaacgcttttcatgacagatcaagcaactacgcgagatttaaataaagcctatattcaagcatttaaacaaaaatgtgcctctatttattatgtacgagtgagacaggacatcctagaaggtagcgagagttatgatgatatgctggatgatttcacttcatcggacttagaagactgtcaatcctgcatgatt

SEQ ID NO: 804 - protein, 721 aa, Streptococcus agalactiae
MTQSDAYLSLNAKTRFRDRTGNYHFTSDKEAVEQYMIEHVEPNTMVFTSLIEKLDYLVSNNYYESDLLKQYNLEFICQIFEHAYAKKFAFLNFMGALKFYNAYALKTEDNRYYLEHYEDRVVMNALFLAAGDEKAAYDLVDDMLANRFQPATPTFLNAGKKRRGEYISCYLLRIEDNMESISRAISTSLQLSKRGGGVALCLTNLREFGAPIKGIKNQATGIVPVMKLLEDSFSYANQLGQRQGAGAVYLHAHHPEVLTFLDTKRENADEKIRIKSLSLGLVIPDITFELAKANKDMALFSPYDIERVYGKPMSDISITEEYETLLANADIRKTFISARKLFQTIAELHFESGYPYILFEDTVNAKNPHKKEGRIVMSNLCSEIAQVNTASQFSEDLTFTKVGHDVCCNLGSINIARAMDQAADFEKLIANSIRALDRVSRTSDLDSAPSIKKGNAANHAVGLGAMNLHGFLATNHIYYDSQEAIDFTDCFFYAMAYYAFKASNHLAKEKGTFEGFSESSYADGSYFYQYTEQNFEPKTQRVKNLLAEYGLTLPSQEDWRKLVQSIKEIGLANAHLLAVAPTGSISYLSSCTPSLQPVVSPVEVRKEGALGRVYVPAYKIDADNYVYYKKGAYEVGSEAIINIAAAAQKHIDQAISLTLFMTDQATTRDLNKAYIQAFKQKCASIYYVRVRQDILEGSESYDDMLDDFTSSDLEDCQSCMI

SEQ ID NO: 805 - DNA, 2178 bp, Streptococcus pyogenes
atgtcacaaaccaatgcgtcatacctctcattaaatgcactgacccgttttaaaaaaccagacggcagctaccattttgatagcgataaagaagctgttaggcgctacctggaagaacatgtctctcccaatcaaatggcttttaactcactagaagataagctagcttacctcatcaatgaagggtattatgagcaggccatttttgatgcctatcctaatgaccttatcaaggaggcctttcattatgcctatcaacaaggctatcgctttttaaatctcatgggcgctatgaaattttaccagtcctatgccttaaaaaccttggacggtaagcagtatctagaaacatttgaagaccgtgctgtgatgaatgcactctttttagctgatggagatcaaacctttgtctttgacgtgattgatgccatcttgcaccgacgctttcaaccagctaccccaacgtttttaaatgccggaaaaaaacgccgtggcgaatacatttcgtgctatcttcttcgtgtcgaagacaatatggaatctatctctcgcgccattagcaccagcttgcaactctcaaaaagaggaggcggagtcgccttgtgcctcaccaacctcagagaaatcggagcaccgataaaagggattgaaaatcaggcaacaggcatcgttcctgtcatgaaactactagaggactctttttcctatgccaatcaactaggtcagcgccaaggagcaggtgcggtttaccttcatgcccatcaccctgaggttttgacctttttagacaccaaacgtgaaaatgccgatgagaaaattcgcattaagtccctagcattgggacttgtgatcccagatattaccttccagttagccaaagaaaacaaagacatggcactcttttcaccctatgatatcaagcgtgcctatggcaaggacatgtcagacatctccatcacagaggaatacgataaactgctagccaatccagccatcaaaaagacctacatcagtgctagaaagttctttcagttaattgcagagctacattttgagtcaggctacccttacctcttgtttgatgacacggtcaataagcgcaaccctcatgccaaaaaaggcagaatcgtcatgtctaacctgtgttctgaaatcgctcaagttagcaccccaagcactttcaaagaagatttgagttttgaaaccattggagaggatatctgctgtaatttagggtctatcaatattgcccaggctatggcagatgcgccacactttgaacagctcatcacaacgagcatcagagcacttgatcgtgtctctagagtgtctgacctgaattgtgcgccttctgttgagacaggcaatgcagccaaccatgcagtaggattaggcgccatgaacctacatggttttttggcaaccaaccacatctactatgatacaaaagaagccgttgactttacagatctgtttttccatgccatggcctattatgcttttaaagcctcttgccaattagccaaagaaaaaggcgcttttgcaggattttcgttatcaacctattcagatggcacttattttgccaagtatttgcaagaagatgccaagccacaaacagccaaggttgccacattgttgcaagattacggcttcacgttgccaacggtggcggattggcaagccctagtagcagatatcaagcagtttggcctagccaatgcgcacttgctagcggttgctccgacaggctccatcagctacttatcatcctgcactccgagtctacaaccagtcgttgctcctgttgaggtccgaaaagaaggtagcctgggcaggatttacgtccctgcctatcagattgaccaggctaactatgcttactatgaacgtggtgcctatgaggtcggcccaaaagccatcatcgacgttgtagctgctgcccaaaaacacgttgaccaagccatctcattgaccctgtttatgaccgatcaagcgaccacacgtgacctgaaccgctcctatatccaagcttttaagcaaaattgtgcatcgatctattatgtgcgagtgaggcaagacgtcctagcaggcagcgaacagtatgacgaggatagtcttgtgacagctcctggagctagtgatgagaccaccacagagtgtcaaagctgtatgatc

SEQ ID NO: 806 - protein, 726 aa, Streptococcus pyogenes
MSQTNASYLSLNALTRFKKPDGSYHFDSDKEAVRRYLEEHVSPNQMAFNSLEDKLAYLINEGYYEQAIFDAYPNDLIKEAFHYAYQQGYRFLNLMGAMKFYQSYALKTLDGKQYLETFEDRAVMNALFLADGDQTFVFDVIDAILHRRFQPATPTFLNAGKKRRGEYISCYLLRVEDNMESISRAISTSLQLSKRGGGVALCLTNLREIGAPIKGIENQATGIVPVMKLLEDSFSYANQLGQRQGAGAVYLHAHHPEVLTFLDTKRENADEKIRIKSLALGLVIPDITFQLAKENKDMALFSPYDIKRAYGKDMSDISITEEYDKLLANPAIKKTYISARKFFQLIAELHFESGYPYLLFDDTVNKRNPHAKKGRIVMSNLCSEIAQVSTPSTFKEDLSFETIGEDICCNLGSINIAQAMADAPHFEQLITTSIRALDRVSRVSDLNCAPSVETGNAANHAVGLGAMNLHGFLATNHIYYDTKEAVDFTDLFFHAMAYYAFKASCQLAKEKGAFAGFSLSTYSDGTYFAKYLQEDAKPQTAKVATLLQDYGFTLPTVADWQALVADIKQFGLANAHLLAVAPTGSISYLSSCTPSLQPVVAPVEVRKEGSLGRIYVPAYQIDQANYAYYERGAYEVGPKAIIDVVAAAQKHVDQAISLTLFMTDQATTRDLNRSYIQAFKQNCASIYYVRVRQDVLAGSEQYDEDSLVTAPGASDETTTECQSCMI

SEQ ID NO: 807 - DNA, 411 bp, Streptococcus agalactiae
atggatagtacagtgaaggtggtctatttttcatcgaaatctaacaatacccatcgttttgttcaaaagttggcttgttctaaccagcgtattccatcagatggtagtagtatattggttactgaggattatattttgattgtgcctacttacgctggaggaggagatgataccaaaggcgcagttccaaaacaagttgtacagtttttaaatgttcgacaaaatcgggaacattgccaaggggttatttcttctggaaataccaattttggtgacacttatgccattgctggacctattattgctcgaaaattaaatgttcctttgcttcatcaatttgaattactgggaacacaagaagatgttacaagggtaaaggagttactttgccaattcactagaaaggataaa

SEQ ID NO: 808 - protein, 137 aa, Streptococcus agalactiae
MDSTVKVVYFSSKSNNTHRFVQKLACSNQRIPSDGSSILVTEDYILIVPTYAGGGDDTKGAVPKQVVQFLNVRQNREHCQGVISSGNTNFGDTYAIAGPIIARKLNVPLLHQFELLGTQEDVTRVKELLCQFTRKDK

SEQ ID NO: 809 - DNA, 486 bp, Streptococcus pyogenes
atggcagagctgattattgtgtatttttcatctaagtccaataacacccatcgcttcgtccaaaaattaggcctgcctgctcagcgcataccagtagataataggccacttgaagtttccacccattaccttttgattgtgcctacctatgcagctggtggctcagatgccaaaggagccgtttctaaacaagtgattcgttttttgaataatcctaacaatcgtaaacattgtaagggagtgatttcttctggaaataccaattttggcgatacctttgccttagcaggccctatcatttctcaaaaattgcaggtccccttattacaccaatttgaactattaggcactgctacagatgtcaaaaaggtacaggcgatttttgcccgcttaaagcatcacacacacgacaagcaaaaacaaaccaacaacctgattacagaaaggacacacccatgtcacaaaccaatgcgtcatacctctcat

SEQ ID NO: 810 - protein, 162 aa, Streptococcus pyogenes
MAELIIVYFSSKSNNTHRFVQKLGLPAQRIPVDNRPLEVSTHYLLIVPTYAAGGSDAKGAVSKQVIRFLNNPNNRKHCKGVISSGNTNFGDTFALAGPIISQKLQVPLLHQFELLGTATDVKKVQAIFARLKHHTHDKQKQTNNLITERTHPCHKPMRHTSH

SEQ ID NO: 811 - DNA, 1008 bp, Streptococcus agalactiae
atgcaatcatactatgatcgttctcaatcgccacttgactatgccttgtcagaaaaagcttttcctatgcgttctgttaattggaataagctaaacgatgacaaagacttagaggtatggaacagagtaactcaaaatttctggttacctgaaaagatcccagtttctaatgaccttaattcttggagaacattggatgctgattggcagcaattaattactcggacttttactggtctaaccttattagattctgtgcaggctactgttggtgatattgctcagattaagcattctcagacagatcatgaacaagttatttatgctaactttgcctttatggtagctattcatgcgcgatcttatggaacgattttttcaaccttatgcactagccaacaaattgaggaagcacatgaatgggtagtggatactgaaagtctacaagctcgatcacgtatacttattcctttttatactggtgacgatcctttgaaatctaaggttgctgcagccatgatgccaggatttttgttatatggtggcttttaccttcctttttacctttcagccagaggaaaattaccaaatacgtctgatattattcgtttaattttacgagataaggtaattcataactattacagtggctataagtatcaacagaaagttgctaaattatctgtagaaaagcaagccgaaatgaagacatttgtctttgacctcctctatcagttgattgatttagaaaaagcctatctttacgaactatatgatggttttgatttggctgaagatgcaatcagatttagcatttacaatgctggtaaatttttacaaaatttaggatatgattctccatttacagaagaagagactcgtatatctcctgaggtttttgcacaactttcggcgcgtgcagatgaaaatcatgatttcttctcaggaaacggctcttcatatattatggggattacagaagaaacattggatgaagattgggagttt

SEQ ID NO: 812 - protein, 336 aa, Streptococcus agalactiae
MQSYYDRSQSPLDYALSEKAFPMRSVNWNKLNDDKDLEVWNRVTQNFWLPEKIPVSNDLNSWRTLDADWQQLITRTFTGLTLLDSVQATVGDIAQIKHSQTDHEQVIYANFAFMVAIHARSYGTIFSTLCTSQQIEEAHEWVVDTESLQARSRILIPFYTGDDPLKSKVAAAMMPGFLLYGGFYLPFYLSARGKLPNTSDIIRLILRDKVIHNYYSGYKYQQKVAKLSVEKQAEMKTFVFDLLYQLIDLEKAYLYELYDGFDLAEDAIRFSIYNAGKFLQNLGYDSPFTEEETRISPEVFAQLSARADENHDFFSGNGSSYIMGITEETLDEDWEF

SEQ ID NO: 813 - DNA, 1011 bp, Streptococcus pyogenes
atgacccaacattattatgaacgttcgcaatccccaattgaatacgccctatctgaaacacaaaaacagttgcgctccatcaattggaattaccttaatgatgacaaagatttagaagtgtggaaccgtgtcactcaaaatttttggttgcctgaaaaggttcctgtttctaatgatttaaattcttggcgctccttgggtgaggattggcaacagctcatcacaaggacctacactgggttgaccttactagatacagtacaagcaacggttggtgatgtggcacaaattcagcattcacaaaccgaccacgaacaagtcatctatacgaactttgcctttatggtggggattcatgcccgctcttacgggacgattttttcgaccctttgcagcagcgagcaaatcgaagaagcacatgaatgggtggtctcaacacagagcttgcaagaccgtgcccgtgtcttgattccttactatacgggtgatgaccctttgaaatcaaaagtagcagcagctatgatgccaggatttttgctgtatggcggcttttaccttcctttttacctatcagcacgtggtaaaatgccaaacacatctgatatcatccgcctgattttacgcgacaaagttattcacaactattacagcggttacaaataccaacaaaaagtagcacgtcttagcccagaaaaacaggctgaaatgaaggcctttgtctttgacttgctctatgaactcatcgaccttgaaaaagcttacttgagagaactgtatgcaggctttgatttggcagaagatgctatccgttttagcctttataacgctggaaaattccttcaaaatttaggctatgagtcgcccttcacagatgaagaaacgcgcgtttcaccagaagtatttgctcagctatcagcgcgtgcagacgaaaaccatgactttttctcaggcaatggctcatcttatgtgatggggatcaccgaagaaaccacagatgacgattgggagttt

SEQ ID NO: 814 - protein, 337 aa, Streptococcus pyogenes
MTQHYYERSQSPIEYALSETQKQLRSINWNYLNDDKDLEVWNRVTQNFWLPEKVPVSNDLNSWRSLGEDWQQLITRTYTGLTLLDTVQATVGDVAQIQHSQTDHEQVIYTNFAFMVGIHARSYGTIFSTLCSSEQIEEAHEWVVSTQSLQDRARVLIPYYTGDDPLKSKVAAAMMPGFLLYGGFYLPFYLSARGKMPNTSDIIRLILRDKVIHNYYSGYKYQQKVARLSPEKQAEMKAFVFDLLYELIDLEKAYLRELYAGFDLAEDAIRFSLYNAGKFLQNLGYESPFTDEETRVSPEVFAQLSARADENHDFFSGNGSSYVMGITEETTDDDWEF

SEQ ID NO: 815 - DNA, 915 bp, Streptococcus agalactiae
ttgatagcaatgaaaacgataaaagattggcaaataaatatttgcttagcgacctataatggtcaaaaataccttcgccagcaattagatagcataatacaacaaggttatactgactggatttgtttaataagggacgatggatctactgatgatacagtagctattattaaagaatatgttaatagagattcacgttttatatttattaattctaacgatgacagaaagttaggaagtcaccgcagtttttacgagttggttaactataaaaaagcagatttttatgttttctcagaccaggatgatgtttggaaagaaaatcgtttagaacgttaccttgaagaagcagagaaatttaaccaagaactaccattgcttgtttattcgaactggacttctgtagatgaaaaattaacagtattgaaagaacataatccagcaacagttattcaagaacaaattgcctttaaccaaataaatggtatggttatcatgatgaatcatgagttagcaaagctttgggaatatcgtcaaattggcgcccatgattcttatgttggaactctagcttacgccgttggaaatgtggcttatatttctgacagtacagtcctttggcgtagacaagtaggggcagagtcgctaaacaattacgggagacaatatggggtggctacgttttggcagatgataaatacttcttttgatcgtgcttcgcttatttttgctcaagtatccgataaaatgtccctggagcgtaaactcttctttagtcgttttatagaattaaaaaatgccaatctaatgagaaggatttatcttttatcaaaattaaaactccgtcggaaatcattgaaagaaacagttgctatgactatcctacttttaacaggttacggtaaaccaaaagca

SEQ ID NO: 816 - protein, 305 aa, Streptococcus agalactiae
MIAMKTIKDWQINICLATYNGQKYLRQQLDSIIQQGYTDWICLIRDDGSTDDTVAIIKEYVNRDSRFIFINSNDDRKLGSHRSFYELVNYKKADFYVFSDQDDVWKENRLERYLEEAEKFNQELPLLVYSNWTSVDEKLTVLKEHNPATVIQEQIAFNQINGMVIMMNHELAKLWEYRQIGAHDSYVGTLAYAVGNVAYISDSTVLWRRQVGAESLNNYGRQYGVATFWQMINTSFDRASLIFAQVSDKMSLERKLFFSRFIELKNANLMRRIYLLSKLKLRRKSLKETVAMTILLLTGYGKPKA

SEQ ID NO: 817 - DNA, 930 bp, Streptococcus pyogenes
atgaacattaatattttactatccacctacaatggagaacgcttcttagcagaacaaattcaaagtatccaaaggcaaacagttaacgactggaccttattgattagagatgatggttcaactgatggcacccaggatattattcgcacatttgtcaaggaagacaaacgaattcagtggatcaatgaggggcagacagaaaatctgggagttattaagaatttttacaccctcttaaagcaccaaaaagcagatgtctattttttcagtgaccaagatgatatatggttagacaataaactggaagtgaccttattggaggctcaaaaacatgaaatgacagctcctttattggtttatacagacctcaaagtggtaacccaacatttagctgtttgccatgacagtatgattaagacccaatctggtcatgcaaacacaagcctacttcaagaattaaccgaaaataccgtaacaggcggcacaatgatgattactcatgctctggctgaggaatggaccacttgtgacggtttattgatgcatgactggtatttagctttactagcttctgctattgggaaattagtttaccttgatattccaacagaattataccgtcagcacgatgctaacgtgttgggagctagaacttggtctaaacgcatgaaaaattggttaaccccccatcatttagtcaacaaatattggtggttgattacttcaagccaaaaacaggctcaattactattagatttaccattaaaaccaaatgaccatgaattggtaacggcctatgtttctttattggatatgccttttaccaaacgcttagctaccttgaaaaggtacggttttagaaaaaatcgcatctttcacacctttatttttcgtagtttagttgttaccttatttggttacaggagaaag

SEQ ID NO: 818 - protein, 310 aa, Streptococcus pyogenes
MNINILLSTYNGERFLAEQIQSIQRQTVNDWTLLIRDDGSTDGTQDIIRTFVKEDKRIQWINEGQTENLGVIKNFYTLLKHQKADVYFFSDQDDIWLDNKLEVTLLEAQKHEMTAPLLVYTDLKVVTQHLAVCHDSMIKTQSGHANTSLLQELTENTVTGGTMMITHALAEEWTTCDGLLMHDWYLALLASAIGKLVYLDIPTELYRQHDANVLGARTWSKRMKNWLTPHHLVNKYWWLITSSQKQAQLLLDLPLKPNDHELVTAYVSLLDMPFTKRLATLKRYGFRKNRIFHTFIFRSLVVTLFGYRRK

SEQ ID NO: 819 - DNA, 3717 bp, Streptococcus agalactiae
ttggaggaaataggaaaagtggataaacatcactcaaaaaaggctattttaaagttaacacttataacaactagtattttattaatgcatagcaatcaagtgaatgcagaggagcaagaattaaaaaaccaagagcaatcacctgtaattgctaatgttgctcaacagccatcgccatcggtaactactaatactgttgaaaaaacatctgtaacagctgcttctgctagtaatacagcgaaagaaatgggtgatacatctgtaaaaaatgacaaaacagaagatgaattattagaagagttatctaaaaaccttgatacgtctaatttgggggctgatcttgaagaagaatatccctctaaaccagagacaaccaacaataaagaaagcaatgtagtaacaaatgcttcaactgcaatagcacagaaagttccctcagcatatgaagaggtgaagccagaaagcaagtcatcgcttgctgttcttgatacatctaaaataacaaaattacaagccataacccaaagaggaaagggaaatgtagtagctattattgatactggctttgatattaaccatgatatttttcgtttagatagcccaaaagatgataagcacagctttaaaactaagacagaatttgaggaattaaaagcaaaacataatatcacttatgggaaatgggttaacgataagattgtttttgcacataactacgccaacaatacagaaacggtggctgatattgcagcagctatgaaagatggttatggttcagaagcaaagaatatttcgcatggtacacacgttgctggtatttttgtaggtaatagtaaacgtccagcaatcaatggtcttcttttagaaggtgcagcgccaaatgctcaagtcttattaatgcgtattccagataaaattgattcggacaaatttggtgaagcatatgctaaagcaatcacagacgctgttaatctaggagcaaaaacgattaatatgagtattggaaaaacagctgattctttaattgctctcaatgataaagttaaattagcacttaaattagcttctgagaagggcgttgcagttgttgtggctgccggaaatgaaggcgcatttggtatggattatagcaaaccattatcaactaatcctgactacggtacggttaatagtccagctatttctgaagatactttgagtgttgctagctatgaatcacttaaaactatcagtgaggtcgttgaaacaactattgaaggtaagttagttaagttgccgattgtgacttctaaaccttttgacaaaggtaaggcctacgatgtggtttatgccaattatggtgcaaaaaaagactttgaaggtaaggactttaaaggtaagattgcattaattgagcgtggtggtggacttgattttatgactaaaatcactcatgctacaaatgcaggtgttgttggtatcgttatttttaacgatcaagaaaaacgtggaaattttctaattccttaccgtgaattacctgtggggattattagtaaagtagatggcgagcgtataaaaaatacttcaagtcagttaacatttaaccagagttttgaagtagttgatagccaaggtggtaatcgtatgctggaacaatcaagttggggcgtgacagctgaaggagcaatcaagcctgatgtaacagcttctggctttgaaatttattcttcaacctataataatcaataccaaacaatgtctggtacaagtatggcttcaccacatgttgcaggattaatgacaatgcttcaaagtcatttggctgagaaatataaagggatgaatttagattctaaaaaattgctagaattgtctaaaaacatcctcatgagctcagcaacagcattatatagtgaagaggataaggcgttttattcaccacgtcagcaaggtgcaggtgtagttgatgctgaaaaagctatccaagctcaatattatattactggaaacgatggcaaagctaaaattaatctcaaacgaatgggagataaatttgatatcacagttacaattcataaacttgtagaaggtgtcaaagaattgtattatcaagctaatgtagcaacagaacaagtaaataaaggtaaatttgcccttaaaccacaagccttgctagatactaattggcagaaagtaattcttcgtgataaagaaacacaagttcgatttactattgatgctagtcaatttagtcagaaattaaaagaacagatggcaaatggttatttcttagaaggttttgtacgttttaaagaagccaaggatagtaatcaggagttaatgagtattccttttgtaggatttaatggtgattttgcgaacttacaagcacttgaaacaccgatttataagacgctttctaaaggtagtttctactataaaccaaatgatacaactcataaagaccaattggagtacaatgaatcagctccttttgaaagcaacaactatactgccttgttaacacaatcagcgtcttggggctatgttgattatgtcaaaaatggtggggagttagaattagcaccggagagtccaaaaagaattattttaggaacttttgagaataaggttgaggataaaacaattcatcttttggaaagagatgcagcgaataatccatattttgccatttctccaaataaagatggaaatagggacgaaatcactccccaggcaactttcttaagaaatgttaaggatatttctgctcaagttctagatcaaaatggaaatgttatttggcaaagtaaggttttaccatcttatcgtaaaaatttccataataatccaaagcaaagtgatggtcattatcgtatggatgctcttcagtggagtggtttagataaggatggcaaagttgtagcagatggtttttatacttatcgcttacgttacacaccagtagcagaaggagcaaatagtcaggagtcagactttaaagtacaagtaagtactaagtcaccaaatcttccttcacgagctcagtttgatgaaactaatcgaacattaagcttagccatgcctaaggaaagtagttatgttcctacatatcgtttacaattagttttatctcatgttgtaaaagatgaagaatatggggatgagacttcttaccattatttccatatagatcaagaaggtaaagtgacacttcctaaaacggttaagataggagagagtgaggttgcggtagaccctaaggccttgacacttgttgtggaagataaagctggtaatttcgcaacggtaaaattgtctgatctcttgaataaggcagtagtatcagagaaagaaaacgctatagtaatttctaacagtttcaaatattttgataacttgaaaaaagaacctatgtttatttctaaaaaagaaaaagtagtaaacaagaatctagaagaaataatattagttaagccgcaaactacagttactactcaatcattgtctaaagaaataactaaatcaggaaatgagaaagtcctcacttctacaaacaataatagtagcagagtagctaagatcatatcacctaaacataacggggattctgttaaccataccttacctagtacatcagatagagcaacgaatggtctatttgttggtactttggcattgttatctagtttacttctttatttgaaacccaaaaagactaaaaataatagtaaa

SEQ ID NO: 820 - protein, 1239 aa, Streptococcus agalactiae
MEEIGKVDKHHSKKAILKLTLITTSILLMHSNQVNAEEQELKNQEQSPVIANVAQQPSPSVTTNTVEKTSVTAASASNTAKEMGDTSVKNDKTEDELLEELSKNLDTSNLGADLEEEYPSKPETTNNKESNVVTNASTAIAQKVPSAYEEVKPESKSSLAVLDTSKITKLQAITQRGKGNVVAIIDTGFDINHDIFRLDSPKDDKHSFKTKTEFEELKAKHNITYGKWVNDKIVFAHNYANNTETVADIAAAMKDGYGSEAKNISHGTHVAGIFVGNSKRPAINGLLLEGAAPNAQVLLMRIPDKIDSDKFGEAYAKAITDAVNLGAKTINMSIGKTADSLIALNDKVKLALKLASEKGVAVVVAAGNEGAFGMDYSKPLSTNPDYGTVNSPAISEDTLSVASYESLKTISEVVETTIEGKLVKLPIVTSKPFDKGKAYDVVYANYGAKKDFEGKDFKGKIALIERGGGLDFMTKITHATNAGVVGIVIFNDQEKRGNFLIPYRELPVGIISKVDGERIKNTSSQLTFNQSFEVVDSQGGNRMLEQSSWGVTAEGAIKPDVTASGFEIYSSTYNNQYQTMSGTSMASPHVAGLMTMLQSHLAEKYKGMNLDSKKLLELSKNILMSSATALYSEEDKAFYSPRQQGAGVVDAEKAIQAQYYITGNDGKAKINLKRMGDKFDITVTIHKLVEGVKELYYQANVATEQVNKGKFALKPQALLDTNWQKVILRDKETQVRFTIDASQFSQKLKEQMANGYFLEGFVRFKEAKDSNQELMSIPFVGFNGDFANLQALETPIYKTLSKGSFYYKPNDTTHKDQLEYNESAPFESNNYTALLTQSASWGYVDYVKNGGELELAPESPKRIILGTFENKVEDKTIHLLERDAANNPYFAISPNKDGNRDEITPQATFLRNVKDISAQVLDQNGNVIWQSKVLPSYRKNFHNNPKQSDGHYRMDALQWSGLDKDGKVVADGFYTYRLRYTPVAEGANSQESDFKVQVSTKSPNLPSRAQFDETNRTLSLAMPKESSYVPTYRLQLVLSHVVKDEEYGDETSYHYFHIDQEGKVTLPKTVKIGESEVAVDPKALTLVVEDKAGNFATVKLSDLLNKAVVSEKENAIVISNSFKYFDNLKKEPMFISKKEKVVNKNLEEIILVKPQTTVTTQSLSKEITKSGNEKVLTSTNNNSSRVAKIISPKHNGDSVNHTLPSTSDRATNGLFVGTLALLSSLLLYLKPKKTKNNSK

SEQ ID NO: 821 - DNA, 3543 bp, Streptococcus pyogenes
ttgcgtaaaaaacaaaaattaccatttgataaacttgccattgcgctcatgtctacgagcatcttgctcaatgcacaatcagacattaaagcaaatactgtgacagaagacactcctgctaccgaacaagctgtagaaaccccacaaccaacagcggtttctgaggaagcaccatcatcaaaggaaaccaaaaccccacaaactcctgatgacgcagaagaaacaatagcagatgacgctaatgatctagcccctcaagctcctgctaaaactgctgatacaccagcaacctcaaaagcgactattagggatttgaacgacccttctcaggtcaaaaccctgcaggaaaaagcaggcaaaggagctgggactgttgttgcagtgattgatgctggttttgataaaaatcatgaagcgtggcgcttaacagacaaaaccaaagcacgttaccaatcaaaagaagatcttgaaaaagctaaaaaagagcacggtattacctatggcgagtgggtcaatgataaggttgcttattaccacgactatagtaaagatggtaaaaccgctgtcgatcaagagcacggcacacacgtgtcagggatcttgtcaggaaatgctccatctgaaacgaaagaaccttaccgcctagaaggtgcgatgcctgaggctcaattgcttttgatgcgtgtcgaaattgtaaatggactagcagactatgctcgtaactacgctcaagctatcatagatgctgtcaacttgggagctaaggtgattaatatgagctttggtaatgctgcactagcctatgccaaccttccagacgaaaccaaaaaagcctttgactatgccaaatcaaaaggtgttagcattgtgacctcagctggtaatgatagtagctttgggggcaagacccgtctacctctagcagatcatcctgattatggggtggttgggacacctgcagcggcagactcaacattgacagttgcttcttacagcccagataaacagctcactgaaactgctacggtcaaaacagccgatcagcaagataaagaaatgcctgttctttcaacaaaccgttttgagccaaacaaggcttacgactatgcttatgctaatcgtgggatgaaagaggatgattttaaggatgtcaaaggtaagattgcccttattgaacgtggcgatattgatttcaaagataagattgcaaacgctaaaaaagctggtgctgtaggagtcttgatctatgacaatcaggacaagggcttcccgattgaattgccaaatgttgatcagatgcctgcggcctttatcagtcgaaaagatggtctcttattaaaagagaatccccaaaaaaccatcaccttcaatgcgacacctaaggtattgccaacagcaagtggcaccaaactaagccgcttctcaagctggggtctgacagctgacggcaatattaagccagatattgcagcacccggccaagatattttgtcatcagtggctaacaacaagtatgccaaactttctggaactagtatgtctgcgccattagtagcgggtatcatgggactgttgcaaaagcaatatgagacacagtatcctgatatgacaccatcagagcgtcttgatttagctaaaaaagtattgatgagctcagcaactgccttatatgatgaagatgaaaaagcttatttttctcctcgccaacaaggagcaggagcagtcgatgctaaaaaagcttcagcagcaacgatgtatgtgacagataaggataatacctcaagcaaggttcacctgaacaatgtttctgataaatttgaagtaacagtaacagttcacaacaaatctgataaacctcaagagttgtattaccaagcaactgttcaaacagataaagtagatggaaaactctttgccttggctcctaaagcattgtatgagacatcatggcaaaaaatcacaattccagccaatagcagcaaacaagtcaccattccaatcgatgttagtcaatttagcaaggacttgcttgccccaatgaaaaatggctatttcttagaaggttttgttcgtttcaaacaagatcctacaaaagaagagcttatgagtattccctatattggtttccgaggtgattttggcaatctgtcagccttagaaaaaccaatctatgatagcaaagacggtagcagctactatcatgaagcaaatagtgatgccaaagaccaattagatggtgatggattacagttttacgctctgaaaaataactttacagcacttactacagagtctaatccatggacgattattaaagctgtcaaagaaggggttgaaaacatagaggatatcgaatcttcagagatcacagaaaccatttttgcaggtacttttgcaaaacaagacgatgatagccactactatatccaccgtcacgctaatggcaagccatatgctgcgatctctccaaatggggacggtaacagagattatgtccaattccaaggtactttcttgcgtaatgctaaaaaccttgtggctgaagtcttggacaaagaaggaaatgttgtttggacaagtgaggtaaccgagcaagttgttaaaaactacaacaatgacttggcaagcacacttggttcaacccgttttgaaaaaacgcgttgggacggtaaagataaagacggcaaagttgttgctaacggaacatacacctatcgtgttcgctacactccgattagctcaggtgcaaaagaacaacacactgattttgatgtgattgtagacaatacgacacctgaagtcgcaacatcggcaacattctcaacagaagatcgtcgtttgacacttgcatctaaaccaaaaaccagccaaccggtttaccgtgagcgtattgcttacacttatatggatgaggatctgccaacaacagagtatatttctccaaatgaagatggtacctttactcttcctgaagaggctgaaacaatggaaggcgctactgttccattgaaaatgtcagactttacttatgttgttgaagatatggctggtaacatcacttatacaccagtgactaagctattggaaggccactctaataaaccagaacaagacggttcagatcaagcaccagacaaaaaaccagaaactaaaccagaacaagacggttcaggtcaagcaccagataaaaaaccagaaactaaaccagaacaagacggttcaggtcaaacaccagacaaaaaaccagaaactaaaccagaacaagacggttcaggtcaaacaccagataaaaaaccagaaactaaaccagaaaaagatagttcaggtcaaacaccaggtaaaactcctcaaaaaggtcaaccttctcgtactctagagaaacgatcttctaagcgtgctttagctacaaaagcatcaacaaaagatcagttaccaacgactaatgacaaggatacaaatcgtttacatctccttaagttagttatgaccactttcttcttgggattagtagctcatatctttaaaacaaaacgcactgaagat

SEQ ID NO: 822 - protein, 1181 aa, Streptococcus pyogenes
LRKKQKLPFDKLAIALMSTSILLNAQSDIKANTVTEDTPATEQAVETPQPTAVSEEAPSSKETKTPQTPDDAEETIADDANDLAPQAPAKTADTPATSKATIRDLNDPSQVKTLQEKAGKGAGTVVAVIDAGFDKNHEAWRLTDKTKARYQSKEDLEKAKKEHGITYGEWVNDKVAYYHDYSKDGKTAVDQEHGTHVSGILSGNAPSETKEPYRLEGAMPEAQLLLMRVEIVNGLADYARNYAQAIIDAVNLGAKVINMSFGNAALAYANLPDETKKAFDYAKSKGVSIVTSAGNDSSFGGKTRLPLADHPDYGVVGTPAAADSTLTVASYSPDKQLTETATVKTADQQDKEMPVLSTNRFEPNKAYDYAYANRGMKEDDFKDVKGKIALIERGDIDFKDKIANAKKAGAVGVLIYDNQDKGFPIELPNVDQMPAAFISRKDGLLLKENPQKTITFNATPKVLPTASGTKLSRFSSWGLTADGNIKPDIAAPGQDILSSVANNKYAKLSGTSMSAPLVAGIMGLLQKQYETQYPDMTPSERLDLAKKVLMSSATALYDEDEKAYFSPRQQGAGAVDAKKASAATMYVTDKDNTSSKVHLNNVSDKFEVTVTVHNKSDKPQELYYQATVQTDKVDGKLFALAPKALYETSWQKITIPANSSKQVTIPIDVSQFSKDLLAPMKNGYFLEGFVRFKQDPTKEELMSIPYIGFRGDFGNLSALEKPIYDSKDGSSYYHEANSDAKDQLDGDGLQFYALKNNFTALTTESNPWTIIKAVKEGVENIEDIESSEITETIFAGTFAKQDDDSHYYIHRHANGKPYAAISPNGDGNRDYVQFQGTFLRNAKNLVAEVLDKEGNVVWTSEVTEQVVKNYNNDLASTLGSTRFEKTRWDGKDKDGKVVANGTYTYRVRYTPISSGAKEQHTDFDVIVDNTTPEVATSATFSTEDRRLTLASKPKTSQPVYRERIAYTYMDEDLPTTEYISPNEDGTFTLPEEAETMEGATVPLKMSDFTYVVEDMAGNITYTPVTKLLEGHSNKPEQDGSDQAPDKKPETKPEQDGSGQAPDKKPETKPEQDGSGQTPDKKPETKPEQDGSGQTPDKKPETKPEKDSSGQTPGKTPQKGQPSRTLEKRSSKRALATKASTKDQLPTTNDKDTNRLHLLKLVMTTFFLGLVAHIFKTKRTED

SEQ ID NO: 823 - DNA, 426 bp, Streptococcus agalactiae
atgtggaatgtaaaaacttttgataatttaactacacatgagttgtttcaaatatataaattaagagtatctgtatttgtggttgaacaagattgtccttatcaagaggttgatgatgaagatttgatttgtttgcatgggatgaattgggtagatggtcaattggcagcttattatagattgataccagaagatgataaggtgcatttgggacgtgtgattgttaatccagactttagaaaaaagggattaggaaatcaattagtggaatatgcgattaaatttagtgaggcaaattaccctaataaacctatttatgctcaggcccaagcttatttacaagatttttatcaatctttcggatttcaacctgtctcagatatctatctagaagataatattcctcatcttgatatggttttatta

SEQ ID NO: 824 - protein, 142 aa, Streptococcus agalactiae
MWNVKTFDNLTTHELFQIYKLRVSVFVVEQDCPYQEVDDEDLICLHGMNWVDGQLAAYYRLIPEDDKVHLGRVIVNPDFRKKGLGNQLVEYAIKFSEANYPNKPIYAQAQAYLQDFYQSFGFQPVSDIYLEDNIPHLDMVLL

SEQ ID NO: 825 - DNA, 117 bp, Streptococcus agalactiae
atggatgtctcctcaattgacgaatcaaggacgccacatgttccaaaaacaattaaactttccattccaaatactataatatcttccaagattgctacgcaagctgaagcaccaaca

SEQ ID NO: 826 - protein, 39 aa, Streptococcus agalactiae
MDVSSIDESRTPHVPKTIKLSIPNTIISSKIATQAEAPT

SEQ ID NO: 827 - DNA, 1353 bp, Streptococcus agalactiae
atgaatgtggttttaaaacagcgaattcctttaaaaattaaacgaatgggaattaatggtgaaggaataggtttttataaaaaaacactaatctttgttccaggggccctcaagggagaagaggtgttttgtcagatttcttctgttagacgtaattttgcagaagctaaactgttaaagataaataaaaaatctaaaaatagggtagaacccccttgttctatttataaagaatgtgggggatgccaaataatgcaccttcaatatgataagcagctagagtttaaaacggatgttattcgacaggctctaatgaaatttaaaccagagggatatgagaattatgaaatccgtaaaacgataggtatgtcggaacctgaacactatcgtgctaaattacaatttcaagtgcgttcgtttggagggaatgtaaaggcaggtttatatgcacaagggacacatcgattgattgatatcaaagattgtttagtgcaagatagccttactcaggaaatgataaatcgagttgcagaacttttaggaaaatataaattgcctatttataatgaacgtaaaatagctggtgtccgtactgttatgattcgacgagcacaagcgagtggagaggttcaactgatctttatcacaagtaaaagacttgattttgatgatgttgttattgaattagttcgagagtttcctgagttaaagacagttgctgtaaatatcaacgctagtaaaacaagtgatatctatggtcaaataacagaagttatttggggtcaagaatccatcaatgaagaagtattagattatggtttttcgttatcaccacgtgctttttatcaacttaatcctaaacaaacacaaattttatatagtgaggcagttaaggccttagatgtgaaggaagatgatgatttaattgacgcttattgtggagtaggaacgattggacttgcttttgctggaaaagttaaaagtgttcgtggaatggatattatccctgaggctattcaggatgctaaagagaacgcactttatatgggttttactaatacacattacgaagctggaaaggcagaggatattatccctaggtggtatagtgagggatttcgcgctaatgcgttaatcgtggatcctcctcgcacaggtttagatgataaattgctaaatactatactaaaaatgcctccagaaaaaatggtttacgtttcttgtaatacatccacgcttgctagagacttagtaacattaacaaaagtataccatgtccactacatccaatccgttgacatgtttccacatacagcaaggaccgaggctgtagtgaaactacaacgtaaggaa

SEQ ID NO: 828 - protein, 451 aa, Streptococcus agalactiae
MNVVLKQRIPLKIKRMGINGEGIGFYKKTLIFVPGALKGEEVFCQISSVRRNFAEAKLLKINKKSKNRVEPPCSIYKECGGCQIMHLQYDKQLEFKTDVIRQALMKFKPEGYENYEIRKTIGMSEPEHYRAKLQFQVRSFGGNVKAGLYAQGTHRLIDIKDCLVQDSLTQEMINRVAELLGKYKLPIYNERKIAGVRTVMIRRAQASGEVQLIFITSKRLDFDDVVIELVREFPELKTVAVNINASKTSDIYGQITEVIWGQESINEEVLDYGFSLSPRAFYQLNPKQTQILYSEAVKALDVKEDDDLIDAYCGVGTIGLAFAGKVKSVRGMDIIPEAIQDAKENALYMGFTNTHYEAGKAEDIIPRWYSEGFRANALIVDPPRTGLDDKLLNTILKMPPEKMVYVSCNTSTLARDLVTLTKVYHVHYIQSVDMFPHTARTEAVVKLQRKE

SEQ ID NO: 829 - DNA, 1353 bp, Streptococcus pyogenes
atggtcgtaaaggttaaacagaaaattcctttaaaaattaagcgaatgggaattaacggtgaggggattggtttttatcagaaaactttggtatttgtccctggtgctttaaagggagaagatattttttgccaaatcacggcggttaaacggaattttgcagaggccaaactgttaacggtaaacaaggcttctaagaatcgtgtcaaaccagcttgttctgtttatgaaacttgtggtggttgccaaatcatgcatctagcctatcctaaacagctagatttcaaagatgatgtgattaggcaggcccttaaaaagttcaaaccaactggctatgaacaatttgagattagaccgactttaggaatgaaaaagccagatcactatcgggccaaattgcagtttcagctgcggtcatttggcgggacggtcaaggctggtttattttcccagggaagtcatcgcttggttcctattgacaattgcttggtacaggatcaactaacgcaagatattatcaataagattacgcagttagtggacaagtacaagttgcccatttacaatgagcgcaagattgctgggattcggacgataatggttcgtaaggcacaggctagtgatcaggtacagattattgttgtgagtagcaaagaagttaggttagcgaatttcattggcgaattgactaaggcatttcctcaggttaaaacggttgccttgaatagtaatcgttctaaatcgagtgagatttatggggacgaaacggaaattctatggggacaagaggcgattcatgaagaagttttagactatggatttgcgttatcaccgagagctttttaccaacttaatccacagcagacagaagttttgtatggtgaggtggtgaaggccttggatgtagggagcaaagatcatattattgatgcctattgtggggttggctcgattggctttgcttttgcagggaaggtcaagtctgtgcgggggatggatattatcccagaagcgattgaagatgcacaaaaaaatgccaaagccatgggctttgacaacgcttactatgaggcagggaaggcagaggatattatttctaaatggtataaacaaggttaccgcgcggatgccgtcattgtggacccaccaagaactggtttagatgataaattattaaaaacgattcttcattaccagcctaaacagatggtttatgtgtcttgtaatacctccactttggcccgcgacttggtgcagctaacaaaggtttacgatgttcactatatccaaagtgtagacatgttcccccatacagctaggaccgaggctgtcgtgaagttacaaaaacgtgta

SEQ ID NO: 830 - protein, 451 aa, Streptococcus pyogenes
MVVKVKQKIPLKIKRMGINGEGIGFYQKTLVFVPGALKGEDIFCQITAVKRNFAEAKLLTVNKASKNRVKPACSVYETCGGCQIMHLAYPKQLDFKDDVIRQALKKFKPTGYEQFEIRPTLGMKKPDHYRAKLQFQLRSFGGTVKAGLFSQGSHRLVPIDNCLVQDQLTQDIINKITQLVDKYKLPIYNERKIAGIRTIMVRKAQASDQVQIIVVSSKEVRLANFIGELTKAFPQVKTVALNSNRSKSSEIYGDETEILWGQEAIHEEVLDYGFALSPRAFYQLNPQQTEVLYGEVVKALDVGSKDHIIDAYCGVGSIGFAFAGKVKSVRGMDIIPEAIEDAQKNAKAMGFDNAYYEAGKAEDIISKWYKQGYRADAVIVDPPRTGLDDKLLKTILHYQPKQMVYVSCNTSTLARDLVQLTKVYDVHYIQSVDMFPHTARTEAVVKLQKRV

SEQ ID NO: 831 - DNA, 774 bp, Streptococcus agalactiae
atgaaaataaccaaaatcgaaaagaaaaaaagactttacactctagagctagacaataccgaaaatttatatataacagaagatactatcgttcattttatgttaagtaaagggatgataattaatgccgagaaacttgaaaatattaaaaaatttgcccaactatcatacggtaaaaatctaggtctttattatatttctttcaagcagagaaccgagaaagaagttattaaatatcttcaacaacatgatattgattctaaaattattccacaaattattgataatctaaaaagtgagaattggataaacgataaaaactacgtgcaatctttcatacagcaaaatctaaatactggcgataagggaccatacgtgataaaacaaaaattattgcaaaaaggtatcaaaagtaaaataattgaatctgaacttcaagctataaactttcaagacttagcatccaaaataagccaaaaactctataaaaaatatcaaaacaaacttccactaaaagcattaaaagataaattgatgcagagcttaactacaaaaggatttgattatcagatagtgcataccgtaattcaaaaccttgaaattgaaaaagatcaagaacttgaagaagacctcatttataaagaattagataaacaataccaaaaattatcaaaaaaacatgaccagtatgaattaaagcaacgtataatcaatgccttaatgcgtaaaggataccagtacgaagatatcaaaagtgctttaagagaatattta

SEQ ID NO: 832 - protein, 258 aa, Streptococcus agalactiae
MKITKIEKKKRLYTLELDNTENLYITEDTIVHFMLSKGMIINAEKLENIKKFAQLSYGKNLGLYYISFKQRTEKEVIKYLQQHDIDSKIIPQIIDNLKSENWINDKNYVQSFIQQNLNTGDKGPYVIKQKLLQKGIKSKIIESELQAINFQDLASKISQKLYKKYQNKLPLKALKDKLMQSLTTKGFDYQIVHTVIQNLEIEKDQELEEDLIYKELDKQYQKLSKKHDQYELKQRIINALMRKGYQYEDIKSALREYL

SEQ ID NO: 833 - DNA, 774 bp, Streptococcus pyogenes
atgaaaatcactaaaattgaaaagaaaaaacgcctctaccttatcgaattggataatgacgaatccctttatgtaacagaagatactattgttcggtttatgttgagtaaagataaagtccttgacaatgatcagcttgaagacatgaaacattttgcccaactgtcctacggcaaaaatttagccctttattttctttcctttcaacaacgcagcaacaagcaagttgctgattacctgcgcaagcatgagattgaagaacacattattgctgacatcatcactcaactccaagaagaacaatggatagacgacaccaaattggctgatacctacattcgccaaaatcagttaaatggtgataaaggtccccaagtcttaaaacaaaaattattacaaaaaggcattgcaagtcatgacattgatcctatcttatctcaaactgactttagccaactcgctcaaaaagtaagccaaaaactctttgacaaatatcaagaaaaattgccaccaaaagccttgaaagataaaatcacccaagcattactgaccaaaggcttttcatacgatctagctaaacatagcctcaatcaccttaattttgaccaagataatcaagaaatagaagatcttcttgacaaagaattagacaaacaatatcgtaaactcagtcgcaaatatgatggttataccttaaagcaaaagctctatcaggctctctaccgaaaaggctacaacagcgacgacattaattgcaagttaagaaattattta

SEQ ID NO: 834 - protein, 258 aa, Streptococcus pyogenes
MKITKIEKKKRLYLIELDNDESLYVTEDTIVRFMLSKDKVLDNDQLEDMKHFAQLSYGKNLALYFLSFQQRSNKQVADYLRKHEIEEHIIADIITQLQEEQWIDDTKLADTYIRQNQLNGDKGPQVLKQKLLQKGIASHDIDPILSQTDFSQLAQKVSQKLFDKYQEKLPPKALKDKITQALLTKGFSYDLAKHSLNHLNFDQDNQEIEDLLDKELDKQYRKLSRKYDGYTLKQKLYQALYRKGYNSDDINCKLRNYL

SEQ ID NO: 835 - DNA, 531 bp, Streptococcus agalactiae
atgagattacctaaagaaggcgactttattacaattcaaagttacaaacatgatggtagtttacaccgaacttggcgtgacaccatggtattaaaaacaaccgaaaatgccctcattggtgttaatgatcatactttagtaacagaaaatgatggtcgacgctgggtgacacgagagcctgcaatagtatactttcataaaaaatactggtttaacattatcgctatgatacgtgaaactggtgtctcctactattgtaatctagcaagtccgtatatcttggaccctgaagcactcaagtatattgactatgaccttgatgtcaaagtatttgcagatggtgaaaaaagactactagatgtggacgaatatgaacagcataaagctcagatgaactatcctaccgatattgattatatattaaaggaaaatgtaaaaatattggtagaatggataaatgagaataaaggccccttttcatcatcatatatcaatatctggtataaacggtaccttgaattgaaaaagcgc

SEQ ID NO: 836 - protein, 177 aa, Streptococcus agalactiae
MRLPKEGDFITIQSYKHDGSLHRTWRDTMVLKTTENALIGVNDHTLVTENDGRRWVTREPAIVYFHKKYWFNIIAMIRETGVSYYCNLASPYILDPEALKYIDYDLDVKVFADGEKRLLDVDEYEQHKAQMNYPTDIDYILKENVKILVEWINENKGPFSSSYINIWYKRYLELKKR

SEQ ID NO: 837 - DNA, 531 bp, Streptococcus pyogenes
atgaaattacctaaagaaggcgactttattacaattcaaagttataagcatgatggtagtttgcaccgtacttggcgcgatactatggtactaaaaacaactgaaaatgccctcattggagttaatgatcacactcttgtcacagaaagtgacggtagacgatgggtgacccgcgaacctgcaatcgtttactttcataaaaaatactggtttaacattatagccatgattcgagataatggcgtctcttattactgtaacttagctagtccatacatgatggacactgaggcccttaaatacattgattacgatttagatgtcaaagtctttgcggatggtgaaaagagattacttgatgttgatgaatacgagattcataaaaaagagatgcagtattcagccgatatggactttatcctaaaagaaaatgtcaaaatattggttgattggattaatcatgaaaaaggaccattttccaaggcctatatcactatttggtacaaacgttatcttgaactgaagaatcgt

SEQ ID NO: 838 - protein, 177 aa, Streptococcus pyogenes
MKLPKEGDFITIQSYKHDGSLHRTWRDTMVLKTTENALIGVNDHTLVTESDGRRWVTREPAIVYFHKKYWFNIIAMIRDNGVSYYCNLASPYMMDTEALKYIDYDLDVKVFADGEKRLLDVDEYEIHKKEMQYSADMDFILKENVKILVDWINHEKGPFSKAYITIWYKRYLELKNR

SEQ ID NO: 839 - DNA, 885 bp, Streptococcus agalactiae
atgaaaaagaacaaagagttaaacgtgctaagagaaaagcaagtaagaaaagaaagtaggaaaaccatggtattatttacaggagcgactgtagaagaagctattgaaaaaggactacaagagttaaacatttcacgattgagggcacatataaaagttgtatcacgtgagaaaaaaggttttttgggctttggtaaaaagccagcaaaagttgaaatagaaggtatcaccgacgaagtaactgatattaatgaatcggtagcgttaaaaaatattaagaatgtaccgtctagcgtagatgtggtggaagaatatatagaggaggttgatgaaacgcttgaaaaagaagacgtatcacaaccagaacttccaaaaattgatgataaaaacgttgtaactacaagtgaagctattgaaaaaattgacctacttcctaatattgaagtagcagctgctcaggtgactaaatacgttgaaaatatcatctatgagatggatttagatgcaacaatagaaactacgacaagtaagcgacaaataaatctccaaatagaaacgccagaagctgggcgcatcattggttatcatggaaaagtattaaaatcgttgcagttgttagcacaaaattatcttcatgaccgcttttctaagagtttttcagtatccattaatgtccatgactacgttgagcatcgtacagaaactttaattgatttttctaaaaaaatagctaggcgtgttttagagactaatgaaccttaccatatggatcctatgagtaacagtgagcgaaaaactgttcataaaacaattgcaactatagagggtgttgaaagttattctgaaggtaacgatcctaatagatttgtagtagttactaagaaa

SEQ ID NO: 840 - protein, 295 aa, Streptococcus agalactiae
MKKNKELNVLREKQVRKESRKTMVLFTGATVEEAIEKGLQELNISRLRAHIKVVSREKKGFLGFGKKPAKVEIEGITDEVTDINESVALKNIKNVPSSVDVVEEYIEEVDETLEKEDVSQPELPKIDDKNVVTTSEAIEKIDLLPNIEVAAAQVTKYVENIIYEMDLDATIETTTSKRQINLQIETPEAGRIIGYHGKVLKSLQLLAQNYLHDRFSKSFSVSINVHDYVEHRTETLIDFSKKIARRVLETNEPYHMDPMSNSERKTVHKTIATIEGVESYSEGNDPNRFVVVTKK

SEQ ID NO: 841 - DNA, 912 bp, Streptococcus pyogenes
atggtattatttacaggaaaaacagtcgaagaagctatcgaaacaggacttcaagagttagggttatcacgccttaaagcgcatatcaaagtcatttcaaaagagaaaaaaggtttcctcgggtttggtaaaaagccagcccaagttgatatcgaaggtatcagcgacaagacggtttataaggctgataaaaaagccactcgaggtgttccagaggatattaatcgtcaaaatactcccgcggtcaattctgctgatgtagaacctgaagaaataaaagccactcaaaggttagaagcagaagataccaaagtggttcctctcatgtctgaagatagtccagcgcaaaccccttctaatcttgctgagacagtcactgaaacaaaagcacaacaaccgtcaatcccagtcgaagaatcagaagtgccccaagatgctggtaatgatggtttcagcaaagatattgaaaaagctgctcaggaagtgtccgattatgtgactaaaattatctatgaaatggatatcgaagctaccgttgaaaccagcaacaatcgtcgccaaatcaatttgcagattgaaacgccagaggcgggacgtgtgattggttaccatggtaaggtcttgaaatccttgcagttgttagctcaaaatttcttgcacgaccgctattcaaaaaatttttcagtatccttgaatgtccatgattatgtggaacatcgaacagaaaccttgattgactttacgcaaaaagttgccaaacgcgttttggaatctggtcaagattacaccatggatcccatgagtaacagtgagcgtaaaatcgttcataaaaccgtttcatccattgaaggggttgatagttattctgaaggcaatgaccctaaccgctatgtggtagtcagtcttcaacgt

SEQ ID NO: 842 - protein, 304 aa, Streptococcus pyogenes
MVLFTGKTVEEAIETGLQELGLSRLKAHIKVISKEKKGFLGFGKKPAQVDIEGISDKTVYKADKKATRGVPEDINRQNTPAVNSADVEPEEIKATQRLEAEDTKVVPLMSEDSPAQTPSNLAETVTETKAQQPSIPVEESEVPQDAGNDGFSKDIEKAAQEVSDYVTKIIYEMDIEATVETSNNRRQINLQIETPEAGRVIGYHGKVLKSLQLLAQNFLHDRYSKNFSVSLNVHDYVEHRTETLIDFTQKVAKRVLESGQDYTMDPMSNSERKIVHKTVSSIEGVDSYSEGNDPNRYVVVSLQR

SEQ ID NO: 843 - DNA, 813 bp, Streptococcus agalactiae
ttgaagaaaaaacttaaaacatttagcttaatattgctgacaggctctttattggttgcttgcggacgaggagaagtatctagtcattcagccacattatgggagcaaatagtttatgcatttgctaaatcaatacaatggctctcctttaaccattcaattggtttgggaataatcttattcactctaataatcagagcgattatgatgccgctttataatatgcaaatgaaatccagccaaaagatgcaggaaattcagccaaggctcaaggaattacaaaaaaaatatccagggaaagatcctgataaccgtttaaagctaaatgatgaaatgcaatctatgtataaagctgagggagttaacccatatgcaagtgtattacctcttctaattcagttacctgtcctatgggctcttttccaagctttgactagggtttctttcttaaaagtaggaacatttttgagcctagaattatcacagccggacccatattatattttacctgtactggcggccttatttacctttttatcaacttggttaactaacaaagcagctgttgaaaaaaatattgctttaactcttatgacttatgttatgccgtttatcatattggtaacaagctttaactttgctagtggtgttgttttatactggacggtgtctaatgcttttcaagtatttcaaattctattattgaacaacccatacaagattataaaggttcgagaagaagcagtaagagtggcacatgaaaaagaacaaagagttaaacgtgctaagagaaaagcaagtaagaaaagaaag

SEQ ID NO: 844 - protein, 271 aa, Streptococcus agalactiae
MKKKLKTFSLILLTGSLLVACGRGEVSSHSATLWEQIVYAFAKSIQWLSFNHSIGLGIILFTLIIRAIMMPLYNMQMKSSQKMQEIQPRLKELQKKYPGKDPDNRLKLNDEMQSMYKAEGVNPYASVLPLLIQLPVLWALFQALTRVSFLKVGTFLSLELSQPDPYYILPVLAALFTFLSTWLTNKAAVEKNIALTLMTYVMPFIILVTSFNFASGVVLYWTVSNAFQVFQILLLNNPYKIIKVREEAVRVAHEKEQRVKRAKRKASKKRK

SEQ ID NO: 845 - DNA, 825 bp, Streptococcus pyogenes
ttgagaaaggttttgagagtgaagaaaaacattaaaattgcaagaatagtccccttagttctattattagtggcctgtggtcgtggtgaggtaacggcacaatcatctagtggttgggaccagttggtttacttatttgccagagcaattcaatggctttcctttgatggttcaattggtgttggcattattctttttacccttactatccgtctcatgctcatgcctttgtttaacatgcaaatcaaatcaagccagaagatgcaagacatccaacctgagcttagagaattgcaaaggaaatacgctggtaaagacacacaaacgcggatgaagttggctgaagaaagtcaagccctttacaaaaaatatggggttaacccttatgctagtctcttacccctcttaattcagatgccagttatgattgccttattccaagccttgacacgggtatctttcttaaaaacagggactttcttgtgggtggaattggcacaacatgatcatttgtaccttttaccagttttggcagctgtcttcactttcttgtccacttggttgaccaatctagcggctaaagaaaaaaatgtcatgatgactgttatgatttatgtgatgccgctaatgatctttttcatgggctttaacttggctagtggagtagtgctctattggacggtctccaatgcctttcaagtggtacaactactgttattaaacaatccttttaagattattgcggaaagacaacgtcttgccaatgaagaaaaagaacgccgtcttcgtgaacgtcgtgctcgtaaaaaagcaatgaagagaaaa

SEQ ID NO: 846 - protein, 275 aa, Streptococcus pyogenes
LRKVLRVKKNIKIARIVPLVLLLVACGRGEVTAQSSSGWDQLVYLFARAIQWLSFDGSIGVGIILFTLTIRLMLMPLFNMQIKSSQKMQDIQPELRELQRKYAGKDTQTRMKLAEESQALYKKYGVNPYASLLPLLIQMPVMIALFQALTRVSFLKTGTFLWVELAQHDHLYLLPVLAAVFTFLSTWLTNLAAKEKNVMMTVMIYVMPLMIFFMGFNLASGVVLYWTVSNAFQVVQLLLLNNPFKIIAERQRLANEEKERRLRERRARKKAMKRK

SEQ ID NO: 847 - DNA, 387 bp, Streptococcus agalactiae
ttgagtcttttaggttatttatggtataataaaaccaatttagataaatggagcactattttgaaaaaaacctatcgggtaaaaagtgataaggattttcaaatgattttcagcagaggtaaaaatgttgctaatcgaaaatttgttatctactatttagaaaaagaacaaaaacactttcgtgtgggaatctctgttagtaagaaattaggaaatgctgttgttcgtaacgctattaaaagaaaaattaggcatgttttactctctcagaaaacagcgctgcaagattatgattttgtcgtgattgcgcgtaaaggtgtagaggaattggactatcaagcattagaaaaaaatcttatacacgttttaaaaatagcaggactcatc

SEQ ID NO: 848 - protein, 129 aa, Streptococcus agalactiae
MSLLGYLWYNKTNLDKWSTILKKTYRVKSDKDFQMIFSRGKNVANRKFVIYYLEKEQKHFRVGISVSKKLGNAVVRNAIKRKIRHVLLSQKTALQDYDFVVIARKGVEELDYQALEKNLIHVLKIAGLI

SEQ ID NO: 849 - DNA, 357 bp, Streptococcus pyogenes
ttgaagaagacctatcgtgtcaagcgtgagaaagatttccaagccatatttaaggatggaaaaagtacagcaaatcgaaaatttgtcatttatcatttaaatagaggccaagaccacttccgtgtgggtatttctgtcggtaaaaaaataggaaatgcagtcaccagaaatgcagtcaaacgaaagatacgtcatgttatcatggcattagggcatcagctgaagtcagaggatttcgtggtgattgcccgtaagggtgtccactctttggagtatcaagagcttcaacaaaatttacatcatgttttaaagttagcacaattgcttgagaaaggttttgagagtgaagaaaaacat

SEQ ID NO: 850 - protein, 119 aa, Streptococcus pyogenes
LKKTYRVKREKDFQAIFKDGKSTANRKFVIYHLNRGQDHFRVGISVGKKIGNAVTRNAVKRKIRHVIMALGHQLKSEDFVVIARKGVHSLEYQELQQNLHHVLKLAQLLEKGFESEEKH

SEQ ID NO: 851 - DNA, 1056 bp, Streptococcus agalactiae
atgttagcgctatatgccttattattagaaagaaggaataagatgacaaaacaaaaaattgccgttcttggacctggttcatgggggactgctcttgcacaagtattaaatgacaatggacatgaggtacgcttatggggaaacgtggttgaacaaatagaagagattaatactaaccatactaatcaacgttacttcaaagatattaccttagattccaaaataaaagcctacactaatcttgaggaagcgattaataatgttgacagcattttattcgtcgtcccaactaaagttacaagacttgttgctaaacaagtggctaatcttttaaagcataaagttgttcttatgcatgcttctaagggactagaacctggtactcatgaacgactttctacaattttagaagaagaaatctctgaacaatatcgtagtgatatcgttgttgtttcaggtcccagtcatgctgaagaagccatcgttcgtgatattactttgattactgctgcttcaaaagatattgaagcagctaagtatgtccaaaaattgtttagtaatcattattttagactttatactaacactgatgtcgtaggagtagaaacagctggtgctctaaaaaatattattgctgttggtgctggagcactacacggtcttggttatggtgataatgctaaagcagctattattacgcgtggtttagctgagataacacgtcttggtgtacaattaggggccgaccctctcactttcagtggtttatccggagttggagatttaattgtgactggtacatctgttcattctcgcaactggagagcgggagatgctttaggacgtggtgagaaacttgaagatattgaaaaaaatatggggatggttattgaaggtatctcaacaactaaagttgcttacgaaatcgcccaaaacttaaatgtttacatgcccattacagaagctatttataaatcaatatatgaaggggctaatatcaaagatagcattttagatatgatgtccaatgaatttcgttcagagaatgaatggcac

SEQ ID NO: 852 - protein, 352 aa, Streptococcus agalactiae
MLALYALLLERRNKMTKQKIAVLGPGSWGTALAQVLNDNGHEVRLWGNVVEQIEEINTNHTNQRYFKDITLDSKIKAYTNLEEAINNVDSILFVVPTKVTRLVAKQVANLLKHKVVLMHASKGLEPGTHERLSTILEEEISEQYRSDIVVVSGPSHAEEAIVRDITLITAASKDIEAAKYVQKLFSNHYFRLYTNTDVVGVETAGALKNIIAVGAGALHGLGYGDNAKAAIITRGLAEITRLGVQLGADPLTFSGLSGVGDLIVTGTSVHSRNWRAGDALGRGEKLEDIEKNMGMVIEGISTTKVAYEIAQNLNVYMPITEAIYKSIYEGANIKDSILDMMSNEFRSENEWH

SEQ ID NO: 853 - DNA, 1014 bp, Streptococcus pyogenes
atgacaaaacaaaaagtagctattttaggacctggttcttggggaactgccctttctcaggttcttaatgacaatggccatgacgtccgtttatggggaaatattcctgatcaaattgaagagataaataccaagcataccaatagacactacttcaaagacattgtgttagacaaaaacattacggcaactcttgatttaggtcaagccctatcagatgttgatgcggtgctttttgttgtgccaactaaagtaacacgattagttgctagacaagttgccgccattttagatcataaagtagtggtcatgcatgcctcaaaaggtctagaaccagagacccacgaacgtttatcaactatcctagaagaagaaattccagctcattttcgtagtgaagtggtcgttgtatcaggtcctagtcatgctgaagaaactatcgttcgcgatattactctcatcacggcagcctcaaaagatattgaagctgcaaagtatgttcagtccctctttagtaaccactacttccgactttataccaataccgacgtcatcggagttgaaacagctggtgccctcaaaaacattattgctgttggagcaggagctctccatggacttgggtatggagataatgccaaagcagcggtaattactcgtgggttagctgaaatcacccgtctaggcgtcaagcttggtgctgacccgttaacctacagtgggttatctggtgttggtgatctaattgtaacaggtacttctgtccattcacgtaactggcgggctggagctgcccttggacgtggtgaaaaattagaagatattgaacgcaacatgggtatggttatcgaaggtatcgcaacaactaaggtagcctatgaaattgcccaagacctcggagtttacatgccaattacaacagctatttataagtccatctacgagggcgctgatatcaaagaaagcatcctcggcatgatgtcaaatgaatttcgttctgaaaatgaatggcat

SEQ ID NO: 854 - protein, 338 aa, Streptococcus pyogenes
MTKQKVAILGPGSWGTALSQVLNDNGHDVRLWGNIPDQIEEINTKHTNRHYFKDIVLDKNITATLDLGQALSDVDAVLFVVPTKVTRLVARQVAAILDHKVVVMHASKGLEPETHERLSTILEEEIPAHFRSEVVVVSGPSHAEETIVRDITLITAASKDIEAAKYVQSLFSNHYFRLYTNTDVIGVETAGALKNIIAVGAGALHGLGYGDNAKAAVITRGLAEITRLGVKLGADPLTYSGLSGVGDLIVTGTSVHSRNWRAGAALGRGEKLEDIERNMGMVIEGIATTKVAYEIAQDLGVYMPITTAIYKSIYEGADIKESILGMMSNEFRSENEWH

SEQ ID NO: 855 - DNA, 897 bp, Streptococcus agalactiae
atgaaagtcagaaaagcagttatccctgccgctggtttaggaacacgttttttacctgctactaaagctttagctaaagaaatgcttccaatcgttgataaaccaactattcaatttattgttgaagaagcactaaaatctggaattgaagatattttagttgtaactggtaaatcaaaacgttctatagaagaccactttgattcaaattttgaattagaatataacctaaaagagaaagggaaaaacgaacttctcaaacttgttgatgaaacaactggcattcgactccattttattcgacaaagtcatcctcgtgggcttggagatgctgtgctacaagcaaaagccttcgttggtaatgaaccttttgttgttatgctaggtgatgatctaatggatattaccaataataaagttattcctctcaccaaacaattaattaatgactttgaagctactcatgcatcaacaattgctgttatggaagttccacatgaagatgtttctgcttatggtgttattgctccacaaggagaaggagttaatggtctatatagcgttaacactttcgttgaaaaaccttctcccgaagaggctccaagtaatttggcaatcattggtcgctacttgttaactccagaaatttttaatattttagaaactcaaaaacctggtgcaggaaatgagattcaactaaccgatgctatcgatactttaaataaaacgcaacgtgtttttgctagaaaatttacaggagaccgttacgacgttggtgacaagtttggttttatgaaaacatctattgattatgctcttcaacacccacaagttaaagatgacttgaagaaatatatcattgatttaggaaaatctctagaaaaaacatctaagaag

SEQ ID NO: 856 - protein, 299 aa, Streptococcus agalactiae
MKVRKAVIPAAGLGTRFLPATKALAKEMLPIVDKPTIQFIVEEALKSGIEDILVVTGKSKRSIEDHFDSNFELEYNLKEKGKNELLKLVDETTGIRLHFIRQSHPRGLGDAVLQAKAFVGNEPFVVMLGDDLMDITNNKVIPLTKQLINDFEATHASTIAVMEVPHEDVSAYGVIAPQGEGVNGLYSVNTFVEKPSPEEAPSNLAIIGRYLLTPEIFNILETQKPGAGNEIQLTDAIDTLNKTQRVFARKFTGDRYDVGDKFGFMKTSIDYALQHPQVKDDLKKYIIDLGKSLEKTSKK

SEQ ID NO: 857 - DNA, 912 bp, Streptococcus pyogenes
atgaccaaagtcagaaaagccattattcctgctgcaggtctaggaacacgttttttacctgctaccaaagctcttgccaaagagatgttgcccatcgttgataaaccaaccatccagtttatcgtcgaagaagcgctaaaatctggcatcgaggaaatccttgtggtgaccggaaaagctaaacgctctatcgaggaccattttgattcaaactttgaattagaatacaacctccaagctaaggggaaaaatgaactgttgaaattagtggatgaaaccactgccattaaccttcattttatccgtcaaagccacccaagagggctgggagatgctgtcttacaagccaaagcctttgtgggcaatgaaccctttgtggtcatgcttggagatgacttaatggacattacaaatgcatccgctaaacctctcaccaaacaactcatggaggactatgacaagacgcatgcatccactatcgctgtgatgaaagttcctcatgaagatgtgtctagctatggggttatcgctcctcaaggcaaggctgtcaagggcctttacagtgtagacacctttgttgaaaaaccacaaccagaagatgcgcctagtgatttggctattattggtcgttacctcctaacccctgaaatttttggtattttggaaagacagacccctggagcaggtaacgaagtgcaactcacagatgctatcgataccctcaataaaactcagcgtgtctttgcacgagaatttaaaggcaatcgttacgatgttggggataaatttggattcatgaaaacatctatcgactatgccttagaacacccacaggtcaaagaggacttgaaaaattacattatcaaactaggaaaagctttggaaaaaagtaaagtaccaacacattcaaag

SEQ ID NO: 858 - protein, 304 aa, Streptococcus pyogenes
MTKVRKAIIPAAGLGTRFLPATKALAKEMLPIVDKPTIQFIVEEALKSGIEEILVVTGKAKRSIEDHFDSNFELEYNLQAKGKNELLKLVDETTAINLHFIRQSHPRGLGDAVLQAKAFVGNEPFVVMLGDDLMDITNASAKPLTKQLMEDYDKTHASTIAVMKVPHEDVSSYGVIAPQGKAVKGLYSVDTFVEKPQPEDAPSDLAIIGRYLLTPEIFGILERQTPGAGNEVQLTDAIDTLNKTQRVFAREFKGNRYDVGDKFGFMKTSIDYALEHPQVKEDLKNYIIKLGKALEKSKVPTHSK

SEQ ID NO: 859 - DNA, 1110 bp, Streptococcus agalactiae
atgatttttttatgttatgatagaaatctgtttttatgtgactataacttattaggaggttcattctcggtgaacagaaaaattattggcttaactctactatctttatctgtactaacattaacagcatgtggtaatcgttcagataagtctgcaaataaatcagatatcaaagttgcgatggtaactaatcaaggtggagtagacgataaatcgtttaatcaatcagcttgggaagggctacaaaagtggggaaaaaagaaggggttgacaaaaggtaatggctttgattatttccagtcatctaatgaatcagatcatgctaataaccttgatacggcagcctctagtggttataatttaatttttggtattggatttggtcttcatgatactattgaaaaagtatcagaaaataataaagatgttaaatacgttattgtagatgatatcattaaaggtaaagaaaatgtagctagtgttacttttgcagacaatgaagctgcttacttagctggagttgctgcagctaagacaactaagacaaaaacagttggttttatcggagggatggaaggcgtcgttgttaagcgatttgaagcaggatttaaggctggagtaaaatcaattgatccggctattaaagttgcggtatcttatgcaggctcatttacagatgcagctaaaggtaaaacgattgctgccacacagtatgcaacaggtgttgatgttatttaccaggctgctggtggtacaggagcaggaatttttagtgaggctaaaactgaaaatgagacccgcaaggaatctaacaaagtctgggtaattggtgttgacagagatcaaagtcaagaaggcaattatgtttcaaaagatggtaagaaagcaaactttgttctggcatctactataaaagaggtggggaaatctctccaatctgtagcagaattaacagagaaaaaacaatatccaggagggaaagtaacagtttttggtctaaaggatagtggtgtagatattaaagagcatcaattgtctagtgagggatctgttgctgtcaaaaaagctaaagaggatattgtttcagggaaaatacaagttcctatgaaa

SEQ ID NO: 860 - protein, 370 aa, Streptococcus agalactiae
MIFLCYDRNLFLCDYNLLGGSFSVNRKIIGLTLLSLSVLTLTACGNRSDKSANKSDIKVAMVTNQGGVDDKSFNQSAWEGLQKWGKKKGLTKGNGFDYFQSSNESDHANNLDTAASSGYNLIFGIGFGLHDTIEKVSENNKDVKYVIVDDIIKGKENVASVTFADNEAAYLAGVAAAKTTKTKTVGFIGGMEGVVVKRFEAGFKAGVKSIDPAIKVAVSYAGSFTDAAKGKTIAATQYATGVDVIYQAAGGTGAGIFSEAKTENETRKESNKVWVIGVDRDQSQEGNYVSKDGKKANFVLASTIKEVGKSLQSVAELTEKKQYPGGKVTVFGLKDSGVDIKEHQLSSEGSVAVKKAKEDIVSGKIQVPMK

SEQ ID NO: 861 - DNA, 1050 bp, Streptococcus pyogenes
atgaacaagaaatttattggtcttggtttagcgtcagtggctgtgctgagtttagctgcttgtggtaatcgtggtgcttctaaaggtggggcatcaggaaaaactgatttaaaagttgcaatggttaccgatactggtggtgtagatgacaaatcattcaaccaatcagcatgggaaggcctgcaatcttggggtaaagaaatgggccttcaaaaaggaacaggtttcgattattttcaatctacaagtgaatctgagtatgcaactaatctcgatacagcagtttcaggagggtatcaactgatttatggtatcggctttgcattgaaagatgctattgctaaagcagctggagataatgaaggagttaagtttgttattatcgatgatattatcgaaggaaaagataatgtagccagtgttacctttgccgaccatgaagctgcttatcttgcaggaattgcagctgcaaaaacaacaaaaacaaaaacagttggtttcgtgggcggtatggaaggaactgtcataactcgatttgaaaaaggttttgaagcaggagttaagtctgttgacgatacaatccaagttaaagttgattatgctggatcatttggtgacgctgcaaaaggaaaaacaatcgcagcagctcagtatgcagcaggtgctgatgttatttaccaggcagcaggaggcactggagcaggtgtatttaatgaagcaaaagctattaatgaaaaacgtagtgaagctgataaagtttgggttattggtgttgaccgtgatcaaaaagacgaaggaaaatacacttctaaagatggcaaagaagcaaactttgtacttgcatcatcaatcaaagaagtcggtaaagctgttcagttaatcaacaagcaagtagcagataaaaaattccctggaggaaaaacaactgtctatggtctaaaagatggcggtgttgaaatcgcaactacaaatgtttcaaaagaagctgttaaagctattaaagaagcgaaagcaaaaattaaatctggtgacattaaagttcctgaaaaa

SEQ ID NO: 862 - protein, 350 aa, Streptococcus pyogenes
MNKKFIGLGLASVAVLSLAACGNRGASKGGASGKTDLKVAMVTDTGGVDDKSFNQSAWEGLQSWGKEMGLQKGTGFDYFQSTSESEYATNLDTAVSGGYQLIYGIGFALKDAIAKAAGDNEGVKFVIIDDIIEGKDNVASVTFADHEAAYLAGIAAAKTTKTKTVGFVGGMEGTVITRFEKGFEAGVKSVDDTIQVKVDYAGSFGDAAKGKTIAAAQYAAGADVIYQAAGGTGAGVFNEAKAINEKRSEADKVWVIGVDRDQKDEGKYTSKDGKEANFVLASSIKEVGKAVQLINKQVADKKFPGGKTTVYGLKDGGVEIATTNVSKEAVKAIKEAKAKIKSGDIKVPEK

SEQ ID NO: 863 - DNA, 675 bp, Streptococcus agalactiae
atgtctatgaagaagttcgctaaagagtatccgacgacagtactcttggtcagtctgacaacccttgtttttttattgatgcaactaacttatggaagtcaagcggagtctagccaagttatttttcaatttggtggaatacaaggtgattatctaaaagcatatccaacaaatctatggagactaataagtcctatctttgttcatattggttgggaacattttttattaaatggtttagctctgtatttcgtaggacaaatgggggaaagtatttggggaagtttgagatttctaattctctatattttatctggcttaatgggtaatatttttacgctattttttactccacatgtggtggcagcaggagcctcaacgtctttatttggtgttttttctgctatagcaatcgcagggtattttggaaaaaatccttatttaaaacaagttggaaaatcatatcaagtgatgatcttgttaaatttattttttaatatcttcacacccggagtgagtttagcaggtcatgttggtggtttagttggtggagtattggtggctatttttttgacaaaacaaaatggttctttattatttaaaacttggcaaagtattttagctttaatgatatttattattgtatcgatcagcttaataggtctatcgttggta

SEQ ID NO: 864 - protein, 225 aa, Streptococcus agalactiae
MSMKKFAKEYPTTVLLVSLTTLVFLLMQLTYGSQAESSQVIFQFGGIQGDYLKAYPTNLWRLISPIFVHIGWEHFLLNGLALYFVGQMGESIWGSLRFLILYILSGLMGNIFTLFFTPHVVAAGASTSLFGVFSAIAIAGYFGKNPYLKQVGKSYQVMILLNLFFNIFTPGVSLAGHVGGLVGGVLVAIFLTKQNGSLLFKTWQSILALMIFIIVSISLIGLSLV

SEQ ID NO: 865 - DNA, 699 bp, Streptococcus pyogenes
atgatattgctgtttaggaggtttatcttagatgacacagttattaaaacgatatcctattactattttccttttagggttaacaggcttaatttttatagcaatgcaagtggtatatggacatttagcaactggtgctcaagctatttatcaagttggaggtatgtttggattactagtaaaagcaatgccagaccagttgtggcgattggtgactccgatatttattcatatcggctttggtcatttttttgtcaatggattaacactatattttgttggtcaaatcgtcgaagacctctggggctcacgccttttttattactttatgttttatcaggtgttatgggcaatgcctttactttttggttgactcctgaaacagtagctgcaggagcatcgacgtcgttatttggactttttgctgctattgtagtattgagttttttgggtaagaaccaagcgttgaaagatttgggcaagtcataccagacgttaattgtagtcaatttactgatgaatctttttatgccaaacgtgagtatggcaggccatattggcggtgtcgtgggtggtgcgttactgagtatagtttttccaactaagatgagagtgataacagtgaagaaaaccaagcgaatgttggctttagtgagctatggtattattttggttggtgtgttagtgcttgggttttta

SEQ ID NO: 866 - protein, 233 aa, Streptococcus pyogenes
MILLFRRFILDDTVIKTISYYYFPFRVNRLNFYSNASGIWTFSNWCSSYLSSWRYVWITSKSNARPVVAIGDSDIYSYRLWSFFCQWINTIFCWSNRRRPLGLTPFLLLYVLSGVMGNAFTFWLTPETVAAGASTSLFGLFAAIVVLSFLGKNQALKDLGKSYQTLIVVNLLMNLFMPNVSMAGHIGGVVGGALLSIVFPTKMRVITVKKTKRMLALVSYGIILVGVLVLGFL

SEQ ID NO: 867 - DNA, 525 bp, Streptococcus agalactiae
atggaaaagaaattattaagaaaagaagttttgataaccttaaaatctcaacctcaagcttacaaatcagaagttgactgtaaacttttagaggcttttataaaaactaaagcttatcaaaatagttgtgtaattgctacttacctatcttttgactacgaatacaatacacaacttcttattaaacaagctttatgtgatggcaaacgtgtccttgttcccaaaacttatccaaaaggtaaaatgatttttgtggactatcaaaaagataacttgaggacaacaccgtttggcttattagaacctgttaatgatagagctgttgaaaaagctagtatagacttaattcatgtgcccggacttatctttaacaataaaggttttcgtataggttatggtgcaggttattttgatcgctatttgagtgattttgaaggtgatactattagtactatttataggtgtcagagacaggattttgtagaagagaagcatgacgtagcagttaaggaggtattatgtcta

SEQ ID NO: 868 - protein, 175 aa, Streptococcus agalactiae
MEKKLLRKEVLITLKSQPQAYKSEVDCKLLEAFIKTKAYQNSCVIATYLSFDYEYNTQLLIKQALCDGKRVLVPKTYPKGKMIFVDYQKDNLRTTPFGLLEPVNDRAVEKASIDLIHVPGLIFNNKGFRIGYGAGYFDRYLSDFEGDTISTIYRCQRQDFVEEKHDVAVKEVLCL

SEQ ID NO: 869 - DNA, 1203 bp, Streptococcus agalactiae
atggacctcccagaaaactatgacaaagaagaattttctcgcattcaaaaagccgctgaaaagattaaatcagatagcgaagtactcgtggttattggtattggtggttcgtaccttggcgcaaaagcagcaattgactttttgaataatcattttgctaatttgcaaaccgcagaagaacgtaaagcgcctcagattctttatgctggaaattctatttcatctacttaccttgccgatttagttgaatacgtccaagataaagaattctcagtaaatgtcatttcaaaatcaggtacaacaactgaaccagcgattgctttccgtgtatttaaagaacttctagttaaaaagtacggtcaagaagaagctaataaacgtatctacgctacaactgataaagttaaaggtgccgtaaaagttgaagcagatgctaacaattgggaaacatttgtagttcctgataatgttggtggtcgtttctcagtactgacagccgtaggtcttcttccaattgctgcttcaggagcagatattactgctcttatggaaggcgcaaatgctgctcgtaaagatttatcttcagataaaatctctgaaaacattgcttatcagtacgctgcagttcgtaatgttctttatcgcaaaggttatatcacagagattttagctaactacgaaccatcattacaatactttggtgaatggtggaaacaattagcaggtgaatcagaaggtaaagatcaaaaaggtatctatcctacatcagcaaacttctcaactgatcttcactcacttggtcaatttattcaagaaggttaccgtaacctctttgagacagttgttcgcgttgagaaacctcgtaaaaatgtgactattcctgaattaaccgaagatttagatggtcttggttatcttcaaggaaaagatgtagattttgttaataaaaaagcaacagatggtgtactccttgctcatacagatggtggggttccaaatatgtttgtaacgcttcctacacaagacgcttacacccttggttacactatttacttctttgagttagcaattggcctttcaggttatcttaactcagtaaatccatttgatcaaccaggggtagaagcatataaacgtaatatgtttgctcttctaggtaaacctggattcgaagagcttagcgctgaattgaatgcacgtctt

SEQ ID NO: 870 - protein, 401 aa, Streptococcus agalactiae
MDLPENYDKEEFSRIQKAAEKIKSDSEVLVVIGIGGSYLGAKAAIDFLNNHFANLQTAEERKAPQILYAGNSISSTYLADLVEYVQDKEFSVNVISKSGTTTEPAIAFRVFKELLVKKYGQEEANKRIYATTDKVKGAVKVEADANNWETFVVPDNVGGRFSVLTAVGLLPIAASGADITALMEGANAARKDLSSDKISENIAYQYAAVRNVLYRKGYITEILANYEPSLQYFGEWWKQLAGESEGKDQKGIYPTSANFSTDLHSLGQFIQEGYRNLFETVVRVEKPRKNVTIPELTEDLDGLGYLQGKDVDFVNKKATDGVLLAHTDGGVPNMFVTLPTQDAYTLGYTIYFFELAIGLSGYLNSVNPFDQPGVEAYKRNMFALLGKPGFEELSAELNARL

SEQ ID NO: 871 - DNA, 1347 bp, Streptococcus pyogenes
atgtcacatattacatttgattattcaaaagtcctcgagtcatttgcgggacaacatgaaattgattttttacaaggccaagtaacagaagctgacaagttattgcgtgaaggaactggaccaggttcagatttcttgggctggcttgatcttccagaaaactatgataaagatgaatttgcacgtatcttgactgctgctgaaaagattaaggcagacagcgaagttcttgtggtgatcggtatcggtgggtcataccttggtgccaaagcagcgattgattttttaaatcatcattttgctaacttgcaaactgccaaagagcgcaaagccccacaaattctttacgctggaaactctatttcatctacttaccttgccgatttagttgaatacgttcaagacaaagagttctcagtaaacgtgatctctaaatcaggtacaaccactgaaccagctattgcctttcgcgtgttcaaagaacttttggttaaaaaatatggccaagaagaagctaacaaacgtatctacgctaccacagacaaagttaagggtgctgttaaggtagaagctgacgctaacaactgggaaacatttgtggtgccagataatgttggtggtcgtttctcagtcttgactgctgttggtttgcttccaattgctgcatcaggtgcagatattactgctcttatggaaggggcaaatgctgctcgtaaagacctttcttcagacaaaatctctgaaaacattgcttaccaatacgctgctgttcgtaatgtgctttaccgtaaaggctacatcactgaaatcttggctaactacgagccatctcttcagtactttggcgaatggtggaaacaattagctggtgaatcagaaggaaaagatcaaaaagggatttacccaacttcagctaacttctcaacagaccttcactcacttggtcaatttatccaagaaggttaccgtaatctctttgaaacagttattcgtgttgataatcctcgtaaaaatgttatcattcctgaattagcagaagacctagatggacttggttaccttcaaggtaaagacgttgatttcgttaacaagaaagctacagatggtgtgcttcttgcccacacagatggcggcgtgccaaacatgtttgtcactcttccagctcaagacgagtttacccttggttacactatttacttctttgagcttgccatcgctgtttcaggctacatgaatgctgttaacccatttgatcaaccaggtgttgaagcttacaaacgtaacatgtttgcgcttcttggaaaaccaggttttgaagcattatcagcagagcttaatgctcgcctc

SEQ ID NO: 872 - protein, 449 aa, Streptococcus pyogenes
MSHITFDYSKVLESFAGQHEIDFLQGQVTEADKLLREGTGPGSDFLGWLDLPENYDKDEFARILTAAEKIKADSEVLVVIGIGGSYLGAKAAIDFLNHHFANLQTAKERKAPQILYAGNSISSTYLADLVEYVQDKEFSVNVISKSGTTTEPAIAFRVFKELLVKKYGQEEANKRIYATTDKVKGAVKVEADANNWETFVVPDNVGGRFSVLTAVGLLPIAASGADITALMEGANAARKDLSSDKISENIAYQYAAVRNVLYRKGYITEILANYEPSLQYFGEWWKQLAGESEGKDQKGIYPTSANFSTDLHSLGQFIQEGYRNLFETVIRVDNPRKNVIIPELAEDLDGLGYLQGKDVDFVNKKATDGVLLAHTDGGVPNMFVTLPAQDEFTLGYTIYFFELAIAVSGYMNAVNPFDQPGVEAYKRNMFALLGKPGFEALSAELNARL

SEQ ID NO: 873 - DNA, 2673 bp, Streptococcus agalactiae
gtgaaacatttaacaaatcaaaaggagtctcaaatgactgaaaaaactaaagcagtagaaactacagatgttgctcttgcaattgatacattggttcaaaatggtttaaaagcacttgatgagatgcgtcaacttaatcaagaacaagttgattatattgtagctaaagcttctgttgcagccttggatgcccatggagaacttgctcttcatgcagtagaagaaactggtcgtggtgtctttgaagataaagcgacaaaaaatttatttgcatgtgaacacgtcgttaacaacatgcgtcatacaaagacagtgggagttattgaagaagacgatgtcacaggcttgacattaattgctgaaccagtgggagttgtctgtggtatcacgccaacaaccaacccaacttcaactgctattttcaagtcattaatctctcttaaaacacgtaatccaattatttttgccttccacccatcagcacaagaatcatcagcacatgcagcacgtattgttcgtgatgctgctattgctgctggagctcctgaaaattgtgtccaatggattgaacaaccatcaattgatgcaactaatgctttgatgaaccatgatggtattgccactatccttgcgacaggtggtaatgcgatggttaaagctgcctactcatgtgggaaacctgcccttggtgtaggtgctgggaatgttccagcttatgttgaaaaatcagctaatatccgacaagccgctcacgatattgttatgtctaaatcatttgataacggtatggtatgtgcatcagaacaggctgttattattgataaagaaatttataaagaatttgttgaagaatttaaatcttatcatacctatttcgttaataagaaagaaaaagctcttcttgaagaattctgttttggtgcaaaagcaaatagcaaaaactgtgctggtgcaaaattaaatccaaatattgttggaaaatcagcagtttggattgctgaacaagctggatttactgttccagaaggaacaaatattcttgccgcagaatgtactgaagttagtgaaaaagaacctttgacacgtgaaaaactatcacctgttattgcagtattgaaagctgaatctacagaagatggtgttgaaaaagctcgtcaaatggttgagtttaatggtctagggcactcagctgctattcatacaaaagatgcagacttagctcgtgaatttggaactagaattcgtgctatccgtgttatttggaattctccttctacttttggtggtattggggatgtttacaatgctttcttgccatcattgactcttggttgtggttcgtatggacgtaactcagttggtgataacgttagtgctataaatctcttgaatatcaaaaaagtaggaagacgtagaaataatatgcaatggtttaaagtcccttcaaaaacatacttcgaacgtgattctattcaatatttgcaaaaatgtcgcgatgttgaacgtgtcatgattgttacagatcacgccatggttgagcttggtttcttggatcgtatcattgaacaacttgatcttcgtcgcaataaagttgtttatcagatttttgctgaagtagaaccagatccagacattacaacagtaatgaaaggaacagatttgatgcgtaccttcaaaccagacactattattgcattaggtggtggttctcctatggatgctgcgaaagttatgtggctcttctatgaacaaccagaagttgatttccatgacctcgttcaaaaattcatggatatccgtaaacgtgcgttcaaattcccagaacttggtaagaaaacaaaatttgttgctattccaacaacttctggaacaggttctgaagtgacaccatttgccgttatctctgacaaagcaaataatcgtaaatatccaatcgctgattattcattaacaccaactgtagctatcgttgatccggcccttgttatgactgttcctggttttattgcggctgatacgggtatggatgtattgacacatgcaacagaggcttatgtttcacagatggcaaatgattatacagacggacttgctcttcaagcaattaaaattgtgtttgactacttagaacgctcagtaaaagatgctgattttgaagcacgtgaaaagatgcacaatgcgtcaactatggcaggtatggctttcgccaatgcattcttaggtatttctcactcaatggcgcataaaattggcgcacaattccataccgtacacggacgtacaaatgcaattcttttgccgtatgttatccgctataatggaactcgtccagctaaaacagcaacatggcctaagtacaattactatcgtgctgacgaaaagtatcaagatatcgctaaattactcggcttaccagcagcaacaccagaagaagctgtcgaatcatatgcaaaagctgtgtatgaccttggaacacgtttaggtattaagatgaatttccgcgaccaaggcattgatgaaaaagaatggaaagaaaaatctcgtgaactagctttcttagcatatgaagatcaatgttcaccagcaaatccacgccttccgatggtagatcacatgcaagaaatcatcgaagatgcttattatggttatgaggaacgtccaggacgtcgtaag

SEQ ID NO: 874 - protein, 891 aa, Streptococcus agalactiae
MKHLTNQKESQMTEKTKAVETTDVALAIDTLVQNGLKALDEMRQLNQEQVDYIVAKASVAALDAHGELALHAVEETGRGVFEDKATKNLFACEHVVNNMRHTKTVGVIEEDDVTGLTLIAEPVGVVCGITPTTNPTSTAIFKSLISLKTRNPIIFAFHPSAQESSAHAARIVRDAAIAAGAPENCVQWIEQPSIDATNALMNHDGIATILATGGNAMVKAAYSCGKPALGVGAGNVPAYVEKSANIRQAAHDIVMSKSFDNGMVCASEQAVIIDKEIYKEFVEEFKSYHTYFVNKKEKALLEEFCFGAKANSKNCAGAKLNPNIVGKSAVWIAEQAGFTVPEGTNILAAECTEVSEKEPLTREKLSPVIAVLKAESTEDGVEKARQMVEFNGLGHSAAIHTKDADLAREFGTRIRAIRVIWNSPSTFGGIGDVYNAFLPSLTLGCGSYGRNSVGDNVSAINLLNIKKVGRRRNNMQWFKVPSKTYFERDSIQYLQKCRDVERVMIVTDHAMVELGFLDRIIEQLDLRRNKVVYQIFAEVEPDPDITTVMKGTDLMRTFKPDTIIALGGGSPMDAAKVMWLFYEQPEVDFHDLVQKFMDIRKRAFKFPELGKKTKFVAIPTTSGTGSEVTPFAVISDKANNRKYPIADYSLTPTVAIVDPALVMTVPGFIAADTGMDVLTHATEAYVSQMANDYTDGLALQAIKIVFDYLERSVKDADFEAREKMHNASTMAGMAFANAFLGISHSMAHKIGAQFHTVHGRTNAILLPYVIRYNGTRPAKTATWPKYNYYRADEKYQDIAKLLGLPAATPEEAVESYAKAVYDLGTRLGIKMNFRDQGIDEKEWKEKSRELAFLAYEDQCSPANPRLPMVDHMQEIIEDAYYGYEERPGRRK

SEQ ID NO: 875 - DNA, 2640 bp, Streptococcus pyogenes
atgactgaaggacataatactgttgaaacaacctctgtttctgtgacaattgatgctcttgttcaaaaaggtttagctgctcttgaagagatgcgtaagcttgaccaagaacaagttgattatatcgtagccaaagcttctgttgctgctttggatgctcacggtgaacttgctaaacatgcttatgaagaaacaggtcgcggtgtctttgaagataaagcaacaaaacatctatttgcttgtgagcatgtggttaataacatgcgccatcaaaaaacagtaggaattattgaagaagatgatgtgacaggtttgacattaattgctgagccggtgggtgttatctgtgggattacaccaacaactaacccaacttcaacagctatctttaaatctttgatttcgttaaaaacacgtaatccaattatttttgcctttcacccatcagcacaagaatcatcagcacatgccgctcgtattgttcgtgatgctgctattgccgctggtgctcctgaaaattgtgtgcagtgggttgaaacaccatcacttgaagcaacaaatgctttgatgaatcatgacggcattgccactatccttgcgacaggtggaaatgcgatggttaaagcggcatactcatgtgggaaacctgcccttggggtaggtgctggtaacgttccagcttatgttgaaaaatcagctaatatccgtcaagccgctcatgatattgtgatgtctaaatcatttgataatggtatggtctgtgcctctgaacaagctgttatcatcgataaagaaatctatgacgattttgtagcagaattcaaatcttaccatacttattttgtaaataaaaaagaaaaagcccttcttgaagaattctgttttggtgccaaagcaaatagcaaaaactgtgctggtgcaaaattaaatccaaatattgtaggaaaaccagctacttggattgcagaacaagctggatttactgttccagaaggaaccaatattcttgctgcagaatgtaaagaagtttcagaaaatgagcctttaacacgtgaaaaattatctccagtcattgctgttttaaaatctgaatcacgtgaagacggtgttgaaaaagctcgtcaaatggttgaatttaatggactcggtcactcagctgccattcatacagcagatgcagaattggcaaaagaatttggaactagaatccgtgctatccgcgtcatctggaattcaccttctacatttggtggtatcggggatgtttacaatgctttcttaccatcattgactcttggttgtggttcgtatggacgtaacgcagttggtgataacgttagtgctataaatctcttgaacatcaaaaaagtaggaagacgtagaaataatatgcaatggtttaaagttccttcaaaaacatacttcgaacgtgattcaattcaatatttgcaaaaatgtcgtgacgttgaacgtgtcatgattgttacagatcacgctatggttgagcttggtttcttggatcgtatcattgaacaacttgatcttcgtcgcaataaagttgtttatcagatctttgctgaagtagaaccagatccagacattacaactgttatgaaaggtactgaattaatgcgtaccttcaaaccagacaccattattgcccttggcgggggatcccctatggatgcagccaaagttatgtggctcttctacgagcaaccagaagttgatttccatgacctcgttcaaaaattcatggatatccgcaaacgtgcgttcaaattcccagaacttggtaagaaaacaaaatttgttgctatcccaacaacttctggaacaggttcagaggtgacaccatttgccgttatctctgacaaagcaaataatcgtaaatatccaatcgctgattactcattaacaccaactgtagccattgttgacccagctttggtattgactgttccaggctttattgctgctgatactggtatggacgttttgacacacgcaaccgaagcttacgtgtcacaaatggccaatgactttacggatggtttagctcttcaagccattaaaattgtttttgataatcttgaaaaatcagttaaaacagccgattttgaagcacgtgaaaagatgcataatgcgtcaactatggcaggtatggctttcgccaatgcattcttaggtatttctcactcaatggcgcataaaattggcgcacaattccataccgtacacggacgtacaaatgcaattcttttgccgtatgttatccgctataatgggactcgtccagctaaaacggcgacatggcctaagtataattactaccgtgcggatgaaaaataccaagacattgcgaaattgttagggcttccagcttctacaccagaagaagcagtggaatcttatgcgaaagctgtttatgatctgggttgccgagttggtattcaaatgaacttcaaagctcaaggtatcgacgaaaacgaatggaaagaacattctcgtgaattggcttaccttgcttatgaagaccaatgttcacctgctaacccacgtcttccaatggttgatcacatgcaagaaattattgaagatgcttactatggttatgctgaacgtccaggacgacgtaag

SEQ ID NO: 876 - protein, 880 aa, Streptococcus pyogenes
MTEGHNTVETTSVSVTIDALVQKGLAALEEMRKLDQEQVDYIVAKASVAALDAHGELAKHAYEETGRGVFEDKATKHLFACEHVVNNMRHQKTVGIIEEDDVTGLTLIAEPVGVICGITPTTNPTSTAIFKSLISLKTRNPIIFAFHPSAQESSAHAARIVRDAAIAAGAPENCVQWVETPSLEATNALMNHDGIATILATGGNAMVKAAYSCGKPALGVGAGNVPAYVEKSANIRQAAHDIVMSKSFDNGMVCASEQAVIIDKEIYDDFVAEFKSYHTYFVNKKEKALLEEFCFGAKANSKNCAGAKLNPNIVGKPATWIAEQAGFTVPEGTNILAAECKEVSENEPLTREKLSPVIAVLKSESREDGVEKARQMVEFNGLGHSAAIHTADAELAKEFGTRIRAIRVIWNSPSTFGGIGDVYNAFLPSLTLGCGSYGRNAVGDNVSAINLLNIKKVGRRRNNMQWFKVPSKTYFERDSIQYLQKCRDVERVMIVTDHAMVELGFLDRIIEQLDLRRNKVVYQIFAEVEPDPDITTVMKGTELMRTFKPDTIIALGGGSPMDAAKVMWLFYEQPEVDFHDLVQKFMDIRKRAFKFPELGKKTKFVAIPTTSGTGSEVTPFAVISDKANNRKYPIADYSLTPTVAIVDPALVLTVPGFIAADTGMDVLTHATEAYVSQMANDFTDGLALQAIKIVFDNLEKSVKTADFEAREKMHNASTMAGMAFANAFLGISHSMAHKIGAQFHTVHGRTNAILLPYVIRYNGTRPAKTATWPKYNYYRADEKYQDIAKLLGLPASTPEEAVESYAKAVYDLGCRVGIQMNFKAQGIDENEWKEHSRELAYLAYEDQCSPANPRLPMVDHMQEIIEDAYYGYAERPGRRK

SEQ ID NO: 877 - DNA, 93 bp, Streptococcus agalactiae
gtgcattatagtgatagcgatactacaggggctgatttatatgttagtaacgtcaaaaaagctattcaaaaatcagctcaacgagctgcaaaa

SEQ ID NO: 878 - protein, 31 aa, Streptococcus agalactiae
MHYSDSDTTGADLYVSNVKKAIQKSAQRAAK

SEQ ID NO: 879 - DNA, 1773 bp, Streptococcus pyogenes
atgagaataaaatggttttcgtttgttagggtaacaggacttttactggttttactctaccacttttttaaaaatgtatttccaggaggttttattggtgttgacattttcttcaccttttcaggatatctaatcacagccctcttgattgatgaatacacaaaaaaagagtctatcgatattatcggttttttaaaaagacgcttttatcgaattgttcctcctttggtgttaatgattttattgaccattccttttacgtttttaattaagaaggatttcattgctaatataggaagtcagattacagctgttttaggatttaccactaatatttatgaaatattgacgggaagtagttatgaaagccaatttattccacatctctttgttcatacgtggagcttagctattgaagttcatttttacttgttttggggtgtatttgtttggttattagctagacgcaaggagactcagaaacaactgagaggactactgtttttgatttctttgggaatatttgctattagtttcttgagcatgtttataagatcttttatgacctcaaatttttccctgatttatttttcgagtctttctcacagttttcccttctttttaggggcgatgtttgccacgataacaggtattaacgagactactgttcgatttcaaaaaaatgtacgtttatggccgcgccagtatgtccttgctgctatgattggagcatttacacttttgcttgtgctaacggtcacattggattttaaccatatcacgacctatctatttggctttgctttggctagcttattcgcatcaattatgatttatgcagcgcgtgttcttcatgagcaaacaccagatgtacaagagcctaaagctatcacttatatagctgatattagctatgggatttacctcttccattggccattttacattatttttagccaattaatgtctcatattttggcagttattctaacagttttcttttcaatcttgtttgccactgtgtcttactatattgtggaacctttggtccaagggagaaaaccaaacctgcttggtttagaaattgactgttctccttactataagtggattgtaggagggtctctcgccttagcattattaactttaggaacttgtatgatagcgcctaaagttggtaagtttgagaaacaattgttggtcagttccctacaacaggctcaaagtaatatggagcggacacatacactagctgcaggagacgctaatgctttgagtgacgtaggtattattggtgattctgtagcattacgctctagtgcagcattctcacaaattatgccacaagcgcaactggatgcagcggtcagtcggaattttaaagaagctttcgatttatttaataaccaaattaaatctaagagtctatctaagactgttgtcttagcagtaggtgttaactcgcttgacaactattctcaagcagttcagtcttttattgaggcattgccaaaaggtcatcgtttagttttggtttctccatataatgccaaaaatgccagtcaggttgcagaagctagagactatggtcttaaattgtccaaaaaatacaagtatgtcactattgcagactggtataaagttgctgttgaacatccagatatttggtatggcagtgatggtgttcattatagtgaagatagtcaaggagcagaactatatgtctccacaatccagactgctgttgagaagtcagctaaaaaaccagctaaa

SEQ ID NO: 880 - protein, 591 aa, Streptococcus pyogenes
MRIKWFSFVRVTGLLLVLLYHFFKNVFPGGFIGVDIFFTFSGYLITALLIDEYTKKESIDIIGFLKRRFYRIVPPLVLMILLTIPFTFLIKKDFIANIGSQITAVLGFTTNIYEILTGSSYESQFIPHLFVHTWSLAIEVHFYLFWGVFVWLLARRKETQKQLRGLLFLISLGIFAISFLSMFIRSFMTSNFSLIYFSSLSHSFPFFLGAMFATITGINETTVRFQKNVRLWPRQYVLAAMIGAFTLLLVLTVTLDFNHITTYLFGFALASLFASIMIYAARVLHEQTPDVQEPKAITYIADISYGIYLFHWPFYIIFSQLMSHILAVILTVFFSILFATVSYYIVEPLVQGRKPNLLGLEIDCSPYYKWIVGGSLALALLTLGTCMIAPKVGKFEKQLLVSSLQQAQSNMERTHTLAAGDANALSDVGIIGDSVALRSSAAFSQIMPQAQLDAAVSRNFKEAFDLFNNQIKSKSLSKTVVLAVGVNSLDNYSQAVQSFIEALPKGHRLVLVSPYNAKNASQVAEARDYGLKLSKKYKYVTIADWYKVAVEHPDIWYGSDGVHYSEDSQGAELYVSTIQTAVEKSAKKPAK

SEQ ID NO: 881 - DNA, 684 bp, Streptococcus agalactiae
  misc_feature (1)..(684): n = a, c, g, or t
atgagaataaaatggttttctttggtacgtataacaggactactacttgttttactttaccatttctttaagaatagttttccaggaggatttgttggcgttgacatcttctttacattttctggttttctgattacggccttattgattgatgaattttctaaaacgaaaaaaattgattttgttagtttttgtcgtagacgtttttaccgtattttcccaccattagtattgatggttttggtgacaataccttttgtatttctggttaaaagcgattttagagcaagtattggctctcaaattatgactgctttaggttttaccagcaacttttacgaaatcttgactggtggtaactacgaaagtcaatttatccctcacttatttgtgcatacctggagtctttctattgaagtccatttttatgttttatggggcttaacggtatggctcttatcgaaaagatcaaaagatcaaaagcaattgagggggactttgttccttatttccatgggaatttttggagtcagcttccttaccatgtttgttagagcctttttcgttgataatttttcaacgatatatttctctacattatcacatatatttccgttctttttaggagcgatggtggctacaatatctggtattcgagagattaccggacgattcaagnnnnnt

SEQ ID NO: 882 - protein, 228 aa, Streptococcus agalactiae
  MISC_FEATURE (1)..(228): Xaa = Any Amino Acid
MRIKWFSLVRITGLLLVLLYHFFKNSFPGGFVGVDIFFTFSGFLITALLIDEFSKTKKIDFVSFCRRRFYRIFPPLVLMVLVTIPFVFLVKSDFRASIGSQIMTALGFTSNFYEILTGGNYESQFIPHLFVHTWSLSIEVHFYVLWGLTVWLLSKRSKDQKQLRGTLFLISMGIFGVSFLTMFVRAFFVDNFSTIYFSTLSHIFPFFLGAMVATISGIREITGRFKXX

SEQ ID NO: 883 - DNA, 378 bp, Streptococcus agalactiae
atgaagaattttaaaataacacgaactcatctagaaatattatctttgataattattgttgtttttggtttatcagtatttaccttaacgacttctagtcaaggagtctttagctatgatggcggcaagataaaatatgtgggctctattgttaatcaccatatgactggtaaaggtaaattaacctatgagaatggggattactataagggcgattttgtaaatggagtctttgaagggaaaggaacatttgtttcagttcatggctggtcttatacaggtgactttaaaaaaggtcaacctgatggacaaggtcgcctcaatgctaaaaataagaaagtctataaggggacatttaaacaggggatttatcaaaaa

SEQ ID NO: 884 - protein, 126 aa, Streptococcus agalactiae
MKNFKITRTHLEILSLIIIVVFGLSVFTLTTSSQGVFSYDGGKIKYVGSIVNHHMTGKGKLTYENGDYYKGDFVNGVFEGKGTFVSVHGWSYTGDFKKGQPDGQGRLNAKNKKVYKGTFKQGIYQK

SEQ ID NO: 885 - DNA, 399 bp, Streptococcus pyogenes
atgatagatatgcaagatatagtaaaaaaatggagtattacacgggcgaagttggaaattgtctcggtgattgtcatattggtttgtgcaatttctgtttttagcgtaagaatttcgaataagacaagtttgacctatgataaagggcgtatgcactatactggttacgtgattaaccataaaatgaatggagaagggaagcttgtctaccccaacggtgatatctatgagggtacttttaaggatggcctatttgaaggaaaaggaacttttactgctaagacgggctggttatataacggggagtttcataaaggacaagcaaatggcaaaggtgtgttaaaagcaaagaataataaagtctataaagggatttttaaacaggggatatttcaaaaa

SEQ ID NO: 886 - protein, 133 aa, Streptococcus pyogenes
MIDMQDIVKKWSITRAKLEIVSVIVILVCAISVFSVRISNKTSLTYDKGRMHYTGYVINHKMNGEGKLVYPNGDIYEGTFKDGLFEGKGTFTAKTGWLYNGEFHKGQANGKGVLKAKNNKVYKGIFKQGIFQK

SEQ ID NO: 887 - DNA, 996 bp, Streptococcus agalactiae
atgacaagatttttagatagtgatgcaatgggtgacgaagaattggtagaacgtacacttcgtccgcagtatttaagagagtatattggacaagataaggttaaagatcagctaaaaatatttattgaagctgctaaattgcgtgatgagtcattggatcatgtgttattatttggccctcctggtttagggaaaacaaccatggcatttgtaattgctaatgagttgggtgtcaatctcaaacaaacatcaggtcccgcaattgaaaaatcaggggatttagtagccattttaaatgatttagaaccaggtgatgttctttttattgatgaaattcatcgtatgccgatggcggttgaagaggtactttatagtgcaatggaagacttctatattgacattatgatcggtgcaggagaaactagtagaagtgttcatctagatttgccgccctttaccttaattggtgcaacgacacgtgcaggtatgttatctaatcccttacgtgctcgctttggtattacagggcatatggagtattatgaagaaaatgatttgacagaaattattgagcgtacagcagacatttttgaaatgaaaattacttatgaagctgcttctgaattagcgcgtcgcagtcgtggaacgccacgtatcgctaaccgtttattgaaacgtgttcgagattatgctcaaatcatgggagatggtttgatagatgacaatattacagataaagcattaacgatgttagatgttgatcacgaggggcttgattacgtcgatcaaaaaatcttaagaaccatgattgaaatgtataatggaggtcctgttggtttaggaactctatccgttaatattgctgaagaacgagatactgttgaagacatgtacgaaccttatttaattcaaaaaggttttattatgcgtacccgtaccggtcgtgtagctacggttaaggcatatgaacatttaggttatcagcgatttgataaa

SEQ ID NO: 888 - protein, 332 aa, Streptococcus agalactiae
MTRFLDSDAMGDEELVERTLRPQYLREYIGQDKVKDQLKIFIEAAKLRDESLDHVLLFGPPGLGKTTMAFVIANELGVNLKQTSGPAIEKSGDLVAILNDLEPGDVLFIDEIHRMPMAVEEVLYSAMEDFYIDIMIGAGETSRSVHLDLPPFTLIGATTRAGMLSNPLRARFGITGHMEYYEENDLTEIIERTADIFEMKITYEAASELARRSRGTPRIANRLLKRVRDYAQIMGDGLIDDNITDKALTMLDVDHEGLDYVDQKILRTMIEMYNGGPVGLGTLSVNIAEERDTVEDMYEPYLIQKGFIMRTRTGRVATVKAYEHLGYQRFDK

SEQ ID NO: 889 - DNA, 1068 bp, Streptococcus pyogenes
gtgctgttgactggtggcgattataataaaagtaggccactgctctcttttactttatgttataatagtcttatggctagaattttagacaataatgtaatgggaaatgaggagttttcggatcggactcttcgccctcaatatctacacgaatatattggacaagataaagttaaggaacaattcgctatttttatagaagcagctaaaagacgtgacgaatctttagaccatgttttattatttggacctccaggactgggaaaaacaacaatggcatttgtgattgccaatgaattgggagttaatttaaagcaaacttcaggtcctgccgttgagaaagctggagatttggtagctattttaaatgaattagaaccaggggatattttgtttattgatgaaattcaccgcatgccaatgtctgtcgaggaagtactatatagtgctatggaagacttctatattgatattatgattggcgctggagatactagtcgtagtattcatttggatctgcctccatttacattgattggtgctactacacgtgcaggcatgttatctaatcccctcagagctcgttttggtatcactggtcacatggaatactatcaagaaaaggatttgacagagattgtggagcgtacagctactatttttgaaataaaaatagaccatgaagctgcacggaaattagcttgtcgcagtagaggaacgccccgcattgctaatcgattactaaaacgagtgcgtgactatgctcaaattattggtgatggcatcataacggctcaaataactgatagagctttgactatgttagatgttgaccgcgaaggtctcgattacattgatcagaaaattttacgaacgatgattgagatgtatcagggagggccagttggtttggggacattatctgtgaatattgccgaggagcgtaatacagttgaagagatgtatgaaccctacttaattcaaaaaggctttctcatgcgaacacgaacaggtcgtgtagcgacgcaaaaggcttatcgtcatcttggctatccctatcaaaacact

SEQ ID NO: 890 - protein, 356 aa, Streptococcus pyogenes
VLLTGGDYNKSRPLLSFTLCYNSLMARILDNNVMGNEEFSDRTLRPQYLHEYIGQDKVKEQFAIFIEAAKRRDESLDHVLLFGPPGLGKTTMAFVIANELGVNLKQTSGPAVEKAGDLVAILNELEPGDILFIDEIHRMPMSVEEVLYSAMEDFYIDIMIGAGDTSRSIHLDLPPFTLIGATTRAGMLSNPLRARFGITGHMEYYQEKDLTEIVERTATIFEIKIDHEAARKLACRSRGTPRIANRLLKRVRDYAQIIGDGIITAQITDRALTMLDVDREGLDYIDQKILRTMIEMYQGGPVGLGTLSVNIAEERNTVEEMYEPYLIQKGFLMRTRTGRVATQKAYRHLGYPYQNT

SEQ ID NO: 891 - DNA, 909 bp, Streptococcus agalactiae
atgttaaaacattttggtagtaaagtaagaaatttgagagtaactagaaatattactcgcgaagatttttgtggtgatgaaactgagttatctgtaagacaattagctaggattgaaagtggacagtcaattccaaacttgactaaagctcactacatagctaaacaattgaatgtaaaattggatattttaacaggaggagagagcttagaattacctaaacggtataaagagttgaagtatttgattttaagaattccaacttatgcagatgctgaacgattaaaattaagagaatgtcagtttgatcatattttcgaagaattctatgataatcttccagaagacgagtgcttagcaattgacagtttacaagctaaatttgaagtctatcaaacaggagacattaattttggtgtggaggttttatgcgaatgctttgataaagtaaaatataaagaaaaatatactcttaatgatttgattatcatagatttgtttttaacttgtgcagttgtatctaaatttaacaatagagcatttactaaagaagtatttcaaactatatgtaaaactttgataagtcagaaccacaaacttacagcagaagatttgttttggtttaatcatgtactcctgaattgtgtatttgttggactttgtttaaatagtgaagagtgtcttgcagaaatgttagaagttagccgacaaacgatggtgtcaacacatgattttcataaaatgcctttatattttatgtaccaatggaaatacttcattacaattgacaatgatataaagtctgcagaaaatgcttaccaacaatcaattatgttttcaaaaatgattgatgacaagcatctaattaaaaaattagaattggagtggcaagaagatataacaggacat

SEQ ID NO: 892 - protein, 303 aa, Streptococcus agalactiae
MLKHFGSKVRNLRVTRNITREDFCGDETELSVRQLARIESGQSIPNLTKAHYIAKQLNVKLDILTGGESLELPKRYKELKYLILRIPTYADAERLKLRECQFDHIFEEFYDNLPEDECLAIDSLQAKFEVYQTGDINFGVEVLCECFDKVKYKEKYTLNDLIIIDLFLTCAVVSKFNNRAFTKEVFQTICKTLISQNHKLTAEDLFWFNHVLLNCVFVGLCLNSEECLAEMLEVSRQTMVSTHDFHKMPLYFMYQWKYFITIDNDIKSAENAYQQSIMFSKMIDDKHLIKKLELEWQEDITGH

SEQ ID NO: 893 - DNA, 909 bp, Streptococcus pyogenes
atgttagaacattttggtggaaaagtaaaagtgttaagacttgaaaagaggattagtcgcgaggacttgtgtggggatgagtctgaactttctgttcgtcaattagcacggatagaactaggtcaatccataccaagtttaagtaaggttatttttattgcaaaagccttaaacgttagtgtcggttacttaactgatggtgctgatttagaactacctaagcgttacaaagaattaaaataccttatcttaaggacaccaacttacatggatgatggaaaattacaagtacgagaagagcagtttgatgaaatttttgaggattattatgataaattaccagaggaagagaaaataatcattgattgtttacaggcaactttagatactttattgagtgagaatactaactttggcattgacttacttcaagaatattttaatcaaataaagactaaggtacgctttaggcaaaatgatttaatacttctagaattatatttagcttatcttgatattgagggaatggatggacaatattcagataagattttttatgattctttattagataatctatcagaacaatttgaacaatttgaattagatgaattatttatagttaataagattatcattgatatttcatcactaagcttaaaaaataaccgacttgataatttagaaaaagcgattgaaatgagtcaaaaaattatggcgaaaattcaagattggaatagaatgcctattttaaaactaatagaatggaaatattttttaatcaaacaaaaagatataataaaagcagaacaatcatttatgaaggcatgtttgttcgcccaaatgacagctgatcagtatttggaaaacaagttaattcaagagtgggaaaaagatgttaaaagttat

SEQ ID NO: 894 - protein, 303 aa, Streptococcus pyogenes
MLEHFGGKVKVLRLEKRISREDLCGDESELSVRQLARIELGQSIPSLSKVIFIAKALNVSVGYLTDGADLELPKRYKELKYLILRTPTYMDDGKLQVREEQFDEIFEDYYDKLPEEEKIIIDCLQATLDTLLSENTNFGIDLLQEYFNQIKTKVRFRQNDLILLELYLAYLDIEGMDGQYSDKIFYDSLLDNLSEQFEQFELDELFIVNKIIIDISSLSLKNNRLDNLEKAIEMSQKIMAKIQDWNRMPILKLIEWKYFLIKQKDIIKAEQSFMKACLFAQMTADQYLENKLIQEWEKDVKSY

SEQ ID NO: 895 - DNA, 1296 bp, Streptococcus agalactiae
atgatcgaacgttattcacgccctgagatggcggcaatttggacagaggaaaataaataccgtgcttggttggaggtcgagattttggctgacgaggcatgggctgagttgggtgagattcctaaggaggatgtggctaagattcgtgagaaggcggattttgacattgaccgcattcttgagattgagcaggacacgcgtcacgatgtggtggctttcactcgtgcggtttctgagacgcttggtgaggagcgcaagtgggtgcactacggtttgacgtcgactgacgtggtggacactgcctacggttacctctacaagcaggctaacgatattatccgtcgtgaccttgagaatttcacaaatattgtggctgataaggctaaggagcacaagttcaccatcatgatgggtcgtacccacggtgttcacgctgagccaacgactttcggtcttaagttggcgacctggtacagcgagatgaaacgtaatattgagcgttttgaacatgctgccgcaggtgtggaagctggtaagatttcaggtgccgttggtaactttgctaacattcctccatttgtggaacaatatgtttgtgacaaattgggcatccgtccgcaagagatttcaacacaggttcttccacgtgacctccacgcagaatattttgcagtgcttgcaagcattgcaacttctatcgaacgtatggcgacagagattcgtggtctgcaaaaatcagaacaacgtgaagttgaagaattctttgccaaaggtcagaaaggtagctctgctatgcctcacaaacgcaacccaatcggttcagagaacatgactgggctagcgcgcgtgattcgtggtcacatggtgacggcttatgagaacgtggcactttggcacgagcgtgatatttcgcactcatctgctgagcgtatcatcacacctgacacaacgatcttgattgactacatgctcaaccgttttggcaatatcgttaagaacttgactgtcttcccggaaaatatgatgcgcaatatggaatcaacttttggtttgatttatagtcaacgtgttatgctcaaattgattgaaaaaggaatgacacgagaagaagcttatgacttagttcaacctaagacagcttattcctgggacaatcaagtggatttcaaaccacttttagaagaagacaccaaagttacctcttgtcttacacaggaagaaattgatgaactatttaatccgatttattacacaaaacgtgttgatgatatttttgaaagactaggattagaaaaa

SEQ ID NO: 896 - protein, 432 aa, Streptococcus agalactiae
MIERYSRPEMAAIWTEENKYRAWLEVEILADEAWAELGEIPKEDVAKIREKADFDIDRILEIEQDTRHDVVAFTRAVSETLGEERKWVHYGLTSTDVVDTAYGYLYKQANDIIRRDLENFTNIVADKAKEHKFTIMMGRTHGVHAEPTTFGLKLATWYSEMKRNIERFEHAAAGVEAGKISGAVGNFANIPPFVEQYVCDKLGIRPQEISTQVLPRDLHAEYFAVLASIATSIERMATEIRGLQKSEQREVEEFFAKGQKGSSAMPHKRNPIGSENMTGLARVIRGHMVTAYENVALWHERDISHSSAERIITPDTTILIDYMLNRFGNIVKNLTVFPENMMRNMESTFGLIYSQRVMLKLIEKGMTREEAYDLVQPKTAYSWDNQVDFKPLLEEDTKVTSCLTQEEIDELFNPIYYTKRVDDIFERLGLEK

SEQ ID NO: 897 - DNA, 1290 bp, Streptococcus pyogenes
atgctagaacgttattcacgccctgagatggcggcaatttggacagaggaaaataaataccatgcttggttggaggtcgagattttggctgacgaggcatgggctgagttgggtgagattcctaaggaggatgtggctaagattcgtgagaaggcggattttgacattgaccgcattcttgaaattgagcaggacacgcgtcacgatgtggtggctttcacgcgtgcggtttctgaaacgcttggtgaggagcgcaagtgggtgcactacggtttgacctcgactgacgtggtggacactgcctatggttacctctacaagcaagctaacgacattatccgtcgcgatcttgagaatttcaccaatatcgtggcagacaaggcgcgtgagcacaaaatgaccatcatgatgggtcgtacccacggtgttcacgccgagccaacgactttcggtcttaagttggcgacttggtacagcgagatgaaacgtaatattgagcgttttgaacatgctgccgcaggtgtggaagctggtaagatttcaggtgccgttggtaactttgccaacatcccaccttttgtggaagaatatgtctgtgacaaattaggcattcgtccgcaagaaatttcaacacaagttcttccacgtgaccttcacgcagaatattttgcagtgcttgcaagtattgcaacttctatcgaacgtatggcgacagagattcgaggtctgcaaaagtcagaacaacgtgaagttgaagaattctttgccaaaggtcagaaaggtagctctgctatgcctcacaaacgcaacccaatcggttcagagaacatgacagggctagcgcgcgtgattcgtggtcacatggtgacagcttatgagaacgtgtcactttggcatgagcgtgacatttcgcactcatcagctgagcgtatcatcacacctgacacaactatcttgattgactacatgctcaaccgctttggtaatatcgttaagaacttgactgtcttcccggaaaatatgatgcgcaatatggaatcaacttttggtttgatttatagtcaacgtgttatgctcaaattgattgaaaaaggaatgacacgagaagaagcttatgacttagttcaacctaagacagcttattcctgggacaatcaagtggatttcaaaccacttttagaagaagacaccaaagttacctcttgtcttacacaagaagaaattgatgaactatttaatccgatttattacacaaaacgtgttgatgatatttttaagcgtttagggatt

SEQ ID NO: 898 - protein, 430 aa, Streptococcus pyogenes
MLERYSRPEMAAIWTEENKYHAWLEVEILADEAWAELGEIPKEDVAKIREKADFDIDRILEIEQDTRHDVVAFTRAVSETLGEERKWVHYGLTSTDVVDTAYGYLYKQANDIIRRDLENFTNIVADKAREHKMTIMMGRTHGVHAEPTTFGLKLATWYSEMKRNIERFEHAAAGVEAGKISGAVGNFANIPPFVEEYVCDKLGIRPQEISTQVLPRDLHAEYFAVLASIATSIERMATEIRGLQKSEQREVEEFFAKGQKGSSAMPHKRNPIGSENMTGLARVIRGHMVTAYENVSLWHERDISHSSAERIITPDTTILIDYMLNRFGNIVKNLTVFPENMMRNMESTFGLIYSQRVMLKLIEKGMTREEAYDLVQPKTAYSWDNQVDFKPLLEEDTKVTSCLTQEEIDELFNPIYYTKRVDDIFKRLGI

SEQ ID NO: 899 - DNA, 1389 bp, Streptococcus agalactiae
atgaatagaataataaacagggatattttacctagaatttcaaagatttctaaaaataataaagagaaagatttactatctatagcttatattacttggctaatctttataatatttgctttgggagtagttacagttaatgatttaaaaccgatgtttaatcaattaatagtaaacctcttaaatatttattattatatggaagccttcatattgggtatggacagctatttacaatataaccttccatacagttttgatttttggagtatttttgtagaggctataaatttatttgtaaaagtatttttaattgcttttattccttctgttattagaaaagtattgaaaaaagaaagttttttcaatgaagttgttattttactaggagcgattgttactataattgtaagtttccatttatatttagagatattgatagtagtgggactaatacttttattaattgcttttgtttcaataggtaagaatcgtgtttataattttgttcaaaatttaaactactttgaagaagtgatttggaattattttgaagaaaatccggttaaaataaaagaaaaatcattgattattaaatttttacttactatttcttttgtttttgtaattgattttgcaatggttagattgttgaattttaatataaaattttctacaatattagcttgttctgctattttattagcatggttataccaaaataagtctgttacagaacccttcctattaaaaaagttagttatctattttatttttttcattgccactttaattggtaatttaaaaaatgagttgtcaatcttagaaacaccattactttttattagtatattttttactatggatagaattattgctctatctaaagaaatgcgtgatttgattatatctaagagtattttattttattatgatcatgaaaatataaagccatcaatattacttagtgagataaaagaaattaagtatcttgaaaatgtagatattggagaacttgaacttgttaggcaaatggtaattaggttgcgtctagagttagaggaagaatttttgattttatcagatatatatatgaaaaatggctatgaaaaatatatacaatttgttcaaggaaatgtttattttatcaacttagaattggataaaattcccaactacactaacttgaaattaatactagaatcaatatttgatcataataatcaaaagatatttatacctaaactttatgaggaatacatatacatcttaatttctttaggagaagttgaaaaagctaaagaaatattaaaagaagtgtcggattatttaactgaagaatctttgaattattttgaaaaagaatatgataaagctaagggtagtaat

SEQ ID NO: 900 - protein, 463 aa, Streptococcus agalactiae
MNRIINRDILPRISKISKNNKEKDLLSIAYITWLIFIIFALGVVTVNDLKPMFNQLIVNLLNIYYYMEAFILGMDSYLQYNLPYSFDFWSIFVEAINLFVKVFLIAFIPSVIRKVLKKESFFNEVVILLGAIVTIIVSFHLYLEILIVVGLILLLIAFVSIGKNRVYNFVQNLNYFEEVIWNYFEENPVKIKEKSLIIKFLLTISFVFVIDFAMVRLLNFNIKFSTILACSAILLAWLYQNKSVTEPFLLKKLVIYFIFFIATLIGNLKNELSILETPLLFISIFFTMDRIIALSKEMRDLIISKSILFYYDHENIKPSILLSEIKEIKYLENVDIGELELVRQMVIRLRLELEEEFLILSDIYMKNGYEKYIQFVQGNVYFINLELDKIPNYTNLKLILESIFDHNNQKIFIPKLYEEYIYILISLGEVEKAKEILKEVSDYLTEESLNYFEKEYDKAKGSN

SEQ ID NO: 901 - DNA, 240 bp, Streptococcus agalactiae
atgtcaccaccttatagggagcgacagtcacgccagccttatttgccagaaagtctttttcaaagatacggttttgagaaatgcggagcagatcagtcccctgcggtagctgaccagctgacacaacggcatccagaccatcggcatcgacattctcaaactcataggtcaaaacatcgcaacgcgcagctaatgttcccaaagcctcaacatcatcgtaaggtgccacaatcacctcgc

SEQ ID NO: 902 - protein, 80 aa, Streptococcus agalactiae
MSPPYRERQSRQPYLPESLFQRYGFEKCGADQSPAVADQLTQRHPDHRHRHSQTHRSKHRNAQLMFPKPQHHRKVPQSPR

SEQ ID NO: 903 - DNA, 1125 bp, Streptococcus agalactiae
atgaggaacaaggaaaaatcgcagaggagtcaagcaatgaactcatttaagaccattgggattattggtggtggtcagctggggcagatgatggcgattgcggctatctacatgggccacaaggtcattacgctggatccagctagcgactgccctgcctcccgcgttagcgaggtgattgtggcaccttacgatgatgttgaggctttgggaacattagctgcgcgttgcgatgttttgacctatgagtttgagaatgtcgatgccgatggtctggatgccgttgtgtcagctggtcagctaccgcaggggactgatctgctccgcatttctcaaaaccgtatctttgaaaaagactttctggcaaataaggctggcgtgactgtcgctccctataaggtggtgacatctagccttgacctagaggggcttgacttgaccaagacctatgtcctcaagacagcgacaggtggttatgacggtcatgggcaaaaggttatccgctcagcagaagacctgccagaggcgcagcaattagccaactcagctcagtgtgtcttggaagagtttgtcaacttcgaccttgaaatatcagtcatcgtgtctggaaatggtcaggatgtgacggtctttcccgttcaggaaaatatccaccgcaacaatatcctgtcaaaaaccatcgtaccagctcgcatctcagaccaactagctgacaaggctaaggaaatggctgtgcagattgccaagaaactccagctatcaggaaccctctgtgtggaaatgtttgcgaccgcagatgacatcatcgtcaatgaaattgccccacgtccccacaactcagggcactactctatcgaagcctgcgacttttcacagtttgacacccacatcttgggcgtactgggcgcaccgcttccgccaatcaaactccatgctccagccgttatgttcaatgtcctaggacaacatgtccagcaggcaattgaccatgttgcccaaaaccctagcgcccacctccacatgtatggtaaactagaagcaaaacataaccgcaaaatgggacacgtgacggtgtttagcgatgtacctgatgaggtggaagagtttgaagaaaggatggatttc

SEQ ID NO: 904 - protein, 375 aa, Streptococcus agalactiae
MRNKEKSQRSQAMNSFKTIGIIGGGQLGQMMAIAAIYMGHKVITLDPASDCPASRVSEVIVAPYDDVEALGTLAARCDVLTYEFENVDADGLDAVVSAGQLPQGTDLLRISQNRIFEKDFLANKAGVTVAPYKVVTSSLDLEGLDLTKTYVLKTATGGYDGHGQKVIRSAEDLPEAQQLANSAQCVLEEFVNFDLEISVIVSGNGQDVTVFPVQENIHRNNILSKTIVPARISDQLADKAKEMAVQIAKKLQLSGTLCVEMFATADDIIVNEIAPRPHNSGHYSIEACDFSQFDTHILGVLGAPLPPIKLHAPAVMFNVLGQHVQQAIDHVAQNPSAHLHMYGKLEAKHNRKMGHVTVFSDVPDEVEEFEERMDF

SEQ ID NO: 905 - DNA, 1107 bp, Streptococcus pyogenes
atgaggaacaaggaaaaatcgcagaggagtcaagtggtgaactcatttaagaccattgggattatcggtggtggtcagctggggcagatgatggccattgcggctatctatatgggtcacaaggtcatcacgctggatcctgctagcgacagccctgcctcccgcgttagcgaggtaattgtggcgccttacgatgatgttgaggctttgggacaattggctgcgcgttgcgatgtgttgacttatgagtttgagaatgttgatgcggacggtttggatgccgttgtgtcagcttgtcagctaccgcaggggaccgatctgctccgcatttcccaaaaccgtatcgttgaaaaagactttctggcaaataaggctggtgtgacagtcgctccctataaggtggtgacgtctagccttgacctaggggggcttgatttgaccaagacctatgtcctcaagacagagacaggtggttatgacggtcatgggcaaaagattatccgctcagcagaagatttgccagaggcgcagcaattagctaactcagctcagtgtgtcttggaagagtttgtcaactttgaccttgaaatctcagtcatcgtgtctggaaatggcaaggatgtgacggtctttcccgttcaggaaaatatccaccgcaacaatatcctgtcaaaaaccatcgtaccagctcgcatctcagatcaactggctgataaggctaagaaaacggcggtgcagattgccaagaaactccagctgtcaggaactctctgtgtggaaatgtttacgaccgcagatgatatcattgtcaatgaaattgccccacgcccccacaactcagggcgctattctatcgaagcctgcgacttttcacagtttgacacccacatcttgggtgtgttgggcgcaccacttcctcagattcagctccacgccccagccgtcatgctcaatgtcctaggacaacatgtccagcaggcaactgactatgttgccaaaaaccctagcgcccacctccacatgtatggtaaactagaagcgaaacataaccgcaaaatgggacatgtgacggtgtttgcaaaagatgcggatgaggtgaaggagttt

SEQ ID NO: 906 - protein, 369 aa, Streptococcus pyogenes
MRNKEKSQRSQVVNSFKTIGIIGGGQLGQMMAIAAIYMGHKVITLDPASDSPASRVSEVIVAPYDDVEALGQLAARCDVLTYEFENVDADGLDAVVSACQLPQGTDLLRISQNRIVEKDFLANKAGVTVAPYKVVTSSLDLGGLDLTKTYVLKTETGGYDGHGQKIIRSAEDLPEAQQLANSAQCVLEEFVNFDLEISVIVSGNGKDVTVFPVQENIHRNNILSKTIVPARISDQLADKAKKTAVQIAKKLQLSGTLCVEMFTTADDIIVNEIAPRPHNSGRYSIEACDFSQFDTHILGVLGAPLPQIQLHAPAVMLNVLGQHVQQATDYVAKNPSAHLHMYGKLEAKHNRKMGHVTVFAKDADEVKEF

SEQ ID NO: 907 - DNA, 582 bp, Streptococcus agalactiae
gtgggtacgtcttcgaaatcaaagatttcggacttaccgcatatttttctacgaaaattttcgacaagtcgaaacgtccctttgtatcttaatattatgcaaccaattatttctattatcatgggttccaaatccgactggacaaccatgcaaaaaacggctgaagttctagataactttggcattgcttacgagaagaaagtcgtctctgcccaccgtacgccagacctcatgttcaagcatgctgaggaggcgcgtggtcgtggtatcaagattatcatcgctggagcaggtggagcagcccacttgccgggtatggtagcagctaaaacaaccctgcctgttatcggtgtgcctgtcaaatcacgtgccctctcaggtttggattcgctctactctattgtgcagatgcctggtggtgtgcctgtggcgaccatggctatcggagaagcaggagcgactaacgctgccctgacagccctccgtatcctctctatcgaggatcaaaatctggctgatgcgctagctcatttccatgaggaacaaggaaaaatcgcagaggagtcaagcaatgaactcatt

SEQ ID NO: 908 - protein, 194 aa, Streptococcus agalactiae
MGTSSKSKISDLPHIFLRKFSTSRNVPLYLNIMQPIISIIMGSKSDWTTMQKTAEVLDNFGIAYEKKVVSAHRTPDLMFKHAEEARGRGIKIIIAGAGGAAHLPGMVAAKTTLPVIGVPVKSRALSGLDSLYSIVQMPGGVPVATMAIGEAGATNAALTALRILSIEDQNLADALAHFHEEQGKIAEESSNELI

SEQ ID NO: 909 - DNA, 609 bp, Streptococcus pyogenes
atgctaaagcacctagtcgccctgacgtgggttcgtcttcgaaatcaaagatttcggacttacctcatatttttctacggaaagtttcgacaagtcgaaacgcccctttgtatcttaattatgaaaactccaattatttctattatcatgggctccaaatctgactgggcaaccatgcaaaaaacggctgaagttctagacaactttggcattgcttacgagaagaaagtcgtctctgcccaccgtacgccagacctcatgttcaagcatgctgaggaagcacgtggtcgtggcatcaaaatcatcatcgcaggagcaggtggggcagctcacttgcctggtatggtggcagctaaaacaacgctgcctgttatcggtgtgcctgtcaaatcacgtgccctttcaggtttggattcgctatattccattgtgcagatgcctggcggtgtgcctgtggcaaccatggctatcggagaagcgggagcgactaacgctgccctgacagccctccgtatcctctctatcgaggaccaaaatctggctgatgcgctagctcatttccatgaggaacaaggaaaaatcgcagaggagtcaagtggtgaactcatt

SEQ ID NO: 910 - protein, 203 aa, Streptococcus pyogenes
MLKHLVALTWVRLRNQRFRTYLIFFYGKFRQVETPLCILIMKTPIISIIMGSKSDWATMQKTAEVLDNFGIAYEKKVVSAHRTPDLMFKHAEEARGRGIKIIIAGAGGAAHLPGMVAAKTTLPVIGVPVKSRALSGLDSLYSIVQMPGGVPVATMAIGEAGATNAALTALRILSIEDQNLADALAHFHEEQGKIAEESSGELI

SEQ ID NO: 911 - DNA, 1263 bp, Streptococcus agalactiae
atgaaattgcttgttgttggttctggtggtcgtgagcatgcgattgctaagaagttgttagcgtctaaggatgtggatcaggtttttgtggcacctggtaatgatggtatgaccttggatggtctagacttggtaaatatcggaatttccgaacattctagactgattgactttgttaaggagaatgagattgcttggacccttattggtcctgatgatgcgctagcagctggtatcgttgatggttttaatagtgctggactcagagcatttggtccaaccaaggcagccgcggagctagagtggtcaaaagactttgccaaggaaatcatggtcaaatacaatgttccaacagcagcctatggcacattttcagattttgaaaaagctaaagcctacatcgaagagcagggcgcaccaatcgtggtcaaggctgacggattggcgttaggcaagggcgtggtcgtggctgaaaccgttgagcaggcggtagaggcggcgcaagagatgcttttggacaacaagtttggcgactcgggtgcgcgcgtggttatcgaggaattcttggatggtgaagagttctcccttttcgccttcgctaatggcgataagttctacatcatgccgacagctcaggatcacaagcgtgcctatgatggtgacaaggggctaaataccggtggtatgggtgcctatgcgccagttccccacctgcctcagagcgtggtggatacagcagttgagactatcgttaagcctgtccttgaaggcatgattgccgaagggcgtccttatctaggtgtcctctatgctgggcttatcctgacggctgatggccctaaggttatcgagttcaactcacgttttggtgaccctgaaactcagattatcctccctcgcctgacttccgatttcgctcagaacatcgacgacatcatgatgggcatcgagccttacatcacttggcagaaggacggcgtgactctgggcgttgtcgttgcctcagaaggctatccgctcgattacgagaaaggtgtgccactgcctgaaaagaccgacggcgacatcatcacctactatgcgggagctaagtttgcggaaaatagcaaagcactgctctcaaacggaggacgtgtctacatgcttgtcaccacagaagacagcgtcaaagcagggcaggacaaaatctatacccaactcgcccaacaagacacaacaggcctcttctaccgaaacgacatcggaagcaaagctattaaggaa

SEQ ID NO: 912 - protein, 421 aa, Streptococcus agalactiae
MKLLVVGSGGREHAIAKKLLASKDVDQVFVAPGNDGMTLDGLDLVNIGISEHSRLIDFVKENEIAWTLIGPDDALAAGIVDGFNSAGLRAFGPTKAAAELEWSKDFAKEIMVKYNVPTAAYGTFSDFEKAKAYIEEQGAPIVVKADGLALGKGVVVAETVEQAVEAAQEMLLDNKFGDSGARVVIEEFLDGEEFSLFAFANGDKFYIMPTAQDHKRAYDGDKGLNTGGMGAYAPVPHLPQSVVDTAVETIVKPVLEGMIAEGRPYLGVLYAGLILTADGPKVIEFNSRFGDPETQIILPRLTSDFAQNIDDIMMGIEPYITWQKDGVTLGVVVASEGYPLDYEKGVPLPEKTDGDIITYYAGAKFAENSKALLSNGGRVYMLVTTEDSVKAGQDKIYTQLAQQDTTGLFYRNDIGSKAIKE

SEQ ID NO: 913 - DNA, 1410 bp, Streptococcus pyogenes
ttggctaatagagtgttccttatttcaagaattgtggtctactatcacatttttacaatgtttcaattattgataactaatacattatgtaaaaaagcgaacgtttatgatataatatctaattataatacgaaagaggtggatgttttgaaattacttgttgttggttcaggtggtcgtgaacatgcgattgctaagaagttgttagcgtctaagggtgtggatcaggtttttgtggcacctggtaatgatggtatgaccttggatggtctggacttggtgaatatagtagtttccgaacattccaggttgattgcctttgctaaggagaatgagatttcttgggcctttattggtcctgatgatgcgctagcagctggtatcgttgatgatttcaacagtgctggactcagagcttttggtccaacaaaggcagcagcggagctagagtggtcaaaagactttgccaaggaaatcatggtcaaatacaatgtcccaacagcagcctatggcacattttcagactttgaaaaagccaaagcctacatcgaagagcagggcgcacctatcgtggtcaaggctgatggcttggcgctaggtaagggtgtggtcgtggctgaaaccgttgagcaggcggtagaggcggcgcaagagatgcttctggacaataagtttggcgattcaggagcgcgtgtggttatcgaggaattcttggatggcgaggagttttccctctttgcctttgctaatggcgataagttctacatcatgccgacagctcaggatcacaagcgtgcctttgacggagacaaggggccaaacactggtggtatgggtgcctatgcgccagttcctcatctacctcagagcgtggtagacacagcggttgagatgatcgttaggcctgtccttgagggcatggttgccgaagggcgtccttatctaggtgtcctctatgtggggcttatcctgacagctgatggacctaaggttatcgagttcaactcacgtttcggtgaccctgaaactcagattatcctccctcgcctgacttctgatttcgctcagaatattgacgatatcatgatgggcattgagccttacatcacttggcagaaggacggtgtgactttgggtgttgtcgttgcctcagaaggctatccattcgattatgagaaaggtgtgccactgcctgaaaagaccgacggcgatatcatcacctactacgcaggagttaagttttcggaaaatagcgagctacttctctcaaacggaggacgtgtctatatgctcgtcaccacagaagacagcgtcaaagcagggcaggacaaaatctatacccaactggcccaacaagacacaacaggtctcttctaccgaaatgatatcggaagcaaagctataagagaa

SEQ ID NO: 914 - protein, 470 aa, Streptococcus pyogenes
LANRVFLISRIVVYYHIFTMFQLLITNTLCKKANVYDIISNYNTKEVDVLKLLVVGSGGREHAIAKKLLASKGVDQVFVAPGNDGMTLDGLDLVNIVVSEHSRLIAFAKENEISWAFIGPDDALAAGIVDDFNSAGLRAFGPTKAAAELEWSKDFAKEIMVKYNVPTAAYGTFSDFEKAKAYIEEQGAPIVVKADGLALGKGVVVAETVEQAVEAAQEMLLDNKFGDSGARVVIEEFLDGEEFSLFAFANGDKFYIMPTAQDHKRAFDGDKGPNTGGMGAYAPVPHLPQSVVDTAVEMIVRPVLEGMVAEGRPYLGVLYVGLILTADGPKVIEFNSRFGDPETQIILPRLTSDFAQNIDDIMMGIEPYITWQKDGVTLGVVVASEGYPFDYEKGVPLPEKTDGDIITYYAGVKFSENSELLLSNGGRVYMLVTTEDSVKAGQDKIYTQLAQQDTTGLFYRNDIGSKAIRE

SEQ ID NO: 915 - DNA, 801 bp, Streptococcus agalactiae
atgactatttatgaccaaattgagtctgctcttgatttaatgactgatttagaacgtgaaattgcttgttattttatggggcagcccatttcaaaagacgctcttgcttctaccattgtcactaagcaactacacatttcacaagcagccttaacgcgttttgctaaaaaatgtgggtttaaaggctatcgtgaatttgtttttgaatatttaaaaagccatgagaccatcagtcaacaattatacggtcttcaaaatgacaacactaagaaagtatttatgaattatcaagagatgatttctaaatctgctgatattattgatgaagaacagcttctagaagtatcacatatgattgagcaagctgatcgtgtttatttttatggcaaagggagctcatcgctagtagctaaagaatttaaaatacgccttatgaggctgggagtgatttgtgaggctctggatgatacagatagtttctcatggactaatagtattgttaatgatagatgcctcgtcattgccttctcactttctgggaacaccaactctgttattggtgccttaaaaatcgcaagttgtcacggagctaaaaccgttctatttacaaaacaacctcacacaattgactatgcttttgacaagattattcaggtggcttctgctaggcatttagactacggcaatagaatttcgcctcagatcccaatgttaatcatggtagatattatctatgcacaatttttagatattaataaaatagaaaaagagcgaatttttagagaaaccattattcaacgc

SEQ ID NO: 916 - protein, 267 aa, Streptococcus agalactiae
MTIYDQIESALDLMTDLEREIACYFMGQPISKDALASTIVTKQLHISQAALTRFAKKCGFKGYREFVFEYLKSHETISQQLYGLQNDNTKKVFMNYQEMISKSADIIDEEQLLEVSHMIEQADRVYFYGKGSSSLVAKEFKIRLMRLGVICEALDDTDSFSWTNSIVNDRCLVIAFSLSGNTNSVIGALKIASCHGAKTVLFTKQPHTIDYAFDKIIQVASARHLDYGNRISPQIPMLIMVDIIYAQFLDINKIEKERIFRETIIQR

SEQ ID NO: 917 - DNA, 840 bp, Streptococcus pyogenes
gtgtgctttgctatgcctaaaaaccaccgcctaattaccaaaatcgaagcatcattggaacatatgaccagtttagaaaaagggattgctcatttttttattacaaccgatctgacacctcaagagttgaccgcatccgagatagttaagcgactacacatctctcaagccgccttgactcgatttgcaaaaaaatgtggttttactggttatcgtgcttttgcctttgattaccttcacagtcttcaagaatcacaagagactttccaatctattcacttagaattgacaaagcgcgtgctgatggactacgacgctcttattaataaaacctatgagctcgttaatgaggaaaaattactgaacttagccaagctgatcgattcttctgagcgagtctatttctttggcaaaggatcttctggactagtagcaagagaaatgaagctacgctttatgcgacttggtttaatctgtgatgcttattcagacactgatggttttacttgggcaaatagcctcgtcaatgaaaattgccttgtttttggtttttctttatctggcaaaacaaactctgtcatcacagcacttcatcaagctagtcagcgaggagccaaaactgtcctcttaacaacagataatcaaaccgaatttgacgactccttagatattattcccgtatcatcaactcaccaactacattatgggaatcgtgtgtcaccacaatttcctcttcttattatgatggacattatttatgcttacgttttagcgattgacaaaccgcacaaagaaaaaatcttcaaaaacactattattgacaaagaaaataacgacctt

SEQ ID NO: 918 - protein, 280 aa, Streptococcus pyogenes
VCFAMPKNHRLITKIEASLEHMTSLEKGIAHFFITTDLTPQELTASEIVKRLHISQAALTRFAKKCGFTGYRAFAFDYLHSLQESQETFQSIHLELTKRVLMDYDALINKTYELVNEEKLLNLAKLIDSSERVYFFGKGSSGLVAREMKLRFMRLGLICDAYSDTDGFTWANSLVNENCLVFGFSLSGKTNSVITALHQASQRGAKTVLLTTDNQTEFDDSLDIIPVSSTHQLHYGNRVSPQFPLLIMMDIIYAYVLAIDKPHKEKIFKNTIIDKENNDL

SEQ ID NO: 919 - DNA, 975 bp, Streptococcus agalactiae
atgattgaaacaatgtcgctagatgacatgagagaatacctaggtcaagaccaaattcccgaggattttgatgacttctggaaaaaacaaacaatgaaatatcaagggaatattgagtatcgtctagacaaaaaagatttcaatattacttttgcacaagcttatgatcttcattttaaaggcagcaataactctattgtctatgccaaatgtttattccctaaaacaaataaaccctatcctgtagttttttattttcatggttaccaaaaccaaagtcctgactggagtgaccaacttaattatgtagcagcaggttacggcgttgtttcaatggatgttcgaggtcaagctggacagtctcaagacaaggggcattttgatggcattacagttaagggccagattgtgcgaggaatgatctcaggaccaaatcatcttttttataaagacatttatcttgatgttttccaattgattgatatcattgctacattagagagtgttgatagtaatcaactttatagttatggctggtctcaaggtggagcacttgctttgatagctgcagctcttaatcccaaaatcgtcaagaccgttgctgtttacccatttttgtcagactttagacgagtattagatttagggggtgtcagtgagccctatgatgaactcttccgctattttaaatatagtgatccttttcataaaacagagaataatgtgttaaaaactttggcttatattgatgttaaaaattttgcacataggatttcttgccccgttgttttactaacagccttaaaagatgatatttgtcctccatcaactcaatttgccatttttaatcgtctgacatcaactaaaaagcatcttttattaccagattatggacatgatccaatgacagtgcaagtaaaagaccatatttttgatcaactgacaggaagtcaatttacaaagcaaaaaatcgag

SEQ ID NO: 920 - protein, 325 aa, Streptococcus agalactiae
MIETMSLDDMREYLGQDQIPEDFDDFWKKQTMKYQGNIEYRLDKKDFNITFAQAYDLHFKGSNNSIVYAKCLFPKTNKPYPVVFYFHGYQNQSPDWSDQLNYVAAGYGVVSMDVRGQAGQSQDKGHFDGITVKGQIVRGMISGPNHLFYKDIYLDVFQLIDIIATLESVDSNQLYSYGWSQGGALALIAAALNPKIVKTVAVYPFLSDFRRVLDLGGVSEPYDELFRYFKYSDPFHKTENNVLKTLAYIDVKNFAHRISCPVVLLTALKDDICPPSTQFAIFNRLTSTKKHLLLPDYGHDPMTVQVKDHIFDQLTGSQFTKQKIE

SEQ ID NO: 921 - DNA, 879 bp, Streptococcus agalactiae
atgaccagaacagtagcaattgatattggcggtacaatgattaagcatggcattgtggataatttaggttgtattgttgaggcaagtgagcttgccacagaagcctacaaaggtggtccaggcattttacaaaaagtttgtcaaattatcgataactatctagcagaagggagcattgatggaattgctatctcatctgctggcatggtagatccagatgaaggatgtatattttactctggtcctcaaattccaaactatgctgggacacaatttaagaaagttttagaagacacttatcaagtacgcacagaaattgaaaatgatgttaattgtgcaggattagctgaagctgtctcaggtagtgccaaagatagttcaatagcgctttgtcttactattggaacaggtattggtggttgtctgattattgataaaacagtttttcatggctttagtaattctgcttgtgaagttggctatatgcacctttcagatggtgattttcaagatttagcctctacaactgcactgattgctgatgttgccaaagcgcatggagatgaaattagccgatgggatggacgtcgtatttttcaggaggctaaaaaaggcaatgaaaaatgtattgcaagtatagaccgtatgataaactaccttggccaaggaatcgctaatatggtttatgtggtaaatcctgaaaaagttgttttaggtggtggaatcatggctcaaaaagattatttacaagataaacttagtgaatctttgaaacgaaatcttgtgacaagtcttgctgaaaaaacagcaatagtctttgcacaacacgaaaaccaagctggtatgctaggagcttactaccattttaaaaacaggggg

SEQ ID NO: 922 - protein, 293 aa, Streptococcus agalactiae
MTRTVAIDIGGTMIKHGIVDNLGCIVEASELATEAYKGGPGILQKVCQIIDNYLAEGSIDGIAISSAGMVDPDEGCIFYSGPQIPNYAGTQFKKVLEDTYQVRTEIENDVNCAGLAEAVSGSAKDSSIALCLTIGTGIGGCLIIDKTVFHGFSNSACEVGYMHLSDGDFQDLASTTALIADVAKAHGDEISRWDGRRIFQEAKKGNEKCIASIDRMINYLGQGIANMVYVVNPEKVVLGGGIMAQKDYLQDKLSESLKRNLVTSLAEKTAIVFAQHENQAGMLGAYYHFKNRG

SEQ ID NO: 923 - DNA, 936 bp, Streptococcus pyogenes
atgaagcattatttagcaattgatattggtggtactgctatcaagtatggcttgatttctgaaacaggagacctgttggaaaaagaggaaatggccactgaggcttataaaggtggtccctctattttggaaaaggtcaagggcttggtaaagacctatcaagaccaaatggatctggctggagtggccatttcttctgcaggaatggttaatcctgatgagggagaaatcttttatgccggccctcagattcctaactatgctggaactcagtttaaaaaagagattgaagagactttcgggttaccgtgtgaagtggaaaacgatgttaactgtgctggtctggccgaagctatttctggtagtgccaaggattatcctgtggctctttgcttgacaattgggacgggaatcggtggctgtttattgtttaattcccaagtttttcatggtagtagtcattcagcttgcgaagttggttaccttcatttgtcagatggtcagtttcaggatctggcatctaccacagctcttgttcaagaggtggtcttagcttatggcgatgacattagccaatgggatggtcgtcgtatttttgagcaggctaaagcgggtgatgcgatttgtatagcagccattagtaagcaggtggattacttaggacaaggtattgctaatatctgctacgttgttaacccaaatgtggtggtgcttggtggcggtatcatggcgcaaaaagactatttagctgataaattaaagacagctcttgatagctacttggtttctagtcttgccaagaaaactcagctgaagtttgctagtcatggaaataatgctggtatattaggagcttactaccattttaaacaaaagaatgagcgatcttgttcatttataactcttgagaaaatcgaaaataatttagcgagtagc

SEQ ID NO: 924 - protein, 312 aa, Streptococcus pyogenes
MKHYLAIDIGGTAIKYGLISETGDLLEKEEMATEAYKGGPSILEKVKGLVKTYQDQMDLAGVAISSAGMVNPDEGEIFYAGPQIPNYAGTQFKKEIEETFGLPCEVENDVNCAGLAEAISGSAKDYPVALCLTIGTGIGGCLLFNSQVFHGSSHSACEVGYLHLSDGQFQDLASTTALVQEVVLAYGDDISQWDGRRIFEQAKAGDAICIAAISKQVDYLGQGIANICYVVNPNVVVLGGGIMAQKDYLADKLKTALDSYLVSSLAKKTQLKFASHGNNAGILGAYYHFKQKNERSCSFITLEKIENNLASS

SEQ ID NO: 925 - DNA, 915 bp, Streptococcus agalactiae
atgaaagatttacaaaaatatcaaggaattattcctgcattttatgcttgctatgatgataagggtgatatttgtcccgaacgagtaaaagccctgaccaattattttattgataaaggtgttcaaggactttatgttaatggttcatccggagaatgtatttaccaaagtgtagcagatcgtaaacttgtactggaaaatgttatgtccgttgctaagggtaaactaacagtaatagcgcatgtggcatgtaataatactaaggatagcgtagagttggctatgcatgctgaagctataggtgttgatgctattgcagcaattccaccaatttattttcgattaccagagtatgccatagcagattattggaatactattagtcaagcagcaccacaaactgattttattatttacaatattcctcaattggcaggggttgctttgacatcggatttatatcgaaaaatgttacaaaatccgcaagtaattggtgttaaaaattcttccatgccagttcaagacattcagaattttgtggctattggaggagaaaatcatattgtttttaatggtccagatgaacaatttttgggtggtcgtctcatgggagccgctgcaggtattggtggtacctatggcgtaatgccagaattatacttgactttaaatcagttaattgttgataaagatttagaaaaagcgcgtgaacttcaatttacaattaacgatattatcacaaagctttgttcgggtcatggtaatatgtatgctgtgatcaaagctgtattggaaatcaatgagcaactaactataggttccgttcggttacctttagcatctgtaacagaagaagataaacctattattaaagaggcagcagaaatgattagacatgctaaaaaacagttttgt

SEQ ID NO: 926 - protein, 305 aa, Streptococcus agalactiae
MKDLQKYQGIIPAFYACYDDKGDICPERVKALTNYFIDKGVQGLYVNGSSGECIYQSVADRKLVLENVMSVAKGKLTVIAHVACNNTKDSVELAMHAEAIGVDAIAAIPPIYFRLPEYAIADYWNTISQAAPQTDFIIYNIPQLAGVALTSDLYRKMLQNPQVIGVKNSSMPVQDIQNFVAIGGENHIVFNGPDEQFLGGRLMGAAAGIGGTYGVMPELYLTLNQLIVDKDLEKARELQFTINDIITKLCSGHGNMYAVIKAVLEINEQLTIGSVRLPLASVTEEDKPIIKEAAEMIRHAKKQFC

SEQ ID NO: 927 - DNA, 912 bp, Streptococcus pyogenes
atgacagatcttacgaaataccaaggcattattcctgccttttacgcttgttacgatgaccaggggaatatcagccctgagcgtgtgcgtgccttgacccagtactatattgacaaaggggttcaggggctttacattaatggctcttctggagagtgtatttaccagagcgtttttgaccgtcaattggtgttagaaaatgtcatggcagtcgctaagggcaagctgacgattattaatcacgttgcctgcaacaacactaaagatagtattgaattggcagctcattcagaacgtttgggcgtggatgccattgcagctattccgcctatttatttccggttaccagaatatgcggttgctgattattggaatgctatttcttcggctgctcctcacacagattttatcatctataatattcctcaactggcaggggttgccttgacgccaagcctttataagactatgttggctaataagcgcgtgattggcgttaaaaattcatctatgccagtgcaggatattcaaaccttctgtgcgattggtggggacgatcatattgtttttaatggcccagatgaacaatttctaggagggcgcttgatgggtgctgctgcaggcattggtggtacctacggggctatgccagaattatttttaaggctgaaccaacttattgctgacaaggatttagaaaaggccaaggcccttcaatatactattaatgagattatcggtgtccttgtttctgctcacggcaatatgtatggggttattaaagaagtacttcgtattaatgagggtcttgatattggttctgttcgatcacctttagctgagttggtcgaggaagatagggttatttgccaacgggctgctgctctgattaatcaggctaaggaaaccttt

SEQ ID NO: 928 - protein, 304 aa, Streptococcus pyogenes
MTDLTKYQGIIPAFYACYDDQGNISPERVRALTQYYIDKGVQGLYINGSSGECIYQSVFDRQLVLENVMAVAKGKLTIINHVACNNTKDSIELAAHSERLGVDAIAAIPPIYFRLPEYAVADYWNAISSAAPHTDFIIYNIPQLAGVALTPSLYKTMLANKRVIGVKNSSMPVQDIQTFCAIGGDDHIVFNGPDEQFLGGRLMGAAAGIGGTYGAMPELFLRLNQLIADKDLEKAKALQYTINEIIGVLVSAHGNMYGVIKEVLRINEGLDIGSVRSPLAELVEEDRVICQRAAALINQAKETF

SEQ ID NO: 929 - DNA, 660 bp, Streptococcus agalactiae
gtgaaaaaagcaaatcaattaatagcagcgatttttgatgttaacaacccctttatgcaaggttgcaatgttgtttttgatctggcattactaaaccttctctttatgataacttgcctaccattggtaactattggtgctgctaaaattagtttgtatcgaacgttgtggcaaaaattagaaggtgatcagacaaatcttttaatattgtatataaaacacctaaaaaaagagtggttccaaggtatgcttttaggtttggttgaactaagtattttggttgtgatcatatttgatttaacaattcttcattatcaaataggtttcattgtgtctttcttgaagataacttgttacgcctttttgttattgactgtgatgacgagcatatacctatttcctatggctgcccgctacgaaatgtctcttttagataccgtgaaaaagagctttataatggcatgtttaaacttgaaatggactggtgtattgatgtttttattaatcatgacttggtttattatggtgcagtctagtctcttatttatgcttacagtgtcagctatatttatttttgcttataccgcctttgcttactttaaaattattattttacaaaaacaatttgcctatttcagcaaacaacaaggagattatcaa

SEQ ID NO: 930 - protein, 220 aa, Streptococcus agalactiae
MKKANQLIAAIFDVNNPFMQGCNVVFDLALLNLLFMITCLPLVTIGAAKISLYRTLWQKLEGDQTNLLILYIKHLKKEWFQGMLLGLVELSILVVIIFDLTILHYQIGFIVSFLKITCYAFLLLTVMTSIYLFPMAARYEMSLLDTVKKSFIMACLNLKWTGVLMFLLIMTWFIMVQSSLLFMLTVSAIFIFAYTAFAYFKIIILQKQFAYFSKQQGDYQ

SEQ ID NO: 931 - DNA, 660 bp, Streptococcus pyogenes
ttgacatcgaaaaaacagggacttttacactctctcttcaagcttgatagtaaatggatgagggctagcgcagcactgtttgatttgctcgtgtttaatctcttatttgtcttgtcctgccttccccttctaacgattggggttgctaaaatggctttgtatgcgagtttgttggattggcgagaaggtcaagttagtcagcttgttactacttatagctctcattttaaatattactttaaaagtgggctacgccttggccttattgagcttgggataatgactatttgtctcttagatcttttcttaattcgaaaccaatcaggcctagtttttcaagggtttaaagtactttgcgttgctgttttatttttggtggttatactctttttgtacgcttatcctcaggccgtcaaaagagacctttccctatctacgctgtttaagcgaagctttttattagcaggactcttttttccatggagttttgctttcttggcttttatttgtctcacgatatttagcctacaattgtctctgttaacgttatttggaggcgtgtctttgctagctatcatcggcatcagtagtctaacttatctctacttgattatcatggaatctcttcttaggcgattcccacttaataatgacattgaa

SEQ ID NO: 932 - protein, 220 aa, Streptococcus pyogenes
LTSKKQGLLHSLFKLDSKWMRASAALFDLLVFNLLFVLSCLPLLTIGVAKMALYASLLDWREGQVSQLVTTYSSHFKYYFKSGLRLGLIELGIMTICLLDLFLIRNQSGLVFQGFKVLCVAVLFLVVILFLYAYPQAVKRDLSLSTLFKRSFLLAGLFFPWSFAFLAFICLTIFSLQLSLLTLFGGVSLLAIIGISSLTYLYLIIMESLLRRFPLNNDIE

SEQ ID NO: 933 - DNA, 441 bp, Streptococcus agalactiae
atgatttacgatcatttattgaatttaacgcattataaagatattaatcctaatttagatttagcgattgattatctactaagtcatgatttaaggaatttagatataggcacctatcatattagcccagaagtgatactcatggtccaatcaaatcaacttagtgagtcatttgatcatatttttgaataccataaaaaataccttgatatacattatgtcattgaaggacatgaagttatcaaattgggaaaaggtgataaggtagaggtggaggaatacttaggcgatataggatttatcaagtgctcagaagagacttcttttgatttgagagataattatatagccttctttttcccagaagaagctcatcagccaaatggtatgggaagtctaggtaattatgtcaaaaaaggggtattgaaagtgttaatggcg

SEQ ID NO: 934 - protein, 147 aa, Streptococcus agalactiae
MIYDHLLNLTHYKDINPNLDLAIDYLLSHDLRNLDIGTYHISPEVILMVQSNQLSESFDHIFEYHKKYLDIHYVIEGHEVIKLGKGDKVEVEEYLGDIGFIKCSEETSFDLRDNYIAFFFPEEAHQPNGMGSLGNYVKKGVLKVLMA

SEQ ID NO: 935 - DNA, 828 bp, Streptococcus agalactiae
atgaaaaagaaaacattcagtgcttataactttttaacggctcttatcctttgtcttttgacagtgctttttatctttccattttattggattatgacaggagcttttaaatctcaacctgatactattatcatccccccacaatggtggcccaaagcaccgaccttagaaaattttaaagctttaactgtacaaaacccagctttgagatggctttggaatagtgtctttatctcaattatgacaatgttcctagtttgctgtacatcgtcaatggcaggctatgttttagctaagaaacgattttacggtcaaaaaatattgttctccctttttattgctgctatggctttacctaaacaagttgttttagtgccattagttagaattatcaattttatggggatacatgataccttatgggcggttattttacctcttgttggttggccttttggggtcttcttgatgaaacagttttctgaaaatattccaacagaattactggaatcagctaaaattgatggttgtggagagattcgaacatttattaatgtagcatttccaattgtcaaacctggatttgctgccctagctattttcacatttatcaatacttggaatgactattttatgcaattagttatgctaacttctagaaataatctgaccatttctcttggggtagctactatgcaggctgaaatggcaacaaactatggcttaattatggcaggtgcagccttagctgctgttcctattgtgacagtattcttagttttccaaaaatcctttactcaggggattacaatgggagctgttaaagga

SEQ ID NO: 936 - protein, 276 aa, Streptococcus agalactiae
MKKKTFSAYNFLTALILCLLTVLFIFPFYWIMTGAFKSQPDTIIIPPQWWPKAPTLENFKALTVQNPALRWLWNSVFISIMTMFLVCCTSSMAGYVLAKKRFYGQKILFSLFIAAMALPKQVVLVPLVRIINFMGIHDTLWAVILPLVGWPFGVFLMKQFSENIPTELLESAKIDGCGEIRTFINVAFPIVKPGFAALAIFTFINTWNDYFMQLVMLTSRNNLTISLGVATMQAEMATNYGLIMAGAALAAVPIVTVFLVFQKSFTQGITMGAVKG

SEQ ID NO: 937 - DNA, 828 bp, Streptococcus pyogenes
atgacgaaaaagaaactaaccgcatcagatatcttaaccactgtgatgctatgtgttttgaccattttgtttatttttccattttattggattatgacaggagcatttaaggctcaagccgataccattatgattccaccgcaatggtggccaaaggcgcctactattgaaaattttaaggccttggtagtgcaaaatccagccttaaaatggttgtggaatagtgtctttatttcggtggcgaccatgttcttggtttgtggaacctcctcgttggctggctatgctttggccaaaaagcggttttatggacagcggcttttgttttcgatttttattgctgctatggccttgccaaaacaggttgttctagtgcctcttgtgcggattgttaattttatgggaatccatgacactttggcggctgttattttgcctcttgtgggctggccatttggtgttttccttatgaaacagttctcagaaaatattccaaccgagttattggaatccgccaagattgatggatgtggcgaaattcgtacctttttcaatgtggctttccctattgtcaaaccaggctttgcagcgctagcgatttttacctttatcaatacttggaatgattattttatgcagttagtgatgttaacctctcgagaaaatttaacgatttcacttggggttgccactatgcaagctgaaatggctactaattatggcttgattatggcaggggctgccatggctgcagtgcctattgtaacagtctttcttgtcttccaaaaatcatttacccaaggcattactatgggtgctgtgaaaggt

SEQ ID NO: 938 - protein, 276 aa, Streptococcus pyogenes
MTKKKLTASDILTTVMLCVLTILFIFPFYWIMTGAFKAQADTIMIPPQWWPKAPTIENFKALVVQNPALKWLWNSVFISVATMFLVCGTSSLAGYALAKKRFYGQRLLFSIFIAAMALPKQVVLVPLVRIVNFMGIHDTLAAVILPLVGWPFGVFLMKQFSENIPTELLESAKIDGCGEIRTFFNVAFPIVKPGFAALAIFTFINTWNDYFMQLVMLTSRENLTISLGVATMQAEMATNYGLIMAGAAMAAVPIVTVFLVFQKSFTQGITMGAVKG

SEQ ID NO: 939 - DNA, 885 bp, Streptococcus agalactiae
atgcgtactaataagttaaagatgagggaaacgatgatagcttatgcttttctagcacctattctcttatttttcttaatttttgtttttgcaccgatggttatgggctttgtcactagtttttttaattattctatgacacagttcacttttattgggttagctaattacaatcgtatgtttcatgattctattttcatgaaatccttgataaatacagtaatcattgtgattggctctgtgccagtagtggttttcttctcactttttgttgctgccaatacttatgaaaaaaatgttttttcacgctctttctaccgttgtgtcttcttcttgccagtagtaactggtagtgttgcagttacagttgtttggaaatggatttatgaccctatgtccggaattttaaattacatcttgaaatcaggtcatgtcattgaacagaatattagctggcttggggataagcactgggcattgcttgctattattattattttgctaacgacctcagttggtcaacctattattctatatattgcggcgatgggaaatattgataattctctttgcgaagctgcgcgtgttgatggagccaatgaaatgcaagttttttggcaaattaaatggccgagtctcttaccaactacactctatattgcagttataacaacaattaattcatttcaatgttttgccttaatccagctcctaacatctggtggaccaaattattcaacaagcactttgatgtattatctttatgaaaaagcctttaaactatcagaatatggctatgctaatactatgggagtattcctagcagtaatgattgctttaataagttttgctcaatttaagatcttaggaaatgatgtggaatat

SEQ ID NO: 940 - protein, 295 aa, Streptococcus agalactiae
MRTNKLKMRETMIAYAFLAPILLFFLIFVFAPMVMGFVTSFFNYSMTQFTFIGLANYNRMFHDSIFMKSLINTVIIVIGSVPVVVFFSLFVAANTYEKNVFSRSFYRCVFFLPVVTGSVAVTVVWKWIYDPMSGILNYILKSGHVIEQNISWLGDKHWALLAIIIILLTTSVGQPIILYIAAMGNIDNSLCEAARVDGANEMQVFWQIKWPSLLPTTLYIAVITTINSFQCFALIQLLTSGGPNYSTSTLMYYLYEKAFKLSEYGYANTMGVFLAVMIALISFAQFKILGNDVEY

SEQ ID NO: 941 - DNA, 987 bp, Streptococcus pyogenes
gtgttcctaacaagtggcttcttttcaatgcacatgtcaaatggtcactggaaagaagcttttctttttagaaaagttgaacagaaaaaagaggtatttcaagtgaacgtcaataaattaaaaatgagagagacgctcatctcatacgctttcttagctccggtcttggttttctttgtgatttttgtcttgataccgatgattatgggctttgtgacgagctttttcaattattccatgacagagtttacctttgttggttttgctaattatgctaggatgtttcaagatcccattttcatgaagtctcttattaacaccttgattattgttattggttcggtacctgttgtagttttcttttccctctttgtggcggctaaaacctacgacaaaaatgtagtggcgcgttcgttttaccgggcagttttctttctgcctgttgttaccggaagtgttgcggtgacggtggtttggaaatggatctatgatccaatgtcagggattttgaattatgtcttaaaatatgctcatgtgattgaacaaaatattagttggctgggagataagcactgggctttgttggctattattgttattttattaaccacatctgttgggcagcctattattctatatattgctgctatgggaaatattgataactctttggtagaagctgcgcgtgtggacggcgccacagaatttcaggtgttttggaatatcaagtggccaagtctgctgccaacaaccttatatattgctgtcataacaaccattaattccttccaatgttttgctttgattcaacttttgacgtctggagggccaaattattcaaccagtaccctcatgtactatttgtatgaaaaggcctttaagctctctgaatacggctatgccaacacaatgggtgtattcttggcagtcatgattgcaatcatcagctttgctcaatttaaaattttaggtaatgatgtggaatat

SEQ ID NO: 942 - protein, 329 aa, Streptococcus pyogenes
VFLTSGFFSMHMSNGHWKEAFLFRKVEQKKEVFQVNVNKLKMRETLISYAFLAPVLVFFVIFVLIPMIMGFVTSFFNYSMTEFTFVGFANYARMFQDPIFMKSLINTLIIVIGSVPVVVFFSLFVAAKTYDKNVVARSFYRAVFFLPVVTGSVAVTVVWKWIYDPMSGILNYVLKYAHVIEQNISWLGDKHWALLAIIVILLTTSVGQPIILYIAAMGNIDNSLVEAARVDGATEFQVFWNIKWPSLLPTTLYIAVITTINSFQCFALIQLLTSGGPNYSTSTLMYYLYEKAFKLSEYGYANTMGVFLAVMIAIISFAQFKILGNDVEY

SEQ ID NO: 943 - DNA, 1314 bp, Streptococcus agalactiae
atgagtatcaaaaaaagtgtgattggtttttgcctcggagctgcagcattatcaatgtttgcttgtgtagacagtagtcaatctgttatggctgccgagaaggataaagtcgaaattacgtggtgggcttttccaacctttactcaagaaaaggctaaggatggagtaggtacttatgagaaaaaagtcatcaaggcttttgaaaagaaaaatcctaatataaaagtaaaactagagacaattgatttcacatctggacctgaaaaaatcactacagcgattgaagcagggacagcacctgatgtgctttttgatgcaccagggcgaattattcaatatggtaaaaatggtaaattagcagatttgaatgatttatttacagaccaatttattaaggatgtcaataataagaatatcattcaagcttctaagtctggcgataaagcctacatgtatccaataagttctgccccattttatatggcgttcaataaaaaaatgcttaaagatgcaggagttttgaaactcgtaaaagaaggttggactactagtgattttgaaaaagtactaaaagcactaaaaaataaaggctatacaccaggttcattctttgcaaacgggcaaggaggagatcaaggaccacgtgcattttttgctaatctttatagtgctccaataacagataaagaagtaacaaaatataccactgacactaaaaattctgtaaaatcaatgaaaaaaatagttgaatggattaagaaaggctacttgatgaatgggtctcagtatgatggctcagctgacattcaaaactttgccaatggacaaactgctttcactatcctatgggctccagctcaacccaaaactcaagcaaaattattagagtcaagtaaagtggattaccttgaagtgccattcccatcagaagatggaaaaccagatttagaataccttgttaatggttttgcggtctttaataataaagatgaaaacaaagtaaaagcctctaagaaatttatcacttttattgctgacgataaaaaatggggaccaaaagatgttatacgtacaggtgctttcccagttagaacatcatttggagatctttataaaggtgataaacgtatgatgaagatttcaaaatggactcaatattattcaccatattacaacactatcgatggattttctgaaatgagaaccttatggttcccaatggttcaatctgtatccaatggtgacgaaaaaccagcagatgctttgaaagactttactcaaaaagcaaatgataccattaaaaaagcagctaaa

SEQ ID NO: 944 - protein, 438 aa, Streptococcus agalactiae
MSIKKSVIGFCLGAAALSMFACVDSSQSVMAAEKDKVEITWWAFPTFTQEKAKDGVGTYEKKVIKAFEKKNPNIKVKLETIDFTSGPEKITTAIEAGTAPDVLFDAPGRIIQYGKNGKLADLNDLFTDQFIKDVNNKNIIQASKSGDKAYMYPISSAPFYMAFNKKMLKDAGVLKLVKEGWTTSDFEKVLKALKNKGYTPGSFFANGQGGDQGPRAFFANLYSAPITDKEVTKYTTDTKNSVKSMKKIVEWIKKGYLMNGSQYDGSADIQNFANGQTAFTILWAPAQPKTQAKLLESSKVDYLEVPFPSEDGKPDLEYLVNGFAVFNNKDENKVKASKKFITFIADDKKWGPKDVIRTGAFPVRTSFGDLYKGDKRMMKISKWTQYYSPYYNTIDGFSEMRTLWFPMVQSVSNGDEKPADALKDFTQKANDTIKKAAK

SEQ ID NO: 945 - DNA, 1317 bp, Streptococcus pyogenes
atgaacatgaagaagttagcttcattagcgatgcttggtgcatctgttttaggactagcagcttgtggcggaaagagccagaaagaggctggtgcaagtaaatctgatactgctaagacagaaatcacatggtgggctttcccggtcttcacgcaagaaaaagctgaagatggtgtgggaacctatgagaagaaattgattgctgcctttgagaaagctaatccagaaatcaaggtaaaattggaaaccattgattttacatctggtcctgagaaaatcacaactgctattgaagctggaacagctcctgatgtcctctttgatgctccaggtcgtatcattcaatatggtaaaaatgggaaattggctgacttgaatgacttgttcacagaagagtttaccaaagatgttaacaatgacaaattgattcaagcctcaaaagcaggagatacagcttacatgtatcctatcagctctgctccattctacatggcgttgaataaaaaaatgctcaaagatgctggcgtccttgatcttgtgaaagagggttggacaacagatgattttgaaaaagtcttgaaagcattgaaggacaaaggatataacccaggttctttctttgctaatggtcaaggtggtgaccaaggaccacgtgccttctttgctaacctttatagtagtcatattaccgatgacaaagtaaccaaatacaccacagatgatgctaactctattaaagccatgaccaagatttccaattggattaaagatggtttaatgatgaatggctctcagtacgatggttcagctgatattcaaaactttgcgaatggccaaacttcctttaccattctttgggcgcctgcacaaccaggcatccaagctaaattgttagaagctagtaaagtggattaccttgaaatcccattcccatcagatgatggcaaaccagaactagaatacctcgtaaatggttttgcggtctttaataacaaagatgaacaaaaagtcgctgcctctaagacatttatccaatttatcgctgatgataaagaatggggacctaaaaatgttgttcgtacaggtgctttccctgtaagaacttcttatggggatctttacaaagacaaacgaatggaaaaaattgctgaatggacaaaattctactcaccatactataacacgattgatgggtttgctgaaatgagaactctttggttcccaatggttcaagccgtctctaatggtgatgaaaagccagaagatgctttgaaagccttcactgaaaaagcaaacaagacaatcaaaaaaacacaa

SEQ ID NO: 946 - protein, 439 aa, Streptococcus pyogenes
MNMKKLASLAMLGASVLGLAACGGKSQKEAGASKSDTAKTEITWWAFPVFTQEKAEDGVGTYEKKLIAAFEKANPEIKVKLETIDFTSGPEKITTAIEAGTAPDVLFDAPGRIIQYGKNGKLADLNDLFTEEFTKDVNNDKLIQASKAGDTAYMYPISSAPFYMALNKKMLKDAGVLDLVKEGWTTDDFEKVLKALKDKGYNPGSFFANGQGGDQGPRAFFANLYSSHITDDKVTKYTTDDANSIKAMTKISNWIKDGLMMNGSQYDGSADIQNFANGQTSFTILWAPAQPGIQAKLLEASKVDYLEIPFPSDDGKPELEYLVNGFAVFNNKDEQKVAASKTFIQFIADDKEWGPKNVVRTGAFPVRTSYGDLYKDKRMEKIAEWTKFYSPYYNTIDGFAEMRTLWFPMVQAVSNGDEKPEDALKAFTEKANKTIKKTQ

SEQ ID NO: 947 - DNA, 696 bp, Streptococcus agalactiae
atgccacatctaagtaaagaagcttttaaaaagcaaataaaaaatggcattattgtgtcatgtcaagctttgcccggggagcctctttatactgaaagtggaggtgttatgcctcttttagctttggcagctcaagaagcaggagcggttggtataagagccaatagtgtccgcgacattaaggaaattcaagaggttactaatttacctatcatcggcattattaaacgtgaatatcctccacaagaaccatttatcactgctacgatgacagaggtggatcaattagctagtttagatattgcagtaatagccttagattgtacacttagagagcgtcatgatggtttgagtgtagttgagtttattcaaaagataaaaaggaaatatcctgaacagttgttaatggctgatataagtacttttgaagaaggcaaaaatgcttttgaagcaggagttgattttgtgggtacaactctatctggatacacagattacagccgccaagaagaaggaccggatatagaactccttaataagctctgtcaagccggtatagatgtgattgcggaaggtaaaattcatactcctaagcaggctaatgaaattaatcatataggtgttgcaggaattgtagttggtggtgctatcactagaccaaaagaaatagcggagcgtttcatctcaggacttagt

SEQ ID NO: 948 - protein, 232 aa, Streptococcus agalactiae [sequence omitted]

SEQ ID NO: 949 - DNA, 702 bp, Streptococcus pyogenes
atgcctgataaaccaaccaaagaaaagctcatggagcagttaaagggtgggattatcgtttcttgtcaggctttgccaggtgagcctctctattcagagactgggggtattatgccactgatggcaaaagctgctcaagaagctggtgctgtcggcatcagagctaattcggttagagacattaaagaaattcaagccataacagacctaccaattatcggtatcatcaaaaaagattacccgccgcaagagccttttattacggcaacgatgaccgaagtggatcaattagctgccttaaatattgcagtgattgctatggattgtaccaagcgtgaccgacatgatggcttggatattgctagctttattcgacaagttaaggaaaagtaccccaatcagcttttgatggcagatattagtacctttgatgaaggactagtggcccatcaggctggcattgattttgttggaaccaccttgtcaggctacaccccgtatagccgtcaggaagcaggtcctgatgtggcattgatagaagctctttgcaaagcaggcattgctgtcattgccgaaggaaagattcattccccagaagaagccaagaaaattaatgacttaggtgtggcaggtattgttgttggaggggccatcacaaggcctaaggaaattgcagagcgttttatcgaagcgctcaaatcc

SEQ ID NO: 950 - protein, 234 aa, Streptococcus pyogenes
MPDKPTKEKLMEQLKGGIIVSCQALPGEPLYSETGGIMPLMAKAAQEAGAVGIRANSVRDIKEIQAITDLPIIGIIKKDYPPQEPFITATMTEVDQLAALNIAVIAMDCTKRDRHDGLDIASFIRQVKEKYPNQLLMADISTFDEGLVAHQAGIDFVGTTLSGYTPYSRQEAGPDVALIEALCKAGIAVIAEGKIHSPEEAKKINDLGVAGIVVGGAITRPKEIAERFIEALKS

SEQ ID NO: 951 - DNA, 1302 bp, Streptococcus agalactiae
atgaaaatgaataaaaaggtactattgacatcgacaatggcagcttcgctattatcagtcgcaagtgttcaagcacaagaaacagatacgacgtggacagcacgtactgtttcagaggtaaaggctgatttggtaaagcaagacaataaatcatcatatactgtgaaatatggtgatacactaagcgttatttcagaagcaatgtcaattgatatgaatgtcttagcaaaaataaataacattgcagatatcaatcttatttatcctgagacaacactgacagtaacttacgatcagaagagtcatactgccacttcaatgaaaatagaaacaccagcaacaaatgctgctggtcaaacaacagctactgtggatttgaaaaccaatcaagtttctgttgcagaccaaaaagtttctctcaatacaatttcggaaggtatgacaccagaagcagcaacaacgattgtttcgccaatgaagacatattcttctgcgccagctttgaaatcaaaagaagtattagcacaagagcaagctgttagtcaagcagcagctaatgaacaggtatcaccagctcctgtgaagtcgattacttcagaagttccagcagctaaagaggaagttaaaccaactcagacgtcagtcagtcagtcaacaacagtatcaccagcttctgttgccgctgaaacaccagctccagtagctaaagtagcaccggtaagaactgtagcagcccctagagtggcaagtgttaaagtagtcactcctaaagtagaaactggtgcatcaccagagcatgtatcagctccagcagttcctgtgactacgacttcaccagctacagacagtaagttacaagcgactgaagttaagagcgttccggtagcacaaaaagctccaacagcaacaccggtagcacaaccagcttcaacaacaaatgcagtagctgcacatcctgaaaatgcagggctccaacctcatgttgcagcttataaagaaaaagtagcgtcaacttatggagttaatgaattcagtacataccgtgcgggagatccaggtgatcatggtaaaggtttagcagttgactttattgtaggtactaatcaagcacttggtaataaagttgcacagtactctacacaaaatatggcagcaaataacatttcatatgttatctggcaacaaaagttttactcaaatacaaacagtatttatggacctgctaatacttggaatgcaatgccagatcgtggtggcgttactgccaaccactatgaccacgttcacgtatcatttaacaaa

SEQ ID NO: 952 - protein, 434 aa, Streptococcus agalactiae
MKMNKKVLLTSTMAASLLSVASVQAQETDTTWTARTVSEVKADLVKQDNKSSYTVKYGDTLSVISEAMSIDMNVLAKINNIADINLIYPETTLTVTYDQKSHTATSMKIETPATNAAGQTTATVDLKTNQVSVADQKVSLNTISEGMTPEAATTIVSPMKTYSSAPALKSKEVLAQEQAVSQAAANEQVSPAPVKSITSEVPAAKEEVKPTQTSVSQSTTVSPASVAAETPAPVAKVAPVRTVAAPRVASVKVVTPKVETGASPEHVSAPAVPVTTTSPATDSKLQATEVKSVPVAQKAPTATPVAQPASTTNAVAAHPENAGLQPHVAAYKEKVASTYGVNEFSTYRAGDPGDHGKGLAVDFIVGTNQALGNKVAQYSTQNMAANNISYVIWQQKFYSNTNSIYGPANTWNAMPDRGGVTANHYDHVHVSFNK

SEQ ID NO: 953 - DNA, 1167 bp, Streptococcus pyogenes
atgattattactaaaaagagcttatttgtgacaagtgtcgctttgtcgttagtacctttggcgacagcgcaggcacaagagtggacaccacgatcggttacagaaatcaagtctgaactcgtcctagttgataatgtttttacttatactgtaaaatacggtgacactttaagcacaattgctgaagcaatggggattgatgtgcatgtcttaggagatattaatcatattgctaatattgacctaatttttccagacacgatcctaacagcaaactacaatcaacacggtcaggcaacgaatttgacggttcaagcacctgcttctagtccagctagcgttagtcatgtacctagcagtgagccattaccccaagcatctgccacctctcaaccgactgttcctatggcaccacctgcgacaccatctgatgtcccaacgacaccattcgcatctgcaaagccagatagttctgtgacagcgtcatctgagctcacatcgtcaacgaatgatgtttcgactgagttgtctagcgaatcacaaaagcagccagaagtaccacaagaagcagttccaactcctaaagcagctgaaacgactgaagtcgaacctaagacagacatctcagaagccccaacttcagctaataggcctgtacctaacgagagtgcttcagaagaagtttcttctgcggccccagcacaagccccagcagaaaaagaagaaacctctgcgccagcagcacaaaaagctgtagctgacaccacaagtgttgcaacctcaaatggcctttcttacgctccaaaccatgcctacaatccaatgaatgcagggcttcaaccacaaacagcagccttcaaagaagaagtggcttctgcctttggtattacgtcatttagtggttaccgtccaggtgatccaggagatcatggtaaaggtttggccattgattttatggtgcctgaaaattctgctcttggtgatcaagttgctcaatatgccattgaccatatggcagagcgtggtatttcatacgttatttggaaacagcgattctatgcgccatttgcaagtatttacggaccagcctacacatggaaccccatgccagatcgcggcagtattacagaaaaccattatgatcatgttcatgtctcctttaatgct

SEQ ID NO: 954 - protein, 389 aa, Streptococcus pyogenes
MIITKKSLFVTSVALSLVPLATAQAQEWTPRSVTEIKSELVLVDNVFTYTVKYGDTLSTIAEAMGIDVHVLGDINHIANIDLIFPDTILTANYNQHGQATNLTVQAPASSPASVSHVPSSEPLPQASATSQPTVPMAPPATPSDVPTTPFASAKPDSSVTASSELTSSTNDVSTELSSESQKQPEVPQEAVPTPKAAETTEVEPKTDISEAPTSANRPVPNESASEEVSSAAPAQAPAEKEETSAPAAQKAVADTTSVATSNGLSYAPNHAYNPMNAGLQPQTAAFKEEVASAFGITSFSGYRPGDPGDHGKGLAIDFMVPENSALGDQVAQYAIDHMAERGISYVIWKQRFYAPFASIYGPAYTWNPMPDRGSITENHYDHVHVSFNA

SEQ ID NO: 955 - DNA, 897 bp, Streptococcus agalactiae
ttgaataaatggttagttaaggcaagttccttagttgttttaggtggtatggttttatctgcgggttcccgagttttagcggatacttatgtccgtccaattgataatggtagaattacaacaggtttcaatggttatcctggacattgtggggtggattatgctgttccgactggaacgattattagggcagtggcagatggtactgtgaaatttgcaggagctggagccaacttttcttggatgacagacttagcaggaaattgtgtcatgattcaacatgcggatggaatgcatagtggttacgctcatatgtcacgtgtggtggctaggactggggaaaaagtcaaacaaggagatatcatcggttacgtaggagcaactggtatggcgacgggacctcaccttcattttgaatttttaccagctaaccctaattttcaaaatggtttccatggacgtatcaatccaacgtcactaattgctaatgttgcgacctttagtggaaaaacgcaagcatcagctccaagcattaagccattacaatcagctcctgtacagaatcaatctagtaaattaaaagtgtatcgagtagatgaattacaaaaggttaatggtgtttggttagtcaaaaataacaccctaacgccgactgggtttgattggaacgataatggtataccagcatcagaaattgatgaggttgatgctaatggtaatttgacagctgaccaggttcttcaaaaaggtggttactttatctttaatcctaaaactcttaagactgtagaaaaacccatccaaggaacagctggtttaacttgggctaagacacgctttgctaatggtagttcagtttggcttcgcgttgacaacagtcaagaactgctttacaaa

SEQ ID NO: 956 - protein, 299 aa, Streptococcus agalactiae
MNKWLVKASSLVVLGGMVLSAGSRVLADTYVRPIDNGRITTGFNGYPGHCGVDYAVPTGTIIRAVADGTVKFAGAGANFSWMTDLAGNCVMIQHADGMHSGYAHMSRVVARTGEKVKQGDIIGYVGATGMATGPHLHFEFLPANPNFQNGFHGRINPTSLIANVATFSGKTQASAPSIKPLQSAPVQNQSSKLKVYRVDELQKVNGVWLVKNNTLTPTGFDWNDNGIPASEIDEVDANGNLTADQVLQKGGYFIFNPKTLKTVEKPIQGTAGLTWAKTRFANGSSVWLRVDNSQELLYK

SEQ ID NO: 957 - DNA, 1545 bp, Streptococcus agalactiae
atgactaaacgtgctttaatctcagtttctgacaaatcaggaattattgactttgcaaaagaattgaaaaacttgggttgggatattatctcaactggtgggactaaggttgcccttgatgatgctggtgttgagaccattgccatcgacgatgtgactggattcccagaaatgatggacggtcgtgttaagaccctccacccaaacattcacggtgggcttctggctcgtcgcgacgctgacagccaccttcaggctgctaaggacaacaatattgagttgattgacctcgtggttgtcaacctctatcccttcaaggagaccatccttcgcccagacgtgacctacgatttggcggtggaaaatatcgacatcggcggtccatcaatgcttcgctcagctgctaaaaaccacgctagcgtaaccgttgtggttgattcagctgactatgccactgttttgggagaattggctgacgctagtcagacgacatttaaaactcgtcaacgcttggcagctaaggccttccgtcatacggcagcctacgacgctttgattgctgagtacttcacagctcaagtgggagaggctaagcctgaaaaattgaccatcacttatgaccttaaacaggctatgcgttacggagaaaatccacagcaagacgctgatttctaccaaaaagccttaccaacagactactcaatcgcttcagctaaacagctcaatggaaaagaattgtccttcaataatatccgtgatgctgatgcagcaatccgtattatccgcgatttcaaagacagtccaacggttgttgccctcaaacacatgaacccatgtggtatcggacaggctgatgatattgagacagcttgggattacgcttatgaagctgatccagtttcaatctttggtggaattgttgtccttaaccgtgaagttgacgcagcgacagctgagaagatgcaccctatcttcttggaaatcatcatcgcaccatcatactcagaagaagcgctagctattctcacaaataaaaagaaaaacttgcgtatccttgagttgccgtttgatgcccaagctgccagcgaagtggaagctgagtacactggcgtagttggtggacttttggtgcaaaaccaagacgttgtggctgaaaatccatctgactggcaagtggtgacagaccgccagccaacagaacaagaggcgactgcccttgagtttgcctggaaggctatcaagtatgttaagtctaacgggattattattactaacgatcacatgacgcttggactcggtgcaggtcaaaccaaccgtgtcggctcagtcaagattgctatcgagcaggctaaggaccaccttgacggtgccgttctagcatcagatgccttcttcccatttgcggacaacattgaagaaatcgctgccgcagggatcaaagcaatcatccaaccaggtggttcagttcgtgaccaagaatctattgacgccgcaaacaaacatggcttgaccatgatcttcacaggcgtgagacattttagacat

SEQ ID NO: 958 - protein, 515 aa, Streptococcus agalactiae
MTKRALISVSDKSGIIDFAKELKNLGWDIISTGGTKVALDDAGVETIAIDDVTGFPEMMDGRVKTLHPNIHGGLLARRDADSHLQAAKDNNIELIDLVVVNLYPFKETILRPDVTYDLAVENIDIGGPSMLRSAAKNHASVTVVVDSADYATVLGELADASQTTFKTRQRLAAKAFRHTAAYDALIAEYFTAQVGEAKPEKLTITYDLKQAMRYGENPQQDADFYQKALPTDYSIASAKQLNGKELSFNNIRDADAAIRIIRDFKDSPTVVALKHMNPCGIGQADDIETAWDYAYEADPVSIFGGIVVLNREVDAATAEKMHPIFLEIIIAPSYSEEALAILTNKKKNLRILELPFDAQAASEVEAEYTGVVGGLLVQNQDVVAENPSDWQVVTDRQPTEQEATALEFAWKAIKYVKSNGIIITNDHMTLGLGAGQTNRVGSVKIAIEQAKDHLDGAVLASDAFFPFADNIEEIAAAGIKAIIQPGGSVRDQESIDAANKHGLTMIFTGVRHFRH

SEQ ID NO: 959 - DNA, 1545 bp, Streptococcus pyogenes
atgactaaacgtgctttaatctcagtgtctgacaagtcaggaattgttgactttgcaaaagaattgaaaaacttgggttgggatattatctcaactggtgggactaaggttacccttgacgatgctggtgttgagaccattgccatcgacgatgtgactagattcccagagatgatggacggtcgtgttaagaccctccacccaaacattcacggtgggcttttggctcgtcgcgacgctgacagccaccttcaggctgctaaggacaacaatatcgagctgattgacctcgtggttgtcaacctctatcccttcaaggagactatccttcgtccagacataacctatgatttggcggtggaaaacatcgacatcggcggtccatcaatgcttcgctcagccgctaaaaatcacgctagcgtgaccgttgtggttgacccagcggattatgcgactgttttgggagaattggctgacgctggtcagacgacatttgaaacgcgtcaacgcttggcagctaaggtctttcgtcacacagcagcctacgacgctttgattgctgagtacttcacaactcaagtgggagaggctaagcctgaaaaattaaccatcacttacgaccttaaacaggctatgcgttacggagaaaatccacaacaagacgctgatttctatcaaaaagccttgccaacagactactcaattgcttctgctaaacagctcaacggaaaagaattgtctttcaataatatccgtgatgccgatgcggcaatccgtattatccgcgatttcaaagaccgtccaactgttgttgctctcaaacacatgaacccatgtggtatcggacaggctgatgacattgagactgcttgggattacacttataaagctgacccagtttcaatctttggcggaattattgtccttaaccgtgaagttgacgcagcgacagccaagaagatgcaccctatcttcttggaaatcatcatcgcaccatcatactcagaagaagcgctagctattctcacaaataaaaagaaaaacttgcgaatccttgagttgccgtttgatgcccaagctgccagcgaagtggaagctgagtacactggcgtagttggtggacttttggtgcaaaaccaagacgttgtggctgaaaatccatctgactggcaagtggtgacagaccgccaaccaacagaacaagaggcgactgcccttgagtttgcctggaaggctatcaagtatgttaagtctaacgggattattattactaacgatcacatgacgcttggactcggtgcaggtcaaaccaaccgtgtcggctcagtcaagattgctatcgagcaggctaaagaccaccttgacggtgccgttctagcatcagatgccttcttcccatttgcggacaacattgaagaaatcgctgccgcagggatcaaagcaatcatccaaccaggtggttcagttcgtgaccaagactctattgacgccgcaaacaaacatggcttgaccatgatcttcacaggtgtgagacattttaggcat

SEQ ID NO: 960 - protein, 515 aa, Streptococcus pyogenes
MTKRALISVSDKSGIVDFAKELKNLGWDIISTGGTKVTLDDAGVETIAIDDVTRFPEMMDGRVKTLHPNIHGGLLARRDADSHLQAAKDNNIELIDLVVVNLYPFKETILRPDITYDLAVENIDIGGPSMLRSAAKNHASVTVVVDPADYATVLGELADAGQTTFETRQRLAAKVFRHTAAYDALIAEYFTTQVGEAKPEKLTITYDLKQAMRYGENPQQDADFYQKALPTDYSIASAKQLNGKELSFNNIRDADAAIRIIRDFKDRPTVVALKHMNPCGIGQADDIETAWDYTYKADPVSIFGGIIVLNREVDAATAKKMHPIFLEIIIAPSYSEEALAILTNKKKNLRILELPFDAQAASEVEAEYTGVVGGLLVQNQDVVAENPSDWQVVTDRQPTEQEATALEFAWKAIKYVKSNGIIITNDHMTLGLGAGQTNRVGSVKIAIEQAKDHLDGAVLASDAFFPFADNIEEIAAAGIKAIIQPGGSVRDQDSIDAANKHGLTMIFTGVRHFRH

SEQ ID NO: 961 - DNA, 750 bp, Streptococcus agalactiae
atgaaactagtgaaaaatttagagatagtagagtctatttttggtgattgggacgagaccataatctggtcgtgtgtccaaggtattatgggagaagtttttgtagatagtttagaccaaccaaaatcttctttggcaaaattgggaaggaaatcatcttttggttttctagcaggtcagcctactttatttctactagaagtttgctctggggaggatattatccttgttcctcagcataaaggatggtcagatttgattgaatcaacttatggtcagaatgctcattcttttaagcgttatgcgacgaaaaaagatactttgtttgagcgaagtaggttagagaagtttgttactcagttgccaaatggttttgaattacgtgctattgatgagaaagtttacaactcttgcttagaaaaggaatggtcacaggatttagtagcaaattacgctacttatcagtactataaaaaacaaggtataggttatgttgtatattatcaggggaatatcattgcaggagcttcatcttattcaacctataaaaatgggattgagatagaagtagatacgcatccagattttcgtcggcgtggtttagcaacaatagttgcagctcagttaatactaacttgtttagataagggaatttatcctagctgggatgctcatacaaggacttcattgaatttatctgaaaaactcggttatgaattttctcatgaatacatagcctatgaaatagat

SEQ ID NO: 962 - protein, 250 aa, Streptococcus agalactiae
MKLVKNLEIVESIFGDWDETIIWSCVQGIMGEVFVDSLDQPKSSLAKLGRKSSFGFLAGQPTLFLLEVCSGEDIILVPQHKGWSDLIESTYGQNAHSFKRYATKKDTLFERSRLEKFVTQLPNGFELRAIDEKVYNSCLEKEWSQDLVANYATYQYYKKQGIGYVVYYQGNIIAGASSYSTYKNGIEIEVDTHPDFRRRGLATIVAAQLILTCLDKGIYPSWDAHTRTSLNLSEKLGYEFSHEYIAYEID

SEQ ID NO: 963 - DNA, 546 bp, Streptococcus agalactiae
atgaaaatcgctgtttttgcttctggtaatggttccaactttcaggtcatagcagagcagtttcaagttagttttgtcttttcagatcatcgtgatgcctatgttttagagcgtgctcagaacttagccattccaagcttcgcttttgaactcaaagagtttgagaataaggcggcttacgagcaagccgtcgttgatttgttggacaaacacgagattgacttggtctgtctggcgggctacatgaagattgtcggagaaaccttgctctcagcctatgaagggcgtatcatcaatattcacccaacctatctgcctgaatttccaggtgctcacggtatcaaggatgcttgggaggcaggtgttgaccagtctggtgtgaccatccattgggtggactctggtgtggataccggtcaggtcatccaacaagtgcacgtgccacgcctagcagatgatagtctagaaagctttgaaacccgcatccacgaaaccgaataccaactctacccagctgtcttagatagcttgggcataaagagaaaa

SEQ ID NO: 964 - protein, 182 aa, Streptococcus agalactiae
MKIAVFASGNGSNFQVIAEQFQVSFVFSDHRDAYVLERAQNLAIPSFAFELKEFENKAAYEQAVVDLLDKHEIDLVCLAGYMKIVGETLLSAYEGRIINIHPTYLPEFPGAHGIKDAWEAGVDQSGVTIHWVDSGVDTGQVIQQVHVPRLADDSLESFETRIHETEYQLYPAVLDSLGIKRK

SEQ ID NO: 965 - DNA, 552 bp, Streptococcus pyogenes
atgaaaatcgctgtttttgcttctggtaatggttccaactttcaggtcatagcagagcagtttccagttagttttgtcttttcagatcatcgtgatgcctatgttttagagcgtgctcagaatttagccattccaagcttcgcttttgaactcaaggagtttgagaataaggtggcttacgagcaagccatcgttgatttgttggacaaacacgagattgacttagtctgtctggcaggctatatgaagattgttggagaaaccttactcttggcctatgagaggcgtattatcaatattcacccagcctacctgcctgaatttccaggtgcccacggtatcgaggatgcttgggaagctggtgttgaccagtctggcgtgaccatccactgggttgactctggtgtggataccggtcaggtcatccaacaagtgcgcgtgccacgcctagcagacgatagcctagaaagctttgaaacccgtatccatgaaaccgaatatcaactctacccagctgtcttagatagcttgggagtggagaggaaagtaatc

SEQ ID NO: 966 - protein, 184 aa, Streptococcus pyogenes
MKIAVFASGNGSNFQVIAEQFPVSFVFSDHRDAYVLERAQNLAIPSFAFELKEFENKVAYEQAIVDLLDKHEIDLVCLAGYMKIVGETLLLAYERRIINIHPAYLPEFPGAHGIEDAWEAGVDQSGVTIHWVDSGVDTGQVIQQVRVPRLADDSLESFETRIHETEYQLYPAVLDSLGVERKVI

SEQ ID NO: 967 - DNA, 1020 bp, Streptococcus agalactiae
atgtctgaaaaaaatgcttatgcccagtctggtgttgatgtagaagcgggctacgaagttgtcgaacgtatcaagaaacacgttgctcgcacagaacgtgctggtgtcatgggagctctcggtggctttggtggtatgtttgacctgtcacaaacaggtgttaaagaacctgtcttgatttcagggactgacggtgtcggaactaaactcatgcttgctatcaagtacgacaagcacgacacaatcggtcaagactgtgttgccatgtgtgtcaacgatattattgcagcaggtgctgagcccctttacttccttgactatgtcgcgactggtaaaaacgaacctgccaaattggaacaggttgtcgctggtgttgctgaaggttgtgttcaagctagcgcagctcttatcggtggtgaaacggctgagatgcctggtatgtatggcgaagatgattatgaccttgcaggctttgctgttggtgtggctgaaaaatctcaaatcatcgacggttcaaaggtaaaagaaggggatattcttcttggacttgcttcaagtggtatccattcaaatggttattcattggtacgtcgtgtctttgctgactacactggtgatgaggtgcttccagagcttgaaggcaaacaactcaaggatgtccttcttgagccaactcgtatctatgttaaagcagctctgccattgatcaaggaagaactagttaacggtatcgcccacatcacgggtggtggttttatcgagaatgttcctcgtatgtttgcggatgatttggctgcggaaatcgatgaggataaggtgcctgtacttccgattttcaaggcgcttgaaaaatatggtgacatcaagcacgaagaaatgtttgaaatcttcaacatgggtgtcggtcttatgctggatgttaaccctgaaaatgttgaccgtgtcaaagaacttttggacgaaccagtctatgaaatcggtcgtatcatcaagaaagcagacgatagtgtggtgattaaa

SEQ ID NO: 968 - protein, 340 aa, Streptococcus agalactiae
MSEKNAYAQSGVDVEAGYEVVERIKKHVARTERAGVMGALGGFGGMFDLSQTGVKEPVLISGTDGVGTKLMLAIKYDKHDTIGQDCVAMCVNDIIAAGAEPLYFLDYVATGKNEPAKLEQVVAGVAEGCVQASAALIGGETAEMPGMYGEDDYDLAGFAVGVAEKSQIIDGSKVKEGDILLGLASSGIHSNGYSLVRRVFADYTGDEVLPELEGKQLKDVLLEPTRIYVKAALPLIKEELVNGIAHITGGGFIENVPRMFADDLAAEIDEDKVPVLPIFKALEKYGDIKHEEMFEIFNMGVGLMLDVNPENVDRVKELLDEPVYEIGRIIKKADDSVVIK

SEQ ID NO: 969 - DNA, 1020 bp, Streptococcus pyogenes
atgtctgaaaaaaatgcttatgcaaaatctggtgttgatgttgaagctggttatgaagtggttgaaagaataaaaaaacacgttgctcgtacagaacgtgcgggagtcatgggagctctaggtggctttggtgggatgtttgacttgagtaaaacaggagttaaagagcctgtcttggtttcagggactgacggtgtcggaacaaaacttatgcttgctatcaagtacgacaagcacgacacaatcggtcaagactgtgttgccatgtgtgtcaatgatattattgcagcaggtgctgagccattatattttttagattatattgcgacaggaaaaaataacccagtcaaacttgaagaagttgtttctggtgttgcagaaggttgtgttcaagcaggagcagcactcattggaggtgagaccgctgaaatgcctggaatgtatggtcaagatgattatgaccttgcaggctttgctgttggtgtggctgaaaaatctcaaatcatcgacggttcaaaagtaaaagaaggcgatattcttttgggacttgcttcaagtggtatccattcaaacggttattctttggtacgtcgtgtctttgctgactatactggtaaagagctgcttccagagcttgaaggcaaacaacttaaggatgtcctccttgagccaactcgtatctatgttaaagcagctctgccattaatcaaggaagaactagtcaaaggtatcggccacatcacgggtggtggctttatcgagaatattcctcgtatgtttgcggatgatttggctgcggaaatcgatgaggacaaggtgccagtgcttccgattttcaaggcgcttgaaaaatatggtgacatcaagcacgaagaaatgtttgaaatcttcaatatgggtgtcggtcttatgctagctgttagtcctgaaaatgttaaccgcgtcaaagagctcttggatgaaccagtttatgaaatcggtcgtatcatcaagaaagcagacgctagtgtggtgattaaa

SEQ ID NO: 970 - protein, 340 aa, Streptococcus pyogenes
MSEKNAYAKSGVDVEAGYEVVERIKKHVARTERAGVMGALGGFGGMFDLSKTGVKEPVLVSGTDGVGTKLMLAIKYDKHDTIGQDCVAMCVNDIIAAGAEPLYFLDYIATGKNNPVKLEEVVSGVAEGCVQAGAALIGGETAEMPGMYGQDDYDLAGFAVGVAEKSQIIDGSKVKEGDILLGLASSGIHSNGYSLVRRVFADYTGKELLPELEGKQLKDVLLEPTRIYVKAALPLIKEELVKGIGHITGGGFIENIPRMFADDLAAEIDEDKVPVLPIFKALEKYGDIKHEEMFEIFNMGVGLMLAVSPENVNRVKELLDEPVYEIGRIIKKADASVVIK

SEQ ID NO: 971 - DNA, 1452 bp, Streptococcus agalactiae
atgacatacgaagtaaaatctctaaatgaagaatgtggagtctttggtatctgggggtatcctcaggcagctcaagtcacttactttgggcttcatagccttcaacatcgcggtcaagaaggagctggtattatttcaaatgataatgggaaactctatggttatcgaaatgttgggctcctttctgaagtttttaagaatcaatctgaattagataatttaactgggaatgcggctattggacatgttcggtatgctactgcaggttctgcagatattcgcaatattcagccttttctttataaatttcatgatgggcaatttgctttatgtcataatggtaatttgacaaatgctatttcctcaaggaaagaattagaaaagcaaggtgcaattttcaatgcctcctcagatactgaaattttaatgcatttgattcgtcgaagccataacccaagttttatggggaaggtaaaagaagctttaagcactgtaaagggaggtttcgcctatctactgatgacagaagataaattaattgctgctcttgaccctaatgcctttcgtcctttgtcaattggacaaatgcaaaatggtgcctgggttatttccagtgagacctgtgcttttgaggtggtaggcgcaaaatgggttagagatgttgaacctggtgaagttattcttatagacgatagtggtattcaatgtgatcgttatactgatgaaacgcaactggcaatttgttcgatggaatatgtctattttgcaaggccggattcaactatacatggtgttaatgttcatacggctcgaaaaaatatgggaaagcgtcttgcacaagaatttaaacaggatgctgatattgtaattggtgtcccaaattcgtccttatcggctgctatgggctttgctgaagaatccggattaccaaatgagatgggccttgtaaaaaatcagtatacgcagcgaacctttattcaaccgacacaagaattaagggaacaaggtgttcgaatgaaattatcagcggtatctggtgttgtcaaaggaaagcgcgttgttatgattgatgactcaattgtaagaggaacgacttctagaaggattgtaggattattaagagaagcaggagctactgaagtacatgttgctatagctagtccagaattaaagtatccttgtttttatggaattgatattcaaacaagacgagaattaatttcagcaaatcacgctgttgacgaagtgtgtgatattattggcgcagatagtctaacttatctatcaatcgatgggttaattaaatcaattggactcgaaacaaaagcaccaaatggtggtttatgcgtagcttactttgatggacattatccaacaccgctttatgattatgaagaagaatacctcagaagtttagaagaaaaaacaagtttttatattcaaaaagtgaaa

SEQ ID NO: 972 - protein, 484 aa, Streptococcus agalactiae
MTYEVKSLNEECGVFGIWGYPQAAQVTYFGLHSLQHRGQEGAGIISNDNGKLYGYRNVGLLSEVFKNQSELDNLTGNAAIGHVRYATAGSADIRNIQPFLYKFHDGQFALCHNGNLTNAISSRKELEKQGAIFNASSDTEILMHLIRRSHNPSFMGKVKEALSTVKGGFAYLLMTEDKLIAALDPNAFRPLSIGQMQNGAWVISSETCAFEVVGAKWVRDVEPGEVILIDDSGIQCDRYTDETQLAICSMEYVYFARPDSTIHGVNVHTARKNMGKRLAQEFKQDADIVIGVPNSSLSAAMGFAEESGLPNEMGLVKNQYTQRTFIQPTQELREQGVRMKLSAVSGVVKGKRVVMIDDSIVRGTTSRRIVGLLREAGATEVHVAIASPELKYPCFYGIDIQTRRELISANHAVDEVCDIIGADSLTYLSIDGLIKSIGLETKAPNGGLCVAYFDGHYPTPLYDYEEEYLRSLEEKTSFYIQKVK

SEQ ID NO: 973 - DNA, 1509 bp, Streptococcus pyogenes
ttgtgcgaaaaactttctattttcgctttacttgacagcctttgtatcgaggtaaaaatgacatacgaagtaaaatctctaaatgaagaatgtggagtctttggtatctggggacatcctcaggcagctcaagtcacttactttgggcttcatagccttcaacatcgcggtcaagaaggagctggtattgtttcaaatgacaatgggaaactctatggttatcgaaatgttgggctcctttctgaagtttttaagaatcaatctgaattagataatttaactgggaatgcggctattggacatgttcggtatgctactgcaggttctgcagatattcgcaatattcagccttttctttataaatttcatgacgggcaatttgctttatgccataatggtaatttgacaaatgctatttccttaaggaaagaattagaaaagcaaggtgcaattttcaatgcctcctcagatactgaaattttgatgcacttgattcgtcgaagccataactcaagtttcatgggaaaggtaaaagaagctctaaatacagtaaagggtggctttgcctatctactgatgacagaaaataaactcattgctgctcttgaccctaatgcctttcgtcctttgtcaattggacaaatgcaaaatggtgcctgggttatttccagtgagacctgtgcttttgaggtggtaggcgcaaaatgggttagagatgttgaacctggcgaagttattcttatagacgatcgtggtattcaatgtgatcgttatactgatgaaacgcaactggcaatttgttcgatggaatatgtctattttgcaaggccggattcaactatacatggtgttaatgttcatacggctcgaaaaaatatgggaaagcgtcttgcacaagaatttaaacaggatgctgatattgtaattggtgtcccaaattcgtccttatcggctgctatgggctttgctgaagaatccggattaccaaatgagatgggtcttgtaaaaaatcagtatacgcagcgaacctttattcaaccgacacaagaattaagggaacaaggtgttcgaatgaaactatcagcggtatccggtgttgtcaaaggaaagcgcgttgttatgattgatgactcaattgtaagaggaacgacttctagaaggattgtcggattattaagagaagcaggagctagtgaagtacatgttgctatagctagtccagaattaaagtatccttgtttttatggtattgatattcagactcgtcgtgagttgatttcagccaatcactctgttgatgaagtgtgtgatattattggcgcagatagtctgacctatctctcactggatgggttgattgaatcaattggactcgaaacaaaagcaccaaatggtggtttatgcgtagcttactttgatgggcattatccaacaccgctttatgattatgaagaagaatacctcagaagtttagaagagaaaacaagtttttatattcaaaaagtgaaa

SEQ ID NO: 974 - protein, 503 aa, Streptococcus pyogenes
LCEKLSIFALLDSLCIEVKMTYEVKSLNEECGVFGIWGHPQAAQVTYFGLHSLQHRGQEGAGIVSNDNGKLYGYRNVGLLSEVFKNQSELDNLTGNAAIGHVRYATAGSADIRNIQPFLYKFHDGQFALCHNGNLTNAISLRKELEKQGAIFNASSDTEILMHLIRRSHNSSFMGKVKEALNTVKGGFAYLLMTENKLIAALDPNAFRPLSIGQMQNGAWVISSETCAFEVVGAKWVRDVEPGEVILIDDRGIQCDRYTDETQLAICSMEYVYFARPDSTIHGVNVHTARKNMGKRLAQEFKQDADIVIGVPNSSLSAAMGFAEESGLPNEMGLVKNQYTQRTFIQPTQELREQGVRMKLSAVSGVVKGKRVVMIDDSIVRGTTSRRIVGLLREAGASEVHVAIASPELKYPCFYGIDIQTRRELISANHSVDEVCDIIGADSLTYLSLDGLIESIGLETKAPNGGLCVAYFDGHYPTPLYDYEEEYLRSLEEKTSFYIQKVK

SEQ ID NO: 975 - DNA, 114 bp, Streptococcus agalactiae
gtgaaggcgaggttagatagaaattcgctatcttttgaacgaagcgagcttaaccgtatctttccgccgtattggtatttgggagtcattgagactaaggttcaatggctagct

SEQ ID NO: 976 - protein, 38 aa, Streptococcus agalactiae
MKARLDRNSLSFERSELNRIFPPYWYLGVIETKVQWLA

SEQ ID NO: 977 - DNA, 111 bp, Streptococcus agalactiae
ttgcggctgtccgctgttgtcacaccgaaagctaccaaggttggtggtactgtcaattcttcgaaagtaccagacatagagtccttaccgccgattgatggcaaaccaaat

SEQ ID NO: 978 - protein, 37 aa, Streptococcus agalactiae
MRLSAVVTPKATKVGGTVNSSKVPDIESLPPIDGKPN

SEQ ID NO: 979 - DNA, 3798 bp, Streptococcus agalactiae
ttgggcttactgaaatctcaatttcagacgtcctcctattttcgagtcgctcccttgtcggacttggtatcttatatgaataaacgtatttttgttgagaaaaaggctgactttggcattaaatcggctagtcttgtgaaagagttgacgcataatctacaactggcttctttgaaggatttgcgtatcgtgcaggtctatgatgtcttcaatttggctgaggatttgctggcgcgtgctgagaagcatattttctctgagcaggtgacagaccgtcttttgacagaagctgaaatcactgcggagcttgataaggttgccttctttgccattgaggcgcttcctggtcaatttgaccaacgtgctgctagttcgcaagaagctttgctattgcttggaagtgacagtcaggtcaaggtcaatacagctcagctttacttggtcaataaggatattgcagaagcagagcttgaagccgttaagaactatcttttgaatcccgttgattcacgtttcaaggatattaccttgccacttgaagtgcaggctttctctgtgtctgataagacaatctctaatcttgatttcttcgaaacttatcaggctgacgattttgcagcctataaggcagagcagggattggctatggaggtcgatgaccttctcttcatccaagattatttcaaatcaatcgggcgtgtgccaactgagactgagttgaaagttttggatacgtattggtcagaccactgccgtcacacaacctttgaaactgaattgaaaaacattgatttttcggcctctaaattccaaaaacaattgcaggcgacttatgacaaatacattgccatgcgtgatgagcttggtcgttctgaaaagccgcagacacttatggatatggcgactatctttggtcgttatgagcgtgccaatggtcgtctggacgatatggaagtctcagatgaaatcaatgcctgctcagttgaaattgaagtagatgttgatggtgtgaaagagccttggctcctcatgtttaagaacgagactcacaaccacccaacagaaattgagccatttggtggagcggcgacttgtatcggtggtgccattcgtgacccattgtcaggacgttcatacgtttatcaggctatgcgtatttcaggcgcaggagatatcacgactccgattgcggaaacacgtgctggtaaattgccacaacaggttatttctaagactgcggcgcacggctattcttcatatggtaaccaaattgggcttgcgacaacttatgtgcgtgagtacttccaccctggcttcgtagctaaacgcatggagcttggagctgtggttggtgctgcacctaaggaaaatgtggttcgtgaaaaaccagaggcaggcgatgtggttgtcttgctcggtggtaaaacaggtcgtgacggtgtcggcggtgcgacaggttcatctaaggttcaaacggttgaatctgtggaaacagctggcgcagaggtacaaaaagggaatgccatcgaagaacgtaagattcaacgccttttccgtgatggtaatgtcactcgcctaatcaagaaatcaaatgacttcggtgcaggtggtgtctgtgttgccatcggtgaattagctgatggtcttgaaatcgatttggacaaggtgccacttaaataccaaggtcttaatggtactgaaattgctatctcagaatctcaagaaaggatgtcagttgttgttggtccaagtgatgtggatgccttcatcgcagcctgtaacaaggaaaatatcgatgcagttgttgttgcgacagttactgaaaaaccaaatcttgtcatgacttggaatggtgaaacaattgttgatttggaacgctgtttccttgataccaacggtgttcgtgtcgtagttgatgccaaagtcgttgacaaggacttaacagttccagaagcgcgcacaacatcagcagagacacttgaagcagatatgcttaaggtcttgtctgacctcaatcacgctagtcaaaaaggtcttcaaactatctttgactcatctgttggtcgttcaaccgttaaccacccaatcggtggtcgttaccaaatcacaccgacagaaagttctgttcaaaaattgccagttcaatatggtgtgacaacaacagcatctgttatggctcaaggttacaatccttatattgcagagtggtcaccttatcacggtgctgcctatgctgttattgaagcgacagctcgcttggtagcaacgggtgctgactggtctcgtgcacgtttctcttaccaagagtatttcgagcgtatggataaacaggcagagcgttttggtcagccagtatcagctcttcttggttctattgaggctcagattcaatttggtttgccatcaatcggcggtaaggactctatgtctggtactttcgaagaattgacagtaccaccaaccttggtagctttcggtgtgacaacagcggacagccgcaaggttctctctcctgagtttaaagcggctggtgagaatatctactacattccaggtcaagctatttcagaagatattgattttgaccttatcaaggctaactttagccagtttgaggctattcaagctcaacataagattaccgctgcctcagccgttaaatacggtggtgtcctagaaagtcttgctctcatgacttttggtaaccgtatcggtgcttctgttgaaattgcagagcttgacagcagcttgacagctcaactcggaggctttgtctttacatcagttgaggaaattgctgacgttgtgaagatcggtcaaactcaggcagactttacagtcactgtcaatggaaatgacctagctggtgcaagccttctatcagccttcgaaggtaaattagaagaagtttacccaacagagtttgaacaggtagatgctattgaggaagttcctgctgtggtatcagatgttgttatcaaggctaaggaaattattgaaaaaccagtagtttacatcccagtctttcctggtactaactcagagtacgattcagctaaggcctttgaacaggttggagctagcgtcaacttggtgccatttgtaaccttgaatgaggctgctattgctgagtcagttgatacgatggttgctaatattgctaaggcaaatatcatcttctttgctggaggtttctcagcagcggatgaaccagatggctctgctaagtttatcgtcaatatcttgcttaacgagaaggttcgcgcagctattgacagcttcatcgaaaaaggtggccttatcatcggtatctgtaatggtttccaagcccttgttaaatcaggtcttcttccatacggaaacttcgaggaagctggtgagacaagtccaaccctcttctataacgatgctaaccagcacgttgcaaagatggttgagactcgtatcgcaaataccaattcaccttggttggcaggagttgaggtcggcgatattcatgtcattccagtttcacacggtgaaggtaaatttgttgtcagcgcttctgaatttgcagagctaagagacaatggtcaaatctggagccaatatgtggactttgacggacaaccatctatggattctaaatacaatccaaacggctctgtcaatgccatcgaagggattaccagcaagaatggtcaaatcatcggtaagatggggcactcagaacgctgggaagacggactcttccaaaatatccctggaaacaaagaccaaaaactctttgaaagtgctgtaaaatactttacagggaag

SEQ ID NO: 980 - protein, 1266 aa, Streptococcus agalactiae
MGLLKSQFQTSSYFRVAPLSDLVSYMNKRIFVEKKADFGIKSASLVKELTHNLQLASLKDLRIVQVYDVFNLAEDLLARAEKHIFSEQVTDRLLTEAEITAELDKVAFFAIEALPGQFDQRAASSQEALLLLGSDSQVKVNTAQLYLVNKDIAEAELEAVKNYLLNPVDSRFKDITLPLEVQAFSVSDKTISNLDFFETYQADDFAAYKAEQGLAMEVDDLLFIQDYFKSIGRVPTETELKVLDTYWSDHCRHTTFETELKNIDFSASKFQKQLQATYDKYIAMRDELGRSEKPQTLMDMATIFGRYERANGRLDDMEVSDEINACSVEIEVDVDGVKEPWLLMFKNETHNHPTEIEPFGGAATCIGGAIRDPLSGRSYVYQAMRISGAGDITTPIAETRAGKLPQQVISKTAAHGYSSYGNQIGLATTYVREYFHPGFVAKRMELGAVVGAAPKENVVREKPEAGDVVVLLGGKTGRDGVGGATGSSKVQTVESVETAGAEVQKGNAIEERKIQRLFRDGNVTRLIKKSNDFGAGGVCVAIGELADGLEIDLDKVPLKYQGLNGTEIAISESQERMSVVVGPSDVDAFIAACNKENIDAVVVATVTEKPNLVMTWNGETIVDLERCFLDTNGVRVVVDAKVVDKDLTVPEARTTSAETLEADMLKVLSDLNHASQKGLQTIFDSSVGRSTVNHPIGGRYQITPTESSVQKLPVQYGVTTTASVMAQGYNPYIAEWSPYHGAAYAVIEATARLVATGADWSRARFSYQEYFERMDKQAERFGQPVSALLGSIEAQIQFGLPSIGGKDSMSGTFEELTVPPTLVAFGVTTADSRKVLSPEFKAAGENIYYIPGQAISEDIDFDLIKANFSQFEAIQAQHKITAASAVKYGGVLESLALMTFGNRIGASVEIAELDSSLTAQLGGFVFTSVEEIADVVKIGQTQADFTVTVNGNDLAGASLLSAFEGKLEEVYPTEFEQVDAIEEVPAVVSDVVIKAKEIIEKPVVYIPVFPGTNSEYDSAKAFEQVGASVNLVPFVTLNEAAIAESVDTMVANIAKANIIFFAGGFSAADEPDGSAKFIVNILLNEKVRAAIDSFIEKGGLIIGICNGFQALVKSGLLPYGNFEEAGETSPTLFYNDANQHVAKMVETRIANTNSPWLAGVEVGDIHVIPVSHGEGKFVVSASEFAELRDNGQIWSQYVDFDGQPSMDSKYNPNGSVNAIEGITSKNGQIIGKMGHSERWEDGLFQNIPGNKDQKLFESAVKYFTGK

SEQ ID NO: 981 - DNA, 3771 bp, Streptococcus pyogenes
atgtcctcctattttccagtcgctcccttgtcggacttggtatcttatatgaataaacgtatttttgttgagaaaaaggctgactttggtattaaatcggctagtcttgtgaaagagttgacgcataatctacaactgacctctttgaaggctttgcgtattgtgcaggtctatgatgtcttcaatttggctgaggatttgctggcgcgtgctgagaagcatattttctctgagcaggtgacagactgtcttttgacggaaactgaaatcactgcggagcttgataaggttgccttctttgccattgaggcgcttcctggtcaatttgaccaacgtgctgctagttcgcaagaagctttgctattatttggaagtgacagtcaggttaaggtcaatacagcccagctatacttggtcaataaggatattacagaagcagagcttgaagccgttaagaactatcttttgaaccctgttgattcgcgtttcaaggacattactttgccgcttgaagagcaggctttctctgtatctgataagacgatccctaatcttgatttctttgaaacttatcaagctgacgattttgcgacttataaggcagagcagggcttggctatggaggtcgatgaccttctcttcatccaaaattatttcaaatcaatcggatgtgtgccaactgagactgagttgaaagttttggatacttactggtcagaccactgccgtcacacaacctttgaaactgaattgaagaacattgatttttcagcttctaaattccaaaaacaattgcagacaacttatgacaaatatatcgccatgcgtgatgagcttggtcgttctgaaaagccacaaacacttatggatatggcgactatttttggtcgttatgagcgtgccaacggtcgtctggacgatatggaagtctcagatgaaatcaatgcctgctcagttgagattgaagtagatgttgatggtgtgaaagagccttggctcctcatgtttaagaacgagactcacaatcacccaacagaaattgagccattcggtggagcggcgacttgtatcggtggtgctattcgtgacccattgtcaggacgttcatacgtttatcaggctatgcgtatttcaggcgcaggcgatatcacgactccgattgcggaaacacgtgctggtaaattgccacaacaagttatttctaaaactgcggcgcacggctattcttcatatggtaaccaaattgggcttgcgacaacttatgtgcgcgagtacttccaccctggcttcgtagccaaacgtatggagcttggagctgtggttggtgctgcacctaaggaaaatgtggttcgtgaaaaaccagaagcaggcgatgtggtcatcttgctcggtggtaaaacaggtcgtgatggtgtcggtggtgcgacaggttcatctaaggttcaaacggttgaatctgtggaaacagctggcgcagaggtacaaaaagggaatgccattgaagaacgtaagattcaacgtcttttccgtgatggcaatgtcactcgtcttattaagaaatcaaatgacttcggtgcaggtggtgtctgtgttgccatcggtgaattggctgacggtcttgaaatcgatttggacaaggtgcctcttaaataccaaggtcttaatggtactgaaattgcaatctcagaatctcaagagcgtatgtcagtcgttgttcgtccaaatgatgtggatgccttcatcgcagcctgcaacaaggaaaatatcgatgcagtcgttgttgcgaccgttactgaaaaaccaaatcttgtcatgacttggaatggcgaaatcatcgttgatttggaacgccgtttccttgataccaatggtgtccgtgtcgttgttgatgctaaagtcgttgacaaggacttgacagttccagaagcacgcacaacatcagcagagacacttgaagcagatacgcttaaggtcttgtctgacctcaaccacgctagtcaaaaaggtcttcaaactatctttgactcatctgttggtcgttcaaccgttaaccacccaatcggtggtcgttaccaaatcacaccgacagaaagttctgttcaaaaattgccagttcaacatggtgtgacaacaactgcatctgttatggctcaaggttacaatccttatattgcagagtggtcaccttatcacggtgctgcctatgctgtcattgaagcgacagctcgcttggtagcaacgggtgctgactggtctcgtgcacgtttctcttaccaagagtactttgagcgtatggataaacaggcagagcgttttggtcagccagtatcagctcttcttggttctattgaggctcagattcaacttggtttgccatcaatcggcggtaaggactctatgtctggtactttcgaagacttgacagtaccaccaaccttggtagctttcggcgtgacaacagcggacagccgcaaggttctctctcctgagtttaaagcggctggcgaaaacatttactatatcccaggtcaagctatttcagaagatattgattttgaccttatcaaggataactttagccagtttgaagctattcaagctcaacataagattacagctgcctcagccgctaaatacggtggtgtcctagaaagtcttgctctcatgacttttggtaaccgtatcggtgcttctgttgaaattgcagagcttgacagcagcttgacagctcaactcggaggttttgtctttacatcagctgaggaaattgctgacgcggtgaaaatcggtcaaactcaggcagactttacagtcactgtcaatggaaatgaccttgctggcgctagccttctagcagccttcgaaggcaaattggaagaggtttacccaacagaatttgagcagacagatgttcttgaagaagttcctgctgtggtatcagatactgttatcaaggctaaggaaacaattgaaaaaccagtggtttacattccagtcttccctggtaccaactcagaatacgattcagctaaggcctttgaacaggttggagctagtgtcaacttggtaccatttgtaaccttgaatgaggttgctattgctgagtcagttgacactatggttgctaatattgctaaggcaaatatcatcttctttgctggaggtttctcagcagcggatgaaccagatgggtctgctaagtttatcgtcaatatcttgcttaacgagaaggtccgcgcagctattgacagcttcatcgaaaaaggtggccttatcatcggtatctgtaatggtttccaagcccttgttaaatcaggtcttcttccatacggaaacttcgaggaagctggtgagacaagtccaactctcttctataatgatgctaatcagcatgttgccaagatggttgagactcgtatcgcaaataccaactcaccttggttggcaggagttgaggtcggcgatattcatgccattccagtttcacatggtgaaggtaaacttgttgtcagcgcttctgaatttgcagagctaagagacaatggtcaaatctggagccaatatgtggactttgacggacaaccatctatggattctaaatacaatccaaacggctctgtcaatgccatcgaagggattaccagcaagaatggtcaaatcatcggtaagatgggacactcagaacgctgggaagacggactcttccaaaatatccctggtaacaaagaccaaatcctctttgcaagtgctgtaaaatactttacagggaag

SEQ ID NO: 982 - protein, 1257 aa, Streptococcus pyogenes
MSSYFPVAPLSDLVSYMNKRIFVEKKADFGIKSASLVKELTHNLQLTSLKALRIVQVYDVFNLAEDLLARAEKHIFSEQVTDCLLTETEITAELDKVAFFAIEALPGQFDQRAASSQEALLLFGSDSQVKVNTAQLYLVNKDITEAELEAVKNYLLNPVDSRFKDITLPLEEQAFSVSDKTIPNLDFFETYQADDFATYKAEQGLAMEVDDLLFIQNYFKSIGCVPTETELKVLDTYWSDHCRHTTFETELKNIDFSASKFQKQLQTTYDKYIAMRDELGRSEKPQTLMDMATIFGRYERANGRLDDMEVSDEINACSVEIEVDVDGVKEPWLLMFKNETHNHPTEIEPFGGAATCIGGAIRDPLSGRSYVYQAMRISGAGDITTPIAETRAGKLPQQVISKTAAHGYSSYGNQIGLATTYVREYFHPGFVAKRMELGAVVGAAPKENVVREKPEAGDVVILLGGKTGRDGVGGATGSSKVQTVESVETAGAEVQKGNAIEERKIQRLFRDGNVTRLIKKSNDFGAGGVCVAIGELADGLEIDLDKVPLKYQGLNGTEIAISESQERMSVVVRPNDVDAFIAACNKENIDAVVVATVTEKPNLVMTWNGEIIVDLERRFLDTNGVRVVVDAKVVDKDLTVPEARTTSAETLEADTLKVLSDLNHASQKGLQTIFDSSVGRSTVNHPIGGRYQITPTESSVQKLPVQHGVTTTASVMAQGYNPYIAEWSPYHGAAYAVIEATARLVATGADWSRARFSYQEYFERMDKQAERFGQPVSALLGSIEAQIQLGLPSIGGKDSMSGTFEDLTVPPTLVAFGVTTADSRKVLSPEFKAAGENIYYIPGQAISEDIDFDLIKDNFSQFEAIQAQHKITAASAAKYGGVLESLALMTFGNRIGASVEIAELDSSLTAQLGGFVFTSAEEIADAVKIGQTQADFTVTVNGNDLAGASLLAAFEGKLEEVYPTEFEQTDVLEEVPAVVSDTVIKAKETIEKPVVYIPVFPGTNSEYDSAKAFEQVGASVNLVPFVTLNEVAIAESVDTMVANIAKANIIFFAGGFSAADEPDGSAKFIVNILLNEKVRAAIDSFIEKGGLIIGICNGFQALVKSGLLPYGNFEEAGETSPTLFYNDANQHVAKMVETRIANTNSPWLAGVEVGDIHAIPVSHGEGKLVVSASEFAELRDNGQIWSQYVDFDGQPSMDSKYNPNGSVNAIEGITSKNGQIIGKMGHSERWEDGLFQNIPGNKDQILFASAVKYFTGK

SEQ ID NO: 983 - DNA, 702 bp, Streptococcus agalactiae
gtgactaaccagcttatttatacaggaaaagcgaaagatatttatagtacaaaagatgaaaatgtgattagaacggtctataaagaccaagctactatgttgaatggagctcgtaaggagactattgatggcaagggagcactaaataatcagatttcatctcttatttttgagaaattaaatatggctggtgtggtgacacattatattgagcaaatttcaaaaaacgaacaattgaataaaaaagttgatattattccacttgaggtggtgctacggaatgtgacagcaggctcattttcaaaacgttttggagtggaagaaggacacgttcttgaaacgccaatcgtggaattttactacaaaaatgataatctgaatgatccttttatcaatgatgagcatgtgaagtttttgggtattgttaatgatgaggagattgcttatctgaaaggagagactcgccatattaatgaactcttgaaagattggtttgctcagattgggcttaacttgattgacttcaagttggagttcggatttgacaaggatggcaaaatcatcttggctgatgagttctcacctgacaactgccgtctctgggatgctgatggtaatcatatggacaaggatgtttttcgtagggatcttggtagcttgaccgatgtctatcaagttgtacttgagaagttgatagcattg

SEQ ID NO: 984 - protein, 234 aa, Streptococcus agalactiae
MTNQLIYTGKAKDIYSTKDENVIRTVYKDQATMLNGARKETIDGKGALNNQISSLIFEKLNMAGVVTHYIEQISKNEQLNKKVDIIPLEVVLRNVTAGSFSKRFGVEEGHVLETPIVEFYYKNDNLNDPFINDEHVKFLGIVNDEEIAYLKGETRHINELLKDWFAQIGLNLIDFKLEFGFDKDGKIILADEFSPDNCRLWDADGNHMDKDVFRRDLGSLTDVYQVVLEKLIAL

SEQ ID NO: 985 - DNA, 732 bp, Streptococcus pyogenes
atgaaaacagaaagaaaggcgaataatcaagtgactaaccagcttatttataaaggaaaagcgaaagatatttatagtacaaaagatgaaaatgtgattagaacggtctataaagaccaagctactatgttgaatggagctcgtaaggagactattgatggcaagggagcactaaataatcagatttcatctcttatttttgagaaattaaataaggctggtgtggtgacacattatattgagcaaatttcaaaaaacgaacaattgaataaaaaagttgatattattccacttgaggtggtgttacggaatgtgacagcaggctcattttcaaaacgttttggagtggaagaaggacatgttcttgaaacgccaattgtggaattttactacaaaaatgatgatctggatgatccttttatcaatgatgagcatgtgaagtttttgggtattgttaatgatgaggagattgcttatctgaaaggagagactcgccgtattaatgaactcttgaaaggttggtttgctcagattgggcttaacttgattgacttcaagttggagttcggatttgatcaagaaggtacaattatcttagcagatgaattttcgcctgataactgtcgcctatgggataagaatggtaaccatatggacaaggatgtttttagaagagaccttggcaacctgacggatgtctatcaagttgtacttgagaagttgatagcattg

SEQ ID NO: 986 - protein, 244 aa, Streptococcus pyogenes
MKTERKANNQVTNQLIYKGKAKDIYSTKDENVIRTVYKDQATMLNGARKETIDGKGALNNQISSLIFEKLNKAGVVTHYIEQISKNEQLNKKVDIIPLEVVLRNVTAGSFSKRFGVEEGHVLETPIVEFYYKNDDLDDPFINDEHVKFLGIVNDEEIAYLKGETRRINELLKGWFAQIGLNLIDFKLEFGFDQEGTIILADEFSPDNCRLWDKNGNHMDKDVFRRDLGNLTDVYQVVLEKLIAL

SEQ ID NO: 987 - DNA, 270 bp, Streptococcus agalactiae
ttgatgcctttacagatgaataggagtgaactcatgtcaagagatgaagtttttgaaaagatgctggaattattaaggcagcaacttggtgacccacagttagatatcacaccagagtcatcgttacatgatgatttagcaattgactctatcgctttaacagagtttattatcaatttggaagatgtgtttcatctagagattccagatgaggctgtcgaacacatgtcaagcgtccaacaactattagattatatcattgaacataag

SEQ ID NO: 988 - protein, 90 aa, Streptococcus agalactiae
MMPLQMNRSELMSRDEVFEKMLELLRQQLGDPQLDITPESSLHDDLAIDSIALTEFIINLEDVFHLEIPDEAVEHMSSVQQLLDYIIEHK

SEQ ID NO: 989 - DNA, 240 bp, Streptococcus pyogenes
atgactagacaggagatttttgaaaggctgattaacttaattcagaagcaaagaagctatttgagtgtagctattacagaacaaacacatttaaaaaatgatttagcggttgactctattgaactagttgaatttattattaatgttgaagatgaatttcatattgctattcctgatgaagatgttgaggatatggtatttatgagagacattttagattatttagttcagcgtttgact

SEQ ID NO: 990 - protein, 80 aa, Streptococcus pyogenes
MTRQEIFERLINLIQKQRSYLSVAITEQTHLKNDLAVDSIELVEFIINVEDEFHIAIPDEDVEDMVFMRDILDYLVQRLT

SEQ ID NO: 991 - DNA, 1005 bp, Streptococcus agalactiae
atgaggagttcattcatgaagaaaattgctatagatgctatgggtggagattacgctcccaaagctattgtagagggtgttaatcaagctatttcagattttagtgatattgaagtacaactctatggcgatcagaaaaaaattgagaaatatttaacagtaacggagcgagttagtattattcatactgaagaaaaaattaattctgatgatgagcctgctaaagctgttcgtcgtaaaaaacagtcttcgatggtcttaggagctaaggcagtcaaagatggtgttgcacaggcctttatttctgcagggaatacaggagctttattagctgctggtttgtttgtagtaggacgtataaaaggtgttgatcgaccaggcttaatgtcaactatgcctacgttagatggtgtgggttttgatatgcttgatttaggagctaatgcagaaaacacagcttctcatcttcatcaatatgctattttagggtcgttttatgcaaaaaatgtccgtggtattgaagttcctcgtgtaggtctcttaaataacggaacggaagaaacaaaaggcgattctcttcataaagaagcttatgaactgttagcagcagagccttctattaattttattggaaatattgaagcacgtgatttgatgtctagtgtagcagatgttgttgtcactgatggttttactggaaatgctgttctaaagacaatggaaggtacagctatgagtattatgggaagcctaaaatcttcaattaaatcaggtggcgtgaaagctaaattaggagcacttctattaaaagatagcctatatcagctaaaagatagtatggactattcaagcgcgggtggagcggttctttttggtttaaaagctccaatagtaaaatgccatggatcaagtgattctaaagctgtttattctactttgaagcaagttcgtacaatgttggaaactcaagtagttgatcaattagttgatgcctttacagatgaa

SEQ ID NO: 992 - protein, 335 aa, Streptococcus agalactiae
MRSSFMKKIAIDAMGGDYAPKAIVEGVNQAISDFSDIEVQLYGDQKKIEKYLTVTERVSIIHTEEKINSDDEPAKAVRRKKQSSMVLGAKAVKDGVAQAFISAGNTGALLAAGLFVVGRIKGVDRPGLMSTMPTLDGVGFDMLDLGANAENTASHLHQYAILGSFYAKNVRGIEVPRVGLLNNGTEETKGDSLHKEAYELLAAEPSINFIGNIEARDLMSSVADVVVTDGFTGNAVLKTMEGTAMSIMGSLKSSIKSGGVKAKLGALLLKDSLYQLKDSMDYSSAGGAVLFGLKAPIVKCHGSSDSKAVYSTLKQVRTMLETQVVDQLVDAFTDE

SEQ ID NO: 993 - DNA, 1083 bp, Streptococcus pyogenes
ttggtttcagaatatgctataataaaaatattattaatagattgtgtaagaacacaagatataattaaaggagtggaaatgaagagaattgcaatagatgctatgggtggagataacgctcctaaagctattgttgagggtgttaatcaagcaatagaagcattttcagatatcgaaattcaactttacggtgatcagacaaagattaactcctatcttattcaatcagatcgtgttgctattattcatacagatgaaaaaattatgtcagatgatgaacctgcaaaagctgttcgccgtaaaaagaaggcttcaatggttttagcagctaaggcagtgaaagaaggaaaagcagatgccattatttcagcagggaatacaggtgctcttttagctgtaggtttgtttgttgtggggcgtatcaagggagttgatcgtccaggattattatcaactattcccacagtaaccggattaggatttgatatgttggatcttggagctaatgctgaaaatacggcaaaacatttacatcaatatgctattttaggctctttctatgctaagaatgtacgtgggattgctaatccacgtgttggtctattaaacaatggtacagaagaaacaaaaggagatccccttcgtaaggccacttatgaacttttaacagcagataatacaatatcttttgttggtaatgtcgaggcgcgagaacttatgtcaggtgttgcagatgttattgtatcagatggtttcacgggaaacgcagtgttgaaatcaatagaaggaacagctattagcattatggggcaactgaaacagataattaatagcggcggtattaagactaaaattggagctagtctacttaaaagtagtctttacgagatgaagaagactcttgactactctagtgctggaggtgcagttttatttggtttaaaggcacctgttgtaaagtctcatggttctagtgatgtaaaagctattttttcaacgataaaacaagtacgtacgatgctagacactaacgtggtcggacaattagtagaagaatttgctaaggagactcaagtaaatgac

SEQ ID NO: 994 - protein, 361 aa, Streptococcus pyogenes
LVSEYAIIKILLIDCVRTQDIIKGVEMKRIAIDAMGGDNAPKAIVEGVNQAIEAFSDIEIQLYGDQTKINSYLIQSDRVAIIHTDEKIMSDDEPAKAVRRKKKASMVLAAKAVKEGKADAIISAGNTGALLAVGLFVVGRIKGVDRPGLLSTIPTVTGLGFDMLDLGANAENTAKHLHQYAILGSFYAKNVRGIANPRVGLLNNGTEETKGDPLRKATYELLTADNTISFVGNVEARELMSGVADVIVSDGFTGNAVLKSIEGTAISIMGQLKQIINSGGIKTKIGASLLKSSLYEMKKTLDYSSAGGAVLFGLKAPVVKSHGSSDVKAIFSTIKQVRTMLDTNVVGQLVEEFAKETQVND

SEQ ID NO: 995 - DNA, 90 bp, Streptococcus agalactiae
atgcaagaaataaaaagaaaaaaggtccaaaagaaaaggaattgctggaagaaatttccacaaaacctgataaccagtggcaaatataaa

SEQ ID NO: 996 - protein, 30 aa, Streptococcus agalactiae
MQEIKRKKVQKKRNCWKKFPQNLITSGKYK

SEQ ID NO: 997 - DNA, 876 bp, Streptococcus agalactiae
atggaattaatttttaggatatttgagatgaaaaaaacattatacattaccaataaactcttttttgctaactggtttgtgccagttattggtgcagttctaattcaagttatcggcatcattgtaagtagacgccttgtagtaaaattgctacctgatgattataaattcaatttatacattgcgcttttactatttgttcctattttggcaagtattttactatttttaatctattttcaaaaaagggattttacttccttgggatttactaaagataataatgttttaacaacgatctcaggatttattactggtagtttactgatgttttttatttatatttgccactggttatcaggttttgtggaaatttcttccagcaattccttttcttttggaccttttttctttttatttcttgcatactttatccaaagcttgacagaggaaattttatttagaggatatgttatgacaacagttaccaaatttaaaggtagttttgcaggtgttttatgtaattctatgttgttttcttttatccactttagaaactatggtatcacagcaatagcactttttaatttatttttacttggtattattttttctattctttttaatatgaccaaaaatattctttttgttacaggagttcatactacatggaattttactatgggatgtgtattaggtaataaggttagtgggggggattctcctgtttctctttttagaattactgaaaattctagctttgctctttggaatggtggggattttggttttgaagggggagtactatgttctttgatattagtaggttgtttagcatacttttctttggaaagcgtgagagtatctgttagatat

SEQ ID NO: 998 - protein, 292 aa, Streptococcus agalactiae
MELIFRIFEMKKTLYITNKLFFANWFVPVIGAVLIQVIGIIVSRRLVVKLLPDDYKFNLYIALLLFVPILASILLFLIYFQKRDFTSLGFTKDNNVLTTISGFITGSLLMFFIYICHWLSGFVEISSSNSFSFGPFFFLFLAYFIQSLTEEILFRGYVMTTVTKFKGSFAGVLCNSMLFSFIHFRNYGITAIALFNLFLLGIIFSILFNMTKNILFVTGVHTTWNFTMGCVLGNKVSGGDSPVSLFRITENSSFALWNGGDFGFEGGVLCSLILVGCLAYFSLESVRVSVRY

SEQ ID NO: 999 - DNA, 759 bp, Streptococcus agalactiae
atgagggttagtcaaacatacggtctcgttttgtataatcgtaattatcgtgaagatgataaattagttaaaatctttacggagactgaggggaaaaggatgttttttgtaaagcatgcttcaaagtcaaaattcaatgctgtgctccaacctttgactattgctcattttattttaaaaattaatgataatggtctttcttatattgatgattataaagaagttttagcatttcaagaaaccaattcagacttgtttaagttgtcatatgcgagttatattacttctttggctgatgtggctattagtgataatgtagcggatgctcaattatttattttcctaaagaaaacgttagaattgattgaggacggtttagattatgagattctaacgaatatttttgaagtacaactactagagaggttcggtgttgctttaaattttcatgattgtgttttttgtcatagggtaggattaccttttgatttttcacacaaatattctggattattatgtccaaaccattattataaagacgagagaagaaaccacctagatcctaatatgctgtacttaatcaatcgttttcagtcaattcaatttgatgatttacaaacaatttctgtgaaacctgagatgaaacttaaaattcgtcaatttttggacatgatttacgatgaatatgtagggattcatcttaaaagtaaaaaatttattgatgatttgtctagttggggaagtattatgaaatcagat

SEQ ID NO: 1000 - protein, 253 aa, Streptococcus agalactiae
MRVSQTYGLVLYNRNYREDDKLVKIFTETEGKRMFFVKHASKSKFNAVLQPLTIAHFILKINDNGLSYIDDYKEVLAFQETNSDLFKLSYASYITSLADVAISDNVADAQLFIFLKKTLELIEDGLDYEILTNIFEVQLLERFGVALNFHDCVFCHRVGLPFDFSHKYSGLLCPNHYYKDERRNHLDPNMLYLINRFQSIQFDDLQTISVKPEMKLKIRQFLDMIYDEYVGIHLKSKKFIDDLSSWGSIMKSD

SEQ ID NO: 1001 - DNA, 753 bp, Streptococcus pyogenes
atgcaactaacagaatcactaggcatcgttctttttaataggaattatcgagaagatgataaattagtcaaaatatttactgaagtagcaggtaagcagatgtttttcgtgaaacatattagtcgttccaaaatgtcctcaatcattcaaccactaacgattgctgattttattttcaagttaaatgatacaggcttgtcttatgttgttgactatagtaacgttaacacttatcggtatattaataatgatatttttcgattagcctatgctagttatgtcttagcattagctgatgctgcgattgcagataatgaatcagattcgcatttgtttacgtttttgaaaaaaacacttgatttgatggaagagggcctagattatgaaattttgacaaatatttttgaaattcagatattagatcgttttggtattagtctaaactttcatgagtgtgccatttgtcatcgcactgatttaccgcttgatttttcccatcgtttttcagctgtactttgttctgaacattattacaaagacaaccgacgtaatcatttagatccaaatgttatctacttgttgagtcgatttcaaaaaatcacatttgatgatttgagaactatttcattgaataaagacatcaaaaagaagcttcgtcagttcattgatgagttgtatcacgactatgtaggaatcaaattaaaaagtaaaacattcattgataatttagttaagtggggagatattatgaaa

SEQ ID NO: 1002 - protein, 251 aa, Streptococcus pyogenes
MQLTESLGIVLFNRNYREDDKLVKIFTEVAGKQMFFVKHISRSKMSSIIQPLTIADFIFKLNDTGLSYVVDYSNVNTYRYINNDIFRLAYASYVLALADAAIADNESDSHLFTFLKKTLDLMEEGLDYEILTNIFEIQILDRFGISLNFHECAICHRTDLPLDFSHRFSAVLCSEHYYKDNRRNHLDPNVIYLLSRFQKITFDDLRTISLNKDIKKKLRQFIDELYHDYVGIKLKSKTFIDNLVKWGDIMK

SEQ ID NO: 1003 - DNA, 1284 bp, Streptococcus agalactiae
atgacaaaaaacctgttattaacaggttttttatcatttaatgacggaaaactggacacaaattatttttcttgtataattaaatatattatttcttatcaggaggttatgatgacattagagaaacgatttaataagtacttagatagaatagaggtctccttaattcgtcagtttgatcaatctatttcagatatacctggaatggtaaaattaactcttggagaaccagattttaccactcctgatcatgttaaagaagcagctaaatcagctattgatgcgaatcaatcgtattacactggtatgagcggtttattagctctaaggcaagctgctgcagattttgcaaaggataaatataatcttacttataatcctgattgtgagatcttggttacgataggtgccacagaagctctgtctgcatctcttatagctattttagaagctggtgatgttgttctattacctgcccccgcttatccaggatatgagccaatagttaaccttgtaggagctgatatcgtagaaattgatactagagaaaatgactttagactaactcctgaaatgttagaaacggctattatccaacaaggtgaaaaattaaaggctgttttacttaattatcctactaaccctacaggtattacctattcaaggcaagaaattgctgcattagctgaagtccttaaaaaatatgatatttttgttattagtgatgaagtttattctgagttaacttacactggtcagcagcatgtttcaattgcagaatatttacctaaccaaactatcttaattaatggcttatcaaaatcacatgctatgactggttggagagttggattggtgtatgctcctgaagcatttattgctcaaatcattaaaagtcatcaatacatggtgacagctgctagtactatttcgcaatttgctggggtagaagccttatctgtgggtaaaaatgatacgttacctatgcgtcaaggatatattaaacgtagagattatatcattgataaaatgtctaaacttggtttcaaaataattaaaccgagtggcgctttttatatctttgctaaaatacctgatagctatccacaggattctttcaagttttgtcaggattttgcttatcaacaagctgtagctattattccaggagtggcttttggtaaatatggtgaaggatatatacgtctttcttatgctgctagtatggaagttattgaaacagcaatggctagattgaaagtttttatggaatcatatgagggt

SEQ ID NO: 1004 - protein, 428 aa, Streptococcus agalactiae
MTKNLLLTGFLSFNDGKLDTNYFSCIIKYIISYQEVMMTLEKRFNKYLDRIEVSLIRQFDQSISDIPGMVKLTLGEPDFTTPDHVKEAAKSAIDANQSYYTGMSGLLALRQAAADFAKDKYNLTYNPDCEILVTIGATEALSASLIAILEAGDVVLLPAPAYPGYEPIVNLVGADIVEIDTRENDFRLTPEMLETAIIQQGEKLKAVLLNYPTNPTGITYSRQEIAALAEVLKKYDIFVISDEVYSELTYTGQQHVSIAEYLPNQTILINGLSKSHAMTGWRVGLVYAPEAFIAQIIKSHQYMVTAASTISQFAGVEALSVGKNDTLPMRQGYIKRRDYIIDKMSKLGFKIIKPSGAFYIFAKIPDSYPQDSFKFCQDFAYQQAVAIIPGVAFGKYGEGYIRLSYAASMEVIETAMARLKVFMESYEG

SEQ ID NO: 1005 - DNA, 1191 bp, Streptococcus pyogenes
atgcccaaactatcaaagcgagttttagaaatgaaagagagtgttactctggctgcaggtgctagagctaaggctttgaaagcgcagggccgcgatgtactgaatttaactttaggagaaccagatttttttacacctaagcacattcaagacaaggcgattgaatctattcaaaatggtacggctagcttttatacaaatgcttctgggcttccagaattaaaagctgcgattgccacatacctgaaaaatcagtatgggtatcacttgtctcctgatcagattgtggcaggaacaggtgccaagttcatcctttatgccttttttatggctgttttaaatcctggtgaccaagttctcattccaacaccatattgggtatcttattctgaccaagtaaaaatggcagaaggtcagccgatcttcgttcaaggactagaagaaaatcaattcaaggtaactgttgaccagctggaaagagcaaggacaagtaagactaaagttgtccttatcaattctccttccaatccaacaggcatgatttatggtgctgaggaattaagggccattggagaatgggcggtgcacaacgatattcttattctggcagatgatatttacgggtccttagtctataacggcaatcagtttgttcctatttcaacactctcagaagcgattcggcgtcaaaccattacggtcaatggcgtggctaaaagttatgccatgacaggctggcgggttggttttgcagcaggtgaaccagagatcatttcggcaatgagtaagatcatcgggcagactacctctaacctgacaaccgtttcacaatatgctgctatcgaggctttctgtggtagtcagtcatcacttgaagagatgcgattagcatttgaagagcgccttaatatcacttatccattgttgtgtcaggtccctgggtttgaggttgttaaaccacaaggagctttttacttctttccaaacgttaagaaagccatggaaatgacaggtttttccgatgtgacaagctttgctaatgctattttagaggaagtcggattagctgttgtgagtggagcaggctttggcgcaccggaaaatgttcgtctgagttatgctacagatatcgaaacccttaaagaagctgttcgtagactgcatgtctttatggaaagtaatgaaattaat

SEQ ID NO: 1006 - protein, 397 aa, Streptococcus pyogenes
MPKLSKRVLEMKESVTLAAGARAKALKAQGRDVLNLTLGEPDFFTPKHIQDKAIESIQNGTASFYTNASGLPELKAAIATYLKNQYGYHLSPDQIVAGTGAKFILYAFFMAVLNPGDQVLIPTPYWVSYSDQVKMAEGQPIFVQGLEENQFKVTVDQLERARTSKTKVVLINSPSNPTGMIYGAEELRAIGEWAVHNDILILADDIYGSLVYNGNQFVPISTLSEAIRRQTITVNGVAKSYAMTGWRVGFAAGEPEIISAMSKIIGQTTSNLTTVSQYAAIEAFCGSQSSLEEMRLAFEERLNITYPLLCQVPGFEVVKPQGAFYFFPNVKKAMEMTGFSDVTSFANAILEEVGLAVVSGAGFGAPENVRLSYATDIETLKEAVRRLHVFMESNEIN

SEQ ID NO: 1007 - DNA, 978 bp, Streptococcus agalactiae
ttggaggaaatcatgtcttattctaatttaaaattgtttgcactgtcatcaaacaaagaactagcgaaaaaagtgtctcagacgattggaattccgctaggtcaatcgacagttcgccaattttctgatggtgagattcaagttaatattgaagagtctattcgtggccatcatgtttttattttacaatcaacaagctcaccagttaatgataatttgatggaaattttaattatggttgacgctttaaagcgtgctagtgcggagtctgttagtgtggtaatgccttactatgggtatgctcgtcaagatcgcaaggcacgttctcgtgaacctattacttcgaaactcgttgcgaacatgctagaagttgctggtgttgatcgtcttttaacagttgatttacatgcagctcaaattcagggattctttgatattcccgttgatcaccttatgggggctccccttattgcagattactttgatcgtcagggattggttggtgatgatgttgttgtcgttagtcctgatcatggtggcgtaacacgtgcacgtaagctggcacagtgtttaaagacaccgattgctatcattgataagcgccgtagtgttactaaaatgaatacatctgaagtaatgaatattattggtaatatcaaaggtaaaaaatgtattttaattgatgatatgattgatactgcaggtactatttgccatgctgcagacgctttagctgaagcaggggcaacagcggtttatgcttcatgtactcaccctgttttatcagggccggctttggataatattcaaaattcagctattgaaaaattaattgtgttagatacgatttacctccctgaagaacgtttgattgataagattgaacaaatttcaattgcggaattgattggtgaagctattatccgtattcacgagaaacgtcctttatcaccattatttgaaatgaataaactaaaa

SEQ ID NO: 1008 - protein, 326 aa, Streptococcus agalactiae
MEEIMSYSNLKLFALSSNKELAKKVSQTIGIPLGQSTVRQFSDGEIQVNIEESIRGHHVFILQSTSSPVNDNLMEILIMVDALKRASAESVSVVMPYYGYARQDRKARSREPITSKLVANMLEVAGVDRLLTVDLHAAQIQGFFDIPVDHLMGAPLIADYFDRQGLVGDDVVVVSPDHGGVTRARKLAQCLKTPIAIIDKRRSVTKMNTSEVMNIIGNIKGKKCILIDDMIDTAGTICHAADALAEAGATAVYASCTHPVLSGPALDNIQNSAIEKLIVLDTIYLPEERLIDKIEQISIAELIGEAIIRIHEKRPLSPLFEMNKLK

SEQ ID NO: 1009 - DNA, 972 bp, Streptococcus pyogenes
ttggaggaaaaaatgtcttattctgatttaaaattgtttgctttatcgtcaaacaaggaattagcagaaaaagttgcgtctgcaatgggtattcaacttggaaagtctacggttcgccagttttcagatggtgaaatccaagtaaatattgaagaatcaattcgtggtcatcatgtctttattttgcaatcaactagctcacctgtcaatgataatttaatggaaattttgattatggtcgatgctttaaagcgtgctagtgctgaaaaaatttcagttgtgatgccttactacggctatgcacgccaagaccgtaaagcgcgttctcgtgaacctattacttcaaaattagttgctaatatgttagaagttgctggtgtagatcgcttattaacggttgatttacatgctgctcaaattcaagggttctttgatattccagttgatcacttgatgggtgcacctttaattgcagactattttgatcgtcatggtttagtgggtgaagatgttgtcgttgttagtcctgaccatggtggtgtgactcgtgcgcgtaaattagcacaattcctccaaacaccaattgcaattatcgataagcgtcgtagtgtggataagatgaacaccagtgaagtgatgaatattatcggaaatgtttcggggaagaaatgtatcttgattgacgatatgattgataccgcagggactatttgccatgcagcagatgcgcttgctgaagcgggggcaacagctgtgtatgcgtcatgtacgcatcccgttctttctggaccagcacttgataatattcaacgttcggctatcgaaaaactaattgttcttgatactatttatctgccaaaagaacgccttattgataaaattgaacaaatttcaattgctgatttggttgcagaagcgattattcgtattcatgaaaaacgtccgttgtcacctttatttgagatgggcaat

SEQ ID NO: 1010 - protein, 324 aa, Streptococcus pyogenes
LEEKMSYSDLKLFALSSNKELAEKVASAMGIQLGKSTVRQFSDGEIQVNIEESIRGHHVFILQSTSSPVNDNLMEILIMVDALKRASAEKISVVMPYYGYARQDRKARSREPITSKLVANMLEVAGVDRLLTVDLHAAQIQGFFDIPVDHLMGAPLIADYFDRHGLVGEDVVVVSPDHGGVTRARKLAQFLQTPIAIIDKRRSVDKMNTSEVMNIIGNVSGKKCILIDDMIDTAGTICHAADALAEAGATAVYASCTHPVLSGPALDNIQRSAIEKLIVLDTIYLPKERLIDKIEQISIADLVAEAIIRIHEKRPLSPLFEMGN

SEQ ID NO: 1011 - DNA, 1185 bp, Streptococcus agalactiae
gtgactgctattaaaggacaagttggtgctttagagtctcaacaatcagaattagaagcgcaaaatgctcaacttgaggctgtatctcagcagttaggtcaagagattcaaactctttctaataaaattgttgcacgtaacgaatctttgaaaaagcaagttcgtagtgctcaaaagggtaacttgactaactatattaatactattttaaattcgaaatcagtatctgatgctgttaatcgtgttgttgctattcgtgaggttgtttcagctaatgaaaagatgttagcacaacaagaggctgacaaagcggccttagaagctaaacaaattgaaaatcaaaatgctataaatactgtagcagctaacaagcaagctatcgaaaataataaagcagccttagcaacacaaagagcacaattagaagcagctcaattagagttatctgctcaattgactacagtccaaaatgaaaaagcatctttaattcaggcaaaagcacaagctgaggaagctgcgcgtaaggcagctgaagcacaagcagcagctgaagcgaaagcacaagctgaagcgaaagcacaagctgagtctgtagcaaaagcacaggcagcagcacaagttgagtctgccacagctcctactgaaacagttcaaacacaaccgagaactgaaataaagccttctaatcttacggctacttcttcggcaactactgttgctacaactacagctacagctactaatgagccaaaagttactcaaccttctgtagtaactaaagcagttgaagcacctaaagcagttgtttcttcaacacctagagcggtatcaaaacctgttgtcagaagttatgattcaagtaacacatacccaatgggacaatgtacttggggagctaagtcaatggcttcttgggttggtaactattggggaaatgctaatcagtggggtgctagtgcacgtgcagctggttattctgtaggaactacccctcgtgttggtgcagtagctgtttggccatatgatggtggtggttacgggcacgttgcagtagtaacgtcagtggctaacaattcatctatccaagttatggaatcaaactatgctggaaatatgagtattggcaattaccgtggttcatttaaccctagtgcttctggctctgtttactatatttacccaaat

SEQ ID NO: 1012 - protein, 395 aa, Streptococcus agalactiae
MTAIKGQVGALESQQSELEAQNAQLEAVSQQLGQEIQTLSNKIVARNESLKKQVRSAQKGNLTNYINTILNSKSVSDAVNRVVAIREVVSANEKMLAQQEADKAALEAKQIENQNAINTVAANKQAIENNKAALATQRAQLEAAQLELSAQLTTVQNEKASLIQAKAQAEEAARKAAEAQAAAEAKAQAEAKAQAESVAKAQAAAQVESATAPTETVQTQPRTEIKPSNLTATSSATTVATTTATATNEPKVTQPSVVTKAVEAPKAVVSSTPRAVSKPVVRSYDSSNTYPMGQCTWGAKSMASWVGNYWGNANQWGASARAAGYSVGTTPRVGAVAVWPYDGGGYGHVAVVTSVANNSSIQVMESNYAGNMSIGNYRGSFNPSASGSVYYIYPN

SEQ ID NO: 1013 - DNA, 1194 bp, Streptococcus pyogenes
atgaaaaaaagaattttatcagcagttcttgtaagtggtgttaccctcggagcagctacaactgtaggagcggaggatttaagtactaagattgctaagcaagattctattatctcaaatctgactacagagcaaaaagctgcacagaatcaagtttcagcgttacaggctcaagtaagttcactacaatctgaacaagataaactgaccgcaagaaatacagaacttgaggcgctttcaaagcgatttgagcaagaaattaaggctctaacaagtcaaattgttgctcgtaatgaaaaattaaaaaatcaagctcgtagtgcttataaaaacaatgaaacttctggttatattaatgcacttttgaattctaaatcaatttctgatgttgtaaaccgtttagtagcaattaatagagctgtctctgctaacgctaaattgttagaacaacaaaaagctgataaagtttcccttgaagaaaagcaagctgctaaccaaacagctattaataccattgccgctaatatggcaatggctgaagaaaaccaaaatacattacgtactcaacaagctaatttggtagctgcaactgcaaatttagctctccaattagcatctgctactgaagataaagctaatttggtagctcaaaaagaagctgcagaaaaagctgctgctgaagccttagcacaagaacaggctgctaaagttaaggcacaagaacaggctgcacaacaagcagcatctgttgaagcagcaaaatctgctattactccagcaccacaagctactccggcagcgcaaagtagtaatgctattgaaccagctgcactcacggctccggcagctccttctgcaggaccacaaacatcatatgattcttctaatacttatccagttggacaatgcacatggggagctaaatctttagctccttgggcaggaaataattggggaaatggtggtcaatgggcttatagtgctcaagcagctggttatcgtactggttcaacgccgatggtaggtgcgattgccgtttggaacgatggtggttatggacatgtcgccgttgtagttgaggttcaaagtgcctcaagtattcgtgtgatggagtctaactacagtggtagacagtacattgctgaccaccgtggctggtttaatccaacaggtgttacatttatttatccacac

SEQ ID NO: 1014 - protein, 398 aa, Streptococcus pyogenes
MKKRILSAVLVSGVTLGAATTVGAEDLSTKIAKQDSIISNLTTEQKAAQNQVSALQAQVSSLQSEQDKLTARNTELEALSKRFEQEIKALTSQIVARNEKLKNQARSAYKNNETSGYINALLNSKSISDVVNRLVAINRAVSANAKLLEQQKADKVSLEEKQAANQTAINTIAANMAMAEENQNTLRTQQANLVAATANLALQLASATEDKANLVAQKEAAEKAAAEALAQEQAAKVKAQEQAAQQAASVEAAKSAITPAPQATPAAQSSNAIEPAALTAPAAPSAGPQTSYDSSNTYPVGQCTWGAKSLAPWAGNNWGNGGQWAYSAQAAGYRTGSTPMVGAIAVWNDGGYGHVAVVVEVQSASSIRVMESNYSGRQYIADHRGWFNPTGVTFIYPH

SEQ ID NO: 1015 - DNA, 228 bp, Streptococcus agalactiae
ttgattactgaatcagtagcagcaattttcgagtcaaagtcatcagcgtttactgttacggcagcagttccaagagttactccactcacaaggactgctgataatattctttttttcatttttattaaactactcctttacgataagacattaaatattttaccaaaaaattcacgaaattatattacgtcattgttacatttatatttgaaatcaactatttctaaa

SEQ ID NO: 1016 - protein, 76 aa, Streptococcus agalactiae
MITESVAAIFESKSSAFTVTAAVPRVTPLTRTADNILFFIFIKLLLYDKTLNILPKNSRNYITSLLHLYLKSTISK

SEQ ID NO: 1017 - DNA, 102 bp, Streptococcus agalactiae
atgggcacgagtggactcgaaccaccgacctcacgcttatcaggcgtgcgctctaaccacctgagctacgcgcccaagcaaatgcttggttttacttttatg

SEQ ID NO: 1018 - protein, 34 aa, Streptococcus agalactiae
MGTSGLEPPTSRLSGVRSNHLSYAPKQMLGFTFM

SEQ ID NO: 1019 - DNA, 1212 bp, Streptococcus agalactiae
ttggaggcttttcctaaaatggcaaaagaaaaatacgatcgtagtaaaccacacgttaacattggtacaatcggacacgttgaccacggtaaaactactttaacagcagctatcacaactgtattggcacgtcgcttgcctacttcagttaaccaaccaaaagattacgcttctatcgatgctgctccagaagagcgcgaacgcggaatcacaatcaacactgcacacgttgagtacgaaactgaaaaacgtcactatgcccacatcgacgctccaggacacgcggactacgttaaaaacatgatcactggtgctgctcaaatggacggagctatccttgtagttgcttcaactgatggaccaatgccacaaactcgtgagcacatccttctttcacgtcaagttggtgttaaacaccttatcgtattcatgaacaaagttgaccttgttgatgatgaagaattgcttgaattggttgaaatggaaattcgtgaccttctttcagaatacgacttcccaggtgatgaccttccagttatccaaggttcagctcttaaagcacttgaaggcgacgaaaaatacgaagacatcatcatggaattgatgagcactgttgatgagtacattccagaaccagaacgtgatactgacaaacctttacttcttccagttgaagatgtattctcaatcactggacgtggtacagttgcttcaggacgtatcgaccgtggtactgttcgtgtcaacgacgaagttgaaatcgttggtattaaagaagatatccaaaaagcagttgttactggtgttgaaatgttccgtaaacaacttgacgaaggtcttgcaggggacaacgttggtgttcttcttcgtggtgttcaacgtgatgaaatcgaacgtggtcaagttcttgctaaaccaggttcaatcaacccacacactagatttaaaggtgaagtttacatcctttctaaagaagaaggtggacgtcatactccattcttcaacaactaccgtccacaattctacttccgtacaactgacgtaacaggttcaatcgaacttccagcaggaacagaaatggttatgcctggtgataacgttactatcgaagttgaattgattcacccaatcgccgtagaacaaggtactactttctcaatccgtgaaggtggacgtactgttggttcaggtatcgtttcagaaatcgaagct

SEQ ID NO: 1020 - protein, 404 aa, Streptococcus agalactiae
MEAFPKMAKEKYDRSKPHVNIGTIGHVDHGKTTLTAAITTVLARRLPTSVNQPKDYASIDAAPEERERGITINTAHVEYETEKRHYAHIDAPGHADYVKNMITGAAQMDGAILVVASTDGPMPQTREHILLSRQVGVKHLIVFMNKVDLVDDEELLELVEMEIRDLLSEYDFPGDDLPVIQGSALKALEGDEKYEDIIMELMSTVDEYIPEPERDTDKPLLLPVEDVFSITGRGTVASGRIDRGTVRVNDEVEIVGIKEDIQKAVVTGVEMFRKQLDEGLAGDNVGVLLRGVQRDEIERGQVLAKPGSINPHTRFKGEVYILSKEEGGRHTPFFNNYRPQFYFRTTDVTGSIELPAGTEMVMPGDNVTIEVELIHPIAVEQGTTFSIREGGRTVGSGIVSEIEA

SEQ ID NO: 1021 - DNA, 1245 bp, Streptococcus pyogenes
atggcctaccgtctatctataaaatatattttattggaggcttttcctaaaatggcaaaagaaaaatacgatcgtagtaaaccccacgttaacattggtacaatcggacacgttgaccatggtaaaactactttaacagctgcaatcacaactgtattggcacgtcgcttgccttcatcagttaaccaaccaaaagattacgcttctatcgatgctgctccagaagaacgcgaacgcggaatcactatcaacactgcacacgttgagtacgaaactgcaactcgtcactatgcgcacatcgacgctccaggacacgcggactacgttaaaaacatgatcactggtgccgctcaaatggacggagctatccttgtagttgcttcaactgatggaccaatgccacaaactcgtgagcacatccttctttcacgtcaggttggtgttaaacaccttatcgtgttcatgaacaaagttgaccttgttgatgacgaagagttgcttgaattagttgagatggaaattcgtgaccttctttcagaatacgatttcccaggtgatgaccttccagttatccaaggttcagctcttaaagctcttgaaggcgacactaaatttgaagacatcatcatggaattgatggatactgttgattcatacattccagaaccagaacgcgacactgacaaaccattgcttcttccagtcgaagacgtattctcaattacaggtcgtggtacagttgcttcaggacgtatcgaccgtggtactgttcgtgtcaacgacgaaatcgaaatcgttggtatcaaagaagaaactaaaaaagctgttgttactggtgttgaaatgttccgtaaacaacttgacgaaggtcttgcaggagacaacgtaggtatccttcttcgtggtgttcaacgtgacgaaatcgaacgtggtcaagttattgctaaaccaagttcaatcaacccacacactaaattcaaaggtgaagtatatatcctttctaaagacgaaggtggacgtcacactccattcttcaacaactaccgtccacaattctacttccgtacaactgacgtaacaggttcaatcgaacttccagcaggtacagaaatggttatgcctggtgataacgtgacaatcaacgttgagttgatccacccaatcgccgtagaacaaggtactactttctcaatccgtgaaggtggacgtactgttggttcaggtatcgtttcagaaatcgaagct

SEQ ID NO: 1022 - protein, 415 aa, Streptococcus pyogenes
MAYRLSIKYILLEAFPKMAKEKYDRSKPHVNIGTIGHVDHGKTTLTAAITTVLARRLPSSVNQPKDYASIDAAPEERERGITINTAHVEYETATRHYAHIDAPGHADYVKNMITGAAQMDGAILVVASTDGPMPQTREHILLSRQVGVKHLIVFMNKVDLVDDEELLELVEMEIRDLLSEYDFPGDDLPVIQGSALKALEGDTKFEDIIMELMDTVDSYIPEPERDTDKPLLLPVEDVFSITGRGTVASGRIDRGTVRVNDEIEIVGIKEETKKAVVTGVEMFRKQLDEGLAGDNVGILLRGVQRDEIERGQVIAKPSSINPHTKFKGEVYILSKDEGGRHTPFFNNYRPQFYFRTTDVTGSIELPAGTEMVMPGDNVTINVELIHPIAVEQGTTFSIREGGRTVGSGIVSEIEA

SEQ ID NO: 1023 - DNA, 486 bp, Streptococcus agalactiae
ttggatgattatttaaaggcatcaaggttgattattttttcatttttttcttgtggcttatattgctcttctgcttctttcattatgagttcctttttctcgttagcatcaatattaagcacgaatccgatcgctacagaaagtaccaagaggctgttccctccttgggataagaaaggaaatgtcactccagttgaggggattaacccagaaataccaccaatgttaacaaaaacttgcatcaatagcattgctccaataccaagagcgatcattgagttgaaaggatctttagcctttatacctacgtgcataatacgtaaaattaagaagaaaaccaaagctaaaataaaccctgcaccaataactcctaattcctcaataacaattgaaaagacaaagtctgttgttgcttctggtaagtaccctaatttttcaatagaattcccaagtcctcgaccaaaccagccaccgttgctcattgca

SEQ ID NO: 1024 - protein, 162 aa, Streptococcus agalactiae
MDDYLKASRLIIFSFFSCGLYCSSASFIMSSFFSLASILSTNPIATESTKRLFPPWDKKGNVTPVEGINPEIPPMLTKTCINSIAPIPRAIIELKGSLAFIPTCIIRKIKKKTKAKINPAPITPNSSITIEKTKSVVASGKYPNFSIEFPSPRPNQPPLLIA

SEQ ID NO: 1025 - DNA, 492 bp, Streptococcus agalactiae
ttggctaattcktwttatgcaatgagcaacggtggctggtttggtcgaggacttgggaattctattgaaaaattagggtacttaccagaagcaacaacagactttgtcttttcaattgttattgaggaattaggagttattggtgcagggtttattttagctttggttttcttcttaattttacgtattatgcacgtaggtataaaggctaaagatcctttcaactcaatgatcgctcttggtattggagcaatgctattgatgcaagtttttgttaacattggtggtatttctgggttaatcccctcaactggagtgacatttcctttcttatcccaaggagggaacagcctcttggtactttctgtagcgatcggattcgtgcttaatattgatgctaacgagaaaaaggaactcataatgaaagaagcagaagagcaatataagccacaagaaaaaaatgaaaaaataatcaaccttgatgcctttaaa

SEQ ID NO: 1026 - protein, 164 aa, Streptococcus agalactiae
  MISC_FEATURE (1)..(164): Xaa = Any Amino Acid
MANSXYAMSNGGWFGRGLGNSIEKLGYLPEATTDFVFSIVIEELGVIGAGFILALVFFLILRIMHVGIKAKDPFNSMIALGIGAMLLMQVFVNIGGISGLIPSTGVTFPFLSQGGNSLLVLSVAIGFVLNIDANEKKELIMKEAEEQYKPQEKNEKIINLDAFK

SEQ ID NO: 1027 - DNA, 1302 bp, Streptococcus pyogenes
atgattatctcaagaagtagagggaaaactatgaagattgataaaaggcacctcttaaattattctatattattgccttatttaattttatcggtgataggcttaataatggtttactcaaccacaagtgtcagcttgattcaagcacatgctaatccatttaaatcggtgattaaccagggagttttttggataataagtctagtggctattacatttatctataaattaaaattaaattttttaacgaatacaagggtattaactgtggttatgttaggagaggcctttcttttaatcattgcccgcttctttacaactgctatcaaaggagcgcatggttggattgtgatcggaccagtcagctttcagcctgctgagtatttaaagatcattatggtatggtatttggcattgacctttgctaagatccaaaaaaacattagcctttatgattatcaagcactaactcgtcgaaaatggtggccaacacaatggaacgatttacgggactggcgtgtttattctttgttgatggtacttttggttgctgctcagcctgacttgggaaatgcttccattattgtattgacagccattattatgttttctatcagtggcattggttaccgatggttttcggctatcctagtcatgattaccggtctatccacggtctttcttgggactattgccgttattggggtagaaagagttgctaagattcctgtttttggctatgtcgctaaacgttttagtgccttttttaatccttttcatgacttgaccgattcaggtcaccaattagccaattcttactatgctatgagtaatggtgggtggtttggccaagggttaggaaattccattgaaaagcgtggctatttgcccgaagcacagacagactttgtcttttcagttgtcattgaagagttaggtctaataggagcagggtttattttggcacttgttttcttcttaattttacgtattatgaatgttggtattaaagcaaaaaatccttttaatgccatgatggctttaggagtaggcggtatgatgctcatgcaagtctttgttaatattggtggtatctcaggcttaattccatctactggtgttaccttcccttttttgtctcaaggtggaaatagcttacttgtcttatctgttgcagtgggttttgtactaaatattgatgctagcgaaaagcgagatgatatatttaaagaagctgaattatcttatcgaaaggacactcgaaaagaaaatagtaaagttgtaaatatcaagcaatttcaa

SEQ ID NO: 1028 - protein, 434 aa, Streptococcus pyogenes
MIISRSRGKTMKIDKRHLLNYSILLPYLILSVIGLIMVYSTTSVSLIQAHANPFKSVINQGVFWIISLVAITFIYKLKLNFLTNTRVLTVVMLGEAFLLIIARFFTTAIKGAHGWIVIGPVSFQPAEYLKIIMVWYLALTFAKIQKNISLYDYQALTRRKWWPTQWNDLRDWRVYSLLMVLLVAAQPDLGNASIIVLTAIIMFSISGIGYRWFSAILVMITGLSTVFLGTIAVIGVERVAKIPVFGYVAKRFSAFFNPFHDLTDSGHQLANSYYAMSNGGWFGQGLGNSIEKRGYLPEAQTDFVFSVVIEELGLIGAGFILALVFFLILRIMNVGIKAKNPFNAMMALGVGGMMLMQVFVNIGGISGLIPSTGVTFPFLSQGGNSLLVLSVAVGFVLNIDASEKRDDIFKEAELSYRKDTRKENSKVVNIKQFQ

SEQ ID NO: 1029 - DNA, 654 bp, Streptococcus agalactiae
  misc_feature (1)..(654): n = a, c, g, or t
atgaaaattgataaaaggcatcttctgaattattccatcctcattccctatttgatattgtctattctaggcttaattgtaatttattcgacaactagtgcaactctaattcagcttggagctaacccttttcgttcagtaatcaaccagggtgtcttttgggcagtcagtttggttgcaattatctttatctataaactgaaactaaattttttgaaaaattctaaagtgttgactatggcagtattggtagaagtatttttactactaatagcgcgcttttttacacaagaagttaatggagcacatggttggattgttattggtcctattagttttcaacctgctgaatatttaaaagttatcattgtatggtatttagcgtttacttttgctcgaaggcaaaaaaagatagaaatatatgattatcaagctttgacaaaagggagatggcttccgagatcactaagcgacctaaaagattggcgattttattctttatttatgattggtttggtaattgcacaacctgatttaggaaatggttcgataattgttctaacggtcattattatgtactgtattagtggtattggttatcgatggttttcagctttacttggtctaatcgtcgtggggtcaactttannnnnt

SEQ ID NO: 1030 - protein, 218 aa, Streptococcus agalactiae
  MISC_FEATURE (1)..(218): Xaa = Any Amino Acid
MKIDKRHLLNYSILIPYLILSILGLIVIYSTTSATLIQLGANPFRSVINQGVFWAVSLVAIIFIYKLKLNFLKNSKVLTMAVLVEVFLLLIARFFTQEVNGAHGWIVIGPISFQPAEYLKVIIVWYLAFTFARRQKKIEIYDYQALTKGRWLPRSLSDLKDWRFYSLFMIGLVIAQPDLGNGSIIVLTVIIMYCISGIGYRWFSALLGLIVVGSTLXX

SEQ ID NO: 1031 - DNA, 171 bp, Streptococcus agalactiae
ttggagaaagaggctaagcagatcattgatttaaaaaggaatcttttcaaaattgatgtccgggcacaaaaggatgaagagaaagttttcatgcgtacggcgtgttgctattctcccttttactttacttcgaaagatgatataatgcataatggtaattttttgatatat

SEQ ID NO: 1032 - protein, 57 aa, Streptococcus agalactiae
MEKEAKQIIDLKRNLFKIDVRAQKDEEKVFMRTACCYSPFYFTSKDDIMHNGNFLIY

SEQ ID NO: 1033 - DNA, 204 bp, Streptococcus pyogenes
ttggagaaagaggctaagcagatgattgatttaaaaaggaatcttttcaaaattgatgtccgggcacaaaaggatgaagagaaagttttcatgcgtacggcgtgtagacaatctagggtttacttgctatttcatcttgtttatggtatcatttcacaggctaagggtgcttcatggataacaacgagattttgtattcctaaa

SEQ ID NO: 1034 - protein, 68 aa, Streptococcus pyogenes
LEKEAKQMIDLKRNLFKIDVRAQKDEEKVFMRTACRQSRVYLLFHLVYGIISQAKGASWITTRFCIPK

SEQ ID NO: 1035 - DNA, 1140 bp, Streptococcus agalactiae
gtgactacgatgattgattttattatttctattgatgattgcgcagttgaattggatagtcgtcaatcttggaaaattcgctaccccttatcaaccattctatttcttgtctttgtttgtcagttagctggcattgaaacctggaaggagatggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccattcctcagttattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaatcatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggc

SEQ ID NO: 1036 - protein, 380 aa, Streptococcus agalactiae; identical to SEQ ID NO: 502

SEQ ID NO: 1037 - DNA, 2820 bp, Streptococcus agalactiae
gtgagatttaagagaggaagtgatggtttgtcccacccgaaattagaaagtagtagcaataaagaaatcattaccgaagaggtcggtttactgaagcagcttttggatgaagcaacgcaaaaattgattggtagtgaatcatttgacaagattgaaaaaatagtttcattatcattaactgacgattatactggtctgaaggaaactatttcggctttaagcaacgaggagatggttattgtttctcgttacttctctattttgccgctcttaattaatatttcagaagacgttgatttagcatatgaaattaattataaaaataatcttaaccaagattacctaggaaagttatcaacgactattgatgttgtagctggccatgaaaatgctaaagatattcttgaacacgtcaatgttgtgcctgtgctaacagctcatcctactcaggtgcagcgtaaaacggtgctcgaattaacgtctaagattcatgatttattacgtaaatacagagatgtcaaggcaggaatcgtgaatcaagaaaaatggtatgctgacttgcgtcgttacatcggcattatcatgcaaacagacactattcgcgagaaaaaattgaaagtcaaaaatgagataaccaatgtaatggaatattacaaccgttctcttattaaagcagttaccaaattaacagcagaatataaggcactggcagctaaaaaaggtattcacttggagaatcctaagcctctgactatggggatgtggattggtggtgatagagatggcaatccctttgtaactgctgagacactaagattatcagctatggtacaaagtgaagtgattattaaccattatattgagcagctaaatgaactttatcgtaatatgtcactttcaataaatctaactgaagtctctcccgaacttgttacattggcaaaccagtcacaagataattcggtatatagggaaaatgaaccttaccgtaaagctttcaattttatccaagataaactggtacaaaccctactaaatttaaaagttggttcttccccaaaagagaaatttgttagtcgccaagaatcttctgatattgtaggaaggtatataaaatcacatatcgctcaagtagcttctgacatacagacagaagaactaccagcatacgctactgctgaggagtttaaacaagatttgttacttgtgaagcaatctttagttcaatatggacaagattctcttgttgatggcgaattagcttgtcttattcaagcagtagatatctttggattttatttagctactattgatatgcgtcaagattctagtattaatgaagcttgtgtagcagaattattgaagtctgccaatattgtagatgattacagttctctttcagaagaagaaaaatgtcaacttctcttaaaagaattaacagaagatcctagaacattatcttctacgcatgctcctaaatccgagttacttcaaaaagaattggctattttccaaacagcacgtgagttaaaagatcaattgggtgaagacattataaaccagcatatcatttctcacacagagagcgtttcggatatgtttgagttagctatcatgttaaaagaagttggactaattgatgccaatcaagctcgtattcagattgtaccgttatttgaaaccatcgaagatttggataattcacgtgatattatgacccagtatctacattatgaattagttaaaaaatggattgctactaacaacaattatcaagaaataatgctaggttattcagatagtaataaagatggtggctatttatcatctggttggactctatataaagctcaaaatgagctaacaaaaataggtgaagaaaacggtattaaaatcacatttttccacggtcgtggtggaactgttggtcgtggtggtggtccatcttatgaagctatcacatcacaaccttttggttcaatcaaagatcgaattcgcctaacagagcaaggtgaaatcattgagaataaatatggtaatcaagatgcagcctattataaccttgaaatgcttatttcagcttccatagaccgcatggtaacacgtatgattactaaccctaatgaaattgataatttccgtgagacaatggatggtattgtgtctgaaagtaatgccgtttatagaaatttagtttttgataatccttatttctatgactatttctttgaagcaagtccaattaaagaggtatcaagtttaaatattggttctcggccagcagcacgtaaaacaattacagaaatttcaggtttacgtgcaattccatgggtattttcatggtcacaaaatcgtattatgtttccaggatggtatggtgttggatcagccttcaagcactttattgaacaagatgaggcaaacttagcaaaattacaaaccatgtatcaaaaatggccattctttaattctcttttatctaatgtagatatggttttatcaaaatcaaatatgaatattgcgcttcagtatgctcagttagctggaagtaaagaagttcgagatgtttttaatatcatccttaatgaatggcagttaactaaagatatgattttagctattgaacagcatgataatttattagaagaaaacccaatgttacatgcaagtttagattatcgtttgccatatttcaatgttttgaattatgttcaaattgaattgattaaacgtcttcgtagtaaccaactagatgaagactatgagaagttgattcatattactattaatggtattgcaacaggtttacgaaattcaggt

SEQ ID NO: 1038 - protein, 940 aa, Streptococcus agalactiae
MRFKRGSDGLSHPKLESSSNKEIITEEVGLLKQLLDEATQKLIGSESFDKIEKIVSLSLTDDYTGLKETISALSNEEMVIVSRYFSILPLLINISEDVDLAYEINYKNNLNQDYLGKLSTTIDVVAGHENAKDILEHVNVVPVLTAHPTQVQRKTVLELTSKIHDLLRKYRDVKAGIVNQEKWYADLRRYIGIIMQTDTIREKKLKVKNEITNVMEYYNRSLIKAVTKLTAEYKALAAKKGIHLENPKPLTMGMWIGGDRDGNPFVTAETLRLSAMVQSEVIINHYIEQLNELYRNMSLSINLTEVSPELVTLANQSQDNSVYRENEPYRKAFNFIQDKLVQTLLNLKVGSSPKEKFVSRQESSDIVGRYIKSHIAQVASDIQTEELPAYATAEEFKQDLLLVKQSLVQYGQDSLVDGELACLIQAVDIFGFYLATIDMRQDSSINEACVAELLKSANIVDDYSSLSEEEKCQLLLKELTEDPRTLSSTHAPKSELLQKELAIFQTARELKDQLGEDIINQHIISHTESVSDMFELAIMLKEVGLIDANQARIQIVPLFETIEDLDNSRDIMTQYLHYELVKKWIATNNNYQEIMLGYSDSNKDGGYLSSGWTLYKAQNELTKIGEENGIKITFFHGRGGTVGRGGGPSYEAITSQPFGSIKDRIRLTEQGEIIENKYGNQDAAYYNLEMLISASIDRMVTRMITNPNEIDNFRETMDGIVSESNAVYRNLVFDNPYFYDYFFEASPIKEVSSLNIGSRPAARKTITEISGLRAIPWVFSWSQNRIMFPGWYGVGSAFKHFIEQDEANLAKLQTMYQKWPFFNSLLSNVDMVLSKSNMNIALQYAQLAGSKEVRDVFNIILNEWQLTKDMILAIEQHDNLLEENPMLHASLDYRLPYFNVLNYVQIELIKRLRSNQLDEDYEKLIHITINGIATGLRNSG

SEQ ID NO: 1039 - DNA, 2760 bp, Streptococcus pyogenes
ttgccacttaaaaagttagagagtagtaacaatcaagatatcattgctgaagaagttgctcttttgaaagaaatgttggaaaatatcacacgacggatgattggagatgatgcgtttacagttatcgagtctattatggtgttatctgaaaaacaagattacatagaattagaaaaagttgtcgccaatatttcaaatcaagaaatggaagtgatttccaggtatttttctattttacccttgctaatcaatatttcagaagatgtcgatttagcctatgaaatcaattatcaaaataatacggatactgattatttaggaaaattagccctaaccatcaaggatcttgctggaaaagataatggtaaagacattttggagcaggttaatgtggttcctgttttaacagcacatccgacgcaagtacaacgtaaaacgattctggaattgacaactcacattcataaacttctgcgcaaataccgtgatgctaaggctggtgtgattaatcttgagaaatggcgtcaggagctatatcgttatattgaaatgatcatgcagacagatattattcgcgagaaaaagcttcaggtgaaaaacgagataaaaaatgtcatgcagtattacgatggttctctcattcaagcagtgaccaagttgacaacagagtacaaaaacttagcccaaaaacacggtctagagttagacaatcccaaacccattaccatggggatgtggattggtggggaccgtgatgggaacccctttgtcacagctgaaaccttgtgcttgtcagctacggttcaaagtgaggttatcctcaattactacattgacgaattagcagccctttaccgaacattttcactgtcgtcaaccttggtacaacccaactcggaagtggaacgtttagccagtttgtctcaggaccaatcgatttaccgtggaaatgaaccttatcgcagagcttttcattatattcaatcgcgtcttaaacaaacacaaattcaactaactaatcagccagcagctagtatgagtagtagtgtgggactaaacacatctgcttggtcctcaccagctagtttagaaaatcccatcttagcctatgactctcctgttgattttaaagctgatttaaaggctattgagcagtcgctacttgataatggcaactccgctttgattgagggggatttgcgagaagtcatgcaagctgttgatatttttggcttcttcttagcaagcattgacatgaggcaagactccagtgtccaagaagcttgtgtggcagagttattaaaaggagccaatattgttgacgattatagctctctttcagaaactgaaaaatgcgatgttctcttacaacaattaatggaggagccaaggactttatcctcagcggcagttgctaaatcagacctattggaaaaagaactggctatctatactacggcacgagaattgaaagataagcttggagaagaggttattaaacaacatattatttcacatacagaaagtgtctctgatatgtttgagttggccatcatgcttaaagaagtgggattggttgaccagcagcgggctcgtgtgcaaattgttcccctctttgaaaccattgaggatttagataatgcccgtgacatcatggcagcctatttaagccatgacattgtcaaatcttggattgcaacgaatcgtaattaccaagaaatcatgttaggttattctgacagtaataaagatggtggctacttggcatcgggttggactctttataaagctcagaatgaattaacggctattggtgaggaacatggagtgaagatcaccttcttccatggtcgtggaggaacagttggtcgaggaggtggcccttcttatgatgccattacttcacaaccttttggttccatcaaagatcggattcgtctgacagagcaaggggaaattattgaaaacaaatacggcaataaagatgtggcttattaccatttagaaatgttgatttcagcttctatcaatcgtatggtgactcaaatgataacagatcctaatgagattgatagttttcgagaaatcatggatagcattgttgctgatagcaatatcatttatcgaaaattggtttttgacaatccccatttctatgattatttctttgaggcaagtccgattaaggaagtttccagtctcaacattgggtcaagaccagcggcccgtaaaacgattacggaaattacaggcttgcgtgccattccttgggtcttttcatggtcacaaaatcgcatcatgtttccaggttggtatggggtaggttcagcctttaaacgttatattgaccgagcacaaggtaaccttgaacgcctccaacatatgtatcagacgtggccttttttccattccttgttatcaaatgttgatatggtattatctaaatcaaacatgaatattgcctttcagtatgcacaactagctgaaaggcaggatgttcgagatgttttttatgagattttggatgagtggcaattgacaaaaaatgttattcttgctatccaagaccatgatgatctattggaggataatccttcccttaagcatagcttgaaatcacgcttgccgtattttaatgtgttgaactatattcaaattgaattgattaaacgttggcgtaataatcaacttgacgaaaatgatgaaaaattgatccatacaactatcaatggcatagcgactggtttacgtaattcaggc

SEQ ID NO: 1040 - protein, 920 aa, Streptococcus pyogenes
LPLKKLESSNNQDIIAEEVALLKEMLENITRRMIGDDAFTVIESIMVLSEKQDYIELEKVVANISNQEMEVISRYFSILPLLINISEDVDLAYEINYQNNTDTDYLGKLALTIKDLAGKDNGKDILEQVNVVPVLTAHPTQVQRKTILELTTHIHKLLRKYRDAKAGVINLEKWRQELYRYIEMIMQTDIIREKKLQVKNEIKNVMQYYDGSLIQAVTKLTTEYKNLAQKHGLELDNPKPITMGMWIGGDRDGNPFVTAETLCLSATVQSEVILNYYIDELAALYRTFSLSSTLVQPNSEVERLASLSQDQSIYRGNEPYRRAFHYIQSRLKQTQIQLTNQPAASMSSSVGLNTSAWSSPASLENPILAYDSPVDFKADLKAIEQSLLDNGNSALIEGDLREVMQAVDIFGFFLASIDMRQDSSVQEACVAELLKGANIVDDYSSLSETEKCDVLLQQLMEEPRTLSSAAVAKSDLLEKELAIYTTARELKDKLGEEVIKQHIISHTESVSDMFELAIMLKEVGLVDQQRARVQIVPLFETIEDLDNARDIMAAYLSHDIVKSWIATNRNYQEIMLGYSDSNKDGGYLASGWTLYKAQNELTAIGEEHGVKITFFHGRGGTVGRGGGPSYDAITSQPFGSIKDRIRLTEQGEIIENKYGNKDVAYYHLEMLISASINRMVTQMITDPNEIDSFREIMDSIVADSNIIYRKLVFDNPHFYDYFFEASPIKEVSSLNIGSRPAARKTITEITGLRAIPWVFSWSQNRIMFPGWYGVGSAFKRYIDRAQGNLERLQHMYQTWPFFHSLLSNVDMVLSKSNMNIAFQYAQLAERQDVRDVFYEILDEWQLTKNVILAIQDHDDLLEDNPSLKHSLKSRLPYFNVLNYIQIELIKRWRNNQLDENDEKLIHTTINGIATGLRNSG

SEQ ID NO: 1041 - DNA, 1797 bp, Streptococcus agalactiae
atgaaacttaaaaaacgctctgaattccctgaaaatgaactttgggatctgactgctctctacaaagatcgtcaagattttttactggctattgaaaaagctcttgaggatatcaaggttttcaaaaaaaattacgagggaaaacttaattgtgttgaggattttactagtgcccttatggaaatcgagcatatttatatccagatgagtcacattgatacgtatgcttttatgcctcaaactactgactttagcaacgaagagtttgcacaaatttctcaagcaggatcagacttcgcaactaaagctaatgtactactttctttctttaatactgccctagcaaatgcagatataaagattttagattctttagaaaataaccctcatttcaaagcaactattcgccaagctaaaattcaaaagcaacacttattaagtccagaagtcgaaaaagctttgacaaacttaaatgaagtcctaaatacaccatatgatatttatactaaaatgcgtgctggcgattttgatatggaagattttgaagttgacggaaaaacctacaaaaatagttttgtaacttatgaaaattactttcaaaatcacgaaaatgcagagatacgtgaaaaatccttccgttcattctcgaaaggtctacgtaagcaccaaaatgctgcagctgcggcttatcttgcaaaagtcaaatctgaaaagttaattgctgatatgcgtggttacgatagtgtttttgattatcttctttccgaacaagaagttgaccgttcaatgtttgacagacaaattgatcttatcatggatgaatttggtccagtagctcaacgattcctcaaacatatcgccgatgttaatggtattgaaaagatgacttttgcagattggaaattagacattgataacgaacttaatcccgaagtaagtatcaatgatgcttatgacttagtaatgaaatcagttgctcctttaggaaaagaatattctcaagaggttgagcgctatcaaaaagagcgttgggttgattttgcagctaacgctaataaagattctggaggatatgctgcggatccttacaaagttcatccctatgtactcatgagctggacggggcgtatgagcgatgtctacacacttattcatgagattggacattctggtcaatttatcttctcagataatcaccaaagttttttcaatactcacatgtccacttactatgttgaagctccatctacttttaacgaacttttacttagtgactacttagaaaaccaatttgatacagcacgtcaaaaacgctttgctcttgcacatcgcttaactgatacttacttccacaatttcattactcacttacttgaagctgctttccaacgtaaagtttacactctaattgaggagggaggaacttttggagcagaacaattaaatgctattatgaaggaagtattaacacaattctggggagatgctattgaaatagatgacgatgccgctttgacatggatgagacaagctcattactacatggggctctatagctatacttactctgctggattagtaatctcgacagccggctatctcaatctcaaaaataatccaaacggagcaaaagagtggttagcattcttgaaatctggtgggagccgtacccctttagaaacagctctattaatcagtgctgatatttctactgataagcctctgcgcgatactattaatttcttatctaacactgtagaccaaattattaattacagtaatcttattgagcaaggc

SEQ ID NO: 1042 - protein, 599 aa, Streptococcus agalactiae
MKLKKRSEFPENELWDLTALYKDRQDFLLAIEKALEDIKVFKKNYEGKLNCVEDFTSALMEIEHIYIQMSHIDTYAFMPQTTDFSNEEFAQISQAGSDFATKANVLLSFFNTALANADIKILDSLENNPHFKATIRQAKIQKQHLLSPEVEKALTNLNEVLNTPYDIYTKMRAGDFDMEDFEVDGKTYKNSFVTYENYFQNHENAEIREKSFRSFSKGLRKHQNAAAAAYLAKVKSEKLIADMRGYDSVFDYLLSEQEVDRSMFDRQIDLIMDEFGPVAQRFLKHIADVNGIEKMTFADWKLDIDNELNPEVSINDAYDLVMKSVAPLGKEYSQEVERYQKERWVDFAANANKDSGGYAADPYKVHPYVLMSWTGRMSDVYTLIHEIGHSGQFIFSDNHQSFFNTHMSTYYVEAPSTFNELLLSDYLENQFDTARQKRFALAHRLTDTYFHNFITHLLEAAFQRKVYTLIEEGGTFGAEQLNAIMKEVLTQFWGDAIEIDDDAALTWMRQAHYYMGLYSYTYSAGLVISTAGYLNLKNNPNGAKEWLAFLKSGGSRTPLETALLISADISTDKPLRDTINFLSNTVDQIINYSNLIEQG

SEQ ID NO: 1043 - DNA, 1872 bp, Streptococcus pyogenes
ttggataggtttagtctccatattccactaaaattctgttatactagtcttgactatattgttaaggagacaactatggaattgaaaaaacgttcagaattccctgaaaatgaactttgggatctaacagcgctctacaaagaccgccaagattttttactcgctattgaaaaagccttacaagatattgacctgtttaagcgcaattatgaaggccgcttaacgtcggtggacgatttcactcaggccttaatagaaattgagcatatttatattcaaatgagtcatattggcacttatgcctttatgcctcaaaccactgacttttcagatgaaagttttgctcaaattgctcaggctggcgatgatttcatgactaaagctagcgttgcccttagcttctttgacaccgccttagccaatgccgaccttgacgtgttagatacattagaaaagaacccttatttcagcgcagctattcgcatggcaaaaattcaaaaagaacacctcttaagtcctgatgtggaaaaagctttggctaacttacgcgaggttatcaatgcgccctatgatatttacaccaaaatgcgggctggtgactttgacatggatgattttgaggtggatggtaaaacctataaaaatagctttgtttcttacgaaaatttctatcaaaatcacgaaaatgctgagattcgtgaaaaagccttccgctctttttcaaaaggtctccgtaaacaccaaaatacagctgcagcggcttacttagccaaggttaaatctgaaaaattgttagcggatatgaaaggctacgcttctgtctttgattacctcctagctgaacaggaagtggatcgtagcttgttcgaccgccaaattgacctcatcatgactgaatttggaccggttgctcagaaattcttaaaacatgtcgcccaagtcaatggtcttgagaaaatgacttttgctgactggaagctagatattgacaatgatctcaatccagaggtcagcattgatggtgcctatgacctcgtgatgaaatctctagccccattagggcaagaatacacgaaagaaatcgaacgttatcagacagaacgctgggttgactttgctgctaacgccaataaggattctggtggttatgccgctgatccctacaaggttcatccgtatgtcttaatgagttggactggaagaatgtctgatgtttatacccttattcatgaaatcggtcactctggccaattcattttttcagataatcaccaaagttacttcaacacccatatgtcaacttattacgtcgaagcgccatcgacctttaatgaattgatgcttagtgattacttggaacatcagtttgatgaccctcgtcaaaaacgttttgcccttgctcaccgtttaacagatacttactttcataacttcatcactcacctattggaagcggctttccaacgtaaggtttacacccttattgaagaaggcggtacctttggagctgaccaattaaatgcgatgatgaaagaggtcttaacagacttctggggagatgccgttgacattgacgatgacgcagctcttacctggatgcgccaagcacattactacatgggcttatatagttatacctattctgctgggcttgttatttcaacagctggttacctcaaccttaaacataatccaaatggtgccaaggagtggcttgacttcctaaaatcaggtggcagccgtacgcctcttgatactgcaatgctcattggggcagacattgccactgaaaagcctcttcgagataccattcaattcttgagtgataccgttgaccaaattatcagttacaccgaggatatgtcacatgcc

SEQ ID NO: 1044 - protein, 624 aa, Streptococcus pyogenes
LDRFSLHIPLKFCYTSLDYIVKETTMELKKRSEFPENELWDLTALYKDRQDFLLAIEKALQDIDLFKRNYEGRLTSVDDFTQALIEIEHIYIQMSHIGTYAFMPQTTDFSDESFAQIAQAGDDFMTKASVALSFFDTALANADLDVLDTLEKNPYFSAAIRMAKIQKEHLLSPDVEKALANLREVINAPYDIYTKMRAGDFDMDDFEVDGKTYKNSFVSYENFYQNHENAEIREKAFRSFSKGLRKHQNTAAAAYLAKVKSEKLLADMKGYASVFDYLLAEQEVDRSLFDRQIDLIMTEFGPVAQKFLKHVAQVNGLEKMTFADWKLDIDNDLNPEVSIDGAYDLVMKSLAPLGQEYTKEIERYQTERWVDFAANANKDSGGYAADPYKVHPYVLMSWTGRMSDVYTLIHEIGHSGQFIFSDNHQSYFNTHMSTYYVEAPSTFNELMLSDYLEHQFDDPRQKRFALAHRLTDTYFHNFITHLLEAAFQRKVYTLIEEGGTFGADQLNAMMKEVLTDFWGDAVDIDDDAALTWMRQAHYYMGLYSYTYSAGLVISTAGYLNLKHNPNGAKEWLDFLKSGGSRTPLDTAMLIGADIATEKPLRDTIQFLSDTVDQIISYTEDMSHA

SEQ ID NO: 1045 - DNA, 387 bp, Streptococcus agalactiae
atgaaaaaatacattaaattattcttgctaacagtattcgctacaactttagtagcttgcgggcaaccatctacatcgaataagacaacaactagctcaacgttagaagttggtaaggttgaattggtggttaaagaagatacgaacgtgttaagtgaaaaggttgtttaccataaaggtgatactgttttggatgtgcttaaagctaactataaagttaaagaaaaagatggtttcattacttcaattgatggcatcagccaagatgaaaccaaagggctttattggatgttcaaggtcaataataaattagctcctaaggcagcaaaccaaattaaagttaaaaagaatgacaaaattgaattttatcaggaagtttacaaaaaa

SEQ ID NO: 1046 - protein, 129 aa, Streptococcus agalactiae
MKKYIKLFLLTVFATTLVACGQPSTSNKTTTSSTLEVGKVELVVKEDTNVLSEKVVYHKGDTVLDVLKANYKVKEKDGFITSIDGISQDETKGLYWMFKVNNKLAPKAANQIKVKKNDKIEFYQEVYKK

SEQ ID NO: 1047 - DNA, 384 bp, Streptococcus pyogenes
gtgaacaaaagatttaaaacaggatttctagcgcttgttgctatgctacttgttgcttgctcgcaaggaacaaaacaaatacagacgactccaagcgttccaaaagcagaccatcacgttcgcttagttgtcaaagaagataccaatactgttgacgaaaaagtttcttttggaaaaggagatacggtgcttgaggttctcaaagataattatgaggttaaagaaaaagatggttttatcacagcaattgatggtatcgagcaagacacgaaagctaacaaatactggctttttaaggtgaatggaaagatggcagataagggtgccgatcaaattaccgttaaagatggtgatagcattgaattttatcaagaagtttttaat

SEQ ID NO: 1048 - protein, 128 aa, Streptococcus pyogenes
VNKRFKTGFLALVAMLLVACSQGTKQIQTTPSVPKADHHVRLVVKEDTNTVDEKVSFGKGDTVLEVLKDNYEVKEKDGFITAIDGIEQDTKANKYWLFKVNGKMADKGADQITVKDGDSIEFYQEVFN

SEQ ID NO: 1049 - DNA, 522 bp, Streptococcus agalactiae
atgataaagaattcaactttaactaaattgactagagtcgctatattatctgctttgtgtgttgtgttgagatatgcttttgcgcctctgcctaacattcagccaattactgccatttttttgattacagttgtcttattcgatttaaaagaaggtgtagctactgtaactataacaatgctagtttcttcttttttaatgggctttgggccatgggtctttttgcaaatcatttccttcactttaattttatgcttgtggaaatttctgatatatccgctgacaaaagctgtatgttttggtaaaataacggaggtagtacttcaaactttctttgcaggagggttaggggttgtttatggcgtcattattgatacctgttttgcttggttatatcatatgccttggtggacttatgtattagcaggacttagttttaatatggcacacgctttatcaacttgtttattttatcctcttttgttaccgattttaaggagatttaggaatgaaaaaatacat

SEQ ID NO: 1050 - protein, 174 aa, Streptococcus agalactiae
MIKNSTLTKLTRVAILSALCVVLRYAFAPLPNIQPITAIFLITVVLFDLKEGVATVTITMLVSSFLMGFGPWVFLQIISFTLILCLWKFLIYPLTKAVCFGKITEVVLQTFFAGGLGVVYGVIIDTCFAWLYHMPWWTYVLAGLSFNMAHALSTCLFYPLLLPILRRFRNEKIH

SEQ ID NO: 1051 - DNA, 501 bp, Streptococcus pyogenes
atgtcagctaagcttatgagtcgcattgctatcatgtcagccctatgtgttgtgttgagaatggtttttagcagcctgcctaacgtgcagcctgtgacggcatttttactcagttatcttctttactttgggttagccgaggctgtattagttatgatgttgtgcttgtttttatcagcctttttgctgggatttggcccttgggtcttttggcaagttacttgttttgtgcttgttcttttattatggcgttttgtcttgtaccctttgtctcagcaattccccaaatatcagcttggctgtcaggctttcttggtcgccttatgtggcctcctttatggggtgttgatagatacttgttttgcgtatttgtatagtatgccttggtggagctatgttctagctgggatgccttttaatatagcgcatgctttatcaactctcgtcttttttccagttgtgatgatgttatttaggaggttaatcggtgaacaaaagatt

SEQ ID NO: 1052 - protein, 167 aa, Streptococcus pyogenes
MSAKLMSRIAIMSALCVVLRMVFSSLPNVQPVTAFLLSYLLYFGLAEAVLVMMLCLFLSAFLLGFGPWVFWQVTCFVLVLLLWRFVLYPLSQQFPKYQLGCQAFLVALCGLLYGVLIDTCFAYLYSMPWWSYVLAGMPFNIAHALSTLVFFPVVMMLFRRLIGEQKI

SEQ ID NO: 1053 - DNA, 846 bp, Streptococcus agalactiae
atgagaagaagaattaaacctattgttgttgcggtttttttcagtttatttggacttttattaattattggtcatttacattcgacaaatactttgaaaaaagaattagttgaagctaaaaagacaattccatccgtaaaagcttcaaaagtaccgcaaaaatcaacatcatcgaaagataaagagtttgttcttaaaccgattatcgatgtctctggttggcaacttcctaaggagattgattacgatacgctttcaaaaaatatttcaggtgttgttattcgtgtctttggtggatcaaagatatctaagactaataacgctgcttatacaactggaatcgataaatcgtttaagacccatatcaaagaatttcaaaagcgaaatatcccagtagctgtctacagttatgcacttggttcaagtgttaaagaaatgaaagaagaggctcagatattttataagaatgcagctccttacaaaccaactttttattggattgacgtagaagaggagacaatgtctaacatgaataaaggtgtccaagcattccgaaaagaattaaaaagacttggtgctaaaaatgttggtatctacattggtacttactttatgactgagcaaggcatctctgtaaaaggatttgacgctgtttggattccaacttatggtagcgattctggatactatgaagcggctccgcaaactgaacttaaatacgatttacaccaatacacctctcaaggttatctaccaggattcaatcaaccgcttgatttaaatcaaattgcagttaataaagacaagaagaaaacttatgagaaactttttggaaaagtaaaagag

SEQ ID NO: 1054 - protein, 282 aa, Streptococcus agalactiae
MRRRIKPIVVAVFFSLFGLLLIIGHLHSTNTLKKELVEAKKTIPSVKASKVPQKSTSSKDKEFVLKPIIDVSGWQLPKEIDYDTLSKNISGVVIRVFGGSKISKTNNAAYTTGIDKSFKTHIKEFQKRNIPVAVYSYALGSSVKEMKEEAQIFYKNAAPYKPTFYWIDVEEETMSNMNKGVQAFRKELKRLGAKNVGIYIGTYFMTEQGISVKGFDAVWIPTYGSDSGYYEAAPQTELKYDLHQYTSQGYLPGFNQPLDLNQIAVNKDKKKTYEKLFGKVKE

SEQ ID NO: 1055 - DNA, 846 bp, Streptococcus pyogenes
atgagaagaaaaataaaacctattgttgtgctagtcttctttattttactggcaatggtattgattatcggaaaaagacaagctaatcatgcgaaacaaaaagaagttgaagacgctaagagtcatattcctattgcaaccagtaatcctggtaaagcaaaaactagcacttctgaaaccgaagactttattttaaatcctattgttgatgtttccggctggcaactccctgaagaaattgattatgacacattgtcacgtcacatctctggcgcaattgtacgtgtctatggaggatcgcaaattacagctcataacaacgctgcttttacaactggaattgacaaatcttttaaaacgcatatcaaagaatttcaaaaacgaaatgttcctgtagctgtttacagttacgcacttggtcgtagtactaaagagatgaaagaagaggcccgagctttctacaaaaacgctgctccctataatccaacttactactggattgatgtcgaagaagccactatgaaagatatgaataaaggcgtaacagccttccgagaagagcttaaaaaacttggtgctgaaaatgttggtctctatattggaacttattttatggcagaacaagatatttcaacaaaaggtttcgattctgtatggattccgacttatggtagtgattctggctattatgaggctgctcctaatacaaccttagattacgatttacaccaatacacctcacaaggttatctcagtggttttaacaatgctttagatttaaatcaaattgccgtaacaaaagacactaaaaaaacgtttgagaagttatttggcaactccaacaat

SEQ ID NO: 1056 - protein, 282 aa, Streptococcus pyogenes
MRRKIKPIVVLVFFILLAMVLIIGKRQANHAKQKEVEDAKSHIPIATSNPGKAKTSTSETEDFILNPIVDVSGWQLPEEIDYDTLSRHISGAIVRVYGGSQITAHNNAAFTTGIDKSFKTHIKEFQKRNVPVAVYSYALGRSTKEMKEEARAFYKNAAPYNPTYYWIDVEEATMKDMNKGVTAFREELKKLGAENVGLYIGTYFMAEQDISTKGFDSVWIPTYGSDSGYYEAAPNTTLDYDLHQYTSQGYLSGFNNALDLNQIAVTKDTKKTFEKLFGNSNN

SEQ ID NO: 1057 - DNA, 672 bp, Streptococcus agalactiae
ttgacaaggcatataaaaatttctatactaaatttacaaaatgaaggagagggaactatggaaatactgattgcaggtggtagtggttttttaggaaagcagataataaaagcagcgcttacaaaagggcataaagtggcttacttatcaagacatgaaggtaaaggtgatatatttaaggatcctagattaacctacattaggggagatattacagaagctgataagattcatttagaagacagaacttttgatatattaattgactgtattggagcgattaagcccaatcaactagatgagcttaacgttaaagcaacccaaaaagcagtagcactctgtcacaaaaatcaaataccaaagttagtttatatttcagccaacagcggctattcagcttacattaaaagtaaaaggaaggcagagcagataatcaaagcaagcggtctggattatctttttgtaagaccaggtttgatgtatggtgaagagcgacctctctcgattttccaagccaagtgtataaagttatttagtcatttgcctttcttaggtattgttgtacaaaaggtctttccaactaaggttgtgatagtggcagaagcaatcgttactacgcttaggaaaaaaccaacccaaaaaatcctttctattgaagaattaaataataaa

SEQ ID NO: 1058 - protein, 224 aa, Streptococcus agalactiae
MTRHIKISILNLQNEGEGTMEILIAGGSGFLGKQIIKAALTKGHKVAYLSRHEGKGDIFKDPRLTYIRGDITEADKIHLEDRTFDILIDCIGAIKPNQLDELNVKATQKAVALCHKNQIPKLVYISANSGYSAYIKSKRKAEQIIKASGLDYLFVRPGLMYGEERPLSIFQAKCIKLFSHLPFLGIVVQKVFPTKVVIVAEAIVTTLRKKPTQKILSIEELNNK

SEQ ID NO: 1059 - DNA, 471 bp, Streptococcus agalactiae
atgagtaaaaagaataaaatcaaaaaaactttagttgatcaaattttagataaagcaaaaatcgaacatgatagtctacaattggatgctttacagggagatttacccaacggtattcaaaaacaagatatctttaagacattagcgctaatcggtgataaaaccggtcccataataggtatcttacctctcaccgagcatttatccgaaaaaaagttagctaaaatttcaggaaacaaaaaggtacaaatgatacctcaaaaagatctccagaaaataaccggttatattcacggagcaaataatccaattggaattcgccaaaaacataattaccctatttttatcgatactatcgctttagaaaaacaagaactcattgtctctgcaggagaaattggacgttctattcgtattaatagtgaggttcttgcagatttcgtaaatgctaaatttgccgatataaaggaa

SEQ ID NO: 1060 - protein, 157 aa, Streptococcus agalactiae
MSKKNKIKKTLVDQILDKAKIEHDSLQLDALQGDLPNGIQKQDIFKTLALIGDKTGPIIGILPLTEHLSEKKLAKISGNKKVQMIPQKDLQKITGYIHGANNPIGIRQKHNYPIFIDTIALEKQELIVSAGEIGRSIRINSEVLADFVNAKFADIKE

SEQ ID NO: 1061 - DNA, 477 bp, Streptococcus pyogenes
atggctaaaaaaacaaaactcaaaaaaaccttagtagaacaaatcctcgataaggctaatattgctcatcaaggactcaagcttaatgctttagaaggcgactttccagatgatcttcaaccatcagatatttacaagacacttgctctgactggtgatcaaacaggtcctctaattggcattattccattaacagaacacttatcagaaaaacaattggcaaaagtatcaggtaacaaaaaagtgtccatggttcctcaaaaagacttgcaaaagacaacaggctatattcacggtgccaataatcctgttgggattcgtcaaaaacattcatatcctatttttattgaccaaactgcactggaaaaaggtcaaataatcgtttcagctggtgaagttgggcgttctataaagatttctagccaggctctagctgatttcgttggcgcaagctttgctgatttaaagaagagaaaa

SEQ ID NO: 1062 - protein, 159 aa, Streptococcus pyogenes
MAKKTKLKKTLVEQILDKANIAHQGLKLNALEGDFPDDLQPSDIYKTLALTGDQTGPLIGIIPLTEHLSEKQLAKVSGNKKVSMVPQKDLQKTTGYIHGANNPVGIRQKHSYPIFIDQTALEKGQIIVSAGEVGRSIKISSQALADFVGASFADLKKRK

SEQ ID NO: 1063 - DNA, 651 bp, Streptococcus agalactiae
ttggagaaaaatatgaaattttatcttgttagacacggaaaaacacaatggaatttagaggggcgtttccaaggtgctaacggagactcacctctccttgaagaagctattgaagaattagaagaacttggacaatacctatcatctattcattttgatgctgtttattctagcgacttaggtcgtgctagagatactgttaatatcctcaatgatgctaattcatgcccaaaagaaatccactatactcctcaacttcgtgaatgggcattgggaactttagaaggttgtaaaattgcaactatgcaagctatctatcctcgtcaaatgaccgcattttatcaaaatcccttacaatttaaacatgacatgttcggtgcagaatctctttatcagacaacgcatcgtgtagagagtttcttacgttctctagcttcaaaaaattacgacaaggtccttattgtaggacatggagcaaacctaactgcgtctattcgttccttactgggttatcaatatggtagtttacactacaaagataaacttgataatgccagcctcacaatcatagaaactcatgattttaaagacttcaactgtctgacttggaacgataaatcttatttaaggcaagaggtcaaaatgacacac

SEQ ID NO: 1064 - protein, 217 aa, Streptococcus agalactiae
MEKNMKFYLVRHGKTQWNLEGRFQGANGDSPLLEEAIEELEELGQYLSSIHFDAVYSSDLGRARDTVNILNDANSCPKEIHYTPQLREWALGTLEGCKIATMQAIYPRQMTAFYQNPLQFKHDMFGAESLYQTTHRVESFLRSLASKNYDKVLIVGHGANLTASIRSLLGYQYGSLHYKDKLDNASLTIIETHDFKDFNCLTWNDKSYLRQEVKMTH

SEQ ID NO: 1065 - DNA, 621 bp, Streptococcus pyogenes
atgaaattatattttgtaagacatgggaaaaccctttggaatttagaaggtcgctttcaaggcgctgggggcgattcgccattacttgaagaggcaaaagacgaaattcacttacttggcaaagagttagctaaggtggcttttgatgccgtttatactagcgaccttcaaagagctatggcaacagcagctattatcttagatgcttttgaccaacagccaaaactttaccacaccgaccagcttcgggagtggagattaggtaaattggaaggggctaaaatagcaacaatggcagctatatatccccaacaaatgctggcttttcgagagaatctagcccagttcaaaccagatcagttcgaggctgaatcaatttaccaaacgactcaacgtgtctgccatcttatccaatcgtttaaagataaacattatcaaaacgttcttattgtaggacacggcgctaacttaacagcaactattcgctcattattaggttttgaacctgctcttttactcgctaaaggtggcttagataatgccagtcttactattcttgaaactaaagattatttaacttatgactgtttaatttggaatgataaatcttttctagaggtg

SEQ ID NO: 1066 - protein, 207 aa, Streptococcus pyogenes
MKLYFVRHGKTLWNLEGRFQGAGGDSPLLEEAKDEIHLLGKELAKVAFDAVYTSDLQRAMATAAIILDAFDQQPKLYHTDQLREWRLGKLEGAKIATMAAIYPQQMLAFRENLAQFKPDQFEAESIYQTTQRVCHLIQSFKDKHYQNVLIVGHGANLTATIRSLLGFEPALLLAKGGLDNASLTILETKDYLTYDCLIWNDKSFLEV

SEQ ID NO: 1067 - DNA, 900 bp, Streptococcus agalactiae
atgattacttcaattgtttttgatgttgatgatacgatttacgatcaacaagcaccttaccgtattgctgtggagaaatgctttcctgattttgatatgagcgctattaaccaagcttatattcgctttcgtcattattcagatattggctttccacgagtaatggctggtgaatggacaacagaatattttcgtttctggcgatgcaaagaaacgcttttagagtttggttatcgtgaaattgacgaagctactggtatttattttcaagaaatatacgaacatgaacttgaaaatattacaatgcttgatgagatgcgtatgacacttgactttttgaaatcaaaaaatgtaccaatgggaattattacaaatggtcctacggaacatcaattgaaaaaagttaaaaaattgggactttatgactatgttgatccaaaacgtgttatagttagtcaagcaactggttttcaaaagcctgaaaaggagatttttaatttagcagcagagcaatttgatatgaacccttcaactacactttatgtgggtgattcatatgataatgatattatgggtgcatttaatggtggttggcattctatgtggttcaaccatagaggacgttctttaaaaccgggaattaaaccagtttatgatgttgctattgataactttgagcaattattcggtgctgttaaagtgttgtttgacttacctgataataaatttatttttgatatcaacgataaaagtaatccagtccttgaaatgggacttaataatggtttaatgatggcagcagagcgtctgcttgagagtaatatgagcgttgacaaagttgttattttactgcgcctaactgcaaaacaagaaaaagtattacgcatgaagtatgctaga

SEQ ID NO: 1068 - protein, 300 aa, Streptococcus agalactiae
MITSIVFDVDDTIYDQQAPYRIAVEKCFPDFDMSAINQAYIRFRHYSDIGFPRVMAGEWTTEYFRFWRCKETLLEFGYREIDEATGIYFQEIYEHELENITMLDEMRMTLDFLKSKNVPMGIITNGPTEHQLKKVKKLGLYDYVDPKRVIVSQATGFQKPEKEIFNLAAEQFDMNPSTTLYVGDSYDNDIMGAFNGGWHSMWFNHRGRSLKPGIKPVYDVAIDNFEQLFGAVKVLFDLPDNKFIFDINDKSNPVLEMGLNNGLMMAAERLLESNMSVDKVVILLRLTAKQEKVLRMKYAR

SEQ ID NO: 1069 - DNA, 900 bp, Streptococcus pyogenes
atgattactgctattgtttttgatgtggatgacacaatttacgaccagcaagcgccttatcgaatcgccatggaaaagtgcttcccagattttgatatgtcagtaatgaatcaagcttatattcgctttcgtcactattcagatgttggattcccaagagtaatggcaggggagtggaccacagaatatttccgattctggcgttgcaaggaaacactgcttgagtttggctatcgagaaatcgacgaagctgcgggagtacattttcaagaagtctatgagcacgaacttgagaacattaccatgttagatgagatgcgcatgacccttgactttttaaaatcaaagaatgttcctatggggattattaccaatgggccaacagaacatcagctgaaaaaagttcgtaaattagggctttatgattatattgatgctaagcgtgtcattgtgagccaagcaacaggctttcaaaaaccagaaaaagaaatttttaacctggcagcagaacaatttgacatgaacccacaaaccacactatatgttggggactcttatgacaatgatatcatgggtgcctttaatggtggttggcattccatgtggtttaatcatagaggtcgtcagctaaaaccaggcactaagcctgtttatgatgtggctattgataactttgaacagctctttggtgccgttaaagtactctttgatttacctgataataaatttatttttgatgtcaatgacaagaaaaatccaattttacagatgggaatcaataatggcttgatgatggcagcagagcgtttacttgaaagcaacatgagcattgacaaggtggttatcttgcttcggttaaccaagcaacaagaaaaagttttgcgcttaaaatatgccaga

SEQ ID NO: 1070 - protein, 300 aa, Streptococcus pyogenes
MITAIVFDVDDTIYDQQAPYRIAMEKCFPDFDMSVMNQAYIRFRHYSDVGFPRVMAGEWTTEYFRFWRCKETLLEFGYREIDEAAGVHFQEVYEHELENITMLDEMRMTLDFLKSKNVPMGIITNGPTEHQLKKVRKLGLYDYIDAKRVIVSQATGFQKPEKEIFNLAAEQFDMNPQTTLYVGDSYDNDIMGAFNGGWHSMWFNHRGRQLKPGTKPVYDVAIDNFEQLFGAVKVLFDLPDNKFIFDVNDKKNPILQMGINNGLMMAAERLLESNMSIDKVVILLRLTKQQEKVLRLKYAR

SEQ ID NO: 1071 - DNA, 1599 bp, Streptococcus agalactiae
atggtgaaaagtctattaaaaatgagaataacaccagaaactcataaaataaattatgaattatcagtgtttttgtggtacaataggatgaatactaacttggaggaaattatgtctaaccaacatattgaagaattaaatgaccaacagattgttcgtcgtgaaaaaatggctgctttgactgaacaaggcattgatccttttggtaaacgatttgaacgtacagcaacatctggtcaattaaatgaaaaatacgctgacaaatcaaaagaagacttgcacgacattgaagaaactgctacaatcgctggtcgtttaatgactaagcgcggtaaggggaaagttggctttgcgcatatccaagatcgcgaaggtcaaattcaaatttatgtccgtaaagattctgttggcgaagaaaactacgaaatctttaaaaaagctgatttaggtgacttccttggtgttgaagggcaagtaatgcgtacagatatgggagaactttctatcaaggctactcatattactcacctttcaaaagcactccgtccacttcctgaaaaattccacggcctaactgatattgaaacaatctatcgtaaacgtcatcttgatttaatctcaaatcgtgacagctttgaccgttttgtaacacgctcaaaaatcatttcagaaattcgtcgctttatggatagcaatggtttcttagaggttgaaacacctgttcttcataatgaagctggtggtgcttctgctcgcccatttatcacacatcacaatgcacaagacattgacatggttcttcgtatcgcaactgaattgcatctaaaacgtcttattgtaggtggtatggagcgtgtttatgaaatcggacgtattttccgtaatgaagggatggatgcaacccacaatccagagttcacatctattgaagcctaccaagcctatgctgactaccaggatattatggacttgacagaaggtattatccagcatgttacaaaaactgtaaaaggtgatggaccaattaattatcaaggcacagaaattaaaattaatgaaccattcaaacgtgttcatatggttgatgcggttaaagaaatcactggtattgacttctggaaagaaatgactcttgaagaagcacaagctttggcacaagaaaaaaatgttccgcttgaaaaacatttcacaacagttggtcacatcattaatgccttcttcgaagaatttgttgaagacactttaattcaaccaacttttgtctttggtcatccagttgaagtgtctccacttgctaagaaaaatgatacagaccctcgttttacagaccgtttcgaactctttatcatgactaaagaatacgctaatgcttttacagaattaaatgacccaattgatcagctatctcgctttgaagcacaagcatctgctaaagaacttggcgatgatgaagcaactggagttgattacgattatgttgaagcacttgaatatggtatgccacctactggtggactaggtattggtatcgaccgtctctgtatgctgttaactgatacaacaactatccgagacgtcctacttttccctacaatgaaa

SEQ ID NO: 1072 - protein, 533 aa, Streptococcus agalactiae
MVKSLLKMRITPETHKINYELSVFLWYNRMNTNLEEIMSNQHIEELNDQQIVRREKMAALTEQGIDPFGKRFERTATSGQLNEKYADKSKEDLHDIEETATIAGRLMTKRGKGKVGFAHIQDREGQIQIYVRKDSVGEENYEIFKKADLGDFLGVEGQVMRTDMGELSIKATHITHLSKALRPLPEKFHGLTDIETIYRKRHLDLISNRDSFDRFVTRSKIISEIRRFMDSNGFLEVETPVLHNEAGGASARPFITHHNAQDIDMVLRIATELHLKRLIVGGMERVYEIGRIFRNEGMDATHNPEFTSIEAYQAYADYQDIMDLTEGIIQHVTKTVKGDGPINYQGTEIKINEPFKRVHMVDAVKEITGIDFWKEMTLEEAQALAQEKNVPLEKHFTTVGHIINAFFEEFVEDTLIQPTFVFGHPVEVSPLAKKNDTDPRFTDRFELFIMTKEYANAFTELNDPIDQLSRFEAQASAKELGDDEATGVDYDYVEALEYGMPPTGGLGIGIDRLCMLLTDTTTIRDVLLFPTMK

SEQ ID NO: 1073 - DNA, 1503 bp, Streptococcus pyogenes
ttggaggaaaatatgtctaatcaacacatcgaagaattaaatgaccaacagattgtccgtcgtgaaaaaatgacggcgctggctgaacaaggaattgatcctttcggtaaacgctttgaccgcacagccaattctgctgaattaaaagaaaagtatgctgataaaacaaaagaagaattacatgagttaaacgaaacagctattgttgctggccgcttgatgacaaaacgtggcaaaggtaaggttggttttgctcatcttcaagaccgtgaaggccaaatccaactttatgttcgcaaggactctgttggcgaagacaactatgaaatcttcaaaaaagccgatttaggcgactttatcggcgttgaaggcgaagtcatgcgtacagacatgggcgagttgtcaatcaaggcaaccaagttgactcacctttctaaatcacttcgtcctcttcctgaaaaattccacggattaactgatattgaaaccatttaccgtaagcgtcaccttgatttaatttcaaatcgtgaaagctttgaccgcttcgtgacccgttccaaaatgatttcagaaatccgtcgttatttagacggtcttgatttcctagaagtagaaacgcctgtgcttcataacgaggctggtggtgctgctgctcgtcctttcgttactcaccataatgctcaaaacattgatatggtgcttcgtatcgcaacagaacttcatttgaaacgtttgattgttggtggtatggaacgtgtctatgaaattggtcgtatcttccgtaacgagggaatggatgctactcataatcctgagttcacttctattgaggtttaccaagcctatgcagactatcttgatatcatgaacctgacagaaggcattatccaacatgctgctaaagctgttagaggtgatggccctattgattatcaaggaactgaaatccgtatcaatgaacctttcaaacgtgttcacatggtagatgctatcaaggaagtgacaggtgctgatttctggcctgaaatgactgtcgaagaagctattgcacttgccaaagaaaaacaggtcccactcgaaaaacacttcataagtgtcggacatatcatcaacgctttcttcgaggaatttgttgaagaaaccttggtccaaccaacctttgtgtttggtcatcctgttgaagtatcgcctttggctaagaagaatccagaagatacccgcttcaccgaccgcttcgaacttttcatcatgaccaaagaatacgccaatgctttcacagagttgaatgatcccattgaccaattatctcgttttgaagcacaagcacaagctaaagaacttggtgatgacgaagcaactggcattgactacgacttcgttgaagctcttgaatatggtatgccgccaaccggtggactcggaatcgggattgatcgtctttgcatgttattaacaaacacaacaacaatcagagatgtgcttttattcccaacgatgaaacct

SEQ ID NO: 1074 - protein, 501 aa, Streptococcus pyogenes
LEENMSNQHIEELNDQQIVRREKMTALAEQGIDPFGKRFDRTANSAELKEKYADKTKEELHELNETAIVAGRLMTKRGKGKVGFAHLQDREGQIQLYVRKDSVGEDNYEIFKKADLGDFIGVEGEVMRTDMGELSIKATKLTHLSKSLRPLPEKFHGLTDIETIYRKRHLDLISNRESFDRFVTRSKMISEIRRYLDGLDFLEVETPVLHNEAGGAAARPFVTHHNAQNIDMVLRIATELHLKRLIVGGMERVYEIGRIFRNEGMDATHNPEFTSIEVYQAYADYLDIMNLTEGIIQHAAKAVRGDGPIDYQGTEIRINEPFKRVHMVDAIKEVTGADFWPEMTVEEAIALAKEKQVPLEKHFISVGHIINAFFEEFVEETLVQPTFVFGHPVEVSPLAKKNPEDTRFTDRFELFIMTKEYANAFTELNDPIDQLSRFEAQAQAKELGDDEATGIDYDFVEALEYGMPPTGGLGIGIDRLCMLLTNTTTIRDVLLFPTMKP

SEQ ID NO: 1075 - DNA, 468 bp, Streptococcus agalactiae
atgacaattattgaaggacaattagtggcaaacgaaatgaaaataggaatcgtagtctcacgtttcaatgaattgattacatctaaattattatcaggagcagtagatggactgctgagacatggtgtttcagaagaagatatagatattgtatgggtacctggtgcttttgaaatcccctatatggctagaaaaatggcattatataaagattatgatgctattatctgtcttggggtagtcattaaaggcagcactgatcattatgattatgtttgtaatgaggtgacaaaaggtattggtcatttaaatagccagtcagatatccctcatatctttggtgttctaacaacggataacatcgaacaagctattgagagggcaggaacaaaagcaggaaataaaggttatgattgtgctctttcggctattgaaatggtgaaccttgataaaaaattgcgtgagcga

SEQ ID NO: 1076 - protein, 156 aa, Streptococcus agalactiae
MTIIEGQLVANEMKIGIVVSRFNELITSKLLSGAVDGLLRHGVSEEDIDIVWVPGAFEIPYMARKMALYKDYDAIICLGVVIKGSTDHYDYVCNEVTKGIGHLNSQSDIPHIFGVLTTDNIEQAIERAGTKAGNKGYDCALSAIEMVNLDKKLRER

SEQ ID NO: 1077 - DNA, 1239 bp, Streptococcus agalactiae
ttggtcttttttatcagaaaatggctactaagagagaggagaaagctaatggcctttagtccaataaaaaaacttttacaagacatcaaatcagggaaaatggtagtgttgatggatgacgaaaatagagagaatgaaggagaccttatttgtgcggctgaaatggtgacaaaagagtcgattaattttatggctaaatttgggaaaggattaatttgcttacctctgtctaattactatgctgaaaagttagaattagctcaaatggctagccataatactgataatcatgaaacagcttttaccatatctattgatcatctatcaactagtactgggatttctgcggaagatagagctttgacagctaagatggttgctaacgacagtagcaaagctaaagactttagacgtcctgggcacttatttcccttgttagccaaggaaggaggtgttttagctagaaatggacatactgaagcaaccgttgatctatgtcgtttagctggattaaaggaatgtggactttgttgtgaaataatggctgaagatggtagtatgatgagaaaggatgagttattagcatttgctcaaaagcacgatttagctatcgctaccataaaacaattgcaagactatagacgtcaagaagagggaggggtggttagagaaattgagattcagctaccaacgcaattcggtcattttacggcttatggatatagcgaagttgtggcaaataaggaacatgttgcccttgttaaaggggatattagtagtggtgaagatgttttatgtcgtttacactcagaatgtttgacaggtgatgtctttcattccttgagatgtgattgtggggaacaactggctaatgccctccaacaaatagaggctgaaggtcgtggagtccttctttatatgagacaggaaggtcgaggaattggtttgattaataagttaaaagcttatcatttgcaagaagaaggcttagatactttagaagctaatttggctttaggttttgaaggagatgagagagactatggagttagtgctcaacttttaaaagatttaggtataaattctataaacttactaaccaataatccagataaaatccaacaacttgaagcagaaggaatttgcgtcaaaaacagagtgccattacaggtggcagtaacagcttatgaccttaattatttaaaaactaaaaaagaaaaaatgggacatcttttagat

SEQ ID NO: 1078 - protein, 413 aa, Streptococcus agalactiae
MVFFIRKWLLRERRKLMAFSPIKKLLQDIKSGKMVVLMDDENRENEGDLICAAEMVTKESINFMAKFGKGLICLPLSNYYAEKLELAQMASHNTDNHETAFTISIDHLSTSTGISAEDRALTAKMVANDSSKAKDFRRPGHLFPLLAKEGGVLARNGHTEATVDLCRLAGLKECGLCCEIMAEDGSMMRKDELLAFAQKHDLAIATIKQLQDYRRQEEGGVVREIEIQLPTQFGHFTAYGYSEVVANKEHVALVKGDISSGEDVLCRLHSECLTGDVFHSLRCDCGEQLANALQQIEAEGRGVLLYMRQEGRGIGLINKLKAYHLQEEGLDTLEANLALGFEGDERDYGVSAQLLKDLGINSINLLTNNPDKIQQLEAEGICVKNRVPLQVAVTAYDLNYLKTKKEKMGHLLD

SEQ ID NO: 1079 - DNA, 648 bp, Streptococcus agalactiae
atgtttacaggaattattgaggaaatgggtcaagtcagtcgtattcggaatggcataaagtcccaacaattaagtattgatgctcccaaactagtccctttattaagaaaaggggatagcgtagctgttaatggtgtttgtttgacggttcttgacaaaagtgaaacagcttttatagcagacgtcatgccagaaagtatgatgcgaacaagcttagctgctttacgacttcattctaaagttaacttagaattagcactcagaagtgactcaaggttaggggggcattttgttcttggacatgtggatggggttggaaaaatagaaaaaatccaaaaagatgatattgctgtcagattttcaattgatgctccacctagtattatgtcttatattatagagaaaggttcggtggctctagatgggattagcttaacagtggtatcatttacagagcattcttttgaagtttcggtcattccccacacgatggctcaaactaatctatccttaaaaaaggttggggatttattaaatatcgaagtggatgttttaggcaaatatgctgagaaatttttagcacccactaatagaactaatcacacttcatcggtaatggattggtcttttttatcagaaaatggctac

SEQ ID NO: 1080 - protein, 216 aa, Streptococcus agalactiae
MFTGIIEEMGQVSRIRNGIKSQQLSIDAPKLVPLLRKGDSVAVNGVCLTVLDKSETAFIADVMPESMMRTSLAALRLHSKVNLELALRSDSRLGGHFVLGHVDGVGKIEKIQKDDIAVRFSIDAPPSIMSYIIEKGSVALDGISLTVVSFTEHSFEVSVIPHTMAQTNLSLKKVGDLLNIEVDVLGKYAEKFLAPTNRTNHTSSVMDWSFLSENGY

SEQ ID NO: 1081 - DNA, 1107 bp, Streptococcus agalactiae
atgatgaaaaaagaagactacatggcattagccttgaaagaggctgagaaaggtatggggttcgttgctcccaacccattagtaggtgctgttattgttaaagatgatcgtataatttccaaaggttatcataaacgatttggagatttacatgcggaaagacaggctattaaaaatgctgatgaggatatctctggaagtactctgtacgtgactttagaaccatgctgtcatgttggtaagcaaccaccttgtactgaagctcttattaaatctggtatcaaaaaagtagtagttggaagtttagatccaaatcctttagtttcaggaaaagggattgccttgttgagaaaagaaggtttaaatgttgaagttggtatcttaagagaagaatgcgatgctctgaatgaaagatttatttttcacatgacctataagcagccttttgtttatttgaaatatgctatgactttagatgggaagatagctacaaagacgggcgattctaagtggatatcaaatgagcactcaagacaatctgttcagaaattgaggcaaaaatgtagtgctattatggtcggtatcaatactgtattagctgataatccacgtttaacttgccgtattcctaaaggtgaagcgcttgtgaggatcgtatgtgatagtcagttgaagatacctttagactcttacctagttaagagcgctaaaacaataccaacatggattgcaacatgttcagataatcttgctcagcaacaaacattaaaagaaatgggttgccgtttgattaaggtcccaagaaaagatggaaagctggatttgaaagtattaatgactattttaggacaagaagggattgatagccttcttattgaaggaggaagtagtttacatttttcagctttaaaagctggtattgttaacagactaattgtttttattgcacccaaaataataggaggtctgaaagcaaaaacagctatttctggagaaggtttggattggcttaaccaagctttcagagtaaaagatattgaacttagtcgtatggattctgacgttgttattgaaggaaaggtagaacattatgtttacaggaattat

SEQ ID NO: 1082 - protein, 369 aa, Streptococcus agalactiae
MMKKEDYMALALKEAEKGMGFVAPNPLVGAVIVKDDRIISKGYHKRFGDLHAERQAIKNADEDISGSTLYVTLEPCCHVGKQPPCTEALIKSGIKKVVVGSLDPNPLVSGKGIALLRKEGLNVEVGILREECDALNERFIFHMTYKQPFVYLKYAMTLDGKIATKTGDSKWISNEHSRQSVQKLRQKCSAIMVGINTVLADNPRLTCRIPKGEALVRIVCDSQLKIPLDSYLVKSAKTIPTWIATCSDNLAQQQTLKEMGCRLIKVPRKDGKLDLKVLMTILGQEGIDSLLIEGGSSLHFSALKAGIVNRLIVFIAPKIIGGLKAKTAISGEGLDWLNQAFRVKDIELSRMDSDVVIEGKVEHYVYRNY

SEQ ID NO: 1083 - DNA, 537 bp, Streptococcus pyogenes
ttggaacttggggagtctttcttgatgccatatagtttagaagagcaaacttatttcatgcaagaggctttaaaagaagccgaaaaatccttacagaaagctgaaatccccattggctgtgtcattgtcaaggatggtgagattattggtcgtgggcacaatgcgcgtgaagagagtaaccaagccattatgcacgctgaaatgatggctattaacgaggctaacgctcatgaaggcaactggcgtttattagataccacactctttgtgaccatcgagccttgtgtgatgtgtagtggtgccattgggctagcaaggattccgcatgttatttatggagccagcaatcaaaaatttggtggagtagacagcctttaccagattttgacagatgagcgcttaaaccatcgcgtgcaagttgaacgaggcctgctagcagcagactgtgctaacatcatgcaaacctttttccgccaagggcgagagcgcaaaaaaatagctaagcatttgatcaaggaacagtcagatccctttgac

SEQ ID NO: 1084 - protein, 179 aa, Streptococcus pyogenes
LELGESFLMPYSLEEQTYFMQEALKEAEKSLQKAEIPIGCVIVKDGEIIGRGHNAREESNQAIMHAEMMAINEANAHEGNWRLLDTTLFVTIEPCVMCSGAIGLARIPHVIYGASNQKFGGVDSLYQILTDERLNHRVQVERGLLAADCANIMQTFFRQGRERKKIAKHLIKEQSDPFD

SEQ ID NO: 1085 - DNA, 1338 bp, Streptococcus agalactiae
atgaatcaaaatcattccgtcaaaagatccttatccgaagttaatcagagcgttgaggttcctcacaatagctctttttggaacactttaagagcttttcttggacctggagctttggttgcagttggttatatggatccaggtaactggattactagcgttattggtggagctacctatcgttacttactattgtttgttgttttagtatcttctttgatggcgatgcaattacaacaaatggctggcaagcttggcattgttacacgacaggacttagcacaagcaacagcttctcgactcccaaaaccgcttcgttacctgctatttattatcattgagttagcccttatcgctactgatttagcagaagtcattggctctgccattgctcttcacttattatttggctggcccctgttactgtctatcatgattactattttggatgtattcttacttttactcttaatgaagttaggcgtccaaaaaattgaagcctttgtttctgttctcatattgacaattttgataatctttacatatttagttgttttatcacaacctgatttagatgctatgttcaaaggatttttaccacaccatgagctttttaacatatcacatgaagggaaaaatagtcctttaaccctcgctcttggcattatcggcgcaacagtcatgccacataatctttatttacattcttctttatctcagactagacgcgtggattatcataataaatcttcaataaaaaaagctgtacgtttcatgaccttagattctaacattcagctatcacttgcatttgtcgtgaattcgctactattagtcttaggagctagtctattttatgggcatgctaatgatatcagtgccttttctcaaatgtatcttgccctatctgataaaactattactggtgcagtagccagttctttcctttctaccctttttgcagttgccctactagcaagtggtcaaaattcaacgattacaggtactttaacaggacaaatcgttatggaaggtttccttcacttcaaattacctcaatggttaataaggctttgtactagattattaactcttcttccaatttttgttatcgccctactagttggaggcgaagaaaatacgttagatcaactaatcgtctattcacaagtttttctttccttagctttaccattttcaatctttccattgatttatttcacgtcgcaaaaatcaattatgggagagcatgctaatgctaaatggaatacctatttagcataccttgtcgccatcattttaacattactcaatttgaaattaatcatggatttactt

SEQ ID NO: 1086 - protein, 446 aa, Streptococcus agalactiae
MNQNHSVKRSLSEVNQSVEVPHNSSFWNTLRAFLGPGALVAVGYMDPGNWITSVIGGATYRYLLLFVVLVSSLMAMQLQQMAGKLGIVTRQDLAQATASRLPKPLRYLLFIIIELALIATDLAEVIGSAIALHLLFGWPLLLSIMITILDVFLLLLLMKLGVQKIEAFVSVLILTILIIFTYLVVLSQPDLDAMFKGFLPHHELFNISHEGKNSPLTLALGIIGATVMPHNLYLHSSLSQTRRVDYHNKSSIKKAVRFMTLDSNIQLSLAFVVNSLLLVLGASLFYGHANDISAFSQMYLALSDKTITGAVASSFLSTLFAVALLASGQNSTITGTLTGQIVMEGFLHFKLPQWLIRLCTRLLTLLPIFVIALLVGGEENTLDQLIVYSQVFLSLALPFSIFPLIYFTSQKSIMGEHANAKWNTYLAYLVAIILTLLNLKLIMDLL

SEQ ID NO: 1087 - DNA, 795 bp, Streptococcus agalactiae
atgattagacattcatttaaaagtaaggtgttattgttagtctttatcttaacaataatagtgaattatttatccgcaacaggttttttaacagggaacagtcagaagagtctgtctgatcgttatcaaacgctcttgacaccagcaccattagccttttcaatttggtcagtcatctatttattgacctttttagtaatattaagagctatattcagtaagagtcaatcttaccaagataactttgctagcatttttccatactttttgggtcttctattagttaataatatatggactgtattttttacgagtaatttgattggcctatcaacaataataatttttgcttactgtattcttctggttatcattatcaagatactaagtaaaaataaatcaaaattactgcttagaataacatttggaattcatgcaggatggttgctagttgcgtcattggtcaatttagcggtctacttagttaaaattgattttaattacccattaccaaaggtatatatagctatcattgccttgatttttataactgttttaagtctttacctagctagagtattacaaaatgcttacttaatcttatccgttttttgggcttggttgatggtttttaaagcacatttagaaggaaattttcaacacctatattttagtatccaaattttatctttgattgcagcaattatccttggcgtatcgtttttcatcatcggttattataatgtcaaggagaggtacaagcaaaaaaatactagcccttactcacgggttctt

SEQ ID NO: 1088 - protein, 265 aa, Streptococcus agalactiae
MIRHSFKSKVLLLVFILTIIVNYLSATGFLTGNSQKSLSDRYQTLLTPAPLAFSIWSVIYLLTFLVILRAIFSKSQSYQDNFASIFPYFLGLLLVNNIWTVFFTSNLIGLSTIIIFAYCILLVIIIKILSKNKSKLLLRITFGIHAGWLLVASLVNLAVYLVKIDFNYPLPKVYIAIIALIFITVLSLYLARVLQNAYLILSVFWAWLMVFKAHLEGNFQHLYFSIQILSLIAAIILGVSFFIIGYYNVKERYKQKNTSPYSRVL

SEQ ID NO: 1089 - DNA, 210 bp, Streptococcus agalactiae
atgtcagaatttacatttgaaattgttgagaagttattggtcctatctgaaaatgaaaaaggttggacaaaagagttgaatcgtgtgagcttcaacggagcgccagctaaatttgatttgcgtacatggagtccagatcatacaaaaatgggtaaaggtatcactttatctaatgaagaatttaaagtcattttagatgcttttcgtaaa

SEQ ID NO: 1090 - protein, 70 aa, Streptococcus agalactiae
MSEFTFEIVEKLLVLSENEKGWTKELNRVSFNGAPAKFDLRTWSPDHTKMGKGITLSNEEFKVILDAFRK

SEQ ID NO: 1091 - DNA, 210 bp, Streptococcus pyogenes
atggcagaatttacattcaacattgaggaacatttactcaccttatcagaaaatgataaaggttggacgaaagaattgaaccgcgtcagctttaatggcgcagaagcgaaatgggatatccgcacgtggagtccagaccatacgaaaatggggaaaggcattactcttactaatgaagaatttaaaaccatcttagacgcttttcgtaag

SEQ ID NO: 1092 - protein, 70 aa, Streptococcus pyogenes
MAEFTFNIEEHLLTLSENDKGWTKELNRVSFNGAEAKWDIRTWSPDHTKMGKGITLTNEEFKTILDAFRK

SEQ ID NO: 1093 - DNA, 1284 bp, Streptococcus agalactiae
atgtctaatgtaaaaaaacgccctgaggttttatcacctgcaggaacactagaaaaattaaaagttgctattgattatggagcagatgctgtatttgttggaggtcaagcgtatggtcttcgaagtagagctggtaacttttctatggaagagttacaagagggaataaactatgctcatgcaagagatgctaaagtttatgtagcggctaatatggttactcatgaaggtaatgagcttggggcaggtccgtggtttcgtgaattacgtgatatgggactagatgcagtcattgtttcagatcctgctcttattgttatttgtgctacagaagcaccaggcttagaaattcatttgtcaactcaagcctcttccacgaactatgaaacttttgaattttggaaagagatggggcttactcgtgtcgtattagcacgtgaggttactatggcagagttggctgaaatcaggaagaggacagatgttgagatagaagcatttgttcatggcgcgatgtgtatttcatactcaggacgatgtgttctatcaaaccatatgagccatcgtgatgctaatcgtggcggttgctctcagtcatgtcgttggaaatatgacctctacgatatgccatttggacaagaacgtcaatcgttaaaaggcgagattccagaacctttctcaatgtcagctgtggatatgtgtatgattgagcatattccagatatgattgaaaatggtgtagatagtttaaaaatagaaggacgtatgaaatccattcattatgtttctacagtaactaattgctataaagctgctgtagatgcctatatggaaagtccagaagcttttgaagctattaaagaagacttgattgatgaactttggaaggttgcacaacgcgaattagcaacaggtttctactaccatacaccaactgaaaatgaacaactctttggagctcgtcgtaaaattcctcaatacaaatttgttggggaagtggtttcatttgacaatgctaaaatggaggctacaattcgtcagcgtaatgttattatggaaggagatcgcgtagaattctatggtcctggcttccgtcactttgaatgttttattgatggtctgcgtgatgctgaaggaaataaaatagaccgtgctccaaatccgatggaattattaaccataacattaccaaatccagtaaaaaaaggggatatgattcgtgcttgtaaagaaggattagtgaacctttatcaaaatgatggtactagcaagactgtaagagct

SEQ ID NO: 1094 - protein, 428 aa, Streptococcus agalactiae
MSNVKKRPEVLSPAGTLEKLKVAIDYGADAVFVGGQAYGLRSRAGNFSMEELQEGINYAHARDAKVYVAANMVTHEGNELGAGPWFRELRDMGLDAVIVSDPALIVICATEAPGLEIHLSTQASSTNYETFEFWKEMGLTRVVLAREVTMAELAEIRKRTDVEIEAFVHGAMCISYSGRCVLSNHMSHRDANRGGCSQSCRWKYDLYDMPFGQERQSLKGEIPEPFSMSAVDMCMIEHIPDMIENGVDSLKIEGRMKSIHYVSTVTNCYKAAVDAYMESPEAFEAIKEDLIDELWKVAQRELATGFYYHTPTENEQLFGARRKIPQYKFVGEVVSFDNAKMEATIRQRNVIMEGDRVEFYGPGFRHFECFIDGLRDAEGNKIDRAPNPMELLTITLPNPVKKGDMIRACKEGLVNLYQNDGTSKTVRA

SEQ ID NO: 1095 - DNA, 1284 bp, Streptococcus pyogenes
atgtcacatatgaaaaaacgtcccgaggtcttatcacctgctggaacacttgaaaaattaaaagttgcgattgactatggcgcagatgctgtttttgttggagggcaggcctatggcctaagaagccgcgctggtaacttctctatggaagaattgcaagaaggcattgattatgcacatgcgcgtggagctaaggtctatgttgctgctaacatggttacccacgaagggaacgaaattggtgcgggcgagtggtttcgtcaactgcgtgatatggggcttgatgcggtcattgtttcagatccagccttgattgttatttgttcaacagaagccccaggtttggaaattcatttgtcaacgcaagcttcatctaccaattacgagacctttgaattttggaaagccatgggcttgacccgagttgttttagctcgcgaggttaatatggccgagttagcagaaatccgcaagcggacagatgtggaaattgaagcctttgtccatggagccatgtgtatctcttattcaggccgctgtgttttgtcaaaccacatgagtcaccgtgatgccaacaggggcggctgctcacagtcttgccgctggaagtatgatttgtatgacatgccatttggaggagagcgccgctccttaaaaggggaaattccagaagactattctatgtcctctgttgacatgtgtatgattgaccatattcctgacctgattgaaaatggggttgatagcttaaaaattgaaggccgaatgaaatctatccactacgtctcaaccgtaaccaactgttacaaggcggctgtaggtgcttacatggaaagcccagaagctttttatgctatcaaagaggaattgattgacgagttgtggaaggttgcccagcgcgagttggctacaggtttttactatggtatcccaactgaaaatgaacaattatttggtgctcgccgcaaaattccacaatataaatttgtcggagaagtagttgcctttgactcagctagcatgacagcgaccattcgtcagcgtaatgtcatcatggaaggcgatcggattgaatgttatggaccaggtttccgtcattttgaaacggttgttaaggacttacatgatgcggatggccaaaagattgaccgtgccccaaatccaatggaactcttaaccatctctttaccgagagaagttaagccaggggatatgattagggcttgcaaggaaggtctggttaacctctatcaaaaagatggcaccagtaaaactgttagaaca

SEQ ID NO: 1096 - protein, 428 aa, Streptococcus pyogenes
MSHMKKRPEVLSPAGTLEKLKVAIDYGADAVFVGGQAYGLRSRAGNFSMEELQEGIDYAHARGAKVYVAANMVTHEGNEIGAGEWFRQLRDMGLDAVIVSDPALIVICSTEAPGLEIHLSTQASSTNYETFEFWKAMGLTRVVLAREVNMAELAEIRKRTDVEIEAFVHGAMCISYSGRCVLSNHMSHRDANRGGCSQSCRWKYDLYDMPFGGERRSLKGEIPEDYSMSSVDMCMIDHIPDLIENGVDSLKIEGRMKSIHYVSTVTNCYKAAVGAYMESPEAFYAIKEELIDELWKVAQRELATGFYYGIPTENEQLFGARRKIPQYKFVGEVVAFDSASMTATIRQRNVIMEGDRIECYGPGFRHFETVVKDLHDADGQKIDRAPNPMELLTISLPREVKPGDMIRACKEGLVNLYQKDGTSKTVRT

SEQ ID NO: 1097 - DNA, 924 bp, Streptococcus agalactiae
atggaaaaaataattttgacagcgacagctgaatctattgaacaagtaaagcaattgctagcaataggaattgaccgcatctatgtaggggaagaaaattacggtcttcgtttaccacattcattttcagacgatgaattgcgtgaaatcgctaaattagtacatgatgctggtaaagaattgacagtagcttgtaatgcactcatgcatcaagagatgatggataatatcaaaccatttttggagttgatgaaagaaattaatgtggattatttggtagttggtgatgcaggagtattttatatcaacaagcgtgatggttataacttcaaacttatctacgacacttctgtcttcgttacatcaagtcgtcaagttaatttttggggacaacatggagcagtagaaacggttttagcacgtgaaataccttctgaagaactttttaagatgtctgagaatcttgaatttcctgctgagattttagtttatggggcttctgtaattcatcactctaagcgtccgttattgcaaaactattataattttactcatatcactgatgaaaaaacacgtgagcgtggtctttttttagcagaaccaggtgatccagaaagtcactattctatttacgaagataagcatgggactcatatttttattaacaatgatatcaatatgatgactaaagtgactgaactagttgaacatcactttactcactggaaattagatggtatttattgtccaggagataattttgttgctattgctgaaatttttgtcgaaacagctcgtttgattgaaaatggaacattcactcaggatcaggctttcttgtttgatgaacgaattagaaaactgcaccctaaaggacgtggtttagatactggattttatgattttgacccatcaacagtaaaa

SEQ ID NO: 1098 - protein, 308 aa, Streptococcus agalactiae
MEKIILTATAESIEQVKQLLAIGIDRIYVGEENYGLRLPHSFSDDELREIAKLVHDAGKELTVACNALMHQEMMDNIKPFLELMKEINVDYLVVGDAGVFYINKRDGYNFKLIYDTSVFVTSSRQVNFWGQHGAVETVLAREIPSEELFKMSENLEFPAEILVYGASVIHHSKRPLLQNYYNFTHITDEKTRERGLFLAEPGDPESHYSIYEDKHGTHIFINNDINMMTKVTELVEHHFTHWKLDGIYCPGDNFVAIAEIFVETARLIENGTFTQDQAFLFDERIRKLHPKGRGLDTGFYDFDPSTVK

SEQ ID NO: 1099 - DNA, 924 bp, Streptococcus pyogenes
atggaaaaaataattattacagccacagctgaaagcattgagcaagtcaaagctttattagctgctggtgttgatcgtatttatgttggtgaagccaattacgggttacgtcttccccataatttttcttatgatgaattgagacaaattgccaaactagtgcatgatgcaggcaaagagttgacagtagcttgcaatgctttgatgcatcaagatatgatggatcagatcaaaccctttttagacttaatgatagagattgctgttgattatcttgtggttggtgatgcaggtgtgttttatgtcaataaaagggatggctataactttaaactgatttatgatacctctgtttttgtgacttctagccgtcaggtaaatttctgggggcaacatggtgctgttgaaagtgttttagcaagggaaatcccatcagcagagttattcaccttagctgaaaatttggaatttccagcagaggtgctagtttacggcgcctcggtgattcatcactcgaaacgtcccttgctagaaaattattaccattttacaaagattgatgatgaggttagtcgtgaacgaggacttttcttggcagaaccaggagatgctagcagccattactccatttatgaagacaatcatggcactcatattttcattaataacgatatcgacatgatgtctaaattgggtgagctgtatgcgcatggcttaactcattggaagctagatggcatttactgtccaggtgatgattttgtcgctattactaaattgtttattcaggctaaaaccttattagaagctgggcaatttacccaagaagaagctgaaaagcttgatcaagcagtgcatgcccatcatccagctggccgtggattagatactggcttttatgagttcgatccaaaaaccgttaaa

SEQ ID NO: 1100 - protein, 308 aa, Streptococcus pyogenes
MEKIIITATAESIEQVKALLAAGVDRIYVGEANYGLRLPHNFSYDELRQIAKLVHDAGKELTVACNALMHQDMMDQIKPFLDLMIEIAVDYLVVGDAGVFYVNKRDGYNFKLIYDTSVFVTSSRQVNFWGQHGAVESVLAREIPSAELFTLAENLEFPAEVLVYGASVIHHSKRPLLENYYHFTKIDDEVSRERGLFLAEPGDASSHYSIYEDNHGTHIFINNDIDMMSKLGELYAHGLTHWKLDGIYCPGDDFVAITKLFIQAKTLLEAGQFTQEEAEKLDQAVHAHHPAGRGLDTGFYEFDPKTVK

SEQ ID NO: 1101 - DNA, 429 bp, Streptococcus agalactiae
atgagtaaattatttaaaactttagttatcagtgctgcatcaggtgcagcagcagcttattttttaacaacaaaaaaaggaaaagagctaaggaaaaatgcagaaaaattctatggagaatataaagaaaatccagaagaatatcatcaaatagctaaagataaagcaagtgaatattcaaatttagctgttgatacttttaaagattataaaggtaaatttgaatcaggtgaattgacaacagaggatatcgtctcagccgttaaggaaaaaagcggagaagtagttgactttgctaatgattttgtcaatcaagctaaatcaaaattctcagacgaggatactgctaaaaaagaagataaggctcctgaaacaaaagtagaagatattgtcattgattataaagaaaacacagaagataaagaaaaa

SEQ ID NO: 1102 - protein, 143 aa, Streptococcus agalactiae
MSKLFKTLVISAASGAAAAYFLTTKKGKELRKNAEKFYGEYKENPEEYHQIAKDKASEYSNLAVDTFKDYKGKFESGELTTEDIVSAVKEKSGEVVDFANDFVNQAKSKFSDEDTAKKEDKAPETKVEDIVIDYKENTEDKEK

SEQ ID NO: 1103 - DNA, 447 bp, Streptococcus pyogenes
ttggaaaaaaaggagaaaagcatgaataaaagtttcaaaaacttagtgattggagctgtttcaggagtagcggcagcttacttcttatcaacagaaaaaggcaaggctttgaaaaatcgtgctgaaaaagcttatcaagcctacaaagaaagtccagatgattaccaccaatttgctaaagaaaaaggtagtgaatacagccatttagcacgtgacactttctatgatgtgaaagataagttggcttctggtgacttaactaaagaggacatgttagacttgctcaaagataaaacaacagctttcgtgcaaaaaacaaaagaaacccttgccgaagttgaagcgaaagaaaagcaagatgatgttatcattgatttaaatgaagaagacatcatcattgactatactgaacaagatgagcctgttagtgatacactagataaacac

SEQ ID NO: 1104 - protein, 149 aa, Streptococcus pyogenes
LEKKEKSMNKSFKNLVIGAVSGVAAAYFLSTEKGKALKNRAEKAYQAYKESPDDYHQFAKEKGSEYSHLARDTFYDVKDKLASGDLTKEDMLDLLKDKTTAFVQKTKETLAEVEAKEKQDDVIIDLNEEDIIIDYTEQDEPVSDTLDKH

SEQ ID NO: 1105 - DNA, 396 bp, Streptococcus agalactiae
atgatagaaattgctgtattaattattgccattgcgtttgttgttttagttttaggaatacttttcgttctgaaaaaagtatcagaaacgattgaggaaaccaagcaaactattaaagtattaacaagcgatgttaacgtgactctttaccaaactaatgaaattttagccaaagctaatgttttagttgatgatgttaatggtaaagtatctactattgatcctctttttgtagctattgctgacttatcagaatctgtatctgatttaaacctacaggcaagacatattggacaaaaggcaagtagtgcaacctcaagtgttactaaggcaggttcagctttagctattggaaaagcggcttcaaaaatttttcgtaaaaaaggagacaaaaaa

SEQ ID NO: 1106 - protein, 132 aa, Streptococcus agalactiae
MIEIAVLIIAIAFVVLVLGILFVLKKVSETIEETKQTIKVLTSDVNVTLYQTNEILAKANVLVDDVNGKVSTIDPLFVAIADLSESVSDLNLQARHIGQKASSATSSVTKAGSALAIGKAASKIFRKKGDKK

SEQ ID NO: 1107 - DNA, 405 bp, Streptococcus pyogenes
atggacttagttggaatctcactgatgattattgcactcgcatttgttgctttggtgattttcttgattattgtattaaagaaagtctcagaaacaattgatgaagccaaaaaaacgatttctgtattgacaagtgatgttaatgtgacacttcatcaaactaatgatattttagcaaaagctaatatccttgttgaagatgttaatggtaaagtagcaaccatcgatccactgtttgttgctattgctgatttgtcagaaagtctttcagatttaaatagtcaagcaaggcattttgggcaaaaagcaactaatgctacaggtaatgtttcaaaagctggaaaattagcattagttggtaaagtagcctcaaaagtatttggaaaaaaaggagaaaagcatgaa

SEQ ID NO: 1108 - protein, 135 aa, Streptococcus pyogenes
MDLVGISLMIIALAFVALVIFLIIVLKKVSETIDEAKKTISVLTSDVNVTLHQTNDILAKANILVEDVNGKVATIDPLFVAIADLSESLSDLNSQARHFGQKATNATGNVSKAGKLALVGKVASKVFGKKGEKHE

SEQ ID NO: 1109 - DNA, 114 bp, Streptococcus agalactiae
atggcttgggcaatcatcactcctggagcagcaatatccagaaaatcaatgggattaatcaagcgacgatatgaaaaaatcacaaggagaatggccccggtaattaaccctccg

SEQ ID NO: 1110 - protein, 38 aa, Streptococcus agalactiae
MAWAIITPGAAISRKSMGLIKRRYEKITRRMAPVINPP

SEQ ID NO: 1111 - DNA, 774 bp, Streptococcus agalactiae
atgatgattaatccagtagcaatacgattaggccccttttctattcgctggtatgctatttgcatagtgtctggtatgttgttagcagtttacttagcaatgaaagaggcccctcgtaagaacattaagtcggatgatattctagatttcattctcatggcttttccactatccattgttggagctcgtatttattatgttatcttcgaatgggcttattactctaagcacccagtagagattatcgccatctggaatggcggtattgctatttacggagggttaattaccggggccattctccttgtgattttttcatatcgtcgcttgattaatcccattgattttctggatattgctgctccaggagtgatgattgcccaagccataggtaggtgggggaattttattaatcaagaagcatacggtagggcagtaaaaaatctgaattacgtaccaaactttataaaaaatcaaatgtatattgatggagcttaccgagtacctacatttttatatgagtctctttggaacttcctaggttttgtcatcatcatgtctattcgtcatcgaccgcgcactttaaaacaaggtgaagtggcatgtttttatttagtttggtatggatgtggacggttcattattgaagggatgaggacagatagcctttatttggcgggtttgcgcgtgtcacaatggttatcagttattttagttattatcggaattgtcatgattatttatcgtcgtcgtgaacaacatatttcatattat

SEQ ID NO: 1112 - protein, 258 aa, Streptococcus agalactiae
MMINPVAIRLGPFSIRWYAICIVSGMLLAVYLAMKEAPRKNIKSDDILDFILMAFPLSIVGARIYYVIFEWAYYSKHPVEIIAIWNGGIAIYGGLITGAILLVIFSYRRLINPIDFLDIAAPGVMIAQAIGRWGNFINQEAYGRAVKNLNYVPNFIKNQMYIDGAYRVPTFLYESLWNFLGFVIIMSIRHRPRTLKQGEVACFYLVWYGCGRFIIEGMRTDSLYLAGLRVSQWLSVILVIIGIVMIIYRRREQHISYY

SEQ ID NO: 1113 - DNA, 777 bp, Streptococcus pyogenes
atgatcaatcccattgccttaaaatgtggtccactagccatccactggtatgctctatgtatcttgtcaggacttgttttggcggtttacttagcatcaaaagaagcacccaaaaaaggaatatcatctgatgctattttcgattttattctgattgcttttccacttgctattgttggtgcaagaatttactatgttatttttgaatggtcttattatgtcaagcatttagatgaaatcatagccatttggaatggcggtattgctatttatggcggtctcattacaggagctcttgtacttttggcttactgttataacaaggtgctcaatcccattcattttttagatattgccgcaccaagtgtcatggtcgctcaagctatcggtcgctggggaaattttatcaaccaagaagcctatggtaaagctgtgagccagttaaattacttaccaagctttattcaaaagcaaatgtttatagagggaagttaccgcattccgacctttctctatgaatcactttggaatcttttgggctttgtcattattatgatgtggcgtcgtaagccaaaaagtctattagatggagaaatctttgcattttacttaatttggtatggtagtggaagactagtcattgaaggtatgcgaacagatagtcttatgtttttaggtattcgcatctcccaatatgtgtctgccttattaattattattggcttaatctttgttataaaaagacgtcgtcaaaaaggaatttcttattatcaagaa

SEQ ID NO: 1114 - protein, 259 aa, Streptococcus pyogenes
MINPIALKCGPLAIHWYALCILSGLVLAVYLASKEAPKKGISSDAIFDFILIAFPLAIVGARIYYVIFEWSYYVKHLDEIIAIWNGGIAIYGGLITGALVLLAYCYNKVLNPIHFLDIAAPSVMVAQAIGRWGNFINQEAYGKAVSQLNYLPSFIQKQMFIEGSYRIPTFLYESLWNLLGFVIIMMWRRKPKSLLDGEIFAFYLIWYGSGRLVIEGMRTDSLMFLGIRISQYVSALLIIIGLIFVIKRRRQKGISYYQE

SEQ ID NO: 1115 - DNA, 933 bp, Streptococcus agalactiae
atggcagttactgttcaaatgttagttgaccgcttaaagttaaatgtcatctatggtgatgaacatctattatctaagcggattacaacagctgacatttcacgtcctggtctagaaatgacagggtattttgattattatgcaccagagcgtttgcaacttgttggtatgaaagagtggtcatatttaatggctatgacaggacataatcgttatcaagtgttacgtgaaatgttccaaaaagaaacaccagctattgttgtagcacgtgatttagaaattccagaagagatgtatgaggcggctaaagataccggtattgctattcttcaaagtaaggcccctacaagtcgtttatcaggtgaagtttcttggtatttagattcttgcttagctgagaggacaagtgttcatggtgtcttgatggatatctatggtatgggtgttctgattcaaggtgattccggtattggtaagagtgagacaggactagagctagttaagcgaggacatcgtttggtagcagatgatcgtgttgatgtttatgctaaagacgaagagacgctttggggagagcctgctgagatattacgtcatttacttgaaattagaggtgtgggaatcattgatattatgagcctatatggagctagtgcggttaaagattcatcgcaagtgcaattagctatataccttgaaaactttgaaactggaaaagtttttgatagactcgggaatggcaatgaagagatcgaattatctggagttaaggttcctcggatacgtattcctgttaaaacaggccgaaacgtgtcagtagttattgaagcagcggctatgaatcacagagctaaacaaatggggtttgatgctacccagacttttgaggatcgtttaacacatttgattagtcagaacgaggtcaatgatgat

SEQ ID NO: 1116 - protein, 311 aa, Streptococcus agalactiae
MAVTVQMLVDRLKLNVIYGDEHLLSKRITTADISRPGLEMTGYFDYYAPERLQLVGMKEWSYLMAMTGHNRYQVLREMFQKETPAIVVARDLEIPEEMYEAAKDTGIAILQSKAPTSRLSGEVSWYLDSCLAERTSVHGVLMDIYGMGVLIQGDSGIGKSETGLELVKRGHRLVADDRVDVYAKDEETLWGEPAEILRHLLEIRGVGIIDIMSLYGASAVKDSSQVQLAIYLENFETGKVFDRLGNGNEEIELSGVKVPRIRIPVKTGRNVSVVIEAAAMNHRAKQMGFDATQTFEDRLTHLISQNEVNDD

SEQ ID NO: 1117 - DNA, 1023 bp, Streptococcus pyogenes
ttggtgtcgttgttctcatttagtagtgaaaaaatgagtatttgcaagggtctaacggtcgatttgtgttataatattgaaaaaggagaaattatgaccgttactgtaaagatgctagtgcaaaaagttaaacttgatgtggtttatgctacagataacttgctgtcaaaagagataacaacatcagatatttcacgtccaggtcttgaaatgactggttattttgattattatgctccagaaaggttgcagctatttggaatgaaagagtggtcttatcttacacagatgacttctcacaaccgttattctgttttaaaagagatgttcaaaaaggacactcctgcagtggttgtctctagaaatttagccattccaaaagaaatggttcaagctgcaaaagaagaaggtatttcacttttaagtagccgtgtttcaactagccgcttagctggagaaatgtcttattttcttgacgcttctttagctgaacgtactagtgttcacggcgttttaatggatatttatggtatgggggttcttatccaaggggattctggaattggtaaaagtgagactggtttagaattagttaagcgagggcatcgtttggttgcagatgaccgtgtggatgtctatgccaaagatgaagaaaccctttggggagagccagcagagatcttgcgccacttgcttgaaattcgtggggtaggtattattgatgtgatgtcgctttatggagctagtgctgtgaaggactcatcacaagttcaattggccatttaccttgaaaactttgaggctggtaaagtttttgatcgtctcggaaacggaaatgaggagataactttctcaggagtgagaatccctcgtattcgtattccggtaaaaacaggtcgaaatgtttcagtggttattgaagccgctgcgatgaatcatcgggctaaagaaatgggctttgatgctacaaaaacttttgaagatcgtttaactcaactaatcaccaaaaatgaggtgagtcaa

SEQ ID NO: 1118 - protein, 341 aa, Streptococcus pyogenes
LVSLFSFSSEKMSICKGLTVDLCYNIEKGEIMTVTVKMLVQKVKLDVVYATDNLLSKEITTSDISRPGLEMTGYFDYYAPERLQLFGMKEWSYLTQMTSHNRYSVLKEMFKKDTPAVVVSRNLAIPKEMVQAAKEEGISLLSSRVSTSRLAGEMSYFLDASLAERTSVHGVLMDIYGMGVLIQGDSGIGKSETGLELVKRGHRLVADDRVDVYAKDEETLWGEPAEILRHLLEIRGVGIIDVMSLYGASAVKDSSQVQLAIYLENFEAGKVFDRLGNGNEEITFSGVRIPRIRIPVKTGRNVSVVIEAAAMNHRAKEMGFDATKTFEDRLTQLITKNEVSQ

SEQ ID NO: 1119 - DNA, 183 bp, Streptococcus agalactiae
ttgaaacaagaagacaaggtcccagaagacgtaaagatgctgaacctgttgatgatgacggttggttctggtaattcatataaaggagatttgctagatgaatctccttttttcttagctttatttagaccactttttcaaaatatcttctttttttcagaaaaacgcgttagcgcttacttt

SEQ ID NO: 1120 - protein, 61 aa, Streptococcus agalactiae
MKQEDKVPEDVKMLNLLMMTVGSGNSYKGDLLDESPFFLALFRPLFQNIFFFSEKRVSAYF

SEQ ID NO: 1121 - DNA, 261 bp, Streptococcus agalactiae
atgaaatcaagcttctacaaacaacgaaaaggtaagttggtctgcggtgttgtcgccggtctagctgataagtataactgggatttagctctttcacgggtgttgattgcactgattttgtattttaccaaatttggtcttttgctatatattttattagctgttttcttaccctataaagaagatattattgaaacaagaagacaaggtcccagaagacgtaaagatgctgaacctgttgatgatgacggttggttctgg

SEQ ID NO: 1122 - protein, 87 aa, Streptococcus agalactiae
MKSSFYKQRKGKLVCGVVAGLADKYNWDLALSRVLIALILYFTKFGLLLYILLAVFLPYKEDIIETRRQGPRRRKDAEPVDDDGWFW

SEQ ID NO: 1123 - DNA, 270 bp, Streptococcus pyogenes
gtggaaactaaattctataaacagcgaaaaaatcgcttggttgcaggtgttattgctggtttagcagataagtatggttgggatcttgctctagcgcgtgtcttagcggctcttcttatttacggaactggttttggagttttgctttatattttgttggccatcttcttaccttacaaggaagacttgcttgaagaacgttatggccgaggtcctcgtcgtcgtaaagacgctgatgtcttaaatgaagaagaagatggttggttctgg

SEQ ID NO: 1124 - protein, 90 aa, Streptococcus pyogenes
VETKFYKQRKNRLVAGVIAGLADKYGWDLALARVLAALLIYGTGFGVLLYILLAIFLPYKEDLLEERYGRGPRRRKDADVLNEEEDGWFW

SEQ ID NO: 1125 - DNA, 2241 bp, Streptococcus agalactiae
ttgttagattataaaaacgctatcttgaaatcgctttttaaaactcttcgtaagtcaaaaatatgctataataaaagcgttatggaaaatttaaatattacacaaattgctattgatttaggtattaaagcgtcacaaatcgaaaaggttttagaattaacagatgaaggaaatactattccttttattgcccgttatcgtaaagaaatgacaggtaatttggatgaagttcaaatcaaatcaattattgaccttgataagagtatgacagctctttcagatcgtaaaactacggtcttagccaaaattgaagaacaaggaaagttgactcaagaactcaaaaaggctattgaagaagcaactaaactagcagatgttgaggaactctacctaccttataaagaaaaacgtcgtacgaaagctacgattgcacgtgaagcaggtctttttcctttagcacgtcttattttacaaaataaggataaccttgaggaagaagctcaaaactatcttacagatggttttgagacaactacgaaggcactttctggagcagtagatattcttatcgaagctttttctgaggataataaattacgttcatggacatataatgagatctggaactacagctcaatcactgcagttgttaaagatgagtcacttgatgaaaaacaggtcttcaaaatctactatgacttttctgaaaaaataagtaaactccatggctatcaagttttagcattgaatcgtggtgagaaaatgggtgttcttaaggttaattttgagcataaccttgaaaaaatgtttcgcttttttgctgttcgatttaaagaaactagccaatatatagatgaccttattgtacagactgtcaagaaaaaaatcgttccagctatggaacgccgtatccgtacagaactaagtgaaggagcagaagatggtgcaatttcactgttttcagagaatcttcgtaacttattgttagtctcaccgcttaaggggaaaatggtgttaggttttgaccctgcctttcgtacaggagcaaaattagcagtagtagaccaaactggaaaattaatgacaacacaagtgatttatccagttcctccagctaatcaagcaaaaatcgaacaatcaaaaatagagttagcaaaacttatcaaagaattcaatatagaaattattgctatagggaatggaacagcgagtcgtgaatcagaagcatttgttgcagaagttttacaagattttccagacgtatcctatgtgattgttaacgaaagtggtgcctctgtttattcagcctcagaattggcacgtcatgaatttccagacttaacggttgaaaaacgttcggccatctcaattgcaagacgtctgcaagacccattagcagaactagtcaaaattgatccaaaatctattggtgtgggtcaatatcaacatgatgttagccaaaaaaaattagcagaaaatcttgattttgttgttgaaactgtagttaaccaagtaggtgttaatgttaatacagcaagtccagccttgttagctcatgtttcaggtttaaataaaacaatatctgaaaatattgttaaatatcgtgaagagaatgggcaaattaagtcacgtgctgaaattaagaaagtgcccagattaggagcaaaagcttttgagcaagctgctggattcttacgtattcctaatgctaaaaatttcttggataatacaggtgttcaccctgagtcttatgaagctgttaaaaagttgcttgaccaactgactatcaaagaattagatgatcttgctaaagagaagttacaaaaccttgacttaattgcaacagcagaaagtattggggtaggtcaagaaacattaaaagacattatagaagatcttttgaaaccaggtcgtgatttgcgtgatgattttgaagcgcctgttttgagacatgatgttttagatgtcagtgatttaaaagttggacaggaattgcaaggaactgttcgaaacgtcgttgattttggtgcttttgttgatattggtgttcatgaagatggtctaatccaccagtctcgccttattaagcgaaaacgcgataaaaaaactagaaaaatgcctcctttacaacatccaagcaaatatctctctgttggtgatattgtaactgtttgggttgtagaggtagatgcggagcgtagcagaattggacttagtcttatcaagccagacggacttgac

SEQ ID NO: 1126 - protein, 747 aa, Streptococcus agalactiae
MLDYKNAILKSLFKTLRKSKICYNKSVMENLNITQIAIDLGIKASQIEKVLELTDEGNTIPFIARYRKEMTGNLDEVQIKSIIDLDKSMTALSDRKTTVLAKIEEQGKLTQELKKAIEEATKLADVEELYLPYKEKRRTKATIAREAGLFPLARLILQNKDNLEEEAQNYLTDGFETTTKALSGAVDILIEAFSEDNKLRSWTYNEIWNYSSITAVVKDESLDEKQVFKIYYDFSEKISKLHGYQVLALNRGEKMGVLKVNFEHNLEKMFRFFAVRFKETSQYIDDLIVQTVKKKIVPAMERRIRTELSEGAEDGAISLFSENLRNLLLVSPLKGKMVLGFDPAFRTGAKLAVVDQTGKLMTTQVIYPVPPANQAKIEQSKIELAKLIKEFNIEIIAIGNGTASRESEAFVAEVLQDFPDVSYVIVNESGASVYSASELARHEFPDLTVEKRSAISIARRLQDPLAELVKIDPKSIGVGQYQHDVSQKKLAENLDFVVETVVNQVGVNVNTASPALLAHVSGLNKTISENIVKYREENGQIKSRAEIKKVPRLGAKAFEQAAGFLRIPNAKNFLDNTGVHPESYEAVKKLLDQLTIKELDDLAKEKLQNLDLIATAESIGVGQETLKDIIEDLLKPGRDLRDDFEAPVLRHDVLDVSDLKVGQELQGTVRNVVDFGAFVDIGVHEDGLIHQSRLIKRKRDKKTRKMPPLQHPSKYLSVGDIVTVWVVEVDAERSRIGLSLIKPDGLD

SEQ ID NO: 1127 - DNA, 2130 bp, Streptococcus pyogenes
atggaaaataacaataatcacaacattgcagaggctttgtcagttagtctccatcaaattgaacaggtgcttgccctaacagcacaaggcaataccattccctttattgcacgttaccgtaaagaagtaacaggaaatctagatgaagtggtgattaagtccattattgatatggataagtctctcactaccctgaatgagcgcaaagcaaccattctcgctaaaattgaggaacagggaaaactgacagatcagttacgaacgagtattgaagcaaccgagaaactcgctgatttggaagagttgtacctgccttataaggaaaaacgccgtacaaaagcgacgattgcgcgtgaagcaggcttgttcccattagcacgtttgattttacaaaatgcgcaaaaccttgaaacagcagcagaaccctttgtcacagaaggatttgccagcccacaagaagctctagcaggagctgtggacatccttgtggaggccatgtcagaagatgctaaattacgctcttggacctacaatgagatttggcagtacagccgcttagtatcaacgcttaaagatgagcagttggatgagaaaaaggttttccaaatctattacgatttttctgaccaagtgtctaacatgcaaggatatcgtactttagcccttaaccgtggcgaaaagttaggcatcttaaaagtgtcttttgagcataacttggagaaaatgcaacgctttttcagtgtgcggttcaaagaaaccaacccttatattgaagaggtcatcaatcagaccatcaaaaagaaaattgttccagctatggaaagacgggttcgttcagaactcagtgatgccgcagaagatggggctatccacctcttttctgaaaatctccgtcatcttttgttagtgtctcctttaaaagggaaaatggttcttgggtttgaccctgcctttcgaacaggtgcaaaattggctatcgttgatcagactggaaaattgttgactactcaggttatttatcccgtagcaccagctagccaaacgaagattcaagcagctaaagaaacactgactcagctcattgagacttaccagattgatattattgccattggaaacggaacagccagtcgggaaagtgaagcctttgtagcagacgttttgaaagatttcccaaatacgtcctatgtcatcgttaacgaaagcggtgcttctgtttattcagcgtcagagttagcccgccatgagtttccagacctcacagtggagaagcgctctgctatttctattgctcgtcgcttgcaagacccactcgcagaattggttaaaattgatcctaaatctattggcgtcggtcagtaccagcacgatgtgagtcagaaaaagttgagtgagaatcttggttttgttgtggatactgtggttaaccaagtcggtgttaatgtgaacacggctagtccatctttattagcacatgtgtcaggtttgaacaaaacgatttcagaaaatattgtcaaataccgcgaagaaaatggagcactgacatcacgcgctgacatcaaaaaagtgccgcgtttaggagccaaggcgtttgagcaagcagcaggttttctcagaattccaggagccaaaaatattttagacaacacaggagttcaccccgagtcctacccagcagtcaaagaactctttaaggtacttggtattcaggacttggacgacgctgccaaggcaactttagcagcagttcaagttccccaaatggcagaaacattggctattgggcaggaaacccttaaagatatcattgctgatctccttaaaccgggtcgtgaccttcgtgatgactttgaagcaccaatcttacgtcaagatatccttgatttgaaagatttggaaattggccagaagcttgaaggaactgtgagaaacgtcgttgactttggtgcttttgtagacattggtgttcatgaagatgggcttattcacatttctgaaatgagcaaaacctttgtcaaccaccctagtcaagttgtttcagtgggtgacttggtaactgtttgggtctctaagattgacttggaccgccacaaggtcaatctcagcctattgccaccgcgtgacactcac

SEQ ID NO: 1128 - protein, 710 aa, Streptococcus pyogenes
MENNNNHNIAEALSVSLHQIEQVLALTAQGNTIPFIARYRKEVTGNLDEVVIKSIIDMDKSLTTLNERKATILAKIEEQGKLTDQLRTSIEATEKLADLEELYLPYKEKRRTKATIAREAGLFPLARLILQNAQNLETAAEPFVTEGFASPQEALAGAVDILVEAMSEDAKLRSWTYNEIWQYSRLVSTLKDEQLDEKKVFQIYYDFSDQVSNMQGYRTLALNRGEKLGILKVSFEHNLEKMQRFFSVRFKETNPYIEEVINQTIKKKIVPAMERRVRSELSDAAEDGAIHLFSENLRHLLLVSPLKGKMVLGFDPAFRTGAKLAIVDQTGKLLTTQVIYPVAPASQTKIQAAKETLTQLIETYQIDIIAIGNGTASRESEAFVADVLKDFPNTSYVIVNESGASVYSASELARHEFPDLTVEKRSAISIARRLQDPLAELVKIDPKSIGVGQYQHDVSQKKLSENLGFVVDTVVNQVGVNVNTASPSLLAHVSGLNKTISENIVKYREENGALTSRADIKKVPRLGAKAFEQAAGFLRIPGAKNILDNTGVHPESYPAVKELFKVLGIQDLDDAAKATLAAVQVPQMAETLAIGQETLKDIIADLLKPGRDLRDDFEAPILRQDILDLKDLEIGQKLEGTVRNVVDFGAFVDIGVHEDGLIHISEMSKTFVNHPSQVVSVGDLVTVWVSKIDLDRHKVNLSLLPPRDTH

SEQ ID NO: 1129 - DNA, 1041 bp, Streptococcus agalactiae
atgattgaattaggtattacaacattcggagagacaacaatccttgaagaaacaaaccaaagctattcacatcctgagaggattcgccaattagttgctgagattgaactagctgatcaagttggtttagatgtatatggtattggagagcaccatcgtgaagattttgcggtctctgcacccgaaattgtcctagcagcaggagcggttagaactaataatatccgtttatctagtgcagtaacgattctctcttccaatgatcctattcgcgtctaccagcaattttcaacgattgacgcactttcaaatggtagagcagaaattatggcagggcgtggttcctttattgagtcttttccattgtttggatacgatttagcggattatgatgatttatttaatgaaaaaatggatatgttgttagcaattaactcagcgacaaatctcgattggaaaggtcatttgacacaaacagttaatgagcgaccaatttatccaagagcattacagagacagttaccaatatgggtggcaacaggaggaaatgttgattctacaattcgtattgcagaacaaggtttgccaattgtttatgcaactattggtgggaatcccaaagcatttcgtcaattggtccatatttataaagaagttggtagtcgtaatggacacaaaccagaacaactaaaagttgctgctcactcttggggatggattgaagaggataatcaaaccgctattgaccgttattttttccctacgaaacagaccgtcgataatattgctaagggacgccctcattggtctgaaatgaccaaagagcagtatttacgttcagtaggtccagaaggtgctatttttgtaggaagtcctgaagtggttgcacataaaattataggacttgttgaagcacttgagttagaccgttttatgttacatctaccagttggctctatgcctcacaaagacgtcctaaatgctatcaaactttatggtaaggaagtagcaccaattgttcgaaaatattttgaaaagaat

SEQ ID NO: 1130 - protein, 347 aa, Streptococcus agalactiae
MIELGITTFGETTILEETNQSYSHPERIRQLVAEIELADQVGLDVYGIGEHHREDFAVSAPEIVLAAGAVRTNNIRLSSAVTILSSNDPIRVYQQFSTIDALSNGRAEIMAGRGSFIESFPLFGYDLADYDDLFNEKMDMLLAINSATNLDWKGHLTQTVNERPIYPRALQRQLPIWVATGGNVDSTIRIAEQGLPIVYATIGGNPKAFRQLVHIYKEVGSRNGHKPEQLKVAAHSWGWIEEDNQTAIDRYFFPTKQTVDNIAKGRPHWSEMTKEQYLRSVGPEGAIFVGSPEVVAHKIIGLVEALELDRFMLHLPVGSMPHKDVLNAIKLYGKEVAPIVRKYFEKN

SEQ ID NO: 1131 - DNA, 135 bp, Streptococcus agalactiae
gtgccattaatggctattacgcacaaacgtcaagatgacttagaaagtatgttcgctagttttgctaaagtaccaaaacctaaaaaagttgattctgattcaaaacctgaacagaaagatgattctcagaaagat

SEQ ID NO: 1132 - protein, 45 aa, Streptococcus agalactiae
MPLMAITHKRQDDLESMFASFAKVPKPKKVDSDSKPEQKDDSQKD

SEQ ID NO: 1133 - DNA, 153 bp, Streptococcus pyogenes
atggcaattacccataaaaaaaatgatgaacttgaaaaaatgctagcaggctttgcatcaatccctagttttgataagcctttggaagtcaatactgatggtaaactagcgaccaaagaaaaaacgacagaacaaacaaaaccaagcaaacca

SEQ ID NO: 1134 - protein, 51 aa, Streptococcus pyogenes
MAITHKKNDELEKMLAGFASIPSFDKPLEVNTDGKLATKEKTTEQTKPSKP

SEQ ID NO: 1135 - DNA, 240 bp, Streptococcus agalactiae
gtgtatgaaggcactttcttttcaaggaatcgattaataataggaatgataccacattcgcaagaaggaaagacaaagccaacgaaggttccaaataagactctgagaaatttatttttcggtaagaacttattgactatatcaggtgttataaagacttcaataattcctgataaaatagttccaagcaaaacaaaaggaagtgcctcaataataatggaaatgaaaatggcaaaccat

SEQ ID NO: 1136 - protein, 80 aa, Streptococcus agalactiae
MYEGTFFSRNRLIIGMIPHSQEGKTKPTKVPNKTLRNLFFGKNLLTISGVIKTSIIPDKIVPSKTKGSASIIMEMKMANH

SEQ ID NO: 1137 - DNA, 900 bp, Streptococcus agalactiae
atggatatctttaatcaattaccggatagtgtccttcaatggtttgccattttcatttccattattattgaggcacttccttttgttttgcttggaactattttatcaggaattattgaagtctttataacacctgatatagtcaataagttcttaccgaaaaataaatttctcagagtcttatttggaaccttcgttggctttgtctttccttcttgcgaatgtggtatcattcctattattaatcgattccttgaaaagaaagtgccttcatacacggcagttccgtttcttgctactgcccctattattaatcctattgttttatttgcgacctactcagcatttggaaattccatacgcttcctgatattacgctttgtaggtgctaccattgtagccattgctttaggagtcatgcttgcctttttagtagatgataatattctaaaagaagacgctaaacctactcattttcatgattattctgataagaagtggtatcaaaaaatctttctagccttagctcatgccatcgatgaattttttgatacaggacgctatctagtatttggtactttaattgcttcagctatgcaaatttatttaccaactcgagttcttactactatcggacatagccctatcacagccatcttagttatgatgttgcttgctttcatcttgtcattgtgtagtgaagctgacgcttttataggtgcttctttattatcaacctttggaatcgcgccagtgatggctttccttttaattggacccatgattgatattaagaatttaatgatgatggtaaattcttttaaaacaaggtttattgtccaattcattagtgtatcttctcttattattattatctattgtttatttgtgggggtaata

SEQ ID NO: 1138 - protein, 300 aa, Streptococcus agalactiae
MDIFNQLPDSVLQWFAIFISIIIEALPFVLLGTILSGIIEVFITPDIVNKFLPKNKFLRVLFGTFVGFVFPSCECGIIPIINRFLEKKVPSYTAVPFLATAPIINPIVLFATYSAFGNSIRFLILRFVGATIVAIALGVMLAFLVDDNILKEDAKPTHFHDYSDKKWYQKIFLALAHAIDEFFDTGRYLVFGTLIASAMQIYLPTRVLTTIGHSPITAILVMMLLAFILSLCSEADAFIGASLLSTFGIAPVMAFLLIGPMIDIKNLMMMVNSFKTRFIVQFISVSSLIIIIYCLFVGVI

SEQ ID NO: 1139 - DNA, 900 bp, Streptococcus pyogenes
atgtcactcttttccaaccttcctcccagtgtcttgcaatggtttgcgatttttatgtccattatcattgaagctcttccttttgtgctcctaggaactattttatctggttgtattgaagtctttgtaacgccagaattggttcaaaaatacctacctaagcaaaaatgcttgcgcattctgtttggaacctttgttggatttgtttttccttcttgtgaatgcgggattattcccatcatcaaccgctttttggaaaaaaaggtgcctagttatacggccgtcccttttctggcaacagcgcctatcattaatcctattgttttgttcgctacttattctgcttttgggaattctttgcgctttctgatacttcgcttggtcggtgctgcactagtagccattacacttggggtaatgttagcttttattgtagatgataacattctcaaggataatgctcaacccgtgcattttcatgattattctcatgaaagcttgccaaaacgcatttatctagcactggtacatgctattgatgaattcttcgacaccggtaggtatctcgtatttggaaccttgattgcctctgccatgcaaatatatgtcccaactcgtgtgttgacaacgattgggcacaatcccttgacagccattttgatcatgatgctgatggctttcattctatcattatgtagtgaagccgatgcctttatcggagcttccttattatccacctttggagtggctccagttcttgcctttcttttaattggtcctatggtggatattaaaaaccttatgatgatggtaaaggcttttaaaggacgcttcattgtccaatttatcggcgtatccgttcttatgattgccgtttattgtttacttgtgggggtgctc

SEQ ID NO: 1140 - protein, 300 aa, Streptococcus pyogenes
MSLFSNLPPSVLQWFAIFMSIIIEALPFVLLGTILSGCIEVFVTPELVQKYLPKQKCLRILFGTFVGFVFPSCECGIIPIINRFLEKKVPSYTAVPFLATAPIINPIVLFATYSAFGNSLRFLILRLVGAALVAITLGVMLAFIVDDNILKDNAQPVHFHDYSHESLPKRIYLALVHAIDEFFDTGRYLVFGTLIASAMQIYVPTRVLTTIGHNPLTAILIMMLMAFILSLCSEADAFIGASLLSTFGVAPVLAFLLIGPMVDIKNLMMMVKAFKGRFIVQFIGVSVLMIAVYCLLVGVL

SEQ ID NO: 1141 - DNA, 111 bp, Streptococcus agalactiae
ttggcagagactgtggttgagtctaaactaactgtaggtactaacaaacctactaaaacgggaaatactaaaatcattgggcttgttgatttagctattttaccatgtagg

SEQ ID NO: 1142 - protein, 37 aa, Streptococcus agalactiae
MAETVVESKLTVGTNKPTKTGNTKIIGLVDLAILPCR

SEQ ID NO: 1143 - DNA, 834 bp, Streptococcus agalactiae
ttgtttatttgtgggggtaatataatgattcgatttcttattcttgctggttattttgaattaagcatgtatttaaagttatcaggtaaactaaatcagtatattaatactcattatacctatttggcctatatttcaatggtcctatcttttattttagcaattgtacagctaattatttgggttaaaaatatgaaaatgcatagtcacctacatggtaaaatagctaaatcaacaagcccaatgattttagtatttcccgttttagtaggtttgttagtacctacagttagtttagactcaaccacagtctctgccaagggatataatttccctctagcagccggctctactggtactgtaagtcaagatgggacacgcgttcaatatttgaaaccagataccagcacttattttacttcttcagcctatgaaaaagaaatgcaaaaagagcttaaaaaatataaaggctctggtacattaaccatcacaactgaaaattacatggaagttatggaactaatttatctctatcccgagcaattcatggatcgccaaatacaatatactgggtttgtttataacgaacccaaacacgaaggatatcaatttattttccgctttggaatcattcattgtattgccgattcaggagtttatggtctactaacgactggaaatcaaaaaagttatccggacaatacttgggtaactgttagaggtacaattaaatccgagtataatcaattgttacaacaaaacttaccagtcttacacattgaagagtctcgtcaagtttctaaagctaataatccttatgtttatcgtgtcttt

SEQ ID NO: 1144 - protein, 278 aa, Streptococcus agalactiae
MFICGGNIMIRFLILAGYFELSMYLKLSGKLNQYINTHYTYLAYISMVLSFILAIVQLIIWVKNMKMHSHLHGKIAKSTSPMILVFPVLVGLLVPTVSLDSTTVSAKGYNFPLAAGSTGTVSQDGTRVQYLKPDTSTYFTSSAYEKEMQKELKKYKGSGTLTITTENYMEVMELIYLYPEQFMDRQIQYTGFVYNEPKHEGYQFIFRFGIIHCIADSGVYGLLTTGNQKSYPDNTWVTVRGTIKSEYNQLLQQNLPVLHIEESRQVSKANNPYVYRVF

SEQ ID NO: 1145 - DNA, 837 bp, Streptococcus pyogenes
ttgtttacttgtgggggtgctctaatgattcgctttttaattttagctggctattttgaactaaccatgtatctccagctgtctggcaaactggatcagtacatcaatgttcggtattcttaccttgcttatatttccatgattttatctttcattttagctcttgttcaactctatacctggatgaaaaacattaaggtacatagccatttaacaggaaaaatcgcaaggctgacgagtccttttatcttggtctttcctgttttgattggtctccttgtgccgaccgtgaccttagattccaccacggtttctgctaaaggctatactttcccattggctgcgggagcctctaaaacgggagtcagtgatgacggtaccaccattcaatacctcaaacctgataccagcctttactttacaaagtctgcctaccaaaaggagatgcgtcaagaactccataaatataaaggcaagaaaccggtcaccattaccactgaaaattatatggaagtgatggaattgatctatctctacccagatgagtttcttgatcgtgacatccaatacactggctttgtttataacgaaccgggccatgacaactaccaattccttttccgcttcggcattattcactgtattgccgactcaggagtgtacggacttttgaccacaggtaatcaaaccagctaccctaacaacacatggctaacagttaaaggtcgccttcatatggaatatgataaaaacttagaacaacatctacctgtccttcaacttgctgaggttcatcaaaccaaagaacctaataatccttatgtttaccgcgttttt

SEQ ID NO: 1146 - protein, 279 aa, Streptococcus pyogenes
LFTCGGALMIRFLILAGYFELTMYLQLSGKLDQYINVRYSYLAYISMILSFILALVQLYTWMKNIKVHSHLTGKIARLTSPFILVFPVLIGLLVPTVTLDSTTVSAKGYTFPLAAGASKTGVSDDGTTIQYLKPDTSLYFTKSAYQKEMRQELHKYKGKKPVTITTENYMEVMELIYLYPDEFLDRDIQYTGFVYNEPGHDNYQFLFRFGIIHCIADSGVYGLLTTGNQTSYPNNTWLTVKGRLHMEYDKNLEQHLPVLQLAEVHQTKEPNNPYVYRVF

SEQ ID NO: 1147 - DNA, 1608 bp, Streptococcus agalactiae
atgggattatttgaccgcctatttggacataagaaaaaagataaagaaccagaaattgaagcatcagaatctgttgttttagaagatgaagattcagttattgataaagaggagggcagcaacttttcgaaggagtcaactttgaatcgaacctctgaagtccctgttgcagaagatgattctttcttagaattagaaagagatacagcattgtcagaatcacatcaaccagttacctctgaaattcatcctttagagtcagaagataccgatgaaattcctgtaaaagaagacgatagttttttagaactagaagatagggctaagacaaaggtagcagatacttctgaggtagaaaatgtagttcctgattccacgactctttctgacaatgtttctgctaaatctgaggcatcttttagtgataaggagcaattaagtgatagtcaggcttcagatcagttttcagaaactccccttcaagaagagatgtctagtggaaaaactgaggtacaaacagagtcagaggatacatctgcggctgatgcttttttagcagattactatgctaaacgtaaagcaattgagaaagaaatctcgtctaattcgctgtcaacagatgagtcagaattttctgaggcacaggaagttttatcgcaatcacaggcagacactataaaagctgagagtcaagaggaaaaatataatcgtagcctgaaaaaaacacgcacaggttttagtgcacgccttaatgctttcctttctaacttccgtcgtgttgacgaagagttctttgaagaattagaagaaatgttaatcttatctgacgttggggtaaatgttgcaacacagttaaccgaagatcttcgttatgaagcaaaattagagaatgccaagaaatcagaggatttaaaacgtgttatcgttgaaaaattagttgaaatctacgaaaaagatggtatttataatgaggctatcaatttccaagaaggtttaaccgtaatgctttttgtaggtgttaatggtgttggaaaaacgacatctataggtaagttagctcatcaatacaagtctcaagggaaaaaagttatgttagtagcagctgatactttccgtgcaggtgctgtggctcaactagtagaatggggacgccgtgttgatgtaccagttgtcactggagaagaaaaagcagatccggctagcgttgtctttgatggcatggaaaaagccgttgctcaaggcgttgatgtcttgttaattgatacagcaggacgtctgcaaaataaagaaaaccttatggcagagttggaaaaaattggacgtattattaagcgtgtcgtacctgatgctccccacgaaactttgcttgctttagatgcatctacaggacaaaatgctttaagtcaagctaaagagttctcgaaaattacaccattaactggccttattctgactaaaattgatggtactgctaagggtggtgtggtactggctattcgtcaagaactagatattcctgttaaattcattggtttcggcgaaaaaatcgatgatattggtgaatttaattcagaagatttcatgcgtggccttctggaaggaatttta

SEQ ID NO: 1148 - protein, 536 aa, Streptococcus agalactiae
MGLFDRLFGHKKKDKEPEIEASESVVLEDEDSVIDKEEGSNFSKESTLNRTSEVPVAEDDSFLELERDTALSESHQPVTSEIHPLESEDTDEIPVKEDDSFLELEDRAKTKVADTSEVENVVPDSTTLSDNVSAKSEASFSDKEQLSDSQASDQFSETPLQEEMSSGKTEVQTESEDTSAADAFLADYYAKRKAIEKEISSNSLSTDESEFSEAQEVLSQSQADTIKAESQEEKYNRSLKKTRTGFSARLNAFLSNFRRVDEEFFEELEEMLILSDVGVNVATQLTEDLRYEAKLENAKKSEDLKRVIVEKLVEIYEKDGIYNEAINFQEGLTVMLFVGVNGVGKTTSIGKLAHQYKSQGKKVMLVAADTFRAGAVAQLVEWGRRVDVPVVTGEEKADPASVVFDGMEKAVAQGVDVLLIDTAGRLQNKENLMAELEKIGRIIKRVVPDAPHETLLALDASTGQNALSQAKEFSKITPLTGLILTKIDGTAKGGVVLAIRQELDIPVKFIGFGEKIDDIGEFNSEDFMRGLLEGIL

SEQ ID NO: 1149 - DNA, 1548 bp, Streptococcus pyogenes
atgggattatttgatcgtttatttgggaaaaaagaaaccccgaaggtagctgaggaaaagttagaagaaaatcttttgacagaaacaactcagaaagaggagctttctgaaaaagccaatgagcaagacaagattgaggcggttcaacaagaggacgtttcttcagagggcgcaggttcggtggaaaatggtcccgaagcagcttcagtaaacgcactggttgaggaagaaacaggtgacaatagtaatcatccatcagaagataccaatgagtttgctgccgacaaaacagaccttaaggtaagtgaacttagtcaatctacggcatcagaaccaaaagaccttgttgaccagccagttgtggaacagtttccaacaaaacaagcccaagctgatgcctcaaatgattcggcgaatgaagaagcagtagacacttcaaaagagcaatccagtagccaacaggttatggaagactactaccgtcgtaaggctgctcttgaaaaaagccttcaagaaaaagcagcggcaacggttccagtgatgccagaagaagttccacaagaaaatcaggcctctacctcagcagaagcttctcaaaacaaggcaacccacgataccattcctgagacagatcaagaaaaatacaagcgtagcttgaaaaaaacgcggactggcttctcagctcgtctgaacagtttctttgccaatttcaggcgagtggatgaagaattctttgaagacttggaagaaatgctgatcttatcagatgtcggtgtacatgtggcgacaactttgacagaggagttgcgttatgaagccaaactggaaaatgcgaaaaaaccagatgccttgaaacgtgtgattgtggaaaaattggtagatatctatgaaaaagatgggcgttataatgaagccattaattatcaagatggcttgacggttatgctttttgtaggtgttaacggggttggtaaaacgacttcaatcgggaagctggcttaccgttacaaacaagaaggtaaaaaagtcatgttggtggcagcagataccttccgagcaggggctgtggctcagctagtcgaatggggacgccgagtagatgtgccagtcattactggccctgaaaaggctgatccagcgtctgttgtttttgacgggatggaaaaagctgtggcaaaaggtgtagatattctcctgattgacacggctggtcgcctgcaaaacaaagaaaatctcatggcagagctggaaaaaatgggtcgtatcattaagcgcgtgctaccagatgcccctcatgaaacgcttttggccttagatgcgtcaacaggacaaaatgcgcttagccaagccaaggaattttcaaaaataacaccattaacaggtttgattttaacgaaaattgatggcacggccaaaggtggtgtagtcctagccatccgtcaagaattagacattccagtcaagtttatcggatttggtgaaaaagtggatgatattggagaattccactcagaagactttatgaaaggccttttggaaggtatctta

SEQ ID NO: 1150 - protein, 516 aa, Streptococcus pyogenes
MGLFDRLFGKKETPKVAEEKLEENLLTETTQKEELSEKANEQDKIEAVQQEDVSSEGAGSVENGPEAASVNALVEEETGDNSNHPSEDTNEFAADKTDLKVSELSQSTASEPKDLVDQPVVEQFPTKQAQADASNDSANEEAVDTSKEQSSSQQVMEDYYRRKAALEKSLQEKAAATVPVMPEEVPQENQASTSAEASQNKATHDTIPETDQEKYKRSLKKTRTGFSARLNSFFANFRRVDEEFFEDLEEMLILSDVGVHVATTLTEELRYEAKLENAKKPDALKRVIVEKLVDIYEKDGRYNEAINYQDGLTVMLFVGVNGVGKTTSIGKLAYRYKQEGKKVMLVAADTFRAGAVAQLVEWGRRVDVPVITGPEKADPASVVFDGMEKAVAKGVDILLIDTAGRLQNKENLMAELEKMGRIIKRVLPDAPHETLLALDASTGQNALSQAKEFSKITPLTGLILTKIDGTAKGGVVLAIRQELDIPVKFIGFGEKVDDIGEFHSEDFMKGLLEGIL

SEQ ID NO: 1151 - DNA, 822 bp, Streptococcus agalactiae
atgtcggatattaaaatacttgccttagatttagatggcactttatttacaacagataagaaagtttcagaagaaaataaagtggccttaaaagcagctagagaaaaaggtataaaagttgttattacaacagggcgtcctttaaaagcaattggtaatttgttagaggacctagagttagtatctgatgaagattacagcattacttttaacggtggtttagttcaacaaaatacagggaaaatcttagctaaaactgcaatgacacgacaagaagtggaagatatccatgaggagttgtatcaagtgggtttgccaacagatatcttaagtgagggaacggtatatagtatcgctaacaagggacaccattctcaatatcatttagccaacccgctcttagaatttatagaagttgatgatttagagcaagtgccaaaggatgtagtttataataaaattgttagtgttattgatgctacatatcttgatcaacaaattgctaaacttcctgatagacttaaagttgactatgaaatgtttaaatcacgtgatatcattttagaattgatgcctaaaggtgttcataaagcagtcggcttagaactactgacaaaacaccttgggttagatagtagtcaagttatggcaatgggagatgaagcaaatgatttatcaatgctagagtgggcaggcttaggagttgcaatggctaatggtattccagaagctaaggcaatagcaaaagcgacaactatttgtaataacgatgagtctggagtcgccgaagcaattgggaaatatattttaagtgaggaaaat

SEQ ID NO: 1152 - protein, 274 aa, Streptococcus agalactiae
MSDIKILALDLDGTLFTTDKKVSEENKVALKAAREKGIKVVITTGRPLKAIGNLLEDLELVSDEDYSITFNGGLVQQNTGKILAKTAMTRQEVEDIHEELYQVGLPTDILSEGTVYSIANKGHHSQYHLANPLLEFIEVDDLEQVPKDVVYNKIVSVIDATYLDQQIAKLPDRLKVDYEMFKSRDIILELMPKGVHKAVGLELLTKHLGLDSSQVMAMGDEANDLSMLEWAGLGVAMANGIPEAKAIAKATTICNNDESGVAEAIGKYILSEEN

SEQ ID NO: 1153 - DNA, 822 bp, Streptococcus pyogenes
atgaatattagaattttggcgcttgatttagacggtaccctctacaacactgaaaaaattgtcacagatgccaataaaaaagccttagcagcggctagagaaaaaggggttaaggtggttattaccacaggtcgccctctaaaggccatcggtaacttgctagaagagttggacttgcttgaccacgatgactacagtattacctttaatggggggttggttcagcgaaatacaggggaggttttggataagagttctctcagttttgaccaggtttgccagattcagcaagctttagaggcggttggcttaccaacagatattatcagtggtggggatgtgtatagcattccaagtaaggacggtaggcattcgcagtaccatctagctaacccactgttgacctttattgaggtgacatctgtagcggaactaccaaaagacattacctataacaaaattgtgacagtcaccgatccagactttttggatcagcagattataaagctatccccaagcttatttgaggattttgaagcctttaaatcacgagatattatttttgaaatcatgccaaaaggcattgataaagcttttggattaaacttgctttgtcagcaccttggccttgatgctagacatgtcatggctatgggagacgaagctaacgactttgcgatgttagaatgggcaggacttggagtagctatggctaatggtgtttcaggagctaaagccgatgccgatgccgtgaccaccttgaccaatgatgagtctggagttgcagaagctgtgaagacatttattttagaagaggagagt

SEQ ID NO: 1154 - protein, 274 aa, Streptococcus pyogenes
MNIRILALDLDGTLYNTEKIVTDANKKALAAAREKGVKVVITTGRPLKAIGNLLEELDLLDHDDYSITFNGGLVQRNTGEVLDKSSLSFDQVCQIQQALEAVGLPTDIISGGDVYSIPSKDGRHSQYHLANPLLTFIEVTSVAELPKDITYNKIVTVTDPDFLDQQIIKLSPSLFEDFEAFKSRDIIFEIMPKGIDKAFGLNLLCQHLGLDARHVMAMGDEANDFAMLEWAGLGVAMANGVSGAKADADAVTTLTNDESGVAEAVKTFILEEES

SEQ ID NO: 1155 - DNA, 795 bp, Streptococcus agalactiae
atgataaaattagtagcaaccgatatggacggtacattcttagatgaaaacggtacctatgataaaaaacgtttagcaaatgtgctaaaaaaatttaaagaacaaggaattgtctttacggcagcaagtgggcgttccttattatcacttgaacaattatttgctgactttcgtgatcagatggcttttatagcagaaaacggaagtgcagcagtcttatttaatcgcttggcatatgaacagcacttgagtcgagaacaatacttagatattattgaccatttgagtaagagcccttatatggagaataatgaatatgtcttatctggcaaggatggtgcatatattctaagtgatgccaatccagattatattgaattcatcactcattattatgataatttgcaaaaagtttctcactttgaagatgttgatgatattattttcaaagtaacggctaactttactgaagagactgttagacaagctgaggagtgggtaaatcaagctataccgtatgccacagcagtgacaacaggttttaaatccattgatattattctaagctcagttaataaacgaaatggtttagagcacctctgtgaacaatacggtattagagcagaagaagtcttatcttttggtgacaatattaatgatttagaaatgctagagtggtcaggaaaagctatcgcaacagaaaatgctagaccagaagttaaagagatagcagattgtattataggtcatcacaataatcaagctgtaatggcttatttagaaagtatggtggat

SEQ ID NO: 1156 - protein, 265 aa, Streptococcus agalactiae
MIKLVATDMDGTFLDENGTYDKKRLANVLKKFKEQGIVFTAASGRSLLSLEQLFADFRDQMAFIAENGSAAVLFNRLAYEQHLSREQYLDIIDHLSKSPYMENNEYVLSGKDGAYILSDANPDYIEFITHYYDNLQKVSHFEDVDDIIFKVTANFTEETVRQAEEWVNQAIPYATAVTTGFKSIDIILSSVNKRNGLEHLCEQYGIRAEEVLSFGDNINDLEMLEWSGKAIATENARPEVKEIADCIIGHHNNQAVMAYLESMVD

SEQ ID NO: 1157 - DNA, 795 bp, Streptococcus pyogenes
atgataaaactaatagcaacagatatggatggtactttcctagctgaagatggtacttataatcaagagcaactagctgcgctcttgccaaagttagccgaaaaaggcattttatttgcggtttcgagtggccgctcgctcttagccattgatcagctctttgagccctttttggatcagattgctgttattgcagaaaatggttccgtggttcaataccgtggtgagattctatttgcagatatgatgaccaaagagcagtataccgaagttgcaaaaaagattttagccaatcctcactatgtagaaacaggtatggttttttctgggcaaaaggcagcctatattttaaaaggcgcatcagaagagtacattcaaaaaacaaaacattactatgctaatgttaaggttattaatggttttgaagatatggagaatgacgccatttttaaagtttctaccaacttcacaggccataccgtcttagaaggaagcgattggttgaatcaagccctcccttatgccactgcagtgaccaccggctttgattccattgatattatcttaaaagaggtgaataagggctttggtatggagcatctttgtcaagccttgggcattaagaaagcagaaacgattgcttttggggataattttaatgattaccagatgttggagtttgctggtagggctattgctacggaaaatgcaagacctgaaatcaaagtgatttcagaccaagtcattggccactgtaatgacggagcagtactaacgtatttaaaaggactagtg

SEQ ID NO: 1158 - protein, 265 aa, Streptococcus pyogenes
MIKLIATDMDGTFLAEDGTYNQEQLAALLPKLAEKGILFAVSSGRSLLAIDQLFEPFLDQIAVIAENGSVVQYRGEILFADMMTKEQYTEVAKKILANPHYVETGMVFSGQKAAYILKGASEEYIQKTKHYYANVKVINGFEDMENDAIFKVSTNFTGHTVLEGSDWLNQALPYATAVTTGFDSIDIILKEVNKGFGMEHLCQALGIKKAETIAFGDNFNDYQMLEFAGRAIATENARPEIKVISDQVIGHCNDGAVLTYLKGLV

SEQ ID NO: 1159 - DNA, 114 bp, Streptococcus agalactiae
atgacaaatggaattgtcttaacacggataatggcaaataataatgctaacgctgataatgctttttcaccacctgacatcaagtttaaagactggatttttttaccaggaggt

SEQ ID NO: 1160 - protein, 38 aa, Streptococcus agalactiae
MTNGIVLTRIMANNNANADNAFSPPDIKFKDWIFLPGG

SEQ ID NO: 1161 - DNA, 3537 bp, Streptococcus agalactiae
atgtttttaaaagaaattgaaatgcaaggctttaagtcctttgcggataaaactaaggtagaatttgatcaaggagttactgctgttgtaggtccaaatggatcaggtaaaagtaatatcacagagagtttacgttgggcattgggagaatcaagcgcaaaaagtttacgaggaggtaagatgccagacgttatatttgctggtacagaaaatcgtaagccccttaattatgcgcaagtgagtgttactttagataatagcgaccattttatcgaaaatatagctgacgaagttcgagttgaacgtcgtatttttcgaaacggagatagtgaatatttaatagatggacgcaaagttcgcttacgtgatattcatgatttatttatggatactggattaggaagagattctttttctattatttcccaaggacgcgttgaagctatttttaatagtaaaccagaagagcgccgtgccatatttgaagaagccgctggtgttctgaaatacaaaacacgtaagaaagaaacacaatccaaattagaacaaactcaagggaacttagatcgcttagaggatattatttatgaattggacatgcaagtccaaccattagaaaaacaagcaagtattgccaagcgttttttagtattagatgaggaacgacaaggactccacttatctattttgattgaagatattttacaacatcaatcagatttaactactgttgaggaaaagctattgacagtaagaaaagagttagcaacttattaccaacaacgtcagtcccttgaagatgaaaatcaatcgttaaaacagaaacgtcaccatttatctgaagaaattgaggctaaacagttagctcttttagacgttacaaagttaaagtcagatttggaacgccaaattgatctgattcgtttagagtcaaaccaaaaggctgaaaaaaaagaagaggcaggtcaacgcttagcagagttagaaattaaagctaaagattgtagtgaccagattacccaaaaaaatatagagttaactactctgtcggaaaaaatagcccaaataagatcagaaattgttagtacagaaagttccttggagcgtttttcaactaatccggatcagattattgaaaaacttcgagaagactttgttaccttgatgcaagaagaagccgacacttcaaacgctttaacagctttactagctgatatagagaatcaaaaacaagcttctcaagctaaatctcaagaaatacaagaagttagcaaaaatttagaagtattaaaaagtaacgcaaaggtagcattggaacgatttgaggctgcaaagaagaatgttcgtcagttattatctcactaccaagatttaggtcaaaccttgcaaaatctagaaggtgagtataagaatcagcagtcaattttatttgatcatttagatgaaatcaaatcaaagcaagcacgtatttcgagtttagaatctattttgaaaaatcatagtaatttctatgctggagtgaagtcagttctacaggctaaggaccagcttggaggtatcataggtgctgttagtgagcatcttagctttgacaaacattaccaaacagcattggagatagctttgggaggtagcagccaacacatcattgttgaagacgagagtgctgccaaacgttcaattgcttttttaaagaaaaaccgccaaggtagagcgacatttctgcctttaactacaataaaaccaagagaattagcacaacattatctctcaaaattacaaagttctcaagggtttttaggaatagctagtgaattggtaacctatgatcaacgcttgtcaaacatttttaaaaataacttagggttaactgctatttttgatacggttgataatgctaatgtagctgcgagacaattgaattatcaagtacgtttagtaaccttagatggaacagagttacgccctggagggtcgtactcagggggagcaaatcgtcaaaataatactgtttttatcaagcctgaattggataatctaaaaaaagaattgaaacaggcacaaagtaaacaattaattcaagaaaaagaagttgccacattgttagagcaactcaaagagaaacaagaaaccttagcacaacttaagaatgatggagaacaagctcgtcttgaggaacaaagagctgatatagagtatcaacaactatcagaaaagcttgctgatttaaataaactatataatggcttgcaattaagcagcggggcgttggaacaaactacttctgaaaatgaaaaaaatcgtttagaaaaagaacttgaacaatttgctattaaaaaagaagagttgacaacttcaattgctcaaattaaggaagataaagattcaattcaagaaaaagtcaataatctaacaacattattgtcagaggcacagctagaagaacgtgatttgctaaacgagcagaaatttgaacgtgccaactgtacacgtctagagattaccttgtctgaaataaaacgtgacattagtaatttacaaacattactaagccatcaggacagtcaattagacaaagaagagcttccacgtatagaaaaacagttgctacaagtaaataatagaagagaaaatgacgaagaaaagcttgtgagtctccgttttgaattggaggattgtgaagctgctttagatgatttagctgcttctctggctaaagagggacaaaaaaatgaaagtcttattcgtcagcaagctcaattagagtcacaatgtgaacaattatctcaacaattgatgatattctcacgtcaattatcagaagactatcagatgacattggatgaagcgaaggtaaaagcaaatgtcttggaagatattttgatggcgcgtgaacaattgaaatctctacaagctaaaattaaagctttaggacctgttaatattgatgcaattgctcaatttgaagaagttcatgaacgattgaccttccttaacacacagcgagacgacttagttcatgccaaaaatttattactagagacgattacagatatggatgatgaagttaagactcgttttaaatcgacatttgaagccattcgtcatagtttcaaagaaacctttgtacagatgtttggtggaggttctgcggaccttattctgacagaaggtgatttattatcagctggggttgatatttcggttcaacctcctggtaaaaaaatccagtctttaaacttgatgtcaggtggtgaaaaagcattatcagcgttagcattattatttgccattatccgtgttaagacaattccatttgtcatcttggatgaagttgaggccgctttagatgaagcaaatgttaagcgatttggcgattatcttaatcgatttgataaatcaagtcaatttatcgttgttactcaccgaaaagggactatgtctgctgctgatagtatctatggggtaacgatgcaagaatcaggcgtttccaaaattgtttctgtaaaattaaaagaagctcaagaaatgaccaat

SEQ ID NO: 1162 - protein, 1179 aa, Streptococcus agalactiae
MFLKEIEMQGFKSFADKTKVEFDQGVTAVVGPNGSGKSNITESLRWALGESSAKSLRGGKMPDVIFAGTENRKPLNYAQVSVTLDNSDHFIENIADEVRVERRIFRNGDSEYLIDGRKVRLRDIHDLFMDTGLGRDSFSIISQGRVEAIFNSKPEERRAIFEEAAGVLKYKTRKKETQSKLEQTQGNLDRLEDIIYELDMQVQPLEKQASIAKRFLVLDEERQGLHLSILIEDILQHQSDLTTVEEKLLTVRKELATYYQQRQSLEDENQSLKQKRHHLSEEIEAKQLALLDVTKLKSDLERQIDLIRLESNQKAEKKEEAGQRLAELEIKAKDCSDQITQKNIELTTLSEKIAQIRSEIVSTESSLERFSTNPDQIIEKLREDFVTLMQEEADTSNALTALLADIENQKQASQAKSQEIQEVSKNLEVLKSNAKVALERFEAAKKNVRQLLSHYQDLGQTLQNLEGEYKNQQSILFDHLDEIKSKQARISSLESILKNHSNFYAGVKSVLQAKDQLGGIIGAVSEHLSFDKHYQTALEIALGGSSQHIIVEDESAAKRSIAFLKKNRQGRATFLPLTTIKPRELAQHYLSKLQSSQGFLGIASELVTYDQRLSNIFKNNLGLTAIFDTVDNANVAARQLNYQVRLVTLDGTELRPGGSYSGGANRQNNTVFIKPELDNLKKELKQAQSKQLIQEKEVATLLEQLKEKQETLAQLKNDGEQARLEEQRADIEYQQLSEKLADLNKLYNGLQLSSGALEQTTSENEKNRLEKELEQFAIKKEELTTSIAQIKEDKDSIQEKVNNLTTLLSEAQLEERDLLNEQKFERANCTRLEITLSEIKRDISNLQTLLSHQDSQLDKEELPRIEKQLLQVNNRRENDEEKLVSLRFELEDCEAALDDLAASLAKEGQKNESLIRQQAQLESQCEQLSQQLMIFSRQLSEDYQMTLDEAKVKANVLEDILMAREQLKSLQAKIKALGPVNIDAIAQFEEVHERLTFLNTQRDDLVHAKNLLLETITDMDDEVKTRFKSTFEAIRHSFKETFVQMFGGGSADLILTEGDLLSAGVDISVQPPGKKIQSLNLMSGGEKALSALALLFAIIRVKTIPFVILDEVEAALDEANVKRFGDYLNRFDKSSQFIVVTHRKGTMSAADSIYGVTMQESGVSKIVSVKLKEAQEMTN

SEQ ID NO: 1163 - DNA, 3537 bp, Streptococcus pyogenes
atgtttttaaaagaaattgagttggaagggttcaagtcctttgcggacaagactaaaattgaatttgataagggagtaactgcagtcgtaggaccaaatggttcaggtaaaagtaatattacagaaagtttacgttgggctttaggagaatcaagtgctaaaaatctgcgtgggggcaagatgccagatgtcatttttgctgggacacaaaaccgtaatcctctaaactatgctaaggtagcggttgttcttgataattccgatcattttataaaaactgccaagaaagaaatccgtgtcgaaaggcatatttaccgaaatggagatagtgactatctgattgatggtcgcaaggtaaggctccgtgatattcatgatttgtttatggatacagggcttggtcgtgattctttctccattatttctcaaggtcgcgtagaggaaattttcaatagtaaacctgaagaaaggcgcgccatttttgaagaagcagctggtgttttaaaatataaaacacgtaaaaaagaaactcagattaaattaaatcaaactcaagataatttagaccgtctagaggatattatttatgagctagacacgcagttggcaccacttgaaaagcaagctaaagtagctaaacaatttttagaacttgatgccaatcgtaagcaactacaactagatattctagtcaaagatattgatatagctcaagaaagacagactaaagatactgaagctttagctgctttacaacaagacttagcatcttattacgctaagcgtcaatctatggaagaagattaccaaaaattcaagcaaaaaaagcaggttcttagtcaagagtcagatcaaacccaaacaacattattagaattaaccaagctaatagctgacttggaaaagcaaattgaattggttaagctagaaagtggccaagaagcagagaaaaaggcagaagccaaaaaacatctcgaacagttacaagaacaattggatggttttcaagcagaagaaaagcagtgtacagaacaattattgcatattgatcaacaactttgtgatgtcaaacaacagttaaacgaattgagcaatgcattagagcgtttttcaagtgatcccgaccaattaatggaaactctaagagaagagtttgtattattgatgcaaaaagaggcggccttatcaaatcagctgacagctttaaaagcccatttagacaaagaaaaacaggctcgtcaacataaggctcaagaatatcagctacttgttactaagcttgatcaacttaatgacgagtctcaaaaagctcaagctcattataaagctcaaaaagagcaagtcgaaatgttgctccaaaattatcaagaaggtgataaacgcgttcaggaattagaaagagattaccaactgaatcaagaaagactatttgacttgttggatcaaaaaaaaggaaaagaagctcgtaaggctagcttagaatctattcaaaaaagtcatagtcaattctatgcgggagtacgagctgtccttcaatcacaaaaaaagcttggagggatcataggtgcagtcagtgaacacctttcttttgattctgattaccaaacagctcttgaagttgcattaggtgctaatagtcagcatattattgtaacagacgaagctgcagcaaaaagagcaattgcttatttgaaaaaaaatcgccaaggacgagcaacttttttacctttaactactataaaggctagatcattatcagaacactatcatcgtcaattggcgacttgtgaaggttatctgggaactgcagaatcattgattcgctatgatgatagtctttcagctattatccaaaatcttttatctagtactgctatctttgaaactattgatcaagctaatattgcagcgcgcttattaggatataaggtaagaattgttactcttgatggaacagaattacgaccaggtggttctttttcaggaggagctaatagacaaagcaatacaacttttatcaaaccagagttagaacaaatcagtgaggaattaacgcgattagttgagcaattaaaaataactgaaaaagaagtagctgccttgcaaagcgatttgatagcaaaaaaagaagaactgacacaattgaaattagccggtgaccaggcacgcttagctgaacaaagagctcaaatggcttatcagcaattgcaagaaaaacaagaagattcaaaggctttgttagctgcccttgatcaaagtcagacgactcattctgatgaatctttattggcagaacaagctcgtattgaagaagcattaacagctattgctaagaaaaaaaatgccttaacttgtgatattgatgatatcaaagaaaacaaagatttgattaggcaaaaaacacaaaacattcaccaagctttatctcaagctcgtttgcaagaaagagatttacttaatgaaaagaaatttgagcaagctaatcaatctcgtctaagaactcagctgaagcaatgccagcaaaatattctcaaacttgaaagcatactaaacaataacgtaagtcaagacagcattcaaagactaccccagtggcaaaaacagttacaagatgccacagagcataagtctggtgctcaaaaacgtttagtccaattaagatttgaaatagaggactatgaggcccgcttagaagaaacagcagaaaaaataaccaaagaaagcgaaaaaaatgacacatttattcgtcgtcaaaccaagttagagacacatttagagcaagtggctaatcgcttacgagcctatgctaaaagtttatcagaagattttcaaatgacactagcagacgcaaaggaggtaacaaatagtattgatcacttagaaagtgccaaagaaaaattacaccatttacaaaagactattcgtgcactaggaccaattaatagtgatgctattaatcagtatgaggaagtgcatgagcgtttgacttttttaacaagtcaaaagacagatctgacaaaagctaaaaatcttttgctagagactattaatagtatggatagcgaagtgaaggctcgtttcaaagtgacttttgaggcaattcaaaaaagttttaaagaaacctttactcagatgtttggtgggggttctgctgatttggttttaacggaaacagacctcttgtctgctggtatagagatttctgtgcagcctcctggtaagaaaattcaatctcttaacttgatgtcaggcggagaaaaagctttgtcagcactggctttattgtttgctattatacgtgttaaaacgattccgtttgtgattttagatgaggtagaagcggctcttgatgaagcaaatgttaagcgctttggggatttcctcaatcgctttgacaaagatagtcaatttattgtcgtgacccatcgtaaaggaacaatggctgcagcagatagtatttatggaattaccatgcaggaatcgggggtctctaaaattgtatctgtaaaattaaaagaagctcaagagatgaccaat

SEQ ID NO: 1164 - protein, 1179 aa, Streptococcus pyogenes
MFLKEIELEGFKSFADKTKIEFDKGVTAVVGPNGSGKSNITESLRWALGESSAKNLRGGKMPDVIFAGTQNRNPLNYAKVAVVLDNSDHFIKTAKKEIRVERHIYRNGDSDYLIDGRKVRLRDIHDLFMDTGLGRDSFSIISQGRVEEIFNSKPEERRAIFEEAAGVLKYKTRKKETQIKLNQTQDNLDRLEDIIYELDTQLAPLEKQAKVAKQFLELDANRKQLQLDILVKDIDIAQERQTKDTEALAALQQDLASYYAKRQSMEEDYQKFKQKKQVLSQESDQTQTTLLELTKLIADLEKQIELVKLESGQEAEKKAEAKKHLEQLQEQLDGFQAEEKQCTEQLLHIDQQLCDVKQQLNELSNALERFSSDPDQLMETLREEFVLLMQKEAALSNQLTALKAHLDKEKQARQHKAQEYQLLVTKLDQLNDESQKAQAHYKAQKEQVEMLLQNYQEGDKRVQELERDYQLNQERLFDLLDQKKGKEARKASLESIQKSHSQFYAGVRAVLQSQKKLGGIIGAVSEHLSFDSDYQTALEVALGANSQHIIVTDEAAAKRAIAYLKKNRQGRATFLPLTTIKARSLSEHYHRQLATCEGYLGTAESLIRYDDSLSAIIQNLLSSTAIFETIDQANIAARLLGYKVRIVTLDGTELRPGGSFSGGANRQSNTTFIKPELEQISEELTRLVEQLKITEKEVAALQSDLIAKKEELTQLKLAGDQARLAEQRAQMAYQQLQEKQEDSKALLAALDQSQTTHSDESLLAEQARIEEALTAIAKKKNALTCDIDDIKENKDLIRQKTQNIHQALSQARLQERDLLNEKKFEQANQSRLRTQLKQCQQNILKLESILNNNVSQDSIQRLPQWQKQLQDATEHKSGAQKRLVQLRFEIEDYEARLEETAEKITKESEKNDTFIRRQTKLETHLEQVANRLRAYAKSLSEDFQMTLADAKEVTNSIDHLESAKEKLHHLQKTIRALGPINSDAINQYEEVHERLTFLTSQKTDLTKAKNLLLETINSMDSEVKARFKVTFEAIQKSFKETFTQMFGGGSADLVLTETDLLSAGIEISVQPPGKKIQSLNLMSGGEKALSALALLFAIIRVKTIPFVILDEVEAALDEANVKRFGDFLNRFDKDSQFIVVTHRKGTMAAADSIYGITMQESGVSKIVSVKLKEAQEMTN

SEQ ID NO: 1165 - DNA, 726 bp, Streptococcus agalactiae
ttgtttaatattttatctatgattgaaatcaaggagaaaaaaatgaaagaattaagatcaaagctggaaaaagactatggtattgtttttgctaatcaagaattattagatacagcttttacccatacatcatacgcaaatgagcatcgcctcctaaacatttcacataatgaacgtttggaatttttaggagacgctgttctacaattacttatttcacagtatctttttacaaagtaccctcaaaaggcagaaggtgatttatcaaaattacgttcaatgattgttcgtgaggaaagtcttgcaggtttttcacgtctatgtggctttgatcactatattaaacttggaaaaggagaagaaaaatctggtggacgtaatcgtgacactattttaggagatttatttgaggcttttttaggagctttattattagacaaaggtgttgaagtggttcatgcctttgttaacaaggtaatgatccctcacgttgaaaaagggacctatgagcgtgttaaagattacaagacaagcttgcaagaattacttcaatctcatggggatgtaaaaatagattatcaagttactaatgaaagtggtccagcacatgcaaaggaatttgaggtgactgtatctgtcaaccaagaaaatttgagccaaggaattggacgatcaaagaaagctgctgaacaagacgctgccaaaaatgctttagcaacgttacaa

SEQ ID NO: 1166 - protein, 242 aa, Streptococcus agalactiae
MFNILSMIEIKEKKMKELRSKLEKDYGIVFANQELLDTAFTHTSYANEHRLLNISHNERLEFLGDAVLQLLISQYLFTKYPQKAEGDLSKLRSMIVREESLAGFSRLCGFDHYIKLGKGEEKSGGRNRDTILGDLFEAFLGALLLDKGVEVVHAFVNKVMIPHVEKGTYERVKDYKTSLQELLQSHGDVKIDYQVTNESGPAHAKEFEVTVSVNQENLSQGIGRSKKAAEQDAAKNALATLQ

SEQ ID NO: 1167 - DNA, 690 bp, Streptococcus pyogenes
atgaaacagcttgaagagttactctcaacatcttttgatattcaatttaatgatttgactttactagaaacagcttttacccacacctcttacgctaacgagcatcgtctcctaaacgtttcacataatgaacgcttggaatttttaggagacgctgttctacaattgattatttcagagtatttatttgcaaagtatcctaaaaagacagaaggagatatgtctaagttacgttccatgattgtacgtgaggaaagcttggcaggtttttcacgattttgttcttttgacgcttatatcaaactaggaaaaggtgaggaaaagtcaggtggtcgccgtcgtgatactattttaggagacttatttgaagcctttttaggtgctcttttattagataaggggattgatgcagtacgtcgcttcttgaaacaagtcatgattcctcaggtggaaaaagggaattttgaaagggttaaagactataaaacttgtcttcaagagtttttgcaaacaaaaggtgatgtggctattgattatcaagtcattagtgagaaaggacctgcccatgctaaacaatttgaggtatcgatagttgttaatggtgctgtccttagtaaaggtttaggtaagtctaaaaaattagcggagcaagatgctgctaaaaatgcccttgcccaacttagtgaggtt

SEQ ID NO: 1168 - protein, 230 aa, Streptococcus pyogenes
MKQLEELLSTSFDIQFNDLTLLETAFTHTSYANEHRLLNVSHNERLEFLGDAVLQLIISEYLFAKYPKKTEGDMSKLRSMIVREESLAGFSRFCSFDAYIKLGKGEEKSGGRRRDTILGDLFEAFLGALLLDKGIDAVRRFLKQVMIPQVEKGNFERVKDYKTCLQEFLQTKGDVAIDYQVISEKGPAHAKQFEVSIVVNGAVLSKGLGKSKKLAEQDAAKNALAQLSEV

SEQ ID NO: 1169 - DNA, 366 bp, Streptococcus agalactiae
ttgaaaaagattttttacattagtttaggatttattagtttagggataggcattgcaggtattgtcttgccggtagttccaacgactccattagtattgctttcagctttttgcttttcgagaagctctgaaaaatttgatatttggttgcgtcaaactaaagtttataaatactacgctgcagattttgttgaaagcagaagtattgccccagcgcgtaaaaagtcaatgatttggcaaatttatatcttgatgggaatttcaatctattttgctcctctaatgtggctcaaactgggattattgattggaactattgtaggaacttatgtgcttttttatgtagtacctgataaaattgatgaa

SEQ ID NO: 1170 - protein, 122 aa, Streptococcus agalactiae
MKKIFYISLGFISLGIGIAGIVLPVVPTTPLVLLSAFCFSRSSEKFDIWLRQTKVYKYYAADFVESRSIAPARKKSMIWQIYILMGISIYFAPLMWLKLGLLIGTIVGTYVLFYVVPDKIDE

SEQ ID NO: 1171 - DNA, 807 bp, Streptococcus agalactiae
atgtcagaaataggatttaaatatagtatcttagcttcaggttcaactggaaattgtttttatattgagacaccccaaaaacgtcttttaattgacgctggtttaacaggcaagaaagtgactagccttcttgcagaaattaatcgtaaaccagaagatttagatgctatactagttacccatgaacattctgaccacattaaaggtgttggcgtattggctaggaaatatcaccttgatatttatgccaatgagcagacgtggaaagttatggatgagcgtaacatgttaggcaaagttgatgttagtcaaaagcatgtttttggacgcggtaaaaccttaactttcggggatttagatattgagagctttggtgtaagtcatgatgctgtggatccccaattttaccgtatgatgaaagatgataagagctttgtgatgttgacagatacaggatatgttagcgaccgaatggcaggcttgattgagaatgcagatggttatttgatcgagtcaaatcacgacattgagattctacgttcgggttcttatccttggacacttaagcaacgtattttatcagataaaggacatttatctaatgaagatggttcagaaaccatgattcgcactataggtaaccgtactaaacacatctatttaggacacttgagtaaggaaaataatattaaggaacttgctcacatgactatggaaaacaatttaatgagagctgactttggtgtgggcacagatttttctgttcacgatacttcacctgattcagctaccccactgacgaggatt

SEQ ID NO: 1172 - protein, 269 aa, Streptococcus agalactiae
MSEIGFKYSILASGSTGNCFYIETPQKRLLIDAGLTGKKVTSLLAEINRKPEDLDAILVTHEHSDHIKGVGVLARKYHLDIYANEQTWKVMDERNMLGKVDVSQKHVFGRGKTLTFGDLDIESFGVSHDAVDPQFYRMMKDDKSFVMLTDTGYVSDRMAGLIENADGYLIESNHDIEILRSGSYPWTLKQRILSDKGHLSNEDGSETMIRTIGNRTKHIYLGHLSKENNIKELAHMTMENNLMRADFGVGTDFSVHDTSPDSATPLTRI

SEQ ID NO: 1173 - DNA, 807 bp, Streptococcus pyogenes
atgaatgagagtggttttaaatacagtattttagcatctgggtccacaggaaattgtttttatttagaaacacctaaaaaacgcttattgattgatgcagggcttactggtaagaaaattaccagtcttcttgctgaaattgaccgcaaacctgaggatttggatgctattttgattacccatgagcactctgaccatattaagggtgtaggcgttatggcccgcaaataccatttggatatctatgctaatgaaaaaacatggcagctgatggatgagtgcaatatgctaggtaagcttgatgcctcacaaaaacatattttccaaagggataaagttttgacctttggagatgttgatatcgaaagttttggagtcagccatgacgctattgatcctcaattttatcggattatgaaagataataagtcttttgtgatgttgacagatacaggatatgtcagtgataggatgacaggtattattgaaaatgcagatggctacttgattgaatccaatcatgatattgaaattttgagatcaggctcttatccttggagcttaaagcagcgtattttatctgatttaggacatttatcaaatgaagatggagcgggagccatgattagaagcctggggtacaataccaaaaaaatatacctaggtcatctgagtaaagaaaataacatcaaagagttagcgcatatgacgatggtcaatcaactggctatggcagatttagcagtaggtacagactttacggtccatgatacctctccagatactgcttgtccattaactgatatt

SEQ ID NO: 1174 - protein, 269 aa, Streptococcus pyogenes
MNESGFKYSILASGSTGNCFYLETPKKRLLIDAGLTGKKITSLLAEIDRKPEDLDAILITHEHSDHIKGVGVMARKYHLDIYANEKTWQLMDECNMLGKLDASQKHIFQRDKVLTFGDVDIESFGVSHDAIDPQFYRIMKDNKSFVMLTDTGYVSDRMTGIIENADGYLIESNHDIEILRSGSYPWSLKQRILSDLGHLSNEDGAGAMIRSLGYNTKKIYLGHLSKENNIKELAHMTMVNQLAMADLAVGTDFTVHDTSPDTACPLTDI

SEQ ID NO: 1175 - DNA, 1347 bp, Streptococcus agalactiae
atgaataatagtgctgcaaatattaggtcgtttgagctagccttactttttttactagtttttgttgctgtttattttgtttatctagcggttagagattttaaaatgtctaaaaatatccggcttttgaattggaaagtcagagatttgatagcaggaaattattcagatagtattctaattcaaggtgatgcagatttggtagaattaggtgaaagtctaaatgatttatctgatgtcttccgaatggcacatgataacttagaacaagaaaagaatcgcttagcaagtatcttaacttatatgactgacggtgtgctggctacagatcgttcaggaaaaatcgttatgattaatgagacagcccaacagcagttcaatctagcatatgatgaagctttatcaatgaatattgttgatatgttagggtcgggaagtccatattcgttccaagatttagtctctaaaacgccagaggtagttcttaatagacgtgatgaaaacggtgaatttgttaccttacggattcgatttgctttgaaccgtcgtgaaagtggttttatttccggtttagttgcagtgtcacacgatgctactgagcaagagaaagaagagcgtgaaagaagactttttgtatctaatgtttctcatgaacttcgtacacctttgacatctgtaaaatcttatttagaagctttagatgagggagcgcttaatgaagaagttgctccaagcttcattaaggtatctctagatgaaacaaatcgtatgatgcgtatgatatcagatttattaagtttatcgcgcattgataatgaagtaacgcatttagatgttgaaatgacgaattttacagctttcatgacctcaattttgaatcgatttgatcagattagaaatcaaaaaacagtcacaggaaaagtttatgaaattgtcagagattatcctcttaagtcaatttgggtggaaattgatacagataagatgactcaagtgattgataacattttaaataatgcagtcaagtattcaccagatggtggtaagatcacagttaatctacgcacaactaaaacgcagatgattttatcaatatcagaccaaggcttaggtattcccaaaaaagatttacctctcatctttgatcgtttttatcgtgttgataaggcgagaagtcgtaaacagggtgggactggacttggtttgtcaattgcaaaagaaattgttaagcagcataagggatttatttgggctaagagtgagtatggtaaagggtctacttttacaatagtcttgccttatgataaagatgctgtaacttatgaagaatgggaggacgttgaagat

SEQ ID NO: 1176 - protein, 449 aa, Streptococcus agalactiae
MNNSAANIRSFELALLFLLVFVAVYFVYLAVRDFKMSKNIRLLNWKVRDLIAGNYSDSILIQGDADLVELGESLNDLSDVFRMAHDNLEQEKNRLASILTYMTDGVLATDRSGKIVMINETAQQQFNLAYDEALSMNIVDMLGSGSPYSFQDLVSKTPEVVLNRRDENGEFVTLRIRFALNRRESGFISGLVAVSHDATEQEKEERERRLFVSNVSHELRTPLTSVKSYLEALDEGALNEEVAPSFIKVSLDETNRMMRMISDLLSLSRIDNEVTHLDVEMTNFTAFMTSILNRFDQIRNQKTVTGKVYEIVRDYPLKSIWVEIDTDKMTQVIDNILNNAVKYSPDGGKITVNLRTTKTQMILSISDQGLGIPKKDLPLIFDRFYRVDKARSRKQGGTGLGLSIAKEIVKQHKGFIWAKSEYGKGSTFTIVLPYDKDAVTYEEWEDVED

SEQ ID NO: 1177 - DNA, 1350 bp, Streptococcus pyogenes
atgactagagatatcattggaaacttatccacatttgaattagcgatccttatcttacttgtttttgttgctttttactttatccatcttgcggtgcgtgattaccgaaatgcacgtattattcggatgatgagccataaaatccgagacttgattaatggtcgctatactgatataatcgacgaaaaagcagacattgagttaatggagctttcagaccagttaaatgacctgtcagatgtttttcgcttgacgcatgaaaatcttgcccaagaaaaaaatcgcttggcaagtattttggcttatatgtcagatggtgtacttgctacagaccggtctggtaaaatcatcatgattaacgagacagctcgcaagcaattaaatttaagtaaagaagaggcactaaagaaaaacattacagatttgttagaaggtgatacttcatatacctaccgtgatttggtatccaaaacaccagtggtaactgttaatagccgaaatgatatgggtgagtttgtctcattacgcttgcgctttgcgttgaataggagagagagtggttttatttcgggcttggttgtggtgctccatgacaccacagaacaggaaaaagaagaacgtgaacgccgtctttttgtctctaatgtaagtcatgaattaaggacccctttaacttcggttaaatcctacttggaggctcttgatgaaggtgcacttaaagaagatattgctccaagtttcataaaagtttctcttgatgaaactaatcggatgatgcgtatgatttcagatcttttaaacctgtctcggattgataatcaagtaacccaattagcagtagagatgactaattttactgcttttataacttctattttaaacagatttgatttggttaaaaatcagcatacaggtacaggaaaagtctatgaaattgtaagagattaccctattacctctgtctggattgaaattgataatgataaaatgacacaggttatcgagaatattttgaacaatgccattaagtattctccagatggtggaaaaattacagtccgtatgaaaacaacagatacccaattaattatttccatttcagaccaaggactaggtatccctaaaacagatttgcctcttatttttgatcggttctatcgtgtagacaaggcaagaagtcgtgcccaaggagggaccggtctaggccttgccattgctaaagaaatcatcaagcagcaccatggctttatctgggctaagagtgactatggtaaaggatcgacctttactattgtcttgccttatgaaaaagatgcagccatctatgaagaatgggaggaagatgtagac

SEQ ID NO: 1178 - protein, 450 aa, Streptococcus pyogenes
MTRDIIGNLSTFELAILILLVFVAFYFIHLAVRDYRNARIIRMMSHKIRDLINGRYTDIIDEKADIELMELSDQLNDLSDVFRLTHENLAQEKNRLASILAYMSDGVLATDRSGKIIMINETARKQLNLSKEEALKKNITDLLEGDTSYTYRDLVSKTPVVTVNSRNDMGEFVSLRLRFALNRRESGFISGLVVVLHDTTEQEKEERERRLFVSNVSHELRTPLTSVKSYLEALDEGALKEDIAPSFIKVSLDETNRMMRMISDLLNLSRIDNQVTQLAVEMTNFTAFITSILNRFDLVKNQHTGTGKVYEIVRDYPITSVWIEIDNDKMTQVIENILNNAIKYSPDGGKITVRMKTTDTQLIISISDQGLGIPKTDLPLIFDRFYRVDKARSRAQGGTGLGLAIAKEIIKQHHGFIWAKSDYGKGSTFTIVLPYEKDAAIYEEWEEDVD

SEQ ID NO: 1179 - DNA, 708 bp, Streptococcus agalactiae
atgaaaaaaatacttatcgttgatgatgaaaaaccaatttcagatattatcaaatttaatttaaccaaagaaggatatgagacggcgacagctttcgatggccgtgaagctttagtacaatatgcagaatttcaaccagatttaatcattttggatttaatgcttcctgaactagatggtttagaagtggctaaggaagttcgtaaaaccagccatattcctattattatgctttctgcaaaagacagtgagtttgacaaagtcattggtttagaaatcggtgcagatgattatgttactaaacctttttcaaatcgtgaacttttggcacgggtcaaagcacatttacgacgtactgaaaatattgaaacagctgtagcagaagaaagtgctcaaaatgcttcttcagatattactattggtgagttgcaaattttaccagatgcctttattgctaagaaacgtggcgaagaaattgaattaacgcaccgagaatttgaattacttcaccatttagcgacacatatcggacaagtcatgacacgcgaacatttattggaaacagtttggggatatgattattttggagatgtccgtacagttgatgtgacggtgagacgtttacgtgaaaagattgaagatactcctggtcgtccagaatatattttgactcgacgtggtgtaggttattacatgaagtcttatgaa

SEQ ID NO: 1180 - protein, 236 aa, Streptococcus agalactiae
MKKILIVDDEKPISDIIKFNLTKEGYETATAFDGREALVQYAEFQPDLIILDLMLPELDGLEVAKEVRKTSHIPIIMLSAKDSEFDKVIGLEIGADDYVTKPFSNRELLARVKAHLRRTENIETAVAEESAQNASSDITIGELQILPDAFIAKKRGEEIELTHREFELLHHLATHIGQVMTREHLLETVWGYDYFGDVRTVDVTVRRLREKIEDTPGRPEYILTRRGVGYYMKSYE

SEQ ID NO: 1181 - DNA, 708 bp, Streptococcus pyogenes
atgaaaaaaatacttattgtggatgatgaaaaaccgatttctgacattattaagtttaatttgacaaaagaaggttatgacattgttacagcttttgatggacgcgaagcggtaacaatttttgaagaagaaaagccagatttaattattcttgatttgatgctccctgagttggacggtcttgaagtagccaaggaaattcgtaaaaccagtcatgtcccgattattatgttgtcggctaaagatagtgagtttgacaaggttattggacttgaaattggggctgatgattacgtgaccaagcccttttctaatcgggaattgctggcgcgtgtcaaggctcatctgcgtcgtaccgaaactattgaaacggctgttgcagaagaaaatgcttcttcaggtacacaggaactgaccattggtaatttacagattttaccagatgcgtttgttgctaaaaaacatggtcaagaggtagagttgacccatcgtgaatttgaactattgcatcatctagctaaccatatggggcaggtgatgacacgagaacacttattggaaattgtttggggatatgattattttggcgatgtgcgcacggttgatgtgactgttcgtcgcctccgtgaaaaaattgaagacacaccaagtcgtcctgagtatattttaacaagacgtggtgttgggtactacatgaaatcttatgac

SEQ ID NO: 1182 - protein, 236 aa, Streptococcus pyogenes
MKKILIVDDEKPISDIIKFNLTKEGYDIVTAFDGREAVTIFEEEKPDLIILDLMLPELDGLEVAKEIRKTSHVPIIMLSAKDSEFDKVIGLEIGADDYVTKPFSNRELLARVKAHLRRTETIETAVAEENASSGTQELTIGNLQILPDAFVAKKHGQEVELTHREFELLHHLANHMGQVMTREHLLEIVWGYDYFGDVRTVDVTVRRLREKIEDTPSRPEYILTRRGVGYYMKSYD

SEQ ID NO: 1183 - DNA, 753 bp, Streptococcus agalactiae
atgtcactcatatcttataagaatgttaacaagtattatggagattatcacgcccttcgtcagattaatttggaaatagagccagggcaagtggttgttctattaggaccttctggatcaggtaaatcaacacttattagaacaatgaacgctctcgaatctattgacgatggtagtttggtcgtgaatggacatgaattagcaaatatttcatctaaagaattggtcaacctccgtaaagaagttggtatggtttttcaacattttaacctttatcctcacaaaaccgtgttagaaaatattacattagctcctattaaagtattaaaacaatctaaaaaagaagctatggaaattgctgaaaaatatttaaaatttgtcaatatgtgggaaagaaaagattcctacccatctatgctatcaggtggtcaaaaacaaagaattgctattgctagagggcttgccatgcatccaaaactcctcctctttgatgagcctacctctgcccttgatcccgaaaccatcggagacgttctttcagtgatgcaaaaattggcaaatgacggaatgaatatggtcgttgtaactcatgaaatgggatttgcacgagaagttgctgatcgtattatttttatggctgatggggaaattttagtggatactacagatgtacaagacttttttgataatcccagagaaccacgtgctaaacaatttttaagcaacattatcaaccataccagtactgacctt

SEQ ID NO: 1184 - protein, 251 aa, Streptococcus agalactiae
MSLISYKNVNKYYGDYHALRQINLEIEPGQVVVLLGPSGSGKSTLIRTMNALESIDDGSLVVNGHELANISSKELVNLRKEVGMVFQHFNLYPHKTVLENITLAPIKVLKQSKKEAMEIAEKYLKFVNMWERKDSYPSMLSGGQKQRIAIARGLAMHPKLLLFDEPTSALDPETIGDVLSVMQKLANDGMNMVVVTHEMGFAREVADRIIFMADGEILVDTTDVQDFFDNPREPRAKQFLSNIINHTSTDL

SEQ ID NO: 1185 - DNA, 735 bp, Streptococcus pyogenes
ttgatgactgaggctattatttcaattaaagacttgcacaagtattatgggcacaatgaagtgcttaagggaattgatttagacattatgccaggagaggttgtggtgattattggcccttctggttctggaaaatcgaccttacttcgaaccatgaatcttttggaagtaccaactaagggacagattaggtttgaggggattgatattaccgataagaagaatgatattttcagcatgcgtgaaaaaatgggaatggttttccagcagtttaacctctttcccaatatgactattttagaaaatatcactttatcgccaatcaaaactaagggaatggctaaagcagaggctgacaaaacagccttgagcttgttggacaaagttggattatcagaaaaagccaaggcttatcctgctagtctttctggtgggcaacagcagcggattgcgattgcgcgtggactggctatggatccagatgttttactctttgatgaaccaacttcagctctagacccagaaatggtgggtgaggtcttggctgtcatgcaagatttggctaaatctgggatgactatggttattgtgactcatgaaatgggctttgctaaagaagtcgcagaccgtgtgatgtttatggatggcggcgttattgtggaagaaggaagtcctaaccaactttttgatctgactaaagaagaacgtacaaaagattttttgagtagagtatta

SEQ ID NO: 1186 - protein, 245 aa, Streptococcus pyogenes
LMTEAIISIKDLHKYYGHNEVLKGIDLDIMPGEVVVIIGPSGSGKSTLLRTMNLLEVPTKGQIRFEGIDITDKKNDIFSMREKMGMVFQQFNLFPNMTILENITLSPIKTKGMAKAEADKTALSLLDKVGLSEKAKAYPASLSGGQQQRIAIARGLAMDPDVLLFDEPTSALDPEMVGEVLAVMQDLAKSGMTMVIVTHEMGFAKEVADRVMFMDGGVIVEEGSPNQLFDLTKEERTKDFLSRVL

SEQ ID NO: 1187 - DNA, 798 bp, Streptococcus agalactiae
atgctgagacgaaaaagattaacgttctatctattatcctgtatttttattttcctgttattttatcctaactcaacgtcagctaatcaattatcagaaatcaaaaaatcgggcgtccttaaagttggagtcaaacaagatgtgcctaactttggttattataatgctgagacgaatcaatacgaaggaatggaaattgatattgccaaaaaaattgccaaatccttaggtgtcaaaccagtttttgtaccgacaaccgcacaaaccagagagcctctgatggacaatgggcaaattgatattctaatcgcaacatacactatcacgcccgaaagaaaagctaactataatatttctaaagcttattatcacgatgaaattggatttttggtgcgtaaaaatagtcatatcaaaactataaaagaattggatggtaaacacattggtgtggctcaaggtgccactacaaaagtcaatttagaaaaatatgctaaagaacacaagctaaaatttagctatgctcaattagggagtttcccagaattagcgatatcgctgtacgctaatcgtattgatgctttttcagttgataaatctatccttagcggctaccttagccctcatacaaccatattaaaagaagggttcaatacgcaagaatacggtattgcaaccagtaaacaggacaaagtcttgattccctacgttaataagttactggtatcatgggaaaaagatggtagtttaaaacacatttatcaaaaatttaagcttaaacccgctaaagtaaaaaaagaa

SEQ ID NO: 1188 - protein, 266 aa, Streptococcus agalactiae
MLRRKRLTFYLLSCIFIFLLFYPNSTSANQLSEIKKSGVLKVGVKQDVPNFGYYNAETNQYEGMEIDIAKKIAKSLGVKPVFVPTTAQTREPLMDNGQIDILIATYTITPERKANYNISKAYYHDEIGFLVRKNSHIKTIKELDGKHIGVAQGATTKVNLEKYAKEHKLKFSYAQLGSFPELAISLYANRIDAFSVDKSILSGYLSPHTTILKEGFNTQEYGIATSKQDKVLIPYVNKLLVSWEKDGSLKHIYQKFKLKPAKVKKE

SEQ ID NO: 1189 - DNA, 897 bp, Streptococcus pyogenes
atgttatactattcttatcttaataaaggagttactatgaagaaatcagttacattactgtctatcggacttgccagccttttattggcagcatgtgcgccacatcaatctcaaaaatcaagttgggacactatcaaagaaaaaggggtgttaaaagtagctaccccaggaacctatcagccaacttctttttacaacgataataatgagttagtaggttacgaagtagatatggtcaaagaaatcggtaaacgacttaacattaaagtcaagtttgttgaaacaggatttgaccaagcctttacctcagttgatagtggtcgagtggatatttctttgaacaactttgacattaccccaaaacgtcagaaaaaatacaatatctctacgccttataaatacggggtaggaggcatgattgtccgtgctgatggcagctcaaacatagctaaaaaagatcttagcgactggaaaggaaaaaaagcagccggcgcttctggaacagaatacatgaaagtagcgcaaaaacagggagctgaactggtgacctacgataatgttacaggagatgtttatctaaacgatgtggctaacggtcgaacagatttcatcccaaatgattacccagctcaaaaattatttgtggattacatgttatctcaaaatccaaatctaaatgtcaaaatgagcgatgttcagtacaacccaaccgaacaaggaattgttatgaacaaaaaagacgatagcctcaagaaaaaaatagatgctgttattaaagacatgataaaagatggtagcttgaagaaaatctctgaaacctactatgctggtcaagatctgacaaaaccttttggcaaagacaaaaaaattcccgtcattgatacgaaagacgttaac

SEQ ID NO: 1190 - protein, 299 aa, Streptococcus pyogenes
MLYYSYLNKGVTMKKSVTLLSIGLASLLLAACAPHQSQKSSWDTIKEKGVLKVATPGTYQPTSFYNDNNELVGYEVDMVKEIGKRLNIKVKFVETGFDQAFTSVDSGRVDISLNNFDITPKRQKKYNISTPYKYGVGGMIVRADGSSNIAKKDLSDWKGKKAAGASGTEYMKVAQKQGAELVTYDNVTGDVYLNDVANGRTDFIPNDYPAQKLFVDYMLSQNPNLNVKMSDVQYNPTEQGIVMNKKDDSLKKKIDAVIKDMIKDGSLKKISETYYAGQDLTKPFGKDKKIPVIDTKDVN

SEQ ID NO: 1191 - DNA, 693 bp, Streptococcus agalactiae
atgactttattaaacatcagtccttttgccatttcaaggtggggcgctttctttaaccatttcgacctattctttaaaggcttcttatatactctaggtatttcgtttggtgcactcctacttgctctgatattaggaattctctctggtggtttatcaacttctaaaagtaaagttggtaagttgatatcacgtatctatgttgaagtttttcaaaacacacctcttttagttcaaatggtttttgtctactatggactagcaatcattagtaatggacatgttatgattagtgcttttttcaccgccgttttgtgcgttggactataccatggtgcctatatttctgaagttattcgctcaggaattgaagctgtccctaaaggacaaacagaggctgctttagctcaaggattcacagctaatcaaaccatgcaacttatcattttgcctcaagctgtcagaacaattttaccaccaatgaccaaccaagttgttaatctaatcaagaatacctctaccgtagcaatcatttctggagccgatatcatgtttgtagctaaggcctgggcttatgatacgactaattatatcccagcttttgcaggagctgctatcttctattttgttatttgtttcccactagcaagctgggcaagaaaacaagaagaattaaataagaaaacttattct

SEQ ID NO: 1192 - protein, 231 aa, Streptococcus agalactiae
MTLLNISPFAISRWGAFFNHFDLFFKGFLYTLGISFGALLLALILGILSGGLSTSKSKVGKLISRIYVEVFQNTPLLVQMVFVYYGLAIISNGHVMISAFFTAVLCVGLYHGAYISEVIRSGIEAVPKGQTEAALAQGFTANQTMQLIILPQAVRTILPPMTNQVVNLIKNTSTVAIISGADIMFVAKAWAYDTTNYIPAFAGAAIFYFVICFPLASWARKQEELNKKTYS

SEQ ID NO: 1193 - DNA, 1584 bp, Streptococcus pyogenes
ttgaaacaggagacctatatgaaaaagctaatccttagctgtttggtcgccttggcccttctgtttggaggaatgagccgggctcaagcaaaccaatatttaagagtcggaatggaagcagcctatgctccttttaactggactcaagatgacgcttcaaacggggctgttccaattgaaggaactagccaatacgccaacggttacgatgtccaagtcgctaaaaaagtcgctaaagctatgaacaaagaacttttagtcgttaagacctcttggaccggtttaattccagcattaacttctggaaaaatcgatatgatcgctgctggtatgagtcctaccaaagagcgtagaaacgaaattagcttctcaaacagctcctacactagccaacctgttctagtcgtaactgccaatggcaaatatgctgatgcaacaagcctcaaggatttttctggagctaaagtaactgcccagcaaggcgtttggcatgtcaatctcttaactcaactaaaaggtgctaagttacaaacaccaatgggagatttctctcaaatgcgacaagcccttacttcgggtgttatcgatgcctatatttctgaacgacctgaagccatgactgctgaagctgctgatagccgtttgaaaatgatcactcttaaaaaagggtttgctgttgctgaatcagatgctgctatcgctgtcggaatgaaaaaaaatgacgatcgtatggcaactgtcaaccaagtgcttgaaggattttctcaaacagatcgtatggccctgatggatgatatggttaccaaacaacccgtggaaaagaaagccgaagatgctaaagcatcatttctaggccaaatgtgggctatttttaaaggtaactggaagcaattcttacgtggaactggaatgacccttctgatttccatggtcggaaccattacaggtctctttattggattattaatcggtattttccgtacagctcctaaagctaagcataaagtagctgccttgggacaaaaactctttggttggttactcactatttatatcgaaatcttccgtgggacacctatgattgttcaatctatggttatctactacggaacagcgcaagcctttggtatttcgatcgaccgtaccctagcggctatttttatcgtatctatcaatacgggggcctatatgagtgaaattgttcgcgggggtattttcgctgtcgacaaaggtcaattcaaagcagcaactgctcttggctttactcacggacaaaccatgcgtaaaatcgtgctaccacaagttgttcgcaacattttaccagcaacaggtaatgagtttgtcatcaatatcaaagatacttctgtcttgaatgttatctctgttgtggaactttacttctcaggtaataccgtagccacacaaacctaccaatatttccaaacctttacgattatcgccattatctactttgttcttaccttcacggtgacacgtatccttcgttatattgaacgccgtttcgatgccgatacttacaccactggagcaaaccaaatgcagattgcggaggtctcaaatgtc

SEQ ID NO: 1194 - protein, 528 aa, Streptococcus pyogenes
LKQETYMKKLILSCLVALALLFGGMSRAQANQYLRVGMEAAYAPFNWTQDDASNGAVPIEGTSQYANGYDVQVAKKVAKAMNKELLVVKTSWTGLIPALTSGKIDMIAAGMSPTKERRNEISFSNSSYTSQPVLVVTANGKYADATSLKDFSGAKVTAQQGVWHVNLLTQLKGAKLQTPMGDFSQMRQALTSGVIDAYISERPEAMTAEAADSRLKMITLKKGFAVAESDAAIAVGMKKNDDRMATVNQVLEGFSQTDRMALMDDMVTKQPVEKKAEDAKASFLGQMWAIFKGNWKQFLRGTGMTLLISMVGTITGLFIGLLIGIFRTAPKAKHKVAALGQKLFGWLLTIYIEIFRGTPMIVQSMVIYYGTAQAFGISIDRTLAAIFIVSINTGAYMSEIVRGGIFAVDKGQFKAATALGFTHGQTMRKIVLPQVVRNILPATGNEFVINIKDTSVLNVISVVELYFSGNTVATQTYQYFQTFTIIAIIYFVLTFTVTRILRYIERRFDADTYTTGANQMQIAEVSNV

SEQ ID NO: 1195 - DNA, 648 bp, Streptococcus agalactiae
atgtcatcagtcttaacactaacaaagatactatttctccttcaagggttcggtttaaccttatatatatcttttatttccattttactatcaatgttttttggaactctattagcaattatgagaaatagcaaaaatcctatctggaaattaatagctagtatctatatcgaatttgtcagaaatgttccaaatctactttggatttttatcattttcttagtattccagatgaaatcagtcagcgctggtattacttcgtttacaatttttacctccgctgctttagcagaaattattcggggaggtttaaatggagtcgataaaggacaaacagaagctggactttctcaaggattcacttatttgcaagttttcattattattattttcccacaagcttttcgcaaaatgttgccagccattatttctcagtttgtaacggttataaaagatacatcactactttattctgttatagctattcaagaaatcttcggaaaaagtcaaattctaatgggaagatatttcgaagctggacaagtttttacactctacgctattataactgctgtctatttcattacaaactttatcatctcaagtttttcacgtaaactttcaaaacgttgggagcaagctactgag

SEQ ID NO: 1196 - protein, 216 aa, Streptococcus agalactiae
MSSVLTLTKILFLLQGFGLTLYISFISILLSMFFGTLLAIMRNSKNPIWKLIASIYIEFVRNVPNLLWIFIIFLVFQMKSVSAGITSFTIFTSAALAEIIRGGLNGVDKGQTEAGLSQGFTYLQVFIIIIFPQAFRKMLPAIISQFVTVIKDTSLLYSVIAIQEIFGKSQILMGRYFEAGQVFTLYAIITAVYFITNFIISSFSRKLSKRWEQATE

SEQ ID NO: 1197 - DNA, 2172 bp, Streptococcus pyogenes
atgacgcacaaaataaaagtattgctgcttgcgataatgtctatttttttgacatgcaatattgcaagtgctgaaactattgctattgtttcagatacagcttatgccccatttgaatttaaagactcagatcaaatttacaaaggaattgacgttgatattattaatgaagtagccaaacgtcaatcttgggatttcagtatgagtttcccgggttttgatgcagctgtaaatgctgttcaatctggtcaagcgagtgctctaatggccggtacaaccattacgaatgctcgtaagaaagtctttcatttctcagagccatattacgataccaaaattgtcattgcgacacgtaaagccaatgccatcaaaaaatacagtgacttaaaaggaaaaacggtcggtgttaaaaatggaacagcggctcaagcctttttgaataactataaaaaaaagtatgattatactgttaaaacatttgacacaggtgatcttatgtataatagtttatctgctggttctattgccgctgttatggatgatgaggcggttatccaatacgcaatcagccaaaaccaagatattgctattaacatgaaaggagagcccattggaagctttgggtttgctgtcaaaaagggaagcggatatgattatctagttaatgatttcaatacagctcttaaagctatgaaagctgatggtacctaccaagctatcatgaccaagtggttaggcacagatgataaagctaccaccagtcaggcaacgggaaatccatctgccaaagctacacctacaaaggacagttataaaattgtctctgattcgtcttttgcaccgtttgaatttcaaaatggtaagggcaaatacgttggtattgacatagaattaatcaaagctattgctaaacaacaaggtttcaaaattgaaatcgctaatccaggtttcgatgctgccttaaatgctgtgcaatctagccaagcagatggggtcattgctggtgcaactattactgacgctcgtaaagctatctttgatttttctgatccttattatacttctaatatcattttagctgttaaagctggaaaaaacatcaagaactatgaagacttagacagaaaaacagtcggtgctaaaaacggcacttcatcttactcttggttaaaagaaaacgctcctaaatatggttataatgtcaaggcatttgatgatggttctagcatgtatgatagcttaaattcaggttctgtagatgctatcatggatgatgaggcggttcttaaatacgctatctctcaaggtcgtcgctttgaaacacctcttgagggcatttctactggtgaagttggttttgctgtcaagaaaggaactaatccagaattaatcgaaatgttcaacaatggcttagctgctctcaaaaaatctggtcagtatgatgacattatagataaataccttgactctaagaaagctgcaactccttctgaaaaaggtgctgatgagtctactatttcaggcctattatcaaataactacaaacaactattggcaggacttggaaccacgctcagtttaacccttatttcatttgctattgctataattatcgggatcatctttgggatgatggccgtgtcaccaactaaatcacttcgacttatttcaacggtctttgtggacgttgttcgagggattcctttgatgattgtggctgccttcattttctggggagtaccaaaccttatcgagagtatgaccggccaccagtcaccgattaatgatttcttagctgctacaattgcactgtcacttaatggcggagcctatattgctgaaattgttcgcggtggtatcgaagctgttccagcagggcaaatggaagctagtcgaagtcttggtttgtcttacggaaccacgatgagaaaagtaattctcccacaagctgtgaaactaatgttacctaactttatcaatcagtttgttatttcattgaaggatacaacaatcgtctcagcaattggtttagtggaactcttccaaacaggtaaaatcattattgctagaaattaccagtcgttccgtatgtatgctattttagcaattatttaccttatcatgattatactcttaacaagacttgcaaaacgtttagaaaagaggcttaac

SEQ ID NO: 1198 - protein, 724 aa, Streptococcus pyogenes
MTHKIKVLLLAIMSIFLTCNIASAETIAIVSDTAYAPFEFKDSDQIYKGIDVDIINEVAKRQSWDFSMSFPGFDAAVNAVQSGQASALMAGTTITNARKKVFHFSEPYYDTKIVIATRKANAIKKYSDLKGKTVGVKNGTAAQAFLNNYKKKYDYTVKTFDTGDLMYNSLSAGSIAAVMDDEAVIQYAISQNQDIAINMKGEPIGSFGFAVKKGSGYDYLVNDFNTALKAMKADGTYQAIMTKWLGTDDKATTSQATGNPSAKATPTKDSYKIVSDSSFAPFEFQNGKGKYVGIDIELIKAIAKQQGFKIEIANPGFDAALNAVQSSQADGVIAGATITDARKAIFDFSDPYYTSNIILAVKAGKNIKNYEDLDRKTVGAKNGTSSYSWLKENAPKYGYNVKAFDDGSSMYDSLNSGSVDAIMDDEAVLKYAISQGRRFETPLEGISTGEVGFAVKKGTNPELIEMFNNGLAALKKSGQYDDIIDKYLDSKKAATPSEKGADESTISGLLSNNYKQLLAGLGTTLSLTLISFAIAIIIGIIFGMMAVSPTKSLRLISTVFVDVVRGIPLMIVAAFIFWGVPNLIESMTGHQSPINDFLAATIALSLNGGAYIAEIVRGGIEAVPAGQMEASRSLGLSYGTTMRKVILPQAVKLMLPNFINQFVISLKDTTIVSAIGLVELFQTGKIIIARNYQSFRMYAILAIIYLIMIILLTRLAKRLEKRLN

SEQ ID NO: 1199 - DNA, 564 bp, Streptococcus agalactiae
atgattaagaaaaataaagtttttttaggagttcttttagtccttgttgttatccttggaggtggtgtattattttaccaatcacaattccaaaagacaactaatcaagcgttagctattgcttataaagatgctaaagtggctaagaaggatgtcatacatcaaaaaattgacaaagaatttgaaaactttagagggagctacgaaattgaattcaataccaaaagcgcagaatacagctatcatgtagatgttaagactggacaaatccttgagcgggacatggataataatggcttttcaaaatcgacttctcagtcaagttcatcgtcaagtcaaaaatctcataaaataagtcaagaagaagccaaaaagattgcatttaaagatgctaatatagaggaatcagaagtcagtaatcttaagatcaaagaagaaattgaaaatggaaaatcagtttatgatattgactttgtggacctgaaaaataaaaatgaagttgattatcaaattgatgcagaaactggaaaaatcattgaacgttctagagatcatatgaatgat

SEQ ID NO: 1200 - protein, 188 aa, Streptococcus agalactiae
MIKKNKVFLGVLLVLVVILGGGVLFYQSQFQKTTNQALAIAYKDAKVAKKDVIHQKIDKEFENFRGSYEIEFNTKSAEYSYHVDVKTGQILERDMDNNGFSKSTSQSSSSSSQKSHKISQEEAKKIAFKDANIEESEVSNLKIKEEIENGKSVYDIDFVDLKNKNEVDYQIDAETGKIIERSRDHMND

SEQ ID NO: 1201 - DNA, 450 bp, Streptococcus pyogenes
atgatacttcaaagtgaccacacgtttttatattgtatagtcaaaatattgggaaaaaccatgtgtttgagttataatagaagaaatcaaagaaagaaggtagtacttatgacaattaaaaaattctctctactagccatagccagcctctctttactcagtcttgcagcctgtgatatggatgataaagacgatcatatggataatcaaccaaagacaagtcaaactagcaagaaagttaaactctcagaagacaaagccaaatcaattgcgttaaaagatgcttctgttacggaagctgatgctcaaatgctatcagttacacaagataatgaagatggcaaagccgtgtatgaaatcgagtttcaaaacaaagatcaagaatacagctataccattgacgccaactcaggggatattgtggaaaaatcttctgaaccaatcaatgac

SEQ ID NO: 1202 - protein, 150 aa, Streptococcus pyogenes
MILQSDHTFLYCIVKILGKTMCLSYNRRNQRKKVVLMTIKKFSLLAIASLSLLSLAACDMDDKDDHMDNQPKTSQTSKKVKLSEDKAKSIALKDASVTEADAQMLSVTQDNEDGKAVYEIEFQNKDQEYSYTIDANSGDIVEKSSEPIND

SEQ ID NO: 1203 - DNA, 1032 bp, Streptococcus agalactiae
ttggaggggagagatatggcaaagaccgctcttaatattccttttacagttgaagggatagaaaattattatcaaaatataaaaatgatactgtctttagcagataaatggagcatacctaaagatgatctattactttttttaaagggcctcaaggctattgatgatataaaagttggctctcctatttttaagtatttttggacttctttaagtttacaagcacccctcaaagctttagaattcgtgttagagcaggctaaaatgccaactgaattgtcaggagaattatcagaaacacaatacttggtcgcacagttttcagatgagttagctccacatgatgatttctggatagccttatcacaagttatttatgattcttttcctgggaatagtctagccgaagatactgtattaaataggaaactccatcaattccgctatttgatttctagtcagcaagcacagtatgttcgacgatactttaaagatgttggtatgactgatagagatgctttagtaaactacctatcatgtttaagagaaccagatagtatcgcctactatgaatctgctcgcttgcataataaacgtcggagaaatggtgaaatctttggtttcccagatgatgagccggttattaatagtaagcttttaatttcattccatacggaatttattattgatgacaaaggaaactttttaaacgagattgacgcagaagtaataacacgtaatggtattatcaatggagctagctttaattatgcttttaaaaataatacacgtcataaagaattagatgttgatcctgtaaagttagacccaaaatttcgaaacgatatgactagaggttatagatcgccaaatctatctagaaggaaatggtttttctttaaagaagaggattacgattgtagttatttcaataaaaaaggatattacgcatttggaaggcgtagtgctaagcaatcggttgataaacaagtcaaatacttgaagaaggctgtgcagaaaatgcgcatcaac

SEQ ID NO: 1204 - protein, 344 aa, Streptococcus agalactiae
MEGRDMAKTALNIPFTVEGIENYYQNIKMILSLADKWSIPKDDLLLFLKGLKAIDDIKVGSPIFKYFWTSLSLQAPLKALEFVLEQAKMPTELSGELSETQYLVAQFSDELAPHDDFWIALSQVIYDSFPGNSLAEDTVLNRKLHQFRYLISSQQAQYVRRYFKDVGMTDRDALVNYLSCLREPDSIAYYESARLHNKRRRNGEIFGFPDDEPVINSKLLISFHTEFIIDDKGNFLNEIDAEVITRNGIINGASFNYAFKNNTRHKELDVDPVKLDPKFRNDMTRGYRSPNLSRRKWFFFKEEDYDCSYFNKKGYYAFGRRSAKQSVDKQVKYLKKAVQKMRIN

SEQ ID NO: 1205 - DNA, 1032 bp, Streptococcus pyogenes
atgtgttataatatggtcaaaaaagatgaggagaaggccatgaaacaagctatcttagatcgctatcaggccttgaaatgctatcaaaacgcaggtttatcaaaccaagcatttcgtgctatagctaaagagcctatcattgataatcgacttggttctccaactttctgggtaatatggcctattgaaaaagaaaaccaatcagctaagcagttactaacgtttcttcttgatttggtagagatgccatttgagctaagtggtcagttgcatgaaactcaaacgctactcacccgattccatccatctctattgccagatcatatgttttggaaagagttggctagcttagttgatcaagcttttcctggcaaaacactaagccaagcaggtgagcttgaaaagcgtttgcatcaatttcgttatgtcatctctagtcaacaagctcaatctatcagaaaccattataaaatgattgagatgacagacgcccaagctctggccctttttttgaggtctaaaaaagggccttgtttgtggcggcaagcaccagattataccttgatggattctgccaggttacataataaactaagatttgaagataataaagtcatttttccaagtcaagaagtttcctataatataaaagtacttctttggtttcataccgaatttactctagatagcacaggcttttttcttaatgaagttgatgcagaagtagtgaccgaaaaaggaattgtcaatggtgcatcttttaactatggcacagatggtcctagacattgggatttagatgttgatccgattagccatcacgatcctcagtttagaagagacacccttaaaggatttcgatcgccaaaaagagtatttcgccagtggtttagagctcaaaaagatgactttatgttctcttattttaatgccaaaggactttttgcttaccacaacaagagtagttttgccagagtcaaaaaatcagctaagcaattcaaacgtcaaattcatcctataaagggttggttt

SEQ ID NO: 1206 - protein, 344 aa, Streptococcus pyogenes
MCYNMVKKDEEKAMKQAILDRYQALKCYQNAGLSNQAFRAIAKEPIIDNRLGSPTFWVIWPIEKENQSAKQLLTFLLDLVEMPFELSGQLHETQTLLTRFHPSLLPDHMFWKELASLVDQAFPGKTLSQAGELEKRLHQFRYVISSQQAQSIRNHYKMIEMTDAQALALFLRSKKGPCLWRQAPDYTLMDSARLHNKLRFEDNKVIFPSQEVSYNIKVLLWFHTEFTLDSTGFFLNEVDAEVVTEKGIVNGASFNYGTDGPRHWDLDVDPISHHDPQFRRDTLKGFRSPKRVFRQWFRAQKDDFMFSYFNAKGLFAYHNKSSFARVKKSAKQFKRQIHPIKGWF

SEQ ID NO: 1207 - DNA, 702 bp, Streptococcus agalactiae
ttgcgaacagtattagtagtgcaaggtgatgacgaaacaatagagttattaaggtcgtatttagagggagctctttataaggttgtgatggctagtgatggtgaggaggctttttctttatttcagcaacatcagattgatttagcaatcatagatattacgctacctaaaatagatggatatgagttgacgcgactcattcgtcaagatagtcagattcctattattatgctagcagctaagacaacagatatggacagaatattaggattgaatattggagcagatgattttatcacgaaaccgtttaattctttggaggttttagctcgaattaattcgcaactgcgtcgttactatgaattcaatagtcttgccaaacctaaaaatcaatttataaagataggggaattggaattagatgaggaacatgttgaactaactaaaaatggtaaacatatcaagttgactgctacagaatttaagattcttcatatcttaatgtcatcaccaggaaggatttatactaaaacacaactctatgagaagattaatggtaggtatttagaaggtgatgagacaacgattatggtgcatatttctaatatccgtgacaaaatcgaagatgatagtaaatatcctaaatatataaaaacacttagaggagtaggatataaaatcgaaaaaccgcagtatcttgtt

SEQ ID NO: 1208 - protein, 234 aa, Streptococcus agalactiae
MRTVLVVQGDDETIELLRSYLEGALYKVVMASDGEEAFSLFQQHQIDLAIIDITLPKIDGYELTRLIRQDSQIPIIMLAAKTTDMDRILGLNIGADDFITKPFNSLEVLARINSQLRRYYEFNSLAKPKNQFIKIGELELDEEHVELTKNGKHIKLTATEFKILHILMSSPGRIYTKTQLYEKINGRYLEGDETTIMVHISNIRDKIEDDSKYPKYIKTLRGVGYKIEKPQYLV

SEQ ID NO: 1209 - DNA, 1941 bp, Streptococcus agalactiae
atgattaaaatcactttcccagatggtgcaattcgtgaatttgaatctggcatcacaacatttgaaattgcacaatcaatttctaactctttagctaaaaaagctttagctggtaaatttaatggtcaacttattgatacaacacgtgctatcgaagaagatggtagtattgagattgtaacacctgaccacgaagatgctttaggagttcttcgtcactcagcagcgcatttatttgctcaagctgcaaaacgcctttttccagacttatgtttaggtgtaggtccagctattcaagatggtttttactacgatactgataataaatcaggtcaaatttcaaatgatgatcttcctcgtattgaagaagaaatgaaaaaaattgttaaggaaaatcacccttgtattcgtgaagaaatcagtaaagaagaagcgttagaactttttaaagatgacccttataaagttgaattaattagtgaacatgctgaagatggtttaactgtttatcgtcaaggtgaatttgtagacctttgtcgtggacctcatgtcccatcaacaggacgtattcaagtctttcatcttctaaatgtcgctggtgcttactggcgtggtaacagtgataatgctatgatgcagcgtgtctatggtactgcttggtttgataaaaaagatttgaaagcatatcttaaacgccgtgaagaagctaaggaacgtgaccatcgcaaattaggtaaagaacttgatttatttatggttaatcctgaagtaggtcaaggattgccattctggttgccaaatggagcaactattcgccgcgaattggaacgttacattgttgataaggagattgcttcaggttatcaacacgtttacacacctccgatggcatctgttgaattttacaagacttctgggcactgggaccactatcgtgaagatatgttcccaacaatggatatgggagatggagaggaattcgttcttcgtccaatgaactgcccacaccatattgaagtttataaacatcatgttcattcatatcgtgaattgccaattcgtatcgctgaacttggtatgatgcaccgttatgaaaaatcaggggccctcacaggattgcaacgtgtacgcgaaatgacactcaacgatgcccatattttcgttacacctgagcaaattaaagatgaatttcttaaagctcttaatcttatagcagaaatttatgaagattttaacttaacagattaccgtttccgcttatcttatcgtgacccagaagataaacataagtattatgataacgatgagatgtgggaaaatgcacaagctatgctaaaagaggctatggatgattttggattagattattttgaagcagaaggcgaagcagccttttacggtcctaaattggatatccaggtgaaaactgctcttggtaatgaagaaacactatctactatccaactagatttccttcttccagaacgctttgatctcaaatacatcggtgcagatggtgaagaacatcgtccaattatgattcaccgcggtggtatttcaacaatggagcgctttacagctattttaattgaaacttacaaaggtgcctttccaacttggcttgctccacaacaagtttctgttattccaatttcaaatgaagcccacattgattatgcttgggaagtggctcgtgtccttaaagatcgtggtattcgtgctgaagtagatgaccgtaacgaaaagatgcaatataagattcgtgcggctcaaacccaaaaaattccatatcaattgattgttggtgataaggaaatggaagaaaaagccgtaaatgtgcgccgctatggaagcaaagcgactgaaacaaaatctatagaggaatttgtagaaagtattttagctgatattgcaagaaaatctagacctgacgaagttaaa

SEQ ID NO: 1210 - protein, 647 aa, Streptococcus agalactiae
MIKITFPDGAIREFESGITTFEIAQSISNSLAKKALAGKFNGQLIDTTRAIEEDGSIEIVTPDHEDALGVLRHSAAHLFAQAAKRLFPDLCLGVGPAIQDGFYYDTDNKSGQISNDDLPRIEEEMKKIVKENHPCIREEISKEEALELFKDDPYKVELISEHAEDGLTVYRQGEFVDLCRGPHVPSTGRIQVFHLLNVAGAYWRGNSDNAMMQRVYGTAWFDKKDLKAYLKRREEAKERDHRKLGKELDLFMVNPEVGQGLPFWLPNGATIRRELERYIVDKEIASGYQHVYTPPMASVEFYKTSGHWDHYREDMFPTMDMGDGEEFVLRPMNCPHHIEVYKHHVHSYRELPIRIAELGMMHRYEKSGALTGLQRVREMTLNDAHIFVTPEQIKDEFLKALNLIAEIYEDFNLTDYRFRLSYRDPEDKHKYYDNDEMWENAQAMLKEAMDDFGLDYFEAEGEAAFYGPKLDIQVKTALGNEETLSTIQLDFLLPERFDLKYIGADGEEHRPIMIHRGGISTMERFTAILIETYKGAFPTWLAPQQVSVIPISNEAHIDYAWEVARVLKDRGIRAEVDDRNEKMQYKIRAAQTQKIPYQLIVGDKEMEEKAVNVRRYGSKATETKSIEEFVESILADIARKSRPDEVK

SEQ ID NO: 1211 - DNA, 1941 bp, Streptococcus pyogenes
atgattaagattacttttccagatggcgccgtgcgtgaatttgaatctggcgtaacaacgtttgacattgctgagtccatcagcaaatcattggctaaaaaagctttagctggtaagttcaatgatcaactcattgacaccactcgtgccattgaagaagatggcagtattgaaatcgtgacacctgaccacaaagatgcttatgaggtgcttcgccactctgcagcccatttatttgcccaagctgcaaaacgcttgttcccaaatcttcatttgggtgtgggccctgccattgcagaaggcttttactatgatacagataatgctgaaggccaaatttcaaacgaagatttgccacgtatcgaagctgaaatgcaaaaaatcgtgacagaaaattacccatgtatccgtgaagaagtgaccaaagaagaagctttggaattgttcaaagatgatccttacaaggtagaattgattaatgagcatgctggtgctggcttgacggtttaccgtcaaggtgaatttgtggatctttgccgtggccctcatgtgccatcaacaggccgtatccaagtcttccacttgctcaatgtggcgggtgcttactggcgtggtaacagcgacaataacatgatgcaacgtatctatggaacagcttggtttgataaaaaagacctcaaagcttacttgactcgtctagaagaagctaaagaacgtgatcaccgtaagcttggtaaagagcttgacttgttcatgattagccaagaagttggccaaggcttgccattttggttaccagatggagcgactattcgtcgtacacttgagcgctacatcacagataaagaattagcatcaggctaccaacacgtttacacaccaccacttgcttctgtagaattgtacaagacatcaggtcattgggatcattatcaagaagatatgttccctgtaatggatatgggagatggtgaggagtttgttcttcgtccaatgaactgcccacaccacattcaagtgtataaaaatcatgtgcgttcttatcgtgaattgcctattcgtattgccgagcttggcatgatgcaccgttacgaaaaatcaggtgccctatcaggacttcaacgggtacgtgaaatgaccttgaatgatggtcacattttcgtaacaccagagcaaatccaggaagaatttcaacgtgcccttcaattaatcattgatgtttatgctgacttcaacttgactgattatcgttttcgtttgtcataccgagaccctaacgatactcataaatattatgacaatgatgagatgtgggaaaatgctcaaagtatgcttaaagctgcacttgatgagatgggtgtagattactttgaagcagaaggtgaagcagctttttatgggcctaagcttgatattcaggtgaaaacagctcttggtaacgaagaaaccctatcaaccattcagttggacttcttgttgccagaacgctttgatctcaaatacattggtgctgatggcgaagaacaccgcccagtcatgattcaccgtggtgttatctcaactatggaacgtttcactgctatccttattgaaacttacaagggtgctttcccaacttggttggcacctcaccaagtaaccgtgattccaatttcaaatgaagcccacattgactatgcttgggaagtagcaaaaacccttcgtgaccgtggtgttcgtgcagatgtcgatgaccgcaatgaaaaaatgcagtacaagattcgtgcgtctcaaaccagcaaaattccttaccaattaattgttggggacaaagaaatggaagacaaatcagtcaatgttcgccgctatggtagcaagacgactcacaccgaatctgtggaagaatttgtggaaaacatcttggcagacattgctcgcaagtcacgtccagatgcacaagct

SEQ ID NO: 1212 - protein, 647 aa, Streptococcus pyogenes
MIKITFPDGAVREFESGVTTFDIAESISKSLAKKALAGKFNDQLIDTTRAIEEDGSIEIVTPDHKDAYEVLRHSAAHLFAQAAKRLFPNLHLGVGPAIAEGFYYDTDNAEGQISNEDLPRIEAEMQKIVTENYPCIREEVTKEEALELFKDDPYKVELINEHAGAGLTVYRQGEFVDLCRGPHVPSTGRIQVFHLLNVAGAYWRGNSDNNMMQRIYGTAWFDKKDLKAYLTRLEEAKERDHRKLGKELDLFMISQEVGQGLPFWLPDGATIRRTLERYITDKELASGYQHVYTPPLASVELYKTSGHWDHYQEDMFPVMDMGDGEEFVLRPMNCPHHIQVYKNHVRSYRELPIRIAELGMMHRYEKSGALSGLQRVREMTLNDGHIFVTPEQIQEEFQRALQLIIDVYADFNLTDYRFRLSYRDPNDTHKYYDNDEMWENAQSMLKAALDEMGVDYFEAEGEAAFYGPKLDIQVKTALGNEETLSTIQLDFLLPERFDLKYIGADGEEHRPVMIHRGVISTMERFTAILIETYKGAFPTWLAPHQVTVIPISNEAHIDYAWEVAKTLRDRGVRADVDDRNEKMQYKIRASQTSKIPYQLIVGDKEMEDKSVNVRRYGSKTTHTESVEEFVENILADIARKSRPDAQA

SEQ ID NO: 1213 - DNA, 1332 bp, Streptococcus agalactiae
atgcgtataggtctatttacagatacatacttcccccaagtttcgggagtttcaacaagtatccgcactttaaaggaagggttggagaaggaaggacacgaagtttatattttcacaactaccgaccgtaatgtcaaacgttttgaagaccctacaattattcgtttaccaagtgtcccttttatttcttttacggatcgtcgagtagtttatagaggtttaatttctgcttataggatagctaaagactacgaacttgatattattcatactcaaacagaattcagcttagggcttttaggaaaattagttgcaaaagctttaagaatacctgttgtgcatacttatcatactcaatatgaggattacgttggttatatcgcaaaaggcaaattgattaagccaagtatggtcaaatatatcatgcgtacctacctaagtgatttggatggtgtcatatgtccttctcgaattgttctcaatcttctagatggttacggtgtcaaaattccaaaacaagttattccgacaggtattcctgttgagaactatcgtcgagaggatatctctgaagaaacaatcaagaatctacgaacggagcttggacttgcggataatgatacaatgctattgagtttatcacgggtatcttttgaaaaaaatattcaagcaatcttgatgcatttatcagctgtcgttgatgaaaatcctcacgtaaaattagtgatagttggagatggtccttatctttcagatctaaaagaacttgttcactctttagaacttgaaaattcagttatttttacaggtatggttgagcatagccaagtggctatctactataaagcatgtgatttctttattagtgcttcaacaagtgaaacgcaaggattaacttacattgagagtctggcgagtggacgtccaatcattgcgcaaagtaatccttatctagatgatgttatttcagataaaatgtttggaactctgtacaagaaggaaagtgatttggcagatgctatcctagatgcaatagcagagacacccaaaatgactcaagaagcttatgaacagaaattatatgagatttctgctgagaatttcagcaagtctgtatatgctttttacctagactttctgatttcacaaaaagctagtgtgaaagaaaaagtctctctgacaataggaaataaggatagccattctactcttcgttttgtcagaaaagcggtatatttacctaagaaagtttttacctttacaggaagagcctctaaaaaagtggtaaaagcacctaaacgtcgtatttcatctattcgagattttttagat

SEQ ID NO: 1214 - protein, 444 aa, Streptococcus agalactiae
MRIGLFTDTYFPQVSGVSTSIRTLKEGLEKEGHEVYIFTTTDRNVKRFEDPTIIRLPSVPFISFTDRRVVYRGLISAYRIAKDYELDIIHTQTEFSLGLLGKLVAKALRIPVVHTYHTQYEDYVGYIAKGKLIKPSMVKYIMRTYLSDLDGVICPSRIVLNLLDGYGVKIPKQVIPTGIPVENYRREDISEETIKNLRTELGLADNDTMLLSLSRVSFEKNIQAILMHLSAVVDENPHVKLVIVGDGPYLSDLKELVHSLELENSVIFTGMVEHSQVAIYYKACDFFISASTSETQGLTYIESLASGRPIIAQSNPYLDDVISDKMFGTLYKKESDLADAILDAIAETPKMTQEAYEQKLYEISAENFSKSVYAFYLDFLISQKASVKEKVSLTIGNKDSHSTLRFVRKAVYLPKKVFTFTGRASKKVVKAPKRRISSIRDFLD

SEQ ID NO: 1215 - DNA, 1332 bp, Streptococcus pyogenes
atgcgtataggtctattcacagatacctattttccacaagtttcaggagtcgctactagtattcgtacgttaaaagaagagctagaaaaagaaggtcacgaagtttatattttcaccactactgatagagatgtcaaacgctttgaagacccgaccattattcgactgccaagtgttccttttgtgtcatttacggatagacgtgtggtttatcgtggcctcatttcgtcatacaaaattgcaaaacactataatcttgatattattcatacgcaaactgagtttagcttaggcttattagggaaaatgataggcaaagctttgcgaattcctgttgtccatacttaccatacccaatatgaggactacgtgagttatattgccaacggaaaaatcattcgaccaagtatggtcaaacctcttcttaggggctatttgaaggatttggatggggttatctgcccaagtaggattgtcctcaatcttctagaaggttacgaagttactatccctaagcgggttatcccaacaggcattcctttggaaaaatatattcgtgatgacatcacagcagaagaagtaaccaacttaaaagcagaattgggcattgctggtgatgaaaccatgttattgagtttgtcacggatttcttatgaaaaaaatattcaagctatcatcaatcagatgccagctattttggctgaaaatgccaagataaagcttattattgtaggaaatggcccctatttgcaagatttgaaacacttggcgatgcagttagaggttgacaaacacgtgacctttacaggcatggtgcctcatgataaggttgctctgtactataaggcttgtgatttctttatctcagcatcaactagtgagactcagggcttgacctatattgaaagtttggctagtggcactcctattattgctcatggcaatccttatttagatgatgtggtgactgataaaatgtttggcactctttattacgctgaaacagatttaactgatgctattattgatgccatactaaaaacaccagttatggataaacggttattagcaaaaaaacgttatgaaatctcagcacagcactttggaaaatctatttacacgttctatttagatacgttaattgctagaaatagcaaagaagctcaaaagctgagtctttatcttaatcattctggtaaaagtagttctctaaaattagtgcaaggtgctattcacttgcctaaacgtgctgctaaggtcacagctatcacctcagtaaaagtagtcaaggctcctatcaagctggtccatgctatcaaagattttctggat

SEQ ID NO: 1216 - protein, 444 aa, Streptococcus pyogenes
MRIGLFTDTYFPQVSGVATSIRTLKEELEKEGHEVYIFTTTDRDVKRFEDPTIIRLPSVPFVSFTDRRVVYRGLISSYKIAKHYNLDIIHTQTEFSLGLLGKMIGKALRIPVVHTYHTQYEDYVSYIANGKIIRPSMVKPLLRGYLKDLDGVICPSRIVLNLLEGYEVTIPKRVIPTGIPLEKYIRDDITAEEVTNLKAELGIAGDETMLLSLSRISYEKNIQAIINQMPAILAENAKIKLIIVGNGPYLQDLKHLAMQLEVDKHVTFTGMVPHDKVALYYKACDFFISASTSETQGLTYIESLASGTPIIAHGNPYLDDVVTDKMFGTLYYAETDLTDAIIDAILKTPVMDKRLLAKKRYEISAQHFGKSIYTFYLDTLIARNSKEAQKLSLYLNHSGKSSSLKLVQGAIHLPKRAAKVTAITSVKVVKAPIKLVHAIKDFLD

SEQ ID NO: 1217 - DNA, 996 bp, Streptococcus agalactiae
atgaaagttttactgtatttagaggctgaagaatacttgaaaaagtcaggtatcggtcgtgctatcaaacatcaagagaaagctcttcaaattgctgggatagattataccactaatcctacagatgactttgaccttgttcatatgaatacctatggtattagaagttggcttttgatgagtaaagctaaaaaaactgggaaaaaagtaattatgcatggccattccactgaagaggactttagaaattcttttattggctcaaatttagtatccccgctttttaaatggtacctttgccgtttttatcaaaaagcagatgccattataaccccaactgattattctaaacaactaataaaagcatatggcatcaagaaaccaatttttgttttatctaacgggattgatctaagtcgctatcagaggtcagaaaagaaagaatctgcatttcgtcactattttcacttaagtaaggatgataaagttgttatgggggccggtctttatttcatgcgtaagggaattgaccaatttgttgaagtagctgcaaaaatgcctgatattcgttttatttggtttggagaaacaaataaatgggttattcctcgaaaggttaggcaaatcgttaccaagcaacatccctcaaatgttacttttgctggttacataaaaggtgatgtttatgaaggtgccatgagtgctagcgatgctttcttctttccgagtcgtgaagagacagaagggatagtagttttagaggctttagctagtcatcagcatgtggttttaagagatatccctgtgtatcacggttgggtgaccgaagacagtgttgaattagcgactgatgttgatggttttgttgaaaagttggataaagtcttatctggtaagagtgataagattaaagaaggttatcatgtggctgagagtcgaagtatcgaacgaattgcccatgaattggcaagtgtttatcaaaaagtaatggagttg

SEQ ID NO: 1218 - protein, 332 aa, Streptococcus agalactiae
MKVLLYLEAEEYLKKSGIGRAIKHQEKALQIAGIDYTTNPTDDFDLVHMNTYGIRSWLLMSKAKKTGKKVIMHGHSTEEDFRNSFIGSNLVSPLFKWYLCRFYQKADAIITPTDYSKQLIKAYGIKKPIFVLSNGIDLSRYQRSEKKESAFRHYFHLSKDDKVVMGAGLYFMRKGIDQFVEVAAKMPDIRFIWFGETNKWVIPRKVRQIVTKQHPSNVTFAGYIKGDVYEGAMSASDAFFFPSREETEGIVVLEALASHQHVVLRDIPVYHGWVTEDSVELATDVDGFVEKLDKVLSGKSDKIKEGYHVAESRSIERIAHELASVYQKVMEL

SEQ ID NO: 1219 - DNA, 996 bp, Streptococcus pyogenes
atgaaagtcttattgtatttagaagcagaaaattatctaagaaaatcaggaattggtcgagcgattaagcatcaggctaaagccttgtcacttgttggtcaacattttacgactaatccaagagaaacttatgatttggttcatctcaatacctatggtttaaaaagttggctgctgatgataaaagcacaaaaagctggtaagaaggttatcatgcatgggcattctacagaagaagattttagaaattcttttattttttcaaatctattatctccttggtttaaaaaatacctttgtcacttttacaataaggcagatgctatcattacccctaccctatattctaagtctttgattgagagttatggagtgaagtcacctatttttgcagtgtcaaatgggattgatttggagcagtacggagcagatcctaaaaaggaagcagcttttcgtcgctactttgacattaaagagggtgaaaaagtggttatgggagcaggattattttttctgaggaaaggaattgatgactttgtcaaagttgcccaagctatgccagatgttcgttttatctggtttggcgagaccaacaaatgggtcattcctgctcaagttcgccaaatggtcaatggtaaccacccgaaaaatcttattttcccaggatacattaaaggggatgtttatgaaggtgccatgactggtgcagatgcctttttctttccaagtcgtgaagaaacagaaggcattgttgtcttagaagccttggccagtcgccagcaccttgttttacgtgatataccagtttactacggatgggttgatcaaagtagtgcggaattagcaaccgatataccaggttttatagaagctctgaaaaaagtcttttctggtgccagcaacaaagttgaagctggttacaaggttgcccagagtcgtcgcctagaaacggttggccatgccttagtagatgtctataaaaaagtaatggagtta

SEQ ID NO: 1220 - protein, 332 aa, Streptococcus pyogenes
MKVLLYLEAENYLRKSGIGRAIKHQAKALSLVGQHFTTNPRETYDLVHLNTYGLKSWLLMIKAQKAGKKVIMHGHSTEEDFRNSFIFSNLLSPWFKKYLCHFYNKADAIITPTLYSKSLIESYGVKSPIFAVSNGIDLEQYGADPKKEAAFRRYFDIKEGEKVVMGAGLFFLRKGIDDFVKVAQAMPDVRFIWFGETNKWVIPAQVRQMVNGNHPKNLIFPGYIKGDVYEGAMTGADAFFFPSREETEGIVVLEALASRQHLVLRDIPVYYGWVDQSSAELATDIPGFIEALKKVFSGASNKVEAGYKVAQSRRLETVGHALVDVYKKVMEL

SEQ ID NO: 1221 - DNA, 1464 bp, Streptococcus agalactiae
atgacaaatgaattgataatgcaagcttttgagtggtatttacctagtgatgggaatcactggaagaaattagaggagtctatatcagaccttaaaaaacttggaattagtaaaatctggttaccaccagcatttaagggaactagcagtgatgatgtaggatatggtgtttatgatctctttgatttaggagaatttgaccagaatggaacaattagaacaaaatatggtaggaaagaagagtatctaaagcttattaagtcgttaaaggcaaatggcattaaaccgtttgcagatatcgttcttaaccataaagccaatggtgatcataaagaaaaatttcaagtcatcaaagtcaatcctgaaaatcgtcaagaagcattaagtgaaccctatgagattgaaggatggacgggatttgatttcccaggtagacagggtgagtacaatgattttaaatggcactggtaccactttactggtttagattacgatgctaaaaataatgaaacagacatctttatgattgtaggcgataataaaggttgggcagacgatgatttgattgatgatgaaaatggtaatttcgattatctcatgtacaatgacattgattttaagcatcctgaagttataaaaaacttacaagattgggctaagtggtttattgaaactacaggcattgaaggttttcgtttggatgctgtgaaacatatcgattcttactttattcaaactttcattaatgatattcgtacaaaaataaaacccgatttagaggtctttggcgaatattggaaatctgaccaaacatcaatgaaggactatttagaggcaacacaatttcaattttctcttgttgatgttaccttacatatgaatttttttgatgccagtcaccaaaaccgtgattttgatatgcgaacaatttttgatgatagtcttgttattgataatcctgagtatgctgttacattcgtagaaaatcatgatacgcaaagtggacaagctctagaaagtagagtggaagattggtttaaacctttagcttatggcttgatacttttacgccaacaagggactccatgtcttttttatggtgattactatggcattcaaggagaatttggtcaaccatcctttaaagaggttattgataaaatggctgagctacgccaaaactatgtatttggcaaacaagtcgattattttacgcattcaaattgtattggttggacttgtcttggggatgaggaacataattcttgtttagctgtggtcctaacaaatggtgatcagggatggaaacatatggaagtaggggaaatttatgcaggcaaaacgtttgttgattatttaggtaattgtgaacaagaggttgttataggagatgatggttggggtgattttttagttgaatctgcgtctatctcggcttgggttcctaaaatagaggaagctaac

SEQ ID NO: 1222 - protein, 488 aa, Streptococcus agalactiae
MTNELIMQAFEWYLPSDGNHWKKLEESISDLKKLGISKIWLPPAFKGTSSDDVGYGVYDLFDLGEFDQNGTIRTKYGRKEEYLKLIKSLKANGIKPFADIVLNHKANGDHKEKFQVIKVNPENRQEALSEPYEIEGWTGFDFPGRQGEYNDFKWHWYHFTGLDYDAKNNETDIFMIVGDNKGWADDDLIDDENGNFDYLMYNDIDFKHPEVIKNLQDWAKWFIETTGIEGFRLDAVKHIDSYFIQTFINDIRTKIKPDLEVFGEYWKSDQTSMKDYLEATQFQFSLVDVTLHMNFFDASHQNRDFDMRTIFDDSLVIDNPEYAVTFVENHDTQSGQALESRVEDWFKPLAYGLILLRQQGTPCLFYGDYYGIQGEFGQPSFKEVIDKMAELRQNYVFGKQVDYFTHSNCIGWTCLGDEEHNSCLAVVLTNGDQGWKHMEVGEIYAGKTFVDYLGNCEQEVVIGDDGWGDFLVESASISAWVPKIEEAN

SEQ ID NO: 1223 - DNA, 2133 bp, Streptococcus pyogenes
atgagagaattacatatcaaaacttataagttattaacgaaaagtgctgttttacttggcttaatttcatttccactaactgtttctgctgccgataatgcttctgtcaccaacaaagcagatttttcaacagatacgatttatcagattgtaacagatcgttttaacgatggtaatacctctaataatggtaagactgatgtttttgataaaaatgaccttaaaaaataccatggaggtgattggcaaggaatcatcgccaagattaaggatggttacctgacagatatggggatttctgccatttggatttcttctcctgttgaaaatatcgacagtattgatccttctaatggaagtgctgcatatcatgggtattgggctaaggacttctttaaaacaaaccagcattttggcactgaagcagactttcaacaactagtcaaagtagctcatcaacaccatattaaggtagttattgattttgctcctaatcatacgtctacagccgaaaaagaaggcacaactttcaaagaagatggcgctttatataaaaacggtaaattagttggtaaattttcagatgataaagacaagatttttaatcatgaatcttggaccgattttagtacttatgaaaattctatttatcattcaatgtacggactagctgatttaaataacattaatccgaaagttgaccagtacatgaaagaagctattgataaatggttagacctgggtgttgatggtatccgagttgacgctgttaaacatatgtcacaaggttggcaaaaaaattggttgagtcatatctatgaaaaacataatgtctttgttttcggggaatggttctcgggacataccgacgatgattatgatatgacgacatttgctaacaatagtgggatggggcttttagattttagatttgccaatgctattagacagttgtatacaggtttttcaacgtttaccatgcgagatttttacaaggttcttgaaaatagagatcaggtgactaatgaagtgacagaccaggtgacctttattgataatcatgatatggaacgcttcgcaacaaaagtggctaataatcaaactgctgttaatcaagcctatgctttgcttttaacatctagaggtgtgcctaatatttattatggtacagagcagtatgcaacaggtgataaagatcctaataatcgtggtgatatgccaagttttaataaagagtcacaagcctataaagtgattagtaagctagctcctttaagaaaacaaaatcaagctttagcttatggaacaactgaacaacgttggattagtgatcatgttttggtatttgagcgtaaatttggtaatcatgtcgcactagtggctattaatagagatcaaacgaatggttatacaattactaatgctaaaacagccttgccccaaaatagctacaaggacaaattagaaggtcttcttggcggtcaagaattaatagttggagcagatggcactattagtagctttgaacttggagcggggcaagtcgctgtatggacttatgaaggagaggacaagacaccacaacttggagatgtcgatgcttcagtgggtattgctggaaataagattactatttcaggtcaaggttttggtaattctaaaggtcaagtgacttttggagaaatctctgctgagatcctttcttggtcagatacccttatcaccttaaaagtaccgacggttccagcaaattattataacatttcagtgacaactgccgataagcaaaccagcaatagttaccaagcctttgaagtattgactgataaacaaattcctgttcgtttactcatcaatgattttaagacagtaccaggggaacaactatatctcatgggtgatgtttttgagatgggggcaaatgacgctaagaatgctgttggtcctctatttaataacactcagaccattgccaagtacccaaactggttctttgatactcatctaccaatcaataaagaaatagcagtcaaacttgttaaaaaagatagtattgggaatgttttatggacaagtcctgagacttatagtataaagacaggtcatgaagcacaaaccattactataaaaaaa

SEQ ID NO: 1224 - protein, 711 aa, Streptococcus pyogenes
MRELHIKTYKLLTKSAVLLGLISFPLTVSAADNASVTNKADFSTDTIYQIVTDRFNDGNTSNNGKTDVFDKNDLKKYHGGDWQGIIAKIKDGYLTDMGISAIWISSPVENIDSIDPSNGSAAYHGYWAKDFFKTNQHFGTEADFQQLVKVAHQHHIKVVIDFAPNHTSTAEKEGTTFKEDGALYKNGKLVGKFSDDKDKIFNHESWTDFSTYENSIYHSMYGLADLNNINPKVDQYMKEAIDKWLDLGVDGIRVDAVKHMSQGWQKNWLSHIYEKHNVFVFGEWFSGHTDDDYDMTTFANNSGMGLLDFRFANAIRQLYTGFSTFTMRDFYKVLENRDQVTNEVTDQVTFIDNHDMERFATKVANNQTAVNQAYALLLTSRGVPNIYYGTEQYATGDKDPNNRGDMPSFNKESQAYKVISKLAPLRKQNQALAYGTTEQRWISDHVLVFERKFGNHVALVAINRDQTNGYTITNAKTALPQNSYKDKLEGLLGGQELIVGADGTISSFELGAGQVAVWTYEGEDKTPQLGDVDASVGIAGNKITISGQGFGNSKGQVTFGEISAEILSWSDTLITLKVPTVPANYYNISVTTADKQTSNSYQAFEVLTDKQIPVRLLINDFKTVPGEQLYLMGDVFEMGANDAKNAVGPLFNNTQTIAKYPNWFFDTHLPINKEIAVKLVKKDSIGNVLWTSPETYSIKTGHEAQTITIKK

SEQ ID NO: 1225 - DNA, 1002 bp, Streptococcus agalactiae
atgaatacagatgatacgattacgatttatgatgttgcccgtgaagcaggtgtttcgatggcaactgttagtcgtgtggtaaatggaaataaaaatgtcaaggaaaatacacgtaagaaagtccttgaagttattgatcgtcttgactatcgtccaaatgctgtggcgcgtggtttagcaagtaaaaaaacgacaactgttggtgttgtcattcctaatatcgcaaatagctacttttcaattttagcgcgtggtattgatgatattgcagcaatgtacaaatataacattgtccttgcttcaagtgatgaagacgatgataaagaggttaatgttgttaatactttgtttgctaagcaagtagacggtattatttttatgggacaccacttaactgaaaagattcgtgcagagttctctcgttcacgcacaccgattgttttagcaggtactgtggaccttgagcatcaattaccaagtgttaatatcgattacaaagcagcagcagttgatgttattgatattttagctggcaatcataaagacattgcttttgtatcaggaccacttattgacgatattaatggcaaggttcgtttggcaggatacaaagaaggtctcaagaaaaatggcttaaactttaaagaggggttggtttttgaagccaactaccgttatgctgaaggctttgcattagctcaacgcgtgattaatgctggagcaacagcagcatatgttgctgaggatgagttagcggcaggtttgttaaatggtctttttgaggcaggtaaacgtgttcctgaagattttgaaattatcacaagcaatgactcgccaatcgcacaatatacacgtcctaacttaacttctatcagtcaaccggtctatgatttgggtgctgttagcatgcgtatgctaacaaaaattatgcacaaagaagagttggaagaaaaagaaatagtgcttaatcacgggattgttaaacgtggcacaacaaataat

SEQ ID NO: 1226 - protein, 334 aa, Streptococcus agalactiae
MNTDDTITIYDVAREAGVSMATVSRVVNGNKNVKENTRKKVLEVIDRLDYRPNAVARGLASKKTTTVGVVIPNIANSYFSILARGIDDIAAMYKYNIVLASSDEDDDKEVNVVNTLFAKQVDGIIFMGHHLTEKIRAEFSRSRTPIVLAGTVDLEHQLPSVNIDYKAAAVDVIDILAGNHKDIAFVSGPLIDDINGKVRLAGYKEGLKKNGLNFKEGLVFEANYRYAEGFALAQRVINAGATAAYVAEDELAAGLLNGLFEAGKRVPEDFEIITSNDSPIAQYTRPNLTSISQPVYDLGAVSMRMLTKIMHKEELEEKEIVLNHGIVKRGTTNN

SEQ ID NO: 1227 - DNA, 999 bp, Streptococcus pyogenes
atgaatacagatgatccccttacaatttatgatgttgcccgtgaagctggtgtttcaatggcaaccgttagtcgtgttgttaatggcaataaaaatgttaaggaaaatacacgtaagaaagttttagaagttattgatcgccttgactatcgtcccaatgctgtcgcgcgtggtctcgccagcaaaaagacaacaaccgttggcgttgtgattccaaatattgcaaatagttatttttctatcttagctaagggtattgacgatatcgccgctatgtacaaatataatattgtgcttgcctccagtgatgaagatgatgacaaggaggttaatgttgtcaataccctttttgccaagcaagtggatggtattatttttatggggcatcacttgacagaaaaaatccgggccgagttttcacgctctcgtactccagttgttttggcaggaactgtagatcttgatcatcaattaccaagcgtcaacattgactatagagctgcggtgtcaaacgttgttgatattttagctgaaaatcataagtgtatcgcttttgtgtcaggaccactcattgatgatatcaatggtaaagtgcgcttagcaggttacaaagaagggttgaagcacaataagcttgacttcaaagaaggccttgtttttgaagcgaactattcttataaagaaggatttgaattggcgcagcgcgtcattaactcaggagcaacagcggcttatgtggctgaagatgaattggcagcgggccttttaaacggcttgtttgaagcaggtaaacgcgtaccagaggactttgaaatcatcaccagcaacgattcaccagtggttcaatacactcgtcccaatttgagttctatcagtcaacctgtttatgacttaggtgctgttagcatgcggatgttgactaaaatcatgaacaaagaagagttggaagaaaaagaaattcttttgaatcatggtattaaaaaacgtgggacaactaag

SEQ ID NO: 1228 - protein, 333 aa, Streptococcus pyogenes
MNTDDPLTIYDVAREAGVSMATVSRVVNGNKNVKENTRKKVLEVIDRLDYRPNAVARGLASKKTTTVGVVIPNIANSYFSILAKGIDDIAAMYKYNIVLASSDEDDDKEVNVVNTLFAKQVDGIIFMGHHLTEKIRAEFSRSRTPVVLAGTVDLDHQLPSVNIDYRAAVSNVVDILAENHKCIAFVSGPLIDDINGKVRLAGYKEGLKHNKLDFKEGLVFEANYSYKEGFELAQRVINSGATAAYVAEDELAAGLLNGLFEAGKRVPEDFEIITSNDSPVVQYTRPNLSSISQPVYDLGAVSMRMLTKIMNKEELEEKEILLNHGIKKRGTTK

SEQ ID NO: 1229 - DNA, 1083 bp, Streptococcus agalactiae
atgtcaaaacttaatcgtatacgccatcacttacattcagtccaagctgaacttgctgtcttttctgatcctgtgacagtcaactatttaacaggtttcttttgcgatccccatgaaagacaaatgtttttatttgtctatgaagatcgcgatcctattttatttgtaccagcactagaagtatcgcgtgcaaaacaaagtgtaccatttcccgtctttggttacatagattcagaaaatccttggcaaaaaatagctagcaacttaccatccttttctgtttctaaagttctagccgaatttgataatcttaatgttactaaattccaaggtctccaaaccgtttttgatggtcattttgaaaacctaacaccttatattcaaaacatgcgcctaattaaatcacgagatgaaattgagaaaatgttagtcgctggagaatttgctgataaagctgttcaagttggatttgacaatatctcgctaaacaacactgaaaccgatattatcgctcaaatcgaatttgaaatgaaaaaacaaggtatcaataaaatgagtttcgacactatggttttgactggcaataatgcagcaaatccacatggtatcccaggaactaataaaatcgaaaataatgctttgttattatttgatttaggtgtagaaacactaggttatacgtcagatatgacccgtacagtagcagtggggaaacctgatcaattcaaaaaagatatttaccatttatgtcttgaagcacatcaagcggctattgattttattaagccaggagtccttgcttctgaagttgacgcagcagcaagaaatgttattgaaaaggctggttatggacaatactttaaccaccgccttggtcatggattaggtatggatgtccatgaatttccatctattatggctggtaacgatatggagattcaagaaggcatgtgcttctctgttgaaccaggtatttatataccagataaagttggtgtgcgaattgaagactgcggttatgtgactaaaaccggctttgaagtatttaccaaaacacccaaggaactactctattttgaagga

SEQ ID NO: 1230 - protein, 361 aa, Streptococcus agalactiae
MSKLNRIRHHLHSVQAELAVFSDPVTVNYLTGFFCDPHERQMFLFVYEDRDPILFVPALEVSRAKQSVPFPVFGYIDSENPWQKIASNLPSFSVSKVLAEFDNLNVTKFQGLQTVFDGHFENLTPYIQNMRLIKSRDEIEKMLVAGEFADKAVQVGFDNISLNNTETDIIAQIEFEMKKQGINKMSFDTMVLTGNNAANPHGIPGTNKIENNALLLFDLGVETLGYTSDMTRTVAVGKPDQFKKDIYHLCLEAHQAAIDFIKPGVLASEVDAAARNVIEKAGYGQYFNHRLGHGLGMDVHEFPSIMAGNDMEIQEGMCFSVEPGIYIPDKVGVRIEDCGYVTKTGFEVFTKTPKELLYFEG

SEQ ID NO: 1231 - DNA, 1083 bp, Streptococcus pyogenes
atgacaaaattagaccaaatacgtttgtatcttgaccaaaagggagctgaattggcgattttctcagatcctgttacgattaactatttaaccggattcttctgtgacccacatgaaagacaactgttcttgtttgtctaccatgatttagctcctgtgctttttgtacctgcccttgaggtggccagagctagccaggccatatcatttcctgtgtttggttatgttgactctgaaaatccttgggaaaagatcaaggccgttttaccaaatacagcagccaaaaccatttatgctgaatttgaccaccttaacgtcaataagttccatggcttgcagactatcttttcaggacaatttaacaatctaaccccttatgtccaaggcatgcgcctcgtcaaatcagctgatgaaatcaataaaatgatgattgccgggcagttcgctgataaggctgttcaagttggttttgacaatatttccttagatgctaccgaaacagacgtcatcgctcaaattgagtttgaaatgaaaaaacaaggcattcataaaatgagctttgacactatggtcttaactggaaataatgcagccaatccccatggcattcctggaacaaataacattgaaaacaatgccctacttctctttgacttaggtgttgagaccttaggctacaccagtgatatgaccagaactgtggctgttggtcagccagaccaatttaaaatcgatatctacaatctctgcctagaggcacaactagcggctattgactttatcaaaccaggtgtaacagctgctcaagtagatgctgctgctcgtcaagtgattgaaaaggctggatatggtgagtacttcaaccaccgcttgggacatggtatcggcatggatgtccacgaatttccctccattatggctggcaatgacttggtccttgaagaaggtatgtgcttctctgttgaacctggtatttacattccaggaaaggtcggtgtgcgcatcgaagactgtggccatgtcactaaaaatggctttgaagtctttacccatactccaaaagagttgctttattttgaaggc

SEQ ID NO: 1232 - protein, 361 aa, Streptococcus agalactiae
MTKLDQIRLYLDQKGAELAIFSDPVTINYLTGFFCDPHERQLFLFVYHDLAPVLFVPALEVARASQAISFPVFGYVDSENPWEKIKAVLPNTAAKTIYAEFDHLNVNKFHGLQTIFSGQFNNLTPYVQGMRLVKSADEINKMMIAGQFADKAVQVGFDNISLDATETDVIAQIEFEMKKQGIHKMSFDTMVLTGNNAANPHGIPGTNNIENNALLLFDLGVETLGYTSDMTRTVAVGQPDQFKIDIYNLCLEAQLAAIDFIKPGVTAAQVDAAARQVIEKAGYGEYFNHRLGHGIGMDVHEFPSIMAGNDLVLEEGMCFSVEPGIYIPGKVGVRIEDCGHVTKNGFEVFTHTPKELLYFEG

SEQ ID NO: 1233 - DNA, 102 bp, Streptococcus agalactiae
atgataggattacgccaattacgtgtcaaatctacaattggagaaaatgaagcattacaacccacagcagatgcctccatccctgcgattcttcccatttca

SEQ ID NO: 1234 - protein, 34 aa, Streptococcus agalactiae
MIGLRQLRVKSTIGENEALQPTADASIPAILPIS

SEQ ID NO: 1235 - DNA, 1788 bp, Streptococcus agalactiae
atgacacatttagttgacttaacaaagaaacccttcaatctaaatcaagaagcaattgagtggattgaaaaaacaattaatgagatgacattggatgagaaaattgggcaactttttttcaatatgggagctagtcgttcagaagaatatttaacagatgttttggatcggtatcatattgctgctgttcgctataatagaggtagttcaagtgaaatctatgatcagaatttaattttacagacaaagtcgaaattgccgatgttgattgctgcaaatacagaagctggtggagacggtgctgtcacggatggaactaaagttggcgatgaaataaaagtggctgctacaaatgatccgaaatatgcttatgaaatgggaagaatcgcagggatggaggcatctgctgtgggttgtaatgcttcattttctccaattgtagatttgacacgtaattggcgtaatcctatcatagctagtcgaaattggggtgctaacgttgatcaaattatttcactttcaaaagagtatatgaaaggaatcatgcaatataatattgtacctttcgctaaacattttccaggggatggcattgatgagcgtgatcatcatttgtcatttgcttccaatcctatgagtaaagaggagtggatgtcgacatttggccgcatttatggtgaattggctgacgcaggtttaccaggagtcatggcaggtcacatacatttaccaaacgttgaaaaagaaatgcatccagagcgagaccttgatgatatgttaccagcttcattgaataaaacacttttagatgagttattgagaggagagttaggttataatggagctattgtaacggacgcttctcatatggttggaatgactgcttcaatggcaaggagagatttgttgccaacggcgattgaagcaggttgtgatttattcttattctttaatgaccctgatgaagacattcaatggatgaaagaaggttacgaaaaaggtattctaacagaggaacgtctccatgacgctttacgtcgtactctcggtctaaaagcgaaattaggcttgcataactatgagggacgtcgccaagaactctttatgcctaaagataaggctatggctttaatcaacacattagagtcgcaaaaaatagctgatgaagttgctgataaagcagtaactctggtaaaagataaacaaaaagatatctttccagtaaatccagaacgttatcgtcatatcttacttgttaacgttgaaggatataagggaggttttggtgcgatgattgctggaaacaagcaacgtgcatcggattacatgaaagagttacttgaggcacgtggccatgaagtaactgtctgggagtctaccgaagagcgtattatgaaattgccacaagaggagcgggcagcagctatcgctaatgtttacgcacaaaaacagccaatcgcaaatctaacagaacactatgacttgattattaacttggtagatgtcaatgctggaggaacaacacaacgtattatttggccagcagctaaaggcacccctgatcagcctttttacgttcatgaaataccatctattgtgatttcagtacaacatgcatttgctttagcagatatgccacaggtagggacttatattaatgcttatgatgggcttcctagcacgataagtgcagtagttgcgaaattggctggagaatcagaatttacaggagtttcaccagtagatgcttactgtggtttaattgatacacatttatggcgccaatgc

SEQ ID NO: 1236 - protein, 596 aa, Streptococcus agalactiae
MTHLVDLTKKPFNLNQEAIEWIEKTINEMTLDEKIGQLFFNMGASRSEEYLTDVLDRYHIAAVRYNRGSSSEIYDQNLILQTKSKLPMLIAANTEAGGDGAVTDGTKVGDEIKVAATNDPKYAYEMGRIAGMEASAVGCNASFSPIVDLTRNWRNPIIASRNWGANVDQIISLSKEYMKGIMQYNIVPFAKHFPGDGIDERDHHLSFASNPMSKEEWMSTFGRIYGELADAGLPGVMAGHIHLPNVEKEMHPERDLDDMLPASLNKTLLDELLRGELGYNGAIVTDASHMVGMTASMARRDLLPTAIEAGCDLFLFFNDPDEDIQWMKEGYEKGILTEERLHDALRRTLGLKAKLGLHNYEGRRQELFMPKDKAMALINTLESQKIADEVADKAVTLVKDKQKDIFPVNPERYRHILLVNVEGYKGGFGAMIAGNKQRASDYMKELLEARGHEVTVWESTEERIMKLPQEERAAAIANVYAQKQPIANLTEHYDLIINLVDVNAGGTTQRIIWPAAKGTPDQPFYVHEIPSIVISVQHAFALADMPQVGTYINAYDGLPSTISAVVAKLAGESEFTGVSPVDAYCGLIDTHLWRQC

SEQ ID NO: 1237 - DNA, 810 bp, Streptococcus agalactiae
atggtagatacaaatcacaaaatcgctttttgcatagattctgatggttgcgcaatggatacaatgacatataagcatcaactcttttttggtccaattgctgcagatatatttgggatatcagaacaagaaagaacaagttttttaaaagagtgggatagagtcaatctttattcaagaactcgtggagttaatcggtttgtgggattggttatgggccttgagtttgccggagtagaacatattgataaattaaaagaatgggtcgaaacaacagactcattgtccaataattccttagagttagcgcttgccaacgattttagtagagatttagagaaggctttagaatggtccaatgaagtgaatcgccaaatcaaaaattatgagggagattctttagcgttttcaggtgtgttagaaagtttagaacgattaagtcaatttggtaatgtttatgtcgtgagttctgctaacaaggaagctgtttggcaagagtgggaagaacagggattgctaaagtatgttgatgatatctattgtcaagatagaggtaaaaaagaagatgttatcgccactttaattgcaagtggttactgccgtgaaactattttgatggtaggagattccctgggtgatctggctgcagcagaacaaaatggtattgcattttacccagtacttgttggtaaggaagtcaaatcatgggaaattcttagagaagatattggtgaagcttttgcaaaaggtcaattcgaacagcaaaggcaaaaagaatctattaataccttttgggctaatttagataac

SEQ ID NO: 1238 - protein, 270 aa, Streptococcus agalactiae
MVDTNHKIAFCIDSDGCAMDTMTYKHQLFFGPIAADIFGISEQERTSFLKEWDRVNLYSRTRGVNRFVGLVMGLEFAGVEHIDKLKEWVETTDSLSNNSLELALANDFSRDLEKALEWSNEVNRQIKNYEGDSLAFSGVLESLERLSQFGNVYVVSSANKEAVWQEWEEQGLLKYVDDIYCQDRGKKEDVIATLIASGYCRETILMVGDSLGDLAAAEQNGIAFYPVLVGKEVKSWEILREDIGEAFAKGQFEQQRQKESINTFWANLDN

SEQ ID NO: 1239 - DNA, 888 bp, Streptococcus agalactiae
ttgtacttagctaagagtagaatacttatagaagttaatgagaggaataagatgtcaaaaacaattacatttaccaataaagttgtcgtcataacaggtgcaggcggtgttctctgtggttatatggctaaagaatttgcgaaagcaggcgctaaagtggcattattagatttgaatcaagaagctgctcaaacatttgctgatgaaattgtagaagaaggtggtatcgctaaggcttataaagctaacgttttgtctaaagaaaaccttgaagaagtgcatcaagccgttttagaggatcttggaccaactgatattttagttaatggtgcaggaggcaacaatcctaaagctacaactgataatgaatttcacgaattagacttaccttcagaaacaaaaaccttctttgagttagatgaagctggtattagctttgtttttaacttaaattatttaggaacattattgccaacgcaagtatttgcccaagatatggttggacgtgaaggagcgaatattattaatatctcttcaatgaatgcttttacccctctgaccaaaataccagcttattctggagctaaagcagctattagtaacttcacacaatggctagctgttcatttctcaaaagttggtatccgttgtaatgctattgcacctggtttcttggtaacaaatcagaaccgaagcttgttatttactgaggacggtcagccaactgcgcgtgctgagaaaattcttaataatacaccaatgggaagatttggagaagcaagtgagctgattggcggattgttctttttagcagatgaaaaatcatcaagttttgttaatggcgttgtccttccgattgatggtggatttgctgcttactctggtgtt

SEQ ID NO: 1240 - protein, 296 aa, Streptococcus agalactiae
MYLAKSRILIEVNERNKMSKTITFTNKVVVITGAGGVLCGYMAKEFAKAGAKVALLDLNQEAAQTFADEIVEEGGIAKAYKANVLSKENLEEVHQAVLEDLGPTDILVNGAGGNNPKATTDNEFHELDLPSETKTFFELDEAGISFVFNLNYLGTLLPTQVFAQDMVGREGANIINISSMNAFTPLTKIPAYSGAKAAISNFTQWLAVHFSKVGIRCNAIAPGFLVTNQNRSLLFTEDGQPTARAEKILNNTPMGRFGEASELIGGLFFLADEKSSSFVNGVVLPIDGGFAAYSGV

SEQ ID NO: 1241 - DNA, 792 bp, Streptococcus pyogenes
atggaaaatatgttttcgttacaaggtaagattgccttgattaccggagcatcttacggtattggttttgaaattgccaaagcctatgctcaagcgggtgcaactattgtgtttaatgacatcaaacaagagttagttgataaggggttggctgcctatcgagagttagggatagaagcgcatggctatgtttgtgacgtgactgatgaagctggtatccaacagatggttagtcaaattgaagatgaagtaggtgctattgatattttggtcaacaatgcaggtattattaggcgtacgccgatgcttgaaatggccgcagaagattttcgtcaagttattgatattgatttaaatgctccttttattgtgtcaaaagctgtattaccatcaatgattgcaaagggacatggtaaaattataaatatctgttctatgatgagcgaattggggcgtgaaacagttagtgcctacgcggcggctaaaggtggcttgaaaatgttaaccaaaaatatagcctctgagtttggagaagccaacattcaatgtaatgggattggtcctggctacattgcgacgccccaaacagctccgttgagagagcgacaagcagatggtagtcgtcatccttttgatcaatttatcattgctaaaacaccagcagcacgttgggggacaacagaagacttagctggtccagctgtttttctagctagcgatgccagtaattttgtcaacggccatattctttatgtcgacggtggcattttagcttatattggaaaacaacct

SEQ ID NO: 1242 - protein, 264 aa, Streptococcus pyogenes
MENMFSLQGKIALITGASYGIGFEIAKAYAQAGATIVFNDIKQELVDKGLAAYRELGIEAHGYVCDVTDEAGIQQMVSQIEDEVGAIDILVNNAGIIRRTPMLEMAAEDFRQVIDIDLNAPFIVSKAVLPSMIAKGHGKIINICSMMSELGRETVSAYAAAKGGLKMLTKNIASEFGEANIQCNGIGPGYIATPQTAPLRERQADGSRHPFDQFIIAKTPAARWGTTEDLAGPAVFLASDASNFVNGHILYVDGGILAYIGKQP

SEQ ID NO: 1243 - DNA, 1044 bp, Streptococcus agalactiae
atggaaatgtcatttaggtggtatggtgaagacgaccccgttactttagaaaatattggtcaaattccaacaatgaaagggattgttacagcgatatacgatgtaccagtaggagaagtttggtcacgtgagcgcattcaacagctgaaagaaaaggtagaggcagcagggcttaaaatttcggttatcgaatcagtacctgttcatgaagatatcaaattgggacgtccaacacgtgatctcttgattgataattatattcaaaccgtcaaaaatttggctgcggaaggtattgatactatttgttataattttatgccagtatttgactggacacgcactgatttagcatatcaatatccagatggttccacagctttgatatttgatgagacggtttctaaaaaaatggatccagtaaacggtgaattatctttgccaggatgggatgccagctatagtaaagaagaaatgaaggctatcatggatgcctatgctgaaattgatgaggaaaaactttgggaaaatctcacttattttattaaacgtattattcctgaagcggaagccgtaggcgttaaaatggccattcatccggatgacccaccatattctatttttggtttacctcgcattattactgggttagaggctattgagcgttttgtgaaattgtacgatagtaaaagtaatggcatcactttatgtgtgggttcttacgcttctgatccccagaatgatgttttagagatttcgcgacgtgcttttgagttagatcgtgtaaactttgttcatgctcgcaatattaaattaggtgatggaaagtcatttaaagaatcggctcatccatcagaatacgggtcaatagacatgtatgaagttattaagttatgccatgaatttgggtttgagggtgctattcgacctgaccacgggcgtatgatttggggagaaacaggtcgtccaggatatggcctatacgatagagctttaggagccacttacgtttctggtttatacgaagctgtgattaaaggttcaaaa

SEQ ID NO: 1244 - protein, 348 aa, Streptococcus agalactiae
MEMSFRWYGEDDPVTLENIGQIPTMKGIVTAIYDVPVGEVWSRERIQQLKEKVEAAGLKISVIESVPVHEDIKLGRPTRDLLIDNYIQTVKNLAAEGIDTICYNFMPVFDWTRTDLAYQYPDGSTALIFDETVSKKMDPVNGELSLPGWDASYSKEEMKAIMDAYAEIDEEKLWENLTYFIKRIIPEAEAVGVKMAIHPDDPPYSIFGLPRIITGLEAIERFVKLYDSKSNGITLCVGSYASDPQNDVLEISRRAFELDRVNFVHARNIKLGDGKSFKESAHPSEYGSIDMYEVIKLCHEFGFEGAIRPDHGRMIWGETGRPGYGLYDRALGATYVSGLYEAVIKGSK

SEQ ID NO: 1245 - DNA, 93 bp, Streptococcus agalactiae
gtgaaggctatatcccaaatcaatcagaaatcagcaaatggcaaacagctgtttttatggaactttgccgattatataaaaaatatggttttg

SEQ ID NO: 1246 - protein, 31 aa, Streptococcus agalactiae
MKAISQINQKSANGKQLFLWNFADYIKNMVL

SEQ ID NO: 1247 - DNA, 1398 bp, Streptococcus agalactiae
atggcgtttaatactgaaacatttatgttaaaaaatcaagcagctatacagctgtatgaagaggtcaagagacaacctatttttgattatcattgccacttagatccaaaggacatttttgaagatcatatttttgataatattgtggatttgtggcttggtggtgaccactataaatggcgtcttatgagggctaatggtatttctgaagcagaaattacaggtccagcatccaaccttgagaaatttaaagcatttgctagaacactagaaagagcatacggtaatcctgtttatcattggtctgctatggaattgaaaaatgtctttggtgttaatgagattttgacagaatcaaatgctgaggaaatttatcatcgtttaaatcatttcttgaaagagcataaaataagtcctagacgtttaattgcagatagcaaagttatgtttattggtactacagaccaccctcttgatactctcgagtggcataaaaagttggctgctgatgagagttttaaaacagttgttgctccgacatttaggccagatgaagcttttattgaacatcgacattttgttgattttattactaaactgggtgacattactcaaaaagagattacagatttttcaacatttatagcagcaatggaagaacgcattgcgtattttgctcaaaatggttgtagggctagcgatatcagttttacggaaatcgtctttgaacaaactgatgaattggagttgaacgatttatttaataaagtttgtgaaggctatatcccaaatcaatcagaaatcagcaaatggcaaacagctgtttttatggaactttgccgattatataaaaaatatggttttgtaacacaggtgcattttggagctttgagaaataatcattctactatttttgaaaaattgggagctgacgtgggtgtggattcacttggtgaccaagtggctttaactgttaatatgaaccgtttattggattccttggttaaaaaagatagtctgcctaaaatgatttggtataatctcaatccagcttacaatatagcagtagctaacactttggcaaattttcaagctaacgaacttggagtgagatcttaccttcaatttggtgcaggttggtggtttgcagatactaaattagggatgattagtcaaatgaatgccttagcagagcaaggcatgttggcgaattttattggtatgttaacagattctagaagttttctatcttatcaacgtcatgactattttcgacgtattttatgtacctacttaggagaatggattgaagaaggagaagttccagaagattatcaagctttaggaagtatggctaaagacatcgcttatcaaaatgcagttaattattttaagaac

SEQ ID NO: 1248 - protein, 466 aa, Streptococcus agalactiae
MAFNTETFMLKNQAAIQLYEEVKRQPIFDYHCHLDPKDIFEDHIFDNIVDLWLGGDHYKWRLMRANGISEAEITGPASNLEKFKAFARTLERAYGNPVYHWSAMELKNVFGVNEILTESNAEEIYHRLNHFLKEHKISPRRLIADSKVMFIGTTDHPLDTLEWHKKLAADESFKTVVAPTFRPDEAFIEHRHFVDFITKLGDITQKEITDFSTFIAAMEERIAYFAQNGCRASDISFTEIVFEQTDELELNDLFNKVCEGYIPNQSEISKWQTAVFMELCRLYKKYGFVTQVHFGALRNNHSTIFEKLGADVGVDSLGDQVALTVNMNRLLDSLVKKDSLPKMIWYNLNPAYNIAVANTLANFQANELGVRSYLQFGAGWWFADTKLGMISQMNALAEQGMLANFIGMLTDSRSFLSYQRHDYFRRILCTYLGEWIEEGEVPEDYQALGSMAKDIAYQNAVNYFKN

SEQ ID NO: 1249 - DNA, 708 bp, Streptococcus agalactiae
ttgaatagctatttttttagtattcttcttgacaattcatcagatgacttatataatatagttaaagataacggttacattttgggaggtattatgttaaatcaattgaaaaacaactatttctttgctgttattcgagggaaatcatctgaggatgcgctcgaaatcgcaaagcatgctattttgggtggtattcggaatattgaagtaactttttcgactcctgaagcaagcaaagtcatcaaacaattatcagatgactttaaaaataataaagaaattattgtgggggccggaacggtcatgacaactgaacttgctaaagaggctattgatgctggagctaaatttttggttagcccacactttgattcagatattgctaatttagctaatgaaaacaaggtttattatttcccaggctgtgcaacggcaacagaaatcgtggtagctagaaagtataaatgtcagattataaagctttttccaggtggagttgtgggtccaggttttatcaaagatattcatggtcctattccagatgttgatttaatgccatcaggtggcgtctctgtttcaaatgtagttgaatggagaaaagcaggagcagttgcggttggtgttggctcagcattatctagtaaagtagccacagaaggctatgatagtgttactaaaatagctaaacagtttgtttctgcacttgat

SEQ ID NO: 1250 - protein, 236 aa, Streptococcus agalactiae
MNSYFFSILLDNSSDDLYNIVKDNGYILGGIMLNQLKNNYFFAVIRGKSSEDALEIAKHAILGGIRNIEVTFSTPEASKVIKQLSDDFKNNKEIIVGAGTVMTTELAKEAIDAGAKFLVSPHFDSDIANLANENKVYYFPGCATATEIVVARKYKCQIIKLFPGGVVGPGFIKDIHGPIPDVDLMPSGGVSVSNVVEWRKAGAVAVGVGSALSSKVATEGYDSVTKIAKQFVSALD

SEQ ID NO: 1251 - DNA, 633 bp, Streptococcus pyogenes
atgggaaaaatagaaatcttaaccaaacttaaggctaatcggcttgtcctagttgtacgaggagagtctagtgaggaagctttagcttgcagcctggccagtattgaaggtggcattaagacaattgaagtcacctatactaacccctttgctagtgaggttatcggtcaattagctgaacgcttcaaagaagatcctgaggtattgataggtgctgggacagttttggatgatgtcactgcccgccaagctattttagcaggagcacagtttattgttggtcctaatttcaatcgagcagtggctttgatttgtcatcgttatagcataccttatttaccaggttgtatgacggttaatgaagtggttacagcattagaatcaggggttgatatggtcaaaatttttcctggttctactgtagggatatcctttattcgggcaatcaaatctcctttgccacaagtagaggttatggttacaggcggagtttcttcagataatctcaaagactggctagctgctggagtagatgttctaggcataggaggcgagtttaatcagttagcgagccaaaaacaatataacctaatcactaagaaagccgctcattatatcaaaagtttgcgacaa

SEQ ID NO: 1252 - protein, 211 aa, Streptococcus pyogenes
MGKIEILTKLKANRLVLVVRGESSEEALACSLASIEGGIKTIEVTYTNPFASEVIGQLAERFKEDPEVLIGAGTVLDDVTARQAILAGAQFIVGPNFNRAVALICHRYSIPYLPGCMTVNEVVTALESGVDMVKIFPGSTVGISFIRAIKSPLPQVEVMVTGGVSSDNLKDWLAAGVDVLGIGGEFNQLASQKQYNLITKKAAHYIKSLRQ

SEQ ID NO: 1253 - DNA, 669 bp, Streptococcus agalactiae
atggctagacccttagtagaacaaacagcagatcgtctattgcatttaattttagaaagagaataccctgttggtgctaagctccccaatgaatatgaattagcagaagatctagatgttggtcgcagcacaatccgagaagcagtcagaagtttagcaacgcgtaatattttagaagtcagacagggctctggaacatatattagttctaaaaagggtgtttctgaggatccattagggttctctctaataaaggacacagataggttgacatcagatctctttgaactacgccttttattggaacctcgaatagcagagctggtagcttatagaattacagatgatcagttacaattactcgaaaagcttgttggagatattgaagatgctgttcacgcaggcgatccgaaacatttacttttagacgtggaatttcattccatgctagctaaatacagtggtaatattgcaatggatagccttttgccagtcatcaaccagtcaattcatctgataaatgcgaattatacaaatcgtcagatgaagtcggatagtttagaagcacatagagaaattatcaaagcaatccgagaaaaaaatccagtagctgcacatgatgctatgcttatgcatatcatgagtgttagacgttcagcattgaaagct

SEQ ID NO: 1254 - protein, 223 aa, Streptococcus agalactiae
MARPLVEQTADRLLHLILEREYPVGAKLPNEYELAEDLDVGRSTIREAVRSLATRNILEVRQGSGTYISSKKGVSEDPLGFSLIKDTDRLTSDLFELRLLLEPRIAELVAYRITDDQLQLLEKLVGDIEDAVHAGDPKHLLLDVEFHSMLAKYSGNIAMDSLLPVINQSIHLINANYTNRQMKSDSLEAHREIIKAIREKNPVAAHDAMLMHIMSVRRSALKA

SEQ ID NO: 1255 - DNA, 723 bp, Streptococcus pyogenes
atgaataaccgacttgaggagtgtggcatgttaccagcttatataaaaattcatgatgcaattaaaaaagacattgatctgggcatctggccaattggtagtcgcttaccaagtgaacgacatttagcggaacatttcaccgttagtcgaatgactctacggcaggctattacattactagtagaagaagggattcttgaaaggcggataggaagtggtacttatgttgccagtcatcgtgttcaagaaaaaatgcgaggaacaacaagtttcacagaaattatacgctcccaaggacgacaaccctcctctaaattattatcctatcaaaagcaattagctagtgataccgaagttaaagaattgaacttagacaaaacagacttggtcattcgaatggaacgtatccgctatgcagacagtgtccctttggtgtacgaaattgcttcaatcccagaaaaatttataaaaacggttaaacgagctgatattacagaacacttttttcactcattgatagcaaatggttacgagattggtaaaagtaaacagacaatctacgctaagctagcaagtgagcgtgtagcctcctacttggaagttgctaaaggacatgccattttggctctaactcaggtgtcttactttacagacggcaaaccttttgagtatgtccgcagtcagtatatcggtgaccgttttgaattttacttagaaaataat

SEQ ID NO: 1256 - protein, 241 aa, Streptococcus pyogenes
MNNRLEECGMLPAYIKIHDAIKKDIDLGIWPIGSRLPSERHLAEHFTVSRMTLRQAITLLVEEGILERRIGSGTYVASHRVQEKMRGTTSFTEIIRSQGRQPSSKLLSYQKQLASDTEVKELNLDKTDLVIRMERIRYADSVPLVYEIASIPEKFIKTVKRADITEHFFHSLIANGYEIGKSKQTIYAKLASERVASYLEVAKGHAILALTQVSYFTDGKPFEYVRSQYIGDRFEFYLENN

SEQ ID NO: 1257 - DNA, 1863 bp, Streptococcus agalactiae
atgatattgcttacctcattgaaaaagaaacaaatgatattaaacgatagtgtaaaaggagagtgtatgttatatccattattgacaaaaacaagaaatacttatgatttaggcggtatttggaactttaaattaggagaacataatccaaatgaattactaccttcagatgaagtcatggttatcccgacttcatttaatgatttgatggtaagtaaagaaaaacgtgattatataggtgatttttggtatgaaaaagtcattgaagtacctaaagtatcagaggatgaagagatggtgctgcgttttggctcagtgacacatcaagctaaaatttatgttgacggtgtattggtaggagagcataagggaggttttactccttttgaagttcttgttcctgaatgtaagtataataatgagaaaattaaggtatcaatttgtgctaataacgttttagactataccacgcttccggtcggaaattatagtgaaatcattcaagaagatggtagcattaagaagaaagtacgtgagaattttgatttcttcaattatgcaggtgtgcatcgtcctcttaagttgatgatacgtcctaaaaatcatatttttgatattacaattacaagtcgtctatcagatgatttacagtcagcagatttacattttttagtggagactaatcaaaaggttgacgaagttagaattagcgtttttgatgaagataacaaactagtgggtgaaacgaaggatagcagattatttcttagtgatgtccatctttgggaagttttaaatgcctatctgtacacagcgcgtgttgaaatttttgttgataatcaactccaagatgtctatgaggaaaattttggtcttagagaaatagaagtgacaaatggtcaattcctattgaatcgcaaacctatttattttaaaggatttggtaaacatgaagatacgttcattaatggcagaggtttgaatgaagctgctaacttaatggatttgaatcttttgaaggatatgggggcaaactcttttagaacatcccattatccttattctgaagaaatgatgcgtttagcagatcgaatgggagtgttagtgatagatgaggttccagcagtagggttatttcaaaattttaacgcttccttagatttgtcaccaaaagataatggtacgtggaatttgatgcaaacaaaagcggcgcatgaacaagctatccaagaattagtgaagcgtgataaaaatcatcctagcgtcgtgatgtgggtagtcgctaacgaaccggctagtcatgaagcgggagcacatgattattttgagccattagtaaaactttataaagatttagaccctcaaaaacgtcctgtcaccttggttaatattttaatggcaaccccagatagagaccaagtgatggacctggttgatgttgtctgccttaatcgttactatggttggtacgttgaccacggtgatttaacaaatgcagaagtaggtataagaaaagagttattagaatggcaagataaatttcctgacaaaccaattatcataacggagtatggcgctgatacgttaccgggattacattctacttggaatattccatatacagaagaatttcaatgtgatttttatgaaatgagtcatcgtgtttttgatggtattcctaatttagttggtgagcaagtctggaattttgcagactttgaaactaatctgatgatacttcgtgtacaggggaatcacaaaggtctcttttcaaggaatcgccagccgaaacaagtcgtcaaagaatttaaaaaacgctggatgactattcctcattaccataataaaaaaaatagtgtaaaa

SEQ ID NO: 1258 - protein, 621 aa, Streptococcus agalactiae
MILLTSLKKKQMILNDSVKGECMLYPLLTKTRNTYDLGGIWNFKLGEHNPNELLPSDEVMVIPTSFNDLMVSKEKRDYIGDFWYEKVIEVPKVSEDEEMVLRFGSVTHQAKIYVDGVLVGEHKGGFTPFEVLVPECKYNNEKIKVSICANNVLDYTTLPVGNYSEIIQEDGSIKKKVRENFDFFNYAGVHRPLKLMIRPKNHIFDITITSRLSDDLQSADLHFLVETNQKVDEVRISVFDEDNKLVGETKDSRLFLSDVHLWEVLNAYLYTARVEIFVDNQLQDVYEENFGLREIEVTNGQFLLNRKPIYFKGFGKHEDTFINGRGLNEAANLMDLNLLKDMGANSFRTSHYPYSEEMMRLADRMGVLVIDEVPAVGLFQNFNASLDLSPKDNGTWNLMQTKAAHEQAIQELVKRDKNHPSVVMWVVANEPASHEAGAHDYFEPLVKLYKDLDPQKRPVTLVNILMATPDRDQVMDLVDVVCLNRYYGWYVDHGDLTNAEVGIRKELLEWQDKFPDKPIIITEYGADTLPGLHSTWNIPYTEEFQCDFYEMSHRVFDGIPNLVGEQVWNFADFETNLMILRVQGNHKGLFSRNRQPKQVVKEFKKRWMTIPHYHNKKNSVK

SEQ ID NO: 1259 - DNA, 3504 bp, Streptococcus pyogenes
atggtttatcgccaaaagagttcagagatcgttacaaggacaattaccaagccatcaagggcgaccagtaacgtcaaacaggagattgatatgacaccagatagcaaggagcagacagtgactggctaccaataccactatattgatcaagaaggaagaaagcagccctttaatcaaggctggcgttttcttatggcagatgtggcgtgtgctcaggacccttcttttgatgattcgaactggcaggtgattcatttaccacatgatttcagtcttacgcagccttacacaagaaatggtgaagctgaaagtgcttataaattaggtggtgtcggttggtatcggcattatctcgtgttagatgaggttttagctggttgtcatgttgccattacttttgagggttcctatatggaaacggaaatttatgttaacgggcaattcattggcaaacacttaaatggctatcaggaatttacttatgatatctctgatgttgtgacttttggagctgaaaatcttctggctgtccgggttgaaaacaaggttcccagttctcgttggtattcaggcagtggtctttatcgtgaagtgagtttgtctgttcttccccagcttcattttgtggcagaccaggtagcaatgaccttggctgatactgctgtgcaggagaaagggcaacagaaagttgatttacgctttgccctcaatcagtctattcagacttgccactaccaattgagcctctgtttatgggaacaatcacattgctcaaaagacaagaaactcctttatcaagaaacagaagtgcctctagctgatttggctttccaaagacagtatggtcttacactgtctttggaagaactccaattgtggtcaccagataatcctcacctctacgatttagaactcactctttactatcaaggtcaggtcattgattgcttttgccttgaaactggttttcgtcagctgacttttatggccaatcaggggctttttgtgaatggcagagctgtcaaattaaagggagtttgtttgcatcatgaccaaggaggcctaggagcttgtgcttacgaagatgccctagccagacaattagtcctgttgaaagacatgggggctaataccattcgtagcacccataacccaagtagtcccaaacttaggcaactagccaatcgtctcggcttttttgtgattgaagaagcctttgacacctggacctatgccaaaaatggaaacgttaatgacttttcaaactatttccatcagactatcggaactgaaaatgcaaactatcttcaaagagtgaggtcacctgaaacgagctgggcccagtatagtattgaggccatggtctggtctgccaagaatgacccgtcagtgttgatgtggtcgattggtaatgaattgatggagggtttttcagccgatgtcagtcattacccagagctgacaagacaaatgtgccaatggattactgctattgacacctcacgtcccattacctttggggacaataaattaaaagaagctgacttttgctggcatgaggaagtgtcgcaaatggcaactcttcttagtcaattagaccatcctcagggactcattgggttaaactatgctgatggaaaagactatgataggcttcatgaggagcactctgattggctgttgtatggttctgaaacagtctcagccattaccagcagggcttattataaagagacaaaaaaagttcttgactccggttatcacctaacctcttatgatcatgctaaggttgattggggtgccttcgctagccaggcttggtatgataccattacccgtgattttgttgctggcgaatgcgtttggacaggctttgattatttaggagaacctaccccctggaacaagatcgacagcggtgttgtaggcctttggccttctcctaaaaatgcctactttggcattttagacacggcaggctttccaaaagatagctattatttttaccaaagtcagtgggcgcaggggcagaccaccttgcacctgttaccagtctggcagaaggaccagctttgtttcgatgagcagggattggtggaggttgtggtttatagcaatgctgccagtgtgcaactgatgtttgaagatgagcagggcaacttaacagattatggaaggaaggcatttcatacttatagcacgccaacgggacacacttatcagctttaccaaggagctgacgctgctaagaatcctcacgagaacctttacctgacttggcgagtgccctatcaaaaagggttgctaagggcagtggcctacgacatttctggtaaaagcattccaaaaaccagtggacgttctcaggttagaacctatggttcagtggcaaagctatcttggaaagcctttgaagcacctattgacgctccttgggaattgctttatctggatttatcactcttggatagccgaggtgaattggtcagccatgctcaagattggttgcaggttcaagtagaaggaccagcccgtttgttggctcttgataatgggaatccgactgaccacaccccttatcaggagcctctgcgccaggcatatgggggaaaattattagccattttagccctcactggagaggcgggacacattaaggtcacggcaaaagcctcgcagcaacttagcagtgtttttcagacacaagtagcctgccgtgcccccaaagaacacttagtgacactacctttagagaaatatcagtttaaaaagagccgactgacaagtcaacaagaaattggtcaatcttgtctaaagaccacacaattcctttctgttttggagaacaaagacacccagcaaaaagcaggtaaggctagcacacctcacattcttatcactagttaccagcactatttatctctgcccttgcaggtttgttctcaggcatttgattttaaaaaaggcgacgatatcttcttgcctcagtggctccaagtcaaagatgcccaaggttctcttgtgaaaaaagctttttcaatgacgtggtacctaaaagagaaaatctttgccaagcctattcttgtcacaggctatgtttcttgttttgggcaatcaataccggttgaggcaaggcttaacctagcacaagctagcaaaagacggcaccaggatctcagtttagtcgccaagcaatccctggccgcaagtcaaaaaaggctaacttattgctaccaatatgatacggtgcaagccataggagccattagcttgcaaaatcacacaggcacatctcttagtgtttctgtggcaatcagttatggtagtcagagctctattaagcaagaaaccttgatgctagctgatagccacttgagccagttagaagaggttattttcttcgatgatattttgactgttttgtatctggcagtgacccttgaagtcattgaaggacctgacctaactgaagacagtattcaaattggcctttgggatttagca

SEQ ID NO: 1260 - protein, 1168 aa, Streptococcus pyogenes
MVYRQKSSEIVTRTITKPSRATSNVKQEIDMTPDSKEQTVTGYQYHYIDQEGRKQPFNQGWRFLMADVACAQDPSFDDSNWQVIHLPHDFSLTQPYTRNGEAESAYKLGGVGWYRHYLVLDEVLAGCHVAITFEGSYMETEIYVNGQFIGKHLNGYQEFTYDISDVVTFGAENLLAVRVENKVPSSRWYSGSGLYREVSLSVLPQLHFVADQVAMTLADTAVQEKGQQKVDLRFALNQSIQTCHYQLSLCLWEQSHCSKDKKLLYQETEVPLADLAFQRQYGLTLSLEELQLWSPDNPHLYDLELTLYYQGQVIDCFCLETGFRQLTFMANQGLFVNGRAVKLKGVCLHHDQGGLGACAYEDALARQLVLLKDMGANTIRSTHNPSSPKLRQLANRLGFFVIEEAFDTWTYAKNGNVNDFSNYFHQTIGTENANYLQRVRSPETSWAQYSIEAMVWSAKNDPSVLMWSIGNELMEGFSADVSHYPELTRQMCQWITAIDTSRPITFGDNKLKEADFCWHEEVSQMATLLSQLDHPQGLIGLNYADGKDYDRLHEEHSDWLLYGSETVSAITSRAYYKETKKVLDSGYHLTSYDHAKVDWGAFASQAWYDTITRDFVAGECVWTGFDYLGEPTPWNKIDSGVVGLWPSPKNAYFGILDTAGFPKDSYYFYQSQWAQGQTTLHLLPVWQKDQLCFDEQGLVEVVVYSNAASVQLMFEDEQGNLTDYGRKAFHTYSTPTGHTYQLYQGADAAKNPHENLYLTWRVPYQKGLLRAVAYDISGKSIPKTSGRSQVRTYGSVAKLSWKAFEAPIDAPWELLYLDLSLLDSRGELVSHAQDWLQVQVEGPARLLALDNGNPTDHTPYQEPLRQAYGGKLLAILALTGEAGHIKVTAKASQQLSSVFQTQVACRAPKEHLVTLPLEKYQFKKSRLTSQQEIGQSCLKTTQFLSVLENKDTQQKAGKASTPHILITSYQHYLSLPLQVCSQAFDFKKGDDIFLPQWLQVKDAQGSLVKKAFSMTWYLKEKIFAKPILVTGYVSCFGQSIPVEARLNLAQASKRRHQDLSLVAKQSLAASQKRLTYCYQYDTVQAIGAISLQNHTGTSLSVSVAISYGSQSSIKQETLMLADSHLSQLEEVIFFDDILTVLYLAVTLEVIEGPDLTEDSIQIGLWDLA

SEQ ID NO: 1261 - DNA, 1056 bp, Streptococcus agalactiae
ttgttaaataagagctaccattggaggattcttatggcaaaaattatttcattaggtgaggttcttttgcgattatctccacctcaatatcacacactgatgcaggctaatcacctaaaatgccaattcggtggttcagaacttaatgtcttagcaagccttgctcaactaggttaccatgtaggattggtctcagctttgcctgataatgatttgggcaagatggcaagtcaatttatattgtcacagcaaattagtccagctgctataattaaaaaagaaggacgactaggaatttattactatgaacaaggattttcggtaagaacaaataaggttatctacgatcgtaactattcatctttttgggaaagtaccttgagtgattatgattttacttctatttttaagggagtggattggtttcatgtttctggaattactccagcactaaccaaggacttatatgaggtgactcggttccttatgacaaaagctaaagaaggaggtgtaaaagtatcgattgatctcaattttcgtgagagtttatggtcatcttttcaagaggcacgtgagcaattatcgccactattaggattattagatgtttgctttggcttagagccgatttatttagctggcgaaagtgaagatttaaaagatgagttgggcttatccagaccttaccttgatattgaattacttgaaaagataacccaaaagattgtccaagaatatgggttagactatattgcctttactcaaagggaaatggaatatactaatcagtatatgttaaaatcatatttgtatcataataatatgttatatcaaactgataaaactggcgttgaagtattagatcgtgtggggacaggagatgcctttgctgcaggtttaattcatgcgcttctggaaaaagaaactcctcaaagggccttagaaatagctatggctacatttaaatacaaacataccattcaaggagatatcaatatcatgacacgagatgatattgcttacctcattgaaaaagaaacaaatgatattaaacga

SEQ ID NO: 1262 - protein, 352 aa, Streptococcus agalactiae
MLNKSYHWRILMAKIISLGEVLLRLSPPQYHTLMQANHLKCQFGGSELNVLASLAQLGYHVGLVSALPDNDLGKMASQFILSQQISPAAIIKKEGRLGIYYYEQGFSVRTNKVIYDRNYSSFWESTLSDYDFTSIFKGVDWFHVSGITPALTKDLYEVTRFLMTKAKEGGVKVSIDLNFRESLWSSFQEAREQLSPLLGLLDVCFGLEPIYLAGESEDLKDELGLSRPYLDIELLEKITQKIVQEYGLDYIAFTQREMEYTNQYMLKSYLYHNNMLYQTDKTGVEVLDRVGTGDAFAAGLIHALLEKETPQRALEIAMATFKYKHTIQGDINIMTRDDIAYLIEKETNDIKR

SEQ ID NO: 1263 - DNA, 1038 bp, Streptococcus pyogenes
ttgaacagtaattccattttgacgaggaaaggaggtcacatgtctaagttattattggttggtgaaccgctgattcgcgttagccccaatcagtttcagcctttgaccaatgcctgcgaggctcagctttttttcggcggttcagaagttaatattgcaagaactctaggcggttttggcttagaagcaaggctatttacggccctaccagataatcctgttggtcacgcttttcatcagtttttgaagcaaagcggcgtggatatgtccttgacggcttggcaaggtcatcgcgttgggctatattaccttgaaaatggctttggctgtcgggctagtcaggtttattatgaccgctgtggctctagcttttcggccttagataaggatagtcttgatttagctgccatttttgaaggcattagtcactttcattttagtgggatcagtttggcgttgggcaaaaaaactcaggacctgattgaggtacttgtgagagaagctaagaaaagggatatttgtatttcctttgaccttaactttagatctagtatgattgccgtagctgatgctaaacgactcttttctcactttgctcaatacgcggatattatttttggcatggaacctttgctgttagacagtgacgattttgacatgtttgatagaaaaaaggcagatactacgacgattagagaacgtctggcaggactttatcagcgctatcagttacaagctatttaccatacggagcgttcaaatgatgcccaaggcagtaatcatttcaaagcttatgcctatgataggcagttttacgaatcctgtgaagtgacgaccccagtcttgcaacgggttggaagtggagatgcttttgtggcgggtttactttatcagttgttagaaggtaacgaaaagcagcgcaaccttgattttgctgtggcaacagctagcctaaaatgtacagtagctgaagatcagctctatcacagtgtccaacaagtagaagcagtcttagctaatcaacgagatatccagagg

SEQ ID NO: 1264 - protein, 346 aa, Streptococcus pyogenes
LNSNSILTRKGGHMSKLLLVGEPLIRVSPNQFQPLTNACEAQLFFGGSEVNIARTLGGFGLEARLFTALPDNPVGHAFHQFLKQSGVDMSLTAWQGHRVGLYYLENGFGCRASQVYYDRCGSSFSALDKDSLDLAAIFEGISHFHFSGISLALGKKTQDLIEVLVREAKKRDICISFDLNFRSSMIAVADAKRLFSHFAQYADIIFGMEPLLLDSDDFDMFDRKKADTTTIRERLAGLYQRYQLQAIYHTERSNDAQGSNHFKAYAYDRQFYESCEVTTPVLQRVGSGDAFVAGLLYQLLEGNEKQRNLDFAVATASLKCTVAEDQLYHSVQQVEAVLANQRDIQR

SEQ ID NO: 1265 - DNA, 177 bp, Streptococcus agalactiae
atggccacaaggatactaatagctgccatttttaaatcagggggcagtggtgtttcgatagttggaaatgattttgaaaatccaattcctgctaacacaaaacctactaccataggagcaaatgaagaagcaatcgaatctgttaaggagaagatagttccaatcattcctgataca

SEQ ID NO: 1266 - protein, 59 aa, Streptococcus agalactiae
MATRILIAAIFKSGGSGVSIVGNDFENPIPANTKPTTIGANEEAIESVKEKIVPIIPDT

SEQ ID NO: 1267 - DNA, 1548 bp, Streptococcus agalactiae
atggagaaaacaatggatatggaacaacgtgaagaagttgtatcttataaccgagcgaaagtatggcagttagttatgtttgccatgaacaatgcttctacaaatatatacttatttacgtttatgtttgttacctatttctcaactggcgttcttggctcggcagccatttttgtcagtcaaattatgggttatatccgtatttttgatggttttattgatccagctattggtattatgattgataaaactgatacaaaatttggtaagtatcgtcctattttgattattgggaacgttattacggctttgtcattgatttttcttcttgcattgagaggtgtcgatgaaaatattcgtttcccattatttatccttgttctaattatccataaaattggatactcaatgcaacagacaataactaaagcagggcaaacagcactgacaaatgaccctaagcaacgtcctatttttaatatcgttgatgcagttatgacaacatcattaatgacaggcggtcagtttgtcgtttcagttttcttagtaccaaaatttggtaattttacacctcaattcttcaatgtccttatttttggaacaattcttatttcagctattttagcaatcgttgcaattattgggatttgggcaaaagacagaaaagaattctttggtttaggagagaatacccaaaagactgctctaaaagattactggaaggtgttgaaaggaaataaaccgcttcagatattatccattgctgcagctttggtaaaatttgccatccaattctttggcgattccgttgttatggtgctattgtttggtattttatttggtaattatgctttatcaggacaattctcacttcttttcattgttcctggtgttattattaatattttgttctcaacaattgctcgtaaaaaaggtcttcgtttttcatatgtcagagcaattcagatcggtatgattggtttacttgcttttggtgcagttctttacgttggtaagcctggtgaccttagtttaacaagcctaaatctttatactattttatttatcgttactaatattattgcgagatacgcttcacaagcacctgctagtttagtattgactatgggagcagatatttctgactatgaaacttctgaatccggtcgttatgtatcaggaatgattggaactatcttctccttaacagattcgattgcttcttcatttgctcctatggtagtaggttttgtgttagcaggaattggattttcaaaatcatttccaactatcgaaacaccactgccccctgatttaaaaatggcagctattagtatccttgtggccattccatttatagctttgtctatagctcttcttttaatgaaattttacaaactagataaagaagaaatggttcgtattcaagagaagattcaagttatgaaagcagcaactactaaggaacgtgctaaagatattgctcgtaatgttcctttgacagatatggattatgttgatgtaacaaaatatcctattgataaagat

SEQ ID NO: 1268 - protein, 516 aa, Streptococcus agalactiae
MEKTMDMEQREEVVSYNRAKVWQLVMFAMNNASTNIYLFTFMFVTYFSTGVLGSAAIFVSQIMGYIRIFDGFIDPAIGIMIDKTDTKFGKYRPILIIGNVITALSLIFLLALRGVDENIRFPLFILVLIIHKIGYSMQQTITKAGQTALTNDPKQRPIFNIVDAVMTTSLMTGGQFVVSVFLVPKFGNFTPQFFNVLIFGTILISAILAIVAIIGIWAKDRKEFFGLGENTQKTALKDYWKVLKGNKPLQILSIAAALVKFAIQFFGDSVVMVLLFGILFGNYALSGQFSLLFIVPGVIINILFSTIARKKGLRFSYVRAIQIGMIGLLAFGAVLYVGKPGDLSLTSLNLYTILFIVTNIIARYASQAPASLVLTMGADISDYETSESGRYVSGMIGTIFSLTDSIASSFAPMVVGFVLAGIGFSKSFPTIETPLPPDLKMAAISILVAIPFIALSIALLLMKFYKLDKEEMVRIQEKIQVMKAATTKERAKDIARNVPLTDMDYVDVTKYPIDKD

SEQ ID NO: 1269 - DNA, 993 bp, Streptococcus agalactiae
gtgatgaaactcaaagtatttaatgttagagaagaagaagcaacattagcacaagattgggcaaaccgaaatcatgtggaactttctatgagtgaaggacctttgacattggaaactgttaatgaggtagaaggttttgatgggattgctaatgcacagattgagcctttagatgatgctatttatcctcttctcaaagaaatgggaattaagcaaatcgctcagcgcagtgctggtgttgatatgtataatcttgagttagctaagcaacatggtattatcattagcaatgtgccaagttactcaccggagtctattgcagaatttacagtgacaatcgctcttaaccttattcgaaaagttgagcttattagagctaatgttcgtgaacagaatttttcatggaccttgccaattcgaggacgagtcctaggtaacatgactgtggctataataggaactggtcgcattggtctagcgactgctaaaatttttaaagggttcggatgtcgtgttattggttatgatatttaccataatccaatggcagatggtatccttgagtatgtcaattcggtagaagaagctgttgaagaagctgatcttgtgtccttacatatgccaccaactgctgaaaatacgcatctatttaatttagatatgtttaaacagtttaaaaaaggtgctattttaatgaatatggcacgtggagcattggtggaaaccaaagatcttcttgaggctttagatcaagggcttttggagggagctggtattgatacttatgaatttgaggggccatatatacctaaaaattgtcaaggtcaagacatttcagacaaggatttcctaagactgattaaccatccgaaagtaatatacactcctcatgcggcttattatacagatgaagcggtcaaaaatctagtagagggtgccttaaatgcttgtgtagaagtgattgaaacgggaacaactactacgaaagtcaac

SEQ ID NO: 1270 - protein, 331 aa, Streptococcus agalactiae
MMKLKVFNVREEEATLAQDWANRNHVELSMSEGPLTLETVNEVEGFDGIANAQIEPLDDAIYPLLKEMGIKQIAQRSAGVDMYNLELAKQHGIIISNVPSYSPESIAEFTVTIALNLIRKVELIRANVREQNFSWTLPIRGRVLGNMTVAIIGTGRIGLATAKIFKGFGCRVIGYDIYHNPMADGILEYVNSVEEAVEEADLVSLHMPPTAENTHLFNLDMFKQFKKGAILMNMARGALVETKDLLEALDQGLLEGAGIDTYEFEGPYIPKNCQGQDISDKDFLRLINHPKVIYTPHAAYYTDEAVKNLVEGALNACVEVIETGTTTTKVN

SEQ ID NO: 1271 - DNA, 252 bp, Streptococcus agalactiae
ttgactgaccacccagccatacaaagcccaaaactagcagcacagatacctaaattagcagcaccagaaccaattccggacaaactaattgccaaagcaatcccaactgttgtgattggagatacgatcaagaaacagaaaatcatcgcaattaaaattgacatcaaaacaggttgtaaaccaagtaatgaagcaatcccttgtccacgccaaacgcatgaagaaacttttgttttcagaaaactagattca

SEQ ID NO: 1272 - protein, 84 aa, Streptococcus agalactiae
MTDHPAIQSPKLAAQIPKLAAPEPIPDKLIAKAIPTVVIGDTIKKQKIIAIKIDIKTGCKPSNEAIPCPRQTHEETFVFRKLDS

SEQ ID NO: 1273 - DNA, 303 bp, Streptococcus agalactiae
atggctaatgtattagcaaaaccgaagattatgctacctatgatatcttcagcagcaatactaggaattctcggagctctctttaatattcaaggaacaccagctagtgcaggttttggtatcagtggtttgattggaccgattaatgctcttaatttagcaaaaggtggatggtcagttatgaatatgttattgataattataatatttgttgctgcaccaattatattgaattttatttttaattacctctttataaaagtacttaaaattattgatccaatggactataaattagatatt

SEQ ID NO: 1274 - protein, 101 aa, Streptococcus agalactiae
MANVLAKPKIMLPMISSAAILGILGALFNIQGTPASAGFGISGLIGPINALNLAKGGWSVMNMLLIIIIFVAAPIILNFIFNYLFIKVLKIIDPMDYKLDI

SEQ ID NO: 1275 - DNA, 543 bp, Streptococcus pyogenes
atgattggtcaaggaatagcgtctctacttggtttacaacctattttgatgtctctccttattgccatgattttctgcttccttattgtttctccaattacaacggtaggaattgctcttgcgattaacttatctggtattggttcaggtgccgcaagctttggactttgcttagcaggttgggctgttaattcaaaaggaacttcacttgctcacgtcttgagatcaccgaaaatttcaatggccaacgttttatcaaaaccaaaaatcatgttgccaatgttatgttctgcagctgtacttggtgttattggtgctatctttaatattcaaggaacacctgctagtgcaggctttggaattagtggtttgatcggacctatcaatgcccttaatttagctaaaggcggatggtgtccagtaaatattctacttatcattatcatttttgtaggggcaccaattgttctcaatatgatctttaactacctttttatcaaggtgcttaaagtgattgatccaatggattacaaacttgatatc

SEQ ID NO: 1276 - protein, 181 aa, Streptococcus pyogenes
MIGQGIASLLGLQPILMSLLIAMIFCFLIVSPITTVGIALAINLSGIGSGAASFGLCLAGWAVNSKGTSLAHVLRSPKISMANVLSKPKIMLPMLCSAAVLGVIGAIFNIQGTPASAGFGISGLIGPINALNLAKGGWCPVNILLIIIIFVGAPIVLNMIFNYLFIKVLKVIDPMDYKLDI

SEQ ID NO: 1277 - DNA, 618 bp, Streptococcus agalactiae
gtgaaatcacaaacaatcattattagtaggaggcatcttatgtcggatgttgtcgaaaaacaaacaactaaatcgtttataatgaacgtattaaatggtttagctttagggactgttattgtcttgataccaggagcaatccttggagaattaatgaaagctttactgccaatgtggagcggctttgcaactttaatcgctgcaacagcagttgcaacaagtatgatggggcttgttattggtattatggttggtctcaattttaaatttaatcccattcaatcagcatcactaggattagcggttatgtttgcaggtggagctgcaaccttccttaaaggcgctattatgctaaaaggaacaggcgatatcattaacatgggaattactgctgccttaggtgtccttttgatccaatttttatctgacaagacgaaatcattcactttgattgtcattccaacagtaacactcttactagttggaggagtaggtcatgtgttattaccttatgtcaaaatgattaccaccatgattggacaagggacacgccgtacgcatgaaaactttctcttcatccttttgtgcccggacatcaattttgaaaagattcctttt

SEQ ID NO: 1278 - protein, 206 aa, Streptococcus agalactiae
MKSQTIIISRRHLMSDVVEKQTTKSFIMNVLNGLALGTVIVLIPGAILGELMKALLPMWSGFATLIAATAVATSMMGLVIGIMVGLNFKFNPIQSASLGLAVMFAGGAATFLKGAIMLKGTGDIINMGITAALGVLLIQFLSDKTKSFTLIVIPTVTLLLVGGVGHVLLPYVKMITTMIGQGTRRTHENFLFILLCPDINFEKIPF

SEQ ID NO: 1279 - DNA, 1056 bp, Streptococcus pyogenes
atgacaacaacagataaagagacatttagttcttttatgaataaggtcttggctggtacagcgattgctatcgttgtggcactcattccaaatgctattttagcgactttcttaaaaccgcttttgccaaatatggcagctgctgaatttttacacattgtgcaagtcttccaattcttcacgccgattatggctggtttcttgattgggcaacaatttaagtttaatcctatgcaacagttggctgttggtggagctgcttatatcggttctggagcctgggcttatacagaagtcattcaaaaaggtgtggcgacaggaacattccaacttagaggtattggggacttaatcaatatgatgattacagctagccttgcggttttagctgtgaaatattttgggaataaatttggctctttaaccattatcttgttacctatcactataggaactggcgtaggttatattggttggaaatttttgccttatgtgtcttacgtgacaaccctgatcggacaagggattaattcttttacaaccttacaacctattttaatgtctattttaattgcagttgctttctcgcttatcattgttagtccgatttcaactgttgcaatcggtttagctattgggcttaatggaatggctgcgggagcagcttctatgggaattgcatcgacagcagcagtcttagtgtgggcgacgcttaaagttaataaatctggtgtaccaattgctatcgcacttggggctatgaaaatgatgatgccaaacttcttgaaacatcctatcatggctattccgatggtgttcactgcagcaattagctcattaacagtaccattgtttaatcttgttggaacaccagcttcatctggttttggcttagttggtgcagtaggtccgattgcttctttagcaggtggtagctcaatacttattattatccttgcttggatcattgttccgtttgcggttgcttttgcggcgcataaggtttctaaagatattctaaaactgtataaagaagacattttcgtctttgaaggc

SEQ ID NO: 1280 - protein, 352 aa, Streptococcus pyogenes
MTTTDKETFSSFMNKVLAGTAIAIVVALIPNAILATFLKPLLPNMAAAEFLHIVQVFQFFTPIMAGFLIGQQFKFNPMQQLAVGGAAYIGSGAWAYTEVIQKGVATGTFQLRGIGDLINMMITASLAVLAVKYFGNKFGSLTIILLPITIGTGVGYIGWKFLPYVSYVTTLIGQGINSFTTLQPILMSILIAVAFSLIIVSPISTVAIGLAIGLNGMAAGAASMGIASTAAVLVWATLKVNKSGVPIAIALGAMKMMMPNFLKHPIMAIPMVFTAAISSLTVPLFNLVGTPASSGFGLVGAVGPIASLAGGSSILIIILAWIIVPFAVAFAAHKVSKDILKLYKEDIFVFEG

SEQ ID NO: 1281 - DNA, 882 bp, Streptococcus agalactiae
atggatattagacaacttacttactttattgctgttgcagaagcaaaaaattattcacgcgctgcaaaaagtctttttgtgacccaacctacactttcacaatccattaaaaaattagaagcagaattaaatactattttattcttacaaaatggtcgtcaactcgctttaactgaagcaggagaaattctctatgagaaaggacaattgttgatgactaatgttaatcaaatggttacggagatccagcaattaaatcaagaaaaaaaggaaggtatccgtgtagggcttacttctctttttgctattcaatttatgaaacagatttcaacttttatggctacacattcaaatgttgaagtatctttgattcaagatggttcccgtaaattacaagaattgttagcaaaaggaaagatcgatattggcttattgtcctttccaagtacccgcaatgatatcactatcgaaccactgcaaacctcaactaaaggatataaagtaagcattgtcatgccaaaatcgcatcctcttgcaacacttcctgaaattgaacttaatgatttaagagattataaagttgcctcactcaacgaacattatatgctaggagagatgttgcctcgtaaatgtcgtgctttaggatttgacccccatatcgtctttaaacacaatgactgggaagttcttattcatagtttacaagacctcaatgcagtcactattttaccaagtgaatttgaaagcattagccaagttcaagatttatgctgggtcccacttaaggataaaaataatttttatccgattggtattgcttaccgaaatgatacttcttttagtcctatgattgaagaatttttaagtcttttaaagaccaat

SEQ ID NO: 1282 - protein, 294 aa, Streptococcus agalactiae
MDIRQLTYFIAVAEAKNYSRAAKSLFVTQPTLSQSIKKLEAELNTILFLQNGRQLALTEAGEILYEKGQLLMTNVNQMVTEIQQLNQEKKEGIRVGLTSLFAIQFMKQISTFMATHSNVEVSLIQDGSRKLQELLAKGKIDIGLLSFPSTRNDITIEPLQTSTKGYKVSIVMPKSHPLATLPEIELNDLRDYKVASLNEHYMLGEMLPRKCRALGFDPHIVFKHNDWEVLIHSLQDLNAVTILPSEFESISQVQDLCWVPLKDKNNFYPIGIAYRNDTSFSPMIEEFLSLLKTN

SEQ ID NO: 1283 - DNA, 480 bp, Streptococcus pyogenes
ttgtcccaaggaaaaatcgatattggtctcctctcctttctaagtattcgaaaggatattaccattgagctattacaaacgtccacaaaaggctataaggtcagtatcgttctcctcaaacagcaccctttggcgcaacatcctcagttaaaacttaaagatttaaaaggctataagattgcttctttaaacgatcactacatgttaggcgaaatgcttcctagaaaatgccgagctctcggttttgaaccagatattgtctttaaacacaatgattgggaagttcttattcatagtttgcacgatttaaataccttgactatcctcccgagtgattttgagagtcttaatcaggtagataacttagtttggattcctttgcaagataaaaataatttttaccctattgggattgcttaccgagatgatgcgagtttcagtccagttattgaggaatttttaagccttttaaaaacgaac

SEQ ID NO: 1284 - protein, 160 aa, Streptococcus pyogenes
LSQGKIDIGLLSFLSIRKDITIELLQTSTKGYKVSIVLLKQHPLAQHPQLKLKDLKGYKIASLNDHYMLGEMLPRKCRALGFEPDIVFKHNDWEVLIHSLHDLNTLTILPSDFESLNQVDNLVWIPLQDKNNFYPIGIAYRDDASFSPVIEEFLSLLKTN

SEQ ID NO: 1285 - DNA, 867 bp, Streptococcus agalactiae
atgctactatttaatagaaattgttgtagggattatcaaaaggaggaagaaatgattttaaaaatttgtcgtgcagcatatagtttacaatggggaggtgtttaccaattagctttgctggattatcctcgaattaaggcgtttgaattggaaaggataggagctttcatagcttacgagaaacaatataaaagaaaaactgagatacaatgtgacgataaacatctcctcgcaaaaattgttcattttttaaaatacaatagttttacttttccctatattcccaaatatagagaagcggcagctacttttaatgaggatggtattagtttaacttctgattttttaagccatacatgtacgattgaaactgcaaaactaatttttaaagaaggtaaaatcttatcagcagttaaagcctttaataagcctgctgaagtactggtaaaagataagaggaatgctgctggagaccctaaagattactttgactatgtgatgttgaactggtcaaataccaattctggttatcgtttagtaatggaaagattgttaggcaaagcaccatctgaacaggagttaacagtaggttttaagccaggggtcagttttcattttacttatcaagatatcatcaatcatcctgattctatttttgatggttatcatcctgctaaaattaaaaatcagctttctttagcagaacatttagttgcatgtgttatcccaaaacattatcaagaagattatcaaagccttgtgcccaatgacttgaaacacagggtttattatttagattactgtaacgaaacactttatgagtggaatcaaaaagtttatgattttctttgtcatttggaaaataaa

SEQ ID NO: 1286 - protein, 289 aa, Streptococcus agalactiae
MLLFNRNCCRDYQKEEEMILKICRAAYSLQWGGVYQLALLDYPRIKAFELERIGAFIAYEKQYKRKTEIQCDDKHLLAKIVHFLKYNSFTFPYIPKYREAAATFNEDGISLTSDFLSHTCTIETAKLIFKEGKILSAVKAFNKPAEVLVKDKRNAAGDPKDYFDYVMLNWSNTNSGYRLVMERLLGKAPSEQELTVGFKPGVSFHFTYQDIINHPDSIFDGYHPAKIKNQLSLAEHLVACVIPKHYQEDYQSLVPNDLKHRVYYLDYCNETLYEWNQKVYDFLCHLENK

SEQ ID NO: 1287 - DNA, 771 bp, Streptococcus agalactiae
atgagcggtgaaaattctatttctttaatgtcattactaatggcatcgtcattagttttgattactttatttttttcttactggcaaaagttaaacctagaaaaagaagtgattattagcgctatccgagcagtgattcaattattagcagtgggttttttgctagactatatatttggttatcaaaatcctattttcacagctcttttaatgctattcatgattattaatgcttcttataacgcagctaagcgtggtaaagggattaataaagggtttgttatttcatttatagctattgggtcagggactataatcactttatctgtcttgattttttcaggaattttaaaatttgttccgaatcaaatgattcctgtaggtggtatgattattagtaattctatggtagcaatcggtttgtgctataaacaattattgtccgaatttagaagtaaacaagaggaagtggagacaaaattagctttaggagcagatattttgccagcttcgattgatattattcgtgatgttatcaaaactggtatggtacctacaattgattcagctaaaacacttgggattgtatctttgccagggatgatgacagggttaattcttgctggaacttcacctatccaagcggttaaataccaaatgatggtgacgtttatgctattagcaacgacttcgatagcttcttttgtagctacttatttggcttataaaattttctttaataatcgtaagcaattagtagtaacaaaagat

SEQ ID NO: 1288 - protein, 257 aa, Streptococcus agalactiae
MSGENSISLMSLLMASSLVLITLFFSYWQKLNLEKEVIISAIRAVIQLLAVGFLLDYIFGYQNPIFTALLMLFMIINASYNAAKRGKGINKGFVISFIAIGSGTIITLSVLIFSGILKFVPNQMIPVGGMIISNSMVAIGLCYKQLLSEFRSKQEEVETKLALGADILPASIDIIRDVIKTGMVPTIDSAKTLGIVSLPGMMTGLILAGTSPIQAVKYQMMVTFMLLATTSIASFVATYLAYKIFFNNRKQLVVTKD

SEQ ID NO: 1289 - DNA, 654 bp, Streptococcus agalactiae
atgtcctatttaacctttaaacacgttgattttaaaacggatgataagttggttttaaatgatatcaactttgcaattgatgaaggtgattttgtttctattgtagggccatctggaagtggtaagagtactgtattaaaattagccagtggtttaatgagtcctactgcaggtcatattttctttgatggaaaagatttgaaccaattagaaccgattgaaagtcgaaaaatgatttcttactgttttcaaacgccacatttatttggtaatacagtggaagacaatattagttttccttaccacattcgacacgaaaaagtagattatagacgcgttgatgatttatttcaacgttttgaaatggaccagtcttacctgaaacaggatgtcaaaaaactatcaggaggagaaaagcaacgtattgctctgattaggcaattattgtttgaacctaaagttttactcttagatgaagttacttcggctttagacaatcataataaagctattgttgaaaaggttattaaatcattacatgacaaaggaataacgattttgtggattacgcatgatgaggaacagagtcgtcgatttgccaataaagtcttaaaagttgtcaatggtagtattgaagcaatggaggttataaaa

SEQ ID NO: 1290 - protein, 218 aa, Streptococcus agalactiae
MSYLTFKHVDFKTDDKLVLNDINFAIDEGDFVSIVGPSGSGKSTVLKLASGLMSPTAGHIFFDGKDLNQLEPIESRKMISYCFQTPHLFGNTVEDNISFPYHIRHEKVDYRRVDDLFQRFEMDQSYLKQDVKKLSGGEKQRIALIRQLLFEPKVLLLDEVTSALDNHNKAIVEKVIKSLHDKGITILWITHDEEQSRRFANKVLKVVNGSIEAMEVIK

SEQ ID NO: 1291 - DNA, 1152 bp, Streptococcus pyogenes
ttgactaagccaattatcacatttaacaatgtttcaaaaacatttgaggacagtggaacacaggttctaaagaacattaactttgaccttgaagaaggaaaattttacaccctgcttggagcttctggctctggaaaatcaactattttaaatattatggcgggcctactagatgccagcagcggagacatttatttagatggggaacgtattaatgatttgccgattaataaacgtgacattcataccgttttccaaaattatgccctcttccctcatatgactgtttttgagaatgttgcctttgctttgaagctgaagaaagtggacaagaaagagattgctaagcgcgtgaaagaaaccttgaaaatggttcaattagaagggtttgaaaatcgttctatccagaagttgtctggtggtcaacgtcaacgtgttgccattgcgcgtgcgattatcaatcaaccgcgtgtggtcttacttgacgaaccactctcagcccttgatttgaaattaagaacagagatgcaatatgaattacgtgaattgcaacaacgtctaggcattacctttgtttttgttactcacgatcaagaagaagccttggccatgagtgattggatttttgtcatgaatgaaggtgaaattgttcagtcgggaacaccagtggatatttacgatgagccaattaatcattttgttgctaattttattggagaatctaatattattaacggtaccatgattgaagactatcttgtctcctttaacgggaaagaatttgaatctgtggacggtggaatgcgccctaatgagcctgttgaagtggttattcgtcctgaagatcttcaaattactttgccagaagaagggaaattacaagttaaggttgatacccaattattccgcggggttcactacgaaattattgcctatgatgaattgggtaatgaatggatgattcattctacccgcaaagctatcgaaggagaagttatcggattagattttacccctgaagatcttcatatcatgcgtcttaatgagactgaagaggaatttgatgcccgtattgaagaatatgtggaaatggatgagcctgaagatggattgattaatgccattgaggaggagcgtaatgaagaaaacctc

SEQ ID NO: 1292 - protein, 384 aa, Streptococcus pyogenes
LTKPIITFNNVSKTFEDSGTQVLKNINFDLEEGKFYTLLGASGSGKSTILNIMAGLLDASSGDIYLDGERINDLPINKRDIHTVFQNYALFPHMTVFENVAFALKLKKVDKKEIAKRVKETLKMVQLEGFENRSIQKLSGGQRQRVAIARAIINQPRVVLLDEPLSALDLKLRTEMQYELRELQQRLGITFVFVTHDQEEALAMSDWIFVMNEGEIVQSGTPVDIYDEPINHFVANFIGESNIINGTMIEDYLVSFNGKEFESVDGGMRPNEPVEVVIRPEDLQITLPEEGKLQVKVDTQLFRGVHYEIIAYDELGNEWMIHSTRKAIEGEVIGLDFTPEDLHIMRLNETEEEFDARIEEYVEMDEPEDGLINAIEEERNEENL

SEQ ID NO: 1293 - DNA, 177 bp, Streptococcus agalactiae
ttgcaactatcaccaataaatgctgcaataaagaaaataataagaaaagttacaatattgaaggacatttttggatttgcagcaagggctccagcagcaaataataaactatcacctggtaaaaatggaaagatgacagccccagtttcaacgaaaataacgaggaagagcaataga

SEQ ID NO: 1294 - protein, 59 aa, Streptococcus agalactiae
MQLSPINAAIKKIIRKVTILKDIFGFAARAPAANNKLSPGKNGKMTAPVSTKITRKSNR

SEQ ID NO: 1295 - DNA, 636 bp, Streptococcus agalactiae
atgtttttaatcgattttattttacatattgatactcatatctatgctatggctaacactgttggtaattggacctatctattgctcttcctcgttattttcgttgaaactggggctgtcatctttccatttttaccaggtgatagtttattatttgctgctggagcccttgctgcaaatccaaaaatgtccttcaatattgtaacttttcttattattttctttattgcagcatttattggtgatagttgcaacttcttgattggtcgtacatttggttaccgttttatcaaacatcctttctttcgtcgtttcattaaagaaaaaaatatccgagatgctgagctttattttgagaaaaaaggtactgctgccatcattttagggcgctatatccctattatcagaacctttgttccttttgtagcaggtattagtcagctccctccaaaagtatttatcaaacgcgccttcattgcagcattatcttggtcagttattgcaacaggttctggttttctctttggtaatattccttttgtgaagcagcacttctcgcttattatcttgggaattgtatttgttaccttaattcctgtccttatttctggtgtcaaatcatatcggaacactaag

SEQ ID NO: 1296 - protein, 212 aa, Streptococcus agalactiae
MFLIDFILHIDTHIYAMANTVGNWTYLLLFLVIFVETGAVIFPFLPGDSLLFAAGALAANPKMSFNIVTFLIIFFIAAFIGDSCNFLIGRTFGYRFIKHPFFRRFIKEKNIRDAELYFEKKGTAAIILGRYIPIIRTFVPFVAGISQLPPKVFIKRAFIAALSWSVIATGSGFLFGNIPFVKQHFSLIILGIVFVTLIPVLISGVKSYRNTK

SEQ ID NO: 1297 - DNA, 225 bp, Streptococcus agalactiae
gtgttaaatagaaatttttggatacattacttagtgttccgatatgatttgacaccagaaataaggacaggaattaaggtaacaaatacaattcccaagataataagcgagaagtgctgcttcacaaaaggaatattaccaaagagaaaaccagaacctgttgcaataactgaccaagataatgctgcaatgaaggcgcgtttgataaatacttttggagggagc

SEQ ID NO: 1298 - protein, 75 aa, Streptococcus agalactiae
MLNRNFWIHYLVFRYDLTPEIRTGIKVTNTIPKIISEKCCFTKGILPKRKPEPVAITDQDNAAMKARLINTFGGS

SEQ ID NO: 1299 - DNA, 471 bp, Streptococcus agalactiae
atgcttgatagaaccattcgtcaatatcaaaatcgcagagataccactcttcccgatgcaaattggaaaccattaggttggcatcaagtagctactaatgaccattatggacatgcagtcgacaaggggcatttaattgcctatgctttagctggaaatttcaaaggttgggatgcttccgtgtcaaatcctcaaaatgttgtcacacaaacagctcattccaaccaatcaaatcaaaaaatcaatcgtggacaaaattattatgaaagcttagttcgtaaggcggttgaccaaaacaaacgtgttcgttaccgtgtaactccattgtaccgtaatgatactgatttagttccatttgcaatgcacctagaagctaaatcacaagatggcacattagaatttaatgttgctattccaaacacacaagcatcatacactatggattatgcaacaggagaaataacactaaat

SEQ ID NO: 1300 - protein, 157 aa, Streptococcus agalactiae
MLDRTIRQYQNRRDTTLPDANWKPLGWHQVATNDHYGHAVDKGHLIAYALAGNFKGWDASVSNPQNVVTQTAHSNQSNQKINRGQNYYESLVRKAVDQNKRVRYRVTPLYRNDTDLVPFAMHLEAKSQDGTLEFNVAIPNTQASYTMDYATGEITLN

SEQ ID NO: 1301 - DNA, 480 bp, Streptococcus pyogenes
atgccttacttactaagtcgacacgacagtatcgaaatcgctatcaaacggataatgcttatcgtaactttaagcccagcaggttggcaccgattgcaccacttaaaaggaagttatgatcacgcggttgatagagggcatttgctaggttatgctttagttggtggactgaaaggttttgatgcttctactggtaatcctgataatattgccactcaactaagttgggctaatcaagcaaataaaccctacttgacaggtcagaattactatgaaggtttagtacgtcgtgctttagataaggggcatcgcgtccgctaccgtgtcaccctactttatgatggtgataatctactagccagcggtagccatttggaggctaaatcctctgatgacagcttgacttttaacgtgtttgttccaaatgtccaagcaggattgaccgctgactatcggacgggacaaatagctatcaatctc

SEQ ID NO: 1302 - protein, 160 aa, Streptococcus pyogenes
MPYLLSRHDSIEIAIKRIMLIVTLSPAGWHRLHHLKGSYDHAVDRGHLLGYALVGGLKGFDASTGNPDNIATQLSWANQANKPYLTGQNYYEGLVRRALDKGHRVRYRVTLLYDGDNLLASGSHLEAKSSDDSLTFNVFVPNVQAGLTADYRTGQIAINL

SEQ ID NO: 1303 - DNA, 216 bp, Streptococcus agalactiae
atgttctacatgaagttagctaaccgtctatcactagctgctacgattgttaatgaagcaaatgccaattctccatttggtattattatacatagtgataaggctgaaaacgttgaatggaacgattttgagacacaattccctgatttattcaattcaccaaaaaaagaggagtctcctaaaaaaagtctatggcaacatttctttagtcaaaaa

SEQ ID NO: 1304 - protein, 72 aa, Streptococcus agalactiae
MFYMKLANRLSLAATIVNEANANSPFGIIIHSDKAENVEWNDFETQFPDLFNSPKKEESPKKSLWQHFFSQK

SEQ ID NO: 1305 - DNA, 456 bp, Streptococcus pyogenes
atgactaatttagaagataagctattaaaaggagcctggggagaaagaagattaaatcctgagcagcaacgctactatctaggaacgtatgctgaacgagtcgttttaagtgctttattagacgaagctcaaactaaaacagtaaaagactatttgaaaagagaattaccgagccttcaattagtctatcaacctttacacttaaaaatctcttccaagctggcacctcaacttcaaatactctatatgaaattagcaaaagaaaaccatttacctgttactattattacagaaacgcatatgacttcaccttttgcgtttatccttcataccgaccacgcaataaatctgaaggaaacacgtttagaagtcatcttaaagcagacaaaaaacgatcaacttagcaaacaaactcctgaaaaaaccaaatccttttggaaaagatttttgaaaaaa

SEQ ID NO: 1306 - protein, 152 aa, Streptococcus pyogenes
MTNLEDKLLKGAWGERRLNPEQQRYYLGTYAERVVLSALLDEAQTKTVKDYLKRELPSLQLVYQPLHLKISSKLAPQLQILYMKLAKENHLPVTIITETHMTSPFAFILHTDHAINLKETRLEVILKQTKNDQLSKQTPEKTKSFWKRFLKK

SEQ ID NO: 1307 - DNA, 483 bp, Streptococcus agalactiae
atggaaatttgggatgcttatgaccaatatgggttcattacaggtcttacacttaatagggatcaaaatatcccacaaggcttattccacttagttgttgatgttatcctttttcatgaggatggtgacgtattgatgatgaaacggcaccctaaaaagaaagcttttcctgcttatttcgaagccaccgctggcggatctgcccttaaaggagaaaatgctaagcaagctattctaagggaactcaaagaagaaactggtatcgttcctcaatgtctaacctttcttaatagagagtggttctctgagcgttcttactttgtagaccattttatcgcaaaatacaatggtgcaaaagatataattacattgcaagaaggagagaccgttgactatatctggttaaaaccagaatatattgatttatttttatctaaaaacaaattaataccctctcaaataaaactcttaaaatccttaatc

SEQ ID NO: 1308 - protein, 161 aa, Streptococcus agalactiae
MEIWDAYDQYGFITGLTLNRDQNIPQGLFHLVVDVILFHEDGDVLMMKRHPKKKAFPAYFEATAGGSALKGENAKQAILRELKEETGIVPQCLTFLNREWFSERSYFVDHFIAKYNGAKDIITLQEGETVDYIWLKPEYIDLFLSKNKLIPSQIKLLKSLI

SEQ ID NO: 1309 - DNA, 639 bp, Streptococcus agalactiae
atgattaaaggtttgttagtcatggacgttgattcaaccttaataatggaagaagctattgatttattagctattgaagcaggggtggggaaacaggttgctgcactgactgacgctgcaatgcgtggcgagttagattttgaagaagctttgaagaaaagagtagcgctacttaaaggtttgcctgttactattttgacagatatattatcctcaatacattttactccaggggcttatgaattgattaaagagtgtcacaagcgtcagatgaaagttggtcttgtatcaggaggttttcacgagacgattgatatcttagctaagcaattacaagttgattatgtcaaagcgaatcgtcttggtgtcaaaggtggttttctcactggcgaagttgagggagagattgtcactaaagaagtgaaaaaaataaagttaaaagagtgggcttctgaaaatcacttagacctttcacaaaccatcgcaatgggagatggtgccaatgatttaccaatgatcaaatccgctggggtaggaattgctttttgtgcaaaaccaattgtcagagaagaagctgcgtatcagattaatgaaaaaaatttgcttaaggtatttgatattattgatgcaaatgaaaac

SEQ ID NO: 1310 - protein, 213 aa, Streptococcus agalactiae
MIKGLLVMDVDSTLIMEEAIDLLAIEAGVGKQVAALTDAAMRGELDFEEALKKRVALLKGLPVTILTDILSSIHFTPGAYELIKECHKRQMKVGLVSGGFHETIDILAKQLQVDYVKANRLGVKGGFLTGEVEGEIVTKEVKKIKLKEWASENHLDLSQTIAMGDGANDLPMIKSAGVGIAFCAKPIVREEAAYQINEKNLLKVFDIIDANEN

SEQ ID NO: 1311 - DNA, 1722 bp, Streptococcus agalactiae
atgtcgagcggaatcatattgctgcttgtggctatagtcctgcttgtgattattgcctacgtagtcggcgtcgtaataagaaaacgtaatgatacattaattgcaaacttagaaactagaaaacaagagttagttgaccttcctgtgcaagaggagattgagcaagtcaaattgcttcatttgattggccaaagtcaatcaacttttagagaatggaaccaaaaatggactgatttatcaactaattcatttaaagatattgattttcatttagttgaagctgaaaatcttaatgattcatttaattttgtgcgtgctaagcacgagattgataatgttgatagtcagctaactattatagaagaagatattgtttcgattcgtgaagctttagaagttttaaaagagcaagaagagaaaaatagtgcccgtgtaacacatgctttggacctatacgaaacacttcaaaaatcaatttctgaaaaagaagataattacgggacaaccatgccagaaattgaaaagcagttgaaaaatatcgaggctgaattttcacattttgtgaccttaaactcaactggtgacccgattgaagcttctgaagttttgaataaagcagaggagcatacgattgctttagggcaaattacagaacaaattccagctattgttgctaaattagaagacgattttccagatcagttagatgatttggagacaggatatcgtcgtcttttagaggaaaactaccatttccctgaaaaggatattgaacaacgttttcaagaagttcgtgaggctattcgttcgaattcagatggtttagttagtttggatctagatcgtgctcgcgatgaaaatgaacatattcaagaaaaaattgataaactttatgatatttttgaacgtgagattgctgcttataaagtagctcataaggatagtaaaattattcctcaattccttgctcatgcaaaatctaacaatgaacaactggggcatgaaatcaaacgattatctgctaaatatatcttaaatgaaaatgaaagcttaagtttacgttccttcacaaatgatttggaagaaattgaaacaaaggttttaccttctgtagaaaattttggtcaagaagcttcaccttatactcatctacaaattttatttgagcgtacgttgaaaacattgactactgttgaagaaaatcaaatggaagtttttgaagccgttaaaactattgaaagcgttgagacacgagcacgccaaaatatggataagtatgttaacaagctccatatgattaaacgtttcatggaaaaacgcaatcttccaggaatcccgcaagacttcttaagcactttctttacaacaagttctcaaattgaggcacttattaatgaactcagtcgcggtcgtattgatattgaggctgtttcacgtttaaatgatgtgactacaaatgctatcgctaatttagagcaagctacatatctagttgttcaagatgcgactctcacagagcagttactacagtattcaaaccgttatcgtagttttgaacaaaatgtgcaaaagagctttgaacaagctttgtacttatttgaagttgaacataactataaagcatctttcgatgaaatttcatacgcacttgagactgtggaaccaggtgtaactgaccgttttgtgacgtcttatgaaaagacacaagaacgtattcgtttc

SEQ ID NO: 1312 - protein, 574 aa, Streptococcus agalactiae
MSSGIILLLVAIVLLVIIAYVVGVVIRKRNDTLIANLETRKQELVDLPVQEEIEQVKLLHLIGQSQSTFREWNQKWTDLSTNSFKDIDFHLVEAENLNDSFNFVRAKHEIDNVDSQLTIIEEDIVSIREALEVLKEQEEKNSARVTHALDLYETLQKSISEKEDNYGTTMPEIEKQLKNIEAEFSHFVTLNSTGDPIEASEVLNKAEEHTIALGQITEQIPAIVAKLEDDFPDQLDDLETGYRRLLEENYHFPEKDIEQRFQEVREAIRSNSDGLVSLDLDRARDENEHIQEKIDKLYDIFEREIAAYKVAHKDSKIIPQFLAHAKSNNEQLGHEIKRLSAKYILNENESLSLRSFTNDLEEIETKVLPSVENFGQEASPYTHLQILFERTLKTLTTVEENQMEVFEAVKTIESVETRARQNMDKYVNKLHMIKRFMEKRNLPGIPQDFLSTFFTTSSQIEALINELSRGRIDIEAVSRLNDVTTNAIANLEQATYLVVQDATLTEQLLQYSNRYRSFEQNVQKSFEQALYLFEVEHNYKASFDEISYALETVEPGVTDRFVTSYEKTQERIRF

SEQ ID NO: 1313 - DNA, 1722 bp, Streptococcus pyogenes
atgtcaagcggaattatcttgctgattgtggctatagtcctactagtgattatcgcctatctagtgggtgtcatcatacgaaagcgtaatgattccctaattaccagtctagaagaacgaaaacaggccttgtttgctttgcctgttaatgatgaaattgaagaagtaaagtcacttcatttgataggacagagccaaacctcttttcgggaatggaatcagaaatgggtagacttaactgtgaattcgtttgcagatattgaaaatcatatttttgaagctgaaaatttgaatgatacgtttaattttattcgcgccaagcatgagattaatagcgttgaaagtcagcttaatcttgttgaagaagatatcgcttctattcgtgaagcacttaatatcttaaaagagcaagaagaaaaaaatagtgctcgtgtcacccatgctcttgatttatatgaaaagctccaagcttctatttctgagaatgaagataattttggttcaactatgcctgaaattgacaaacagatgaaaaacattgaaactgaattttcacagtttgtcgcactcaactcatcaggtgatcctgtagaagcttctgaagttctggatagagcagaagagcatactattgctctagggcagattacagagcagattccagctattgtggccaagttggaagatgattttccagatcagttagatgatttggaaacaggatatcgccgtttacttgaagaaaactatcattttccagaaaaaaacattgaggcacgttttcaggagattcgtgagtctattcgtgccaattcatcagagttagttacacttgacttggatcgtgctagagaagaaaacacgcatattcaagaacgcattgattctctttatgaagtctttgagcgcgaaattgccgcttataaggtagctgctaaaaatagtaagatgctacctcgttacctagaacatgtgaaacgtaataatgaacaactcaaagatgaaattgcacgtttatcacgtaaatatattctaagtgaaacggaaagtctgactgttaaggcatttgagaaggatattaaagagatagaagacagtacacttgctgttgcagaacaatttggtttacaagaaaaaccattttcagaactgcaagtgacttttgaacgcagtataaagacgcttactaatgtcgagtcaggtcaaatggatgtttttgcagcagttaaagatattgaaaaaattgaatcacaggcacgccataaccttgatgtttatgttactcagcttcatatgattaaacgttatatggaaaaacgtcacttgcctggaattccacaagactttcttagtgctttctttacaacgagttcacaattggaagctttgatggatgagcttagtagaggacggatcaatattgaggcagtgtcacgtttgtcggaagttgcgacggttgctattgctaatctagaagatttaacctatcaagtggttcaaaatgctaccttgactgaacaattactacaatattctaatcgctatcgttcttttgaagcaggagttcaaagtagttttgaacatgctttgagacttttcgaagtagaaaatgattatcaggcttcttttgatgaaatttcttatgctcttgaaacagttgaacctggggtaacagatcggtttgttaactcttatgaaaaaacacgagagcacattcgtttt

SEQ ID NO: 1314 - protein, 574 aa, Streptococcus pyogenes
MSSGIILLIVAIVLLVIIAYLVGVIIRKRNDSLITSLEERKQALFALPVNDEIEEVKSLHLIGQSQTSFREWNQKWVDLTVNSFADIENHIFEAENLNDTFNFIRAKHEINSVESQLNLVEEDIASIREALNILKEQEEKNSARVTHALDLYEKLQASISENEDNFGSTMPEIDKQMKNIETEFSQFVALNSSGDPVEASEVLDRAEEHTIALGQITEQIPAIVAKLEDDFPDQLDDLETGYRRLLEENYHFPEKNIEARFQEIRESIRANSSELVTLDLDRAREENTHIQERIDSLYEVFEREIAAYKVAAKNSKMLPRYLEHVKRNNEQLKDEIARLSRKYILSETESLTVKAFEKDIKEIEDSTLAVAEQFGLQEKPFSELQVTFERSIKTLTNVESGQMDVFAAVKDIEKIESQARHNLDVYVTQLHMIKRYMEKRHLPGIPQDFLSAFFTTSSQLEALMDELSRGRINIEAVSRLSEVATVAIANLEDLTYQVVQNATLTEQLLQYSNRYRSFEAGVQSSFEHALRLFEVENDYQASFDEISYALETVEPGVTDRFVNSYEKTREHIRF

SEQ ID NO: 1315 - DNA, 1950 bp, Streptococcus agalactiae
atgacagaagaaacaaagaatatggaacaacgtgctcaagaatatgacgcaagtcagattcaagtattagaaggtttagaagctgttcgcatgcgtccaggcatgtatatcggttcgacttcgaaagaagggcttcatcaccttgtatgggaaattgttgataactcaattgatgaagccttagctggatttgcaggacatattaaagtttacattgaaccagataactctattacagttgttgatgatggtcgcggtattccggtagatatccaagaaaaaactggaagaccagctgtagagacagtttttacagttctccatgccggtggtaaatttggtggtggcggatacaaggtttctggtggcttacatggtgtagggtcatctgttgttaatgcattgtcaacacaattagatgtcaaggtttataaaaatggcaaggttcattatcaagaataccaacgcggtgttgttgttaatgatcttgaaattatcggtgatactgacttatcaggaacaacagttcactttacgcctgacccagaaattttcactgaaaccactgtatttgattttgataaattagccaaacgtattcaggaattagcttttttaaatcgtggactaagaatctccatttcagacaagcgagaaggtcaagaagttgaaaaagaatatcactatgaaggtggtataggttcatacgttgagtttatcaatgagaacaaagaagtgatttttgaaaatcctatttatactgacggtgaattagatggtatttcagttgaagtagcaatgcagtatactactggatatcaagagactgttatgagttttgcaaataacatccacactcatgaaggaggaacgcacgaacaaggatttcgtactgccttgacacgtgtgattaatgattacgctaaaaagaataagattctcaaagaaaatgaagataatttaactggagaagatgttcgtgaaggtttaacagcagttatatctgttaaacatccaaatccacaatttgaaggacaaactaaaacaaaacttggaaattctgaagttgttaaaattacaaatcgtctctttagcgaagctttcaatcgattcctattagaaaatccacaagtagctaagaagattgttgaaaaaggaattttggcatctaaagcccgtattgcagcaaaacgggcgcgtgaagtaacacgtaaaaagtcaggcttagagatttcaaacttacctgggaaactggctgattgctcatctaataatgctgagatgaatgaactttttatagtggagggagattctgcgggagggtctgcaaaatcaggacgtaatcgtgagtttcaagcaattttaccgattaggggtaagattctaaacgttgaaaaagctacaatggataaaattttagcaaacgaagaaatccgaagtctcttcacagctatgggaactggatttggtgcagattttgatgtatcaaaagtcagatatcaaaaattagtcattatgactgatgccgatgttgatggagctcacatcagaactttacttttaactctgatttatcgttttatgcgacctgttttggaagcaggatatgtttatatcgctcaaccaccaatctatggtgtcaaagtaggaagtgagattaaagcttatattcagccaggggtcaatcaagaagaggaattacgtcaagctctagatacctatagttcaggacgttcaaaacctactgtacaacgttacaaaggtctaggtgagatggatgaccatcaactttgggaaacaacaatggatcctgaaaaccgcttgatggcacgtgtctcagttgatgatgcagcagaagcagataagattttcgatatgctaatgggagatcgagtagaaccacgacgtgaattcattgaagctaatgctgtttatagtaacttagatatc

SEQ ID NO: 1316 - protein, 650 aa, Streptococcus agalactiae
MTEETKNMEQRAQEYDASQIQVLEGLEAVRMRPGMYIGSTSKEGLHHLVWEIVDNSIDEALAGFAGHIKVYIEPDNSITVVDDGRGIPVDIQEKTGRPAVETVFTVLHAGGKFGGGGYKVSGGLHGVGSSVVNALSTQLDVKVYKNGKVHYQEYQRGVVVNDLEIIGDTDLSGTTVHFTPDPEIFTETTVFDFDKLAKRIQELAFLNRGLRISISDKREGQEVEKEYHYEGGIGSYVEFINENKEVIFENPIYTDGELDGISVEVAMQYTTGYQETVMSFANNIHTHEGGTHEQGFRTALTRVINDYAKKNKILKENEDNLTGEDVREGLTAVISVKHPNPQFEGQTKTKLGNSEVVKITNRLFSEAFNRFLLENPQVAKKIVEKGILASKARIAAKRAREVTRKKSGLEISNLPGKLADCSSNNAEMNELFIVEGDSAGGSAKSGRNREFQAILPIRGKILNVEKATMDKILANEEIRSLFTAMGTGFGADFDVSKVRYQKLVIMTDADVDGAHIRTLLLTLIYRFMRPVLEAGYVYIAQPPIYGVKVGSEIKAYIQPGVNQEEELRQALDTYSSGRSKPTVQRYKGLGEMDDHQLWETTMDPENRLMARVSVDDAAEADKIFDMLMGDRVEPRREFIEANAVYSNLDI

SEQ ID NO: 1317 - DNA, 1950 bp, Streptococcus pyogenes
atgattgaagaaaataaacattttgaaaaaaaaatgcaagaatacgatgccagtcaaattcaggttctagaagggctggaggctgtccgcatgcgtccagggatgtatattggctcgacagctaaagagggtttgcatcatttagtctgggaaattgttgacaactcaattgacgaagcattagcaggttttgcctctcatattaaagtctttattgaagcagataattccattacagtagtagatgatggccgtggaattccagttgatatccaagccaagacaggacgtcccgccgttgaaacagtttttacagtcttacacgcaggtggtaaatttggtggaggcggctataaggtttctggaggattacatggtgtagggtcatctgttgttaatgctttatcaacacaattagatgtacgtgtttataaaaacggccaaattcattaccaagaatttaaacgcggggctgttgtagcagatcttgaggtcattggaaccactgatgtgactggcacgaccgtacactttacacccgatccagaaatttttaccgaaacgactcagtttgattacagtgttttagcaaaacgtattcaagagttagcctttttgaatcgtggtttaaaaatttccattacagataagcgctcaggtatggaacaagaagaacatttcctttatgaaggtggaattggttcttatgttgaatttttaaatgataaaaaagatgttatctttgaaacgcccatctatacagatggtgaattagaaggtattgcagttgaagtagccatgcaatacacgactagctatcaagaaacagtcatgagttttgctaataatattcatactcatgaaggtggaacgcatgaacaaggctttagagcggctcttactcgggtcatcaatgactacgctaagaaaaataaaattcttaaagaaaatgaggacaatttgacaggagaagatgttcgtgaaggtttgacggcggtaatttctgttaagcatccaaatcctcaatttgaaggtcaaaccaaaacaaaattgggcaactcagaagtggttaagatcactaatcgtctctttagtgaggcctttcaacgttttcttttggaaaacccacaagttgctcgtaagattgtggaaaaagggattttggcttctaaagctagaattgcagctaagcgagcccgcgaagtcacccgcaaaaaatcaggcttagaaatttcaaacttacctggaaaattagcagactgttcgtcaaatgacgctaaccaaaacgaacttttcatcgtcgaaggagattcagcgggtgggtcggccaaatcaggtcgtaaccgagagtttcaagctatcttgcctattcgcggtaaaattttgaacgtggaaaaagcaactatggataagattcttgccaacgaagaaattagaagtctctttaccgctatgggtacaggttttggtgcagattttgacgtgtcaaaagctcgctaccaaaagctggttatcatgaccgatgccgatgtggatggcgctcatattagaaccttacttttaaccttgatttaccgctttatgagacctgttctagaagctggctatgtttacatcgcccagccacctatttatggtgttaaggtcggtagtgagattaaagagtatattcagccaggtattgatcaagaagaccaattaaaaacagctcttgaaaaatatagtattggtcgttcaaaaccaactgttcaacgttataaaggtcttggggaaatggatgaccatcaactttgggaaactactatggatcctgaaaatcgtttgatggcgcgtgtgacagttgatgatgccgcagaagcagataaagtatttgatatgttaatgggagatcgtgttgaaccaagacgtgatttcattgaggaaaatgcggtttatagtacactggatatt

SEQ ID NO: 1318 - protein, 650 aa, Streptococcus pyogenes
MIEENKHFEKKMQEYDASQIQVLEGLEAVRMRPGMYIGSTAKEGLHHLVWEIVDNSIDEALAGFASHIKVFIEADNSITVVDDGRGIPVDIQAKTGRPAVETVFTVLHAGGKFGGGGYKVSGGLHGVGSSVVNALSTQLDVRVYKNGQIHYQEFKRGAVVADLEVIGTTDVTGTTVHFTPDPEIFTETTQFDYSVLAKRIQELAFLNRGLKISITDKRSGMEQEEHFLYEGGIGSYVEFLNDKKDVIFETPIYTDGELEGIAVEVAMQYTTSYQETVMSFANNIHTHEGGTHEQGFRAALTRVINDYAKKNKILKENEDNLTGEDVREGLTAVISVKHPNPQFEGQTKTKLGNSEVVKITNRLFSEAFQRFLLENPQVARKIVEKGILASKARIAAKRAREVTRKKSGLEISNLPGKLADCSSNDANQNELFIVEGDSAGGSAKSGRNREFQAILPIRGKILNVEKATMDKILANEEIRSLFTAMGTGFGADFDVSKARYQKLVIMTDADVDGAHIRTLLLTLIYRFMRPVLEAGYVYIAQPPIYGVKVGSEIKEYIQPGIDQEDQLKTALEKYSIGRSKPTVQRYKGLGEMDDHQLWETTMDPENRLMARVTVDDAAEADKVFDMLMGDRVEPRRDFIEENAVYSTLDI

SEQ ID NO: 1319 - DNA, 558 bp, Streptococcus agalactiae
atgaattatcatgattatatttgggatttgggtggtacactacttgataattacgaaagttccacacgtgcttttgtagagactttgaaagaatttggatatcaagcagaccacgatagtgtgtatcaaaaattaaaagagtcaacagcagatgcaattgcatattttatccctgaagaagctgattttttaaaagagtataaggctaatgaagctaaggttttggaaacaccaattctattccaaggggcaaaagaacttttagcgaaaattcaaagacaaggtagtcgtaattttttggtgtctcatcgtgataatcaagttatagttattctggaaaaaacagaaattattgactattttacagaagtagtgactgctgataacggcttttcaaggaaacctagtcccgagagtatgctttatttgaaagaaaaataccaaattgataattgtttagtaataggcgatcgtgatatagataagcaagcaggagaatcggctggttttgataccttattagtcgatgggtcaaaatcattgatggagataatagag

SEQ ID NO: 1320 - protein, 186 aa, Streptococcus agalactiae
MNYHDYIWDLGGTLLDNYESSTRAFVETLKEFGYQADHDSVYQKLKESTADAIAYFIPEEADFLKEYKANEAKVLETPILFQGAKELLAKIQRQGSRNFLVSHRDNQVIVILEKTEIIDYFTEVVTADNGFSRKPSPESMLYLKEKYQIDNCLVIGDRDIDKQAGESAGFDTLLVDGSKSLMEIIE

SEQ ID NO: 1321 - DNA, 567 bp, Streptococcus pyogenes
atgaaaggtatgaattatcaagattatatatgggatttgggaggtaccttactcgataattacgagctttcaacccaagcttttgtccaaacgctagcttttttcagccttccaggagatcacgatgctgtttaccaaaaattaaaagaatcaaccgctatcgctgtggcaatgtttgctcctaatgagccagaatttttgcatgtgtataggctaagagaagcagacaaattggcacaacccatttggtgtttgggagctaaagaaattttgggaaagatagcgacttcaggttcgcgaaattttttaatttctcatcgagattgtcaggtgaaccaacttttagagcaagctgggttgctaatctattttacagaagtcgtgacagcttcaaatggctttgctcggaaaccaaatcctgaaagtttgttttatttaaaagaaaagtatgatattaatagtggattagtaattggagatcggctaattgataaacaagcaggacaagcagcgggttttaataccttgcttgttgacggtagaaaaaacctattggagatagtaacg

SEQ ID NO: 1322 - protein, 189 aa, Streptococcus pyogenes
MKGMNYQDYIWDLGGTLLDNYELSTQAFVQTLAFFSLPGDHDAVYQKLKESTAIAVAMFAPNEPEFLHVYRLREADKLAQPIWCLGAKEILGKIATSGSRNFLISHRDCQVNQLLEQAGLLIYFTEVVTASNGFARKPNPESLFYLKEKYDINSGLVIGDRLIDKQAGQAAGFNTLLVDGRKNLLEIVT

SEQ ID NO: 1323 - DNA, 1224 bp, Streptococcus agalactiae
atgaataaaaaaggaagtcctatgtcacaaaaatcaaactattttaaagggcaaattgattatgctgttgtgataccagtattttttttattaatgattggtttagcctcaatttatgttgcaacgatgaatgattatccttctaatatctatatcgcgatgtttcagcaggtgtcttggattattatggggtgtattattgcatttgtcgttatgcttttcagtactgaatttttatggaaagccacgccctatctgtatgctttaggactaaccctaatggttcttcccttaattttttatagtccacagctttttgcggcaacaggtgctaaaaattgggtgaccattggctcggtaactttgtttcaaccgtcagagtttatgaagatttcctatattttaatgttatctcgaataactgttagttttcatcagaaaaatcgcaaaacttttcaagatgattggaagttgctaggattgtttggtttggttacattgccagtgatgattcttctaatgttacaaaaagatttaggaacagcattagttttccttgccattttgtcaggtttaatccttttatcgggcatatcttggtggataatcttgccaattttatctactatcgttctttttatagctagctttttgatgatttttatctcaccaaacggcaaggaatggttttataatttggggatggatacatatcaaatcaaccgtttatctgcttggattgatccatttagttttgcagactcaattgcttatcaacaaacacagggtatggtatcaattggaagtggcggggtaacaggtaaaggttttaatattttagagctctcggttcctgttcgtgaaagtgacatgatttttactgtcattgctgagaattttggcttcattggttcggcgattgttttagggttatatctcattatcatttaccgtatgttaaggatcaccattgaatctaataatcaattttatacttttatatcaactggttttatcatgatgattgttttccatgtttttgaaaatattggtgcagcagttggtatattacctctaacaggaatcccacttccgtttatttcgcaaggtggaagttcattactaagtaatcttattggaattggattggtcttatccatgtcttatcaaaatacagttcgtcaggccaaggctaatggatcacatttgaagtatcgtagtata

SEQ ID NO: 1324 - protein, 408 aa, Streptococcus agalactiae
MNKKGSPMSQKSNYFKGQIDYAVVIPVFFLLMIGLASIYVATMNDYPSNIYIAMFQQVSWIIMGCIIAFVVMLFSTEFLWKATPYLYALGLTLMVLPLIFYSPQLFAATGAKNWVTIGSVTLFQPSEFMKISYILMLSRITVSFHQKNRKTFQDDWKLLGLFGLVTLPVMILLMLQKDLGTALVFLAILSGLILLSGISWWIILPILSTIVLFIASFLMIFISPNGKEWFYNLGMDTYQINRLSAWIDPFSFADSIAYQQTQGMVSIGSGGVTGKGFNILELSVPVRESDMIFTVIAENFGFIGSAIVLGLYLIIIYRMLRITIESNNQFYTFISTGFIMMIVFHVFENIGAAVGILPLTGIPLPFISQGGSSLLSNLIGIGLVLSMSYQNTVRQAKANGSHLKYRSI

SEQ ID NO: 1325 - DNA, 186 bp, Streptococcus agalactiae
ttgtctatcagaacagatatagatgagtttaaagaagcgattgataaaggctatatttcagggaacacagtagcgatagtgcgtaaaaacggaaagatatttgattatgtgttactacacgaagaagtgagagaagaagaggttgttacagttgagagagtgcttgatgtactgaggaagttatca

SEQ ID NO: 1326 - protein, 62 aa, Streptococcus agalactiae
MSIRTDIDEFKEAIDKGYISGNTVAIVRKNGKIFDYVLLHEEVREEEVVTVERVLDVLRKLS

SEQ ID NO: 1327 - DNA, 180 bp, Streptococcus pyogenes
atgctaacatacgacgagtttaagcaagcgattgacaatggatatatcgcaggcgatacagtagcgatcgtgcgtaaagacggacagatttttgattatgtgttgccacatgagaaagtaaagaatggagaagttgtgactaaggaaaaagtggaagaggtgctggtggagctttcgaga

SEQ ID NO: 1328 - protein, 60 aa, Streptococcus pyogenes
MLTYDEFKQAIDNGYIAGDTVAIVRKDGQIFDYVLPHEKVKNGEVVTKEKVEEVLVELSR

SEQ ID NO: 1329 - DNA, 198 bp, Streptococcus agalactiae
atgtcacaagaaaaactaaaatcaaaattagatcaagcaaaaggtggtgctaaagaaggctttggcaaaataaccggtgataaagagttagaagcaaaaggatttatcgaaaaaacaattgctaaaggcaaagaactagcagatgatgctaaagatgctgttgaaggggcagtagatgctgtcaaagaaaaactgaag

SEQ ID NO: 1330 - protein, 66 aa, Streptococcus agalactiae
MSQEKLKSKLDQAKGGAKEGFGKITGDKELEAKGFIEKTIAKGKELADDAKDAVEGAVDAVKEKLK

SEQ ID NO: 1331 - DNA, 198 bp, Streptococcus pyogenes
atgtcagaagaaaaattaaaatcaaaaattgagcaagcatctggtggcctaaaagaaggtgctggtaagttgacaggtgataaagagctagaagcaaaaggatttgttgaaaaaacaattgctaaaggcaaagaacttgcagacgatgcaaaggaagcggttgaaggtgctgtagatgccgttaaggaaaaattaaaa

SEQ ID NO: 1332 - protein, 66 aa, Streptococcus pyogenes
MSEEKLKSKIEQASGGLKEGAGKLTGDKELEAKGFVEKTIAKGKELADDAKEAVEGAVDAVKEKLK

SEQ ID NO: 1333 - DNA, 609 bp, Streptococcus agalactiae
atgaagaatatggcgctccctaaaatggctaccgttaagacaaaaacagctcttaaaaagactcaaaaaacgtatcctcaaaacttactcaaccagaaatttaatcctgataaacctaatcaagtatggtctactgacttcacctatatttctattggatataagaaatatgtctatctctgcgcaataattgatctctattctagaaaatatattgcttggaaattgagtcatcgtatggatgcaaagttagcatgtgacactctagaattagctcttaataaaagaaagattgaaggaacacttctctttcattccgaccaagggtcacaatttaaggccagggaatttagaaaaataattgatgacaacaatatcatgcattctttttctaaacctagatatccttatgataatgccgtaactgaagcatttttcaagtatttaaagcatagacaaatcaaccaaaaaaattatcaaaatatcaaacaggttcaattagactgctttgaatacattgagaatttttataacaattacatcccacatacggctaatctaggactaacccctaatcagaaagaagaaaattattttaacgcaataaaa

SEQ ID NO: 1334 - protein, 203 aa, Streptococcus agalactiae
MKNMALPKMATVKTKTALKKTQKTYPQNLLNQKFNPDKPNQVWSTDFTYISIGYKKYVYLCAIIDLYSRKYIAWKLSHRMDAKLACDTLELALNKRKIEGTLLFHSDQGSQFKAREFRKIIDDNNIMHSFSKPRYPYDNAVTEAFFKYLKHRQINQKNYQNIKQVQLDCFEYIENFYNNYIPHTANLGLTPNQKEENYFNAIK

SEQ ID NO: 1335 - DNA, 1080 bp, Streptococcus pyogenes
gtgttacaatctgttttaaaagacacaaaaacgaaaggacagcctatgtcaacagttaaacgctatgatgaagaattcaaacaatctcttgttaacctttatcaaactggaaaaactcggtctgaactctgtaaagactatggggtatccgcttctgcgcttgcaaaatggatcaaacagtattcccaagtcaaactcgaagataattctgtacttactgccaagcaaatacaagagctacaaaaacgtaatgcgcagcttgaagaggagaaccttatcctaaaaaaaagcaagtgccatattcatgcaaaacttaaagtaagactcctcgctgtttatcggttacgctttgaacacgtcacaacaaccttgtatcgtgttttacgtgtcaatcgctccacttactataaatttctaaaacataagccctcaaaaagagaattggataatcaaatttatagaaaacaaatacttgagatttataccaaagcaaacaaaagacttggtgtgaagtctatcaaagtcattcttcaaagagactacgacacaaaaatctctgaaggaagaatttaccgtctaatgaagaatatggcgctccctaaaatggctaccgttaagccaaaaacagctcttaaaaggactcaaaaaacgtatcctcaaaacttactcaaccagaaatttaatcctgacaaacctaatcaagtatggtctactgacttcacctatatttctattggatataagaaatatgtctatctctgcgcaatacttgatctctattctagaaaatgtattgcttggaaactgagtcaccgtatggatgcaaagttagcatgtgacactctagaattagctcttaataaaagaaagattgaaggaacacttctctttcattccgaccaagggtcacaatttaaggccagggaattgagaaaaataattgatgacaacactatcatgcattctttttctaaacctggatatccttatgataatgccgtaactgaagcatttttcaagtatttaaagcatagacaaatcaaccaaaaaaagtatcaaacaggttcaattagactgctt

SEQ ID NO: 1336 - protein, 360 aa, Streptococcus pyogenes
VLQSVLKDTKTKGQPMSTVKRYDEEFKQSLVNLYQTGKTRSELCKDYGVSASALAKWIKQYSQVKLEDNSVLTAKQIQELQKRNAQLEEENLILKKSKCHIHAKLKVRLLAVYRLRFEHVTTTLYRVLRVNRSTYYKFLKHKPSKRELDNQIYRKQILEIYTKANKRLGVKSIKVILQRDYDTKISEGRIYRLMKNMALPKMATVKPKTALKRTQKTYPQNLLNQKFNPDKPNQVWSTDFTYISIGYKKYVYLCAILDLYSRKCIAWKLSHRMDAKLACDTLELALNKRKIEGTLLFHSDQGSQFKARELRKIIDDNTIMHSFSKPGYPYDNAVTEAFFKYLKHRQINQKKYQTGSIRLL

SEQ ID NO: 1337 - DNA, 93 bp, Streptococcus agalactiae
atggaaaaaagaaatgatatcgataaagaatatggtaaaaacttaaggctcaagtctttcgcgtctttttgcatatcagctgttgaaacaaat

SEQ ID NO: 1338 - protein, 31 aa, Streptococcus agalactiae
MEKRNDIDKEYGKNLRLKSFASFCISAVETN

SEQ ID NO: 1339 - DNA, 1317 bp, Streptococcus agalactiae
atgaagaaattaaaaatattcccaaaaatgttcatacaaatattttctattcttggaatactaattatattagttcattcattattcttttttatctttcctaaaacatatttggagacgaggaaagtaaaaatccacattatggcagatgaaatttctaaaaatatgaatggaaaagagttaaaatatttagaccaaactttggagctttattctaaaagtagtgacataaaggtatttataaaaaaaaataataacaaaaatgaattacaaataaatgataatataaatgttaatgtaaaaagtgatagtaattctttaataattgaagaaagggaaattaaacttcatgatggcaaaaaaatacatcttcaatttgtttcaacagctgatatgcaaaaagacgcgaaagacttgagccttaagtttttaccatattctttatcgatatcatttcttttttccattgttatttctttaatttatgctaaatctataaaaaacaatatacaagaaataactatggttactgataaaatgataaaacttgacaaagaaacaagattgaaaattagttctaatgatgaaattggacaactaaaacagcaaatcaatgacttatattgtgctttattgaatacaattaatgatttggaatttaaaaataaggaaattttaaagttagaaaaattgaaatatgatttttttaagggggcgtcccacgaacttaaaactcctctttccagcctaaagatattacttgagaatatgaaatataatatcggaaaatataaagatagagacttttatatcagtgagtgtattaatattgtagataacttaacaaagaatgtctcgcaaatattatctttttattctataaaagacttgaataatgatgaagaatatttaaatgttggtgatacattagatgaagtattagaaaaatactctatcttagtaaatcaaaaaaaaataaatattaataaggaattattagactataatatttatataggaaaaacggcactaaatattgtattttctaatttgattagcaatgcagtaaaatatactaatcgaaatggaataattaatatcaaaatagctaatgattggttacttatagaaaactcatatgataaaaataaaatttcgaaaataaataaaattttagatgctagttttgatctaaaattggataatagtaatggattaggattaaatatagtaaagaatatacttaataagtataatataaagtatgaaatattacatggtgaaaattattttatatttaaaataaaaataatctct

SEQ ID NO: 1340 - protein, 439 aa, Streptococcus agalactiae
MKKLKIFPKMFIQIFSILGILIILVHSLFFFIFPKTYLETRKVKIHIMADEISKNMNGKELKYLDQTLELYSKSSDIKVFIKKNNNKNELQINDNINVNVKSDSNSLIIEEREIKLHDGKKIHLQFVSTADMQKDAKDLSLKFLPYSLSISFLFSIVISLIYAKSIKNNIQEITMVTDKMIKLDKETRLKISSNDEIGQLKQQINDLYCALLNTINDLEFKNKEILKLEKLKYDFFKGASHELKTPLSSLKILLENMKYNIGKYKDRDFYISECINIVDNLTKNVSQILSFYSIKDLNNDEEYLNVGDTLDEVLEKYSILVNQKKININKELLDYNIYIGKTALNIVFSNLISNAVKYTNRNGIINIKIANDWLLIENSYDKNKISKINKILDASFDLKLDNSNGLGLNIVKNILNKYNIKYEILHGENYFIFKIKIIS

SEQ ID NO: 1341 - DNA, 1386 bp, Streptococcus pyogenes
gtgagactaatcaaaaaaacctttttggtcatcaatggcttaattattgtagtggttacctctattttgttagtgctttattttgcaatgccaatttattacaccaaagtcaaagacaaagaagttaagtgtgaatttgaccaaacaagcaagcaaatcaaaggcaaaacggtaaccgagattagagatatcctaacaaaaaaaatcaacaaagataatatttggtacagcttagtagacagtgataaccaactgctctatccttccttgcagctcctagacggcgtcagtgaaagcaaagacagtcaaaatgttaatatcgtcaccacctttgacaactcttattctaatgttaaggtgatgagtcaaaaagtaaccctacgcgatggaaaaaaaatgacattgcttgggcaatcttcacttcaacccgtaacagatgctagcaaagttctccttgacctctacccgtcactattgattttttcagtgaccgtagggagtattgtcgcctacttatatagtaggacttctagccggcgtatccttagcatgtcacaaaccgccaaaaaaatggtcaacctagaaccaaacttaacgtgtaccattcacggcaaagatgaaatagcaatgttggctagtgatattaaccgtttgtatgcgagtctttcaacgagcatcaaatccttgcaaaaagagtatgaaaaagcttctgattcagaaagagagaaatctgagtttttacgcatgacatcgcacgagctaaagacaccaatcactagtgttatcggaatgattgatggaatgctctataatgttggtgactttgcagatcgtgacaaatatttgcgaaagtgccgagacgtccttgaagggcaagcccaactggttcaatccattttatctttatctaagattgaaaccctagcttctcaaaatcaagaactgttttcactaaaaagcagcctagaagaagaaatggaagtctttctcgtcttatcagaactaaaacacctcaaagtgactatcaatctcgaagaacaattcgtcaaagccaataaagtatatctactaaaggcgattaaaaatattattgacaatgcctttcactataccaaatcaggcggccaagtgatgattcaactaaaagacaaccaactagtgattaaaaatgaagcagagacattattgacacaacagcagatgaaacagttattccaaccgttttatcgaccagattatagtcgtaacaggaaagacggtggtacaggattggggctgtttatcacccaccagattcttgatcagcatcatctggcttatcgctttgttgttcttgatcaaagatggatggtatttacgattgattttccatcccatcatgacgat

SEQ ID NO: 1342 - protein, 462 aa, Streptococcus pyogenes
VRLIKKTFLVINGLIIVVVTSILLVLYFAMPIYYTKVKDKEVKCEFDQTSKQIKGKTVTEIRDILTKKINKDNIWYSLVDSDNQLLYPSLQLLDGVSESKDSQNVNIVTTFDNSYSNVKVMSQKVTLRDGKKMTLLGQSSLQPVTDASKVLLDLYPSLLIFSVTVGSIVAYLYSRTSSRRILSMSQTAKKMVNLEPNLTCTIHGKDEIAMLASDINRLYASLSTSIKSLQKEYEKASDSEREKSEFLRMTSHELKTPITSVIGMIDGMLYNVGDFADRDKYLRKCRDVLEGQAQLVQSILSLSKIETLASQNQELFSLKSSLEEEMEVFLVLSELKHLKVTINLEEQFVKANKVYLLKAIKNIIDNAFHYTKSGGQVMIQLKDNQLVIKNEAETLLTQQQMKQLFQPFYRPDYSRNRKDGGTGLGLFITHQILDQHHLAYRFVVLDQRWMVFTIDFPSHHDD

SEQ ID NO: 1343 - DNA, 663 bp, Streptococcus agalactiae
atggaggtatctatgaaaatattaactgttgaagatgataagttgataagagagggaataagtgaatacctttcagaatttggatatactgttattcaggctaaagatggaagggaagccttgtcaaaatttaatagtgatataaacttggttatcttagacattcagataccttttataaatggtttagaagtgttgaaagaaattagaaagaaaagcaatttaccaattctaattttgactgcatttagtgatgaagaatataaaattgatgcatttactaatttagtagatggatatgtagaaaaaccattttcattgcctgttttaaaggctagaatagattctttaattaagaagaattttggacatttagagaagtttgaatataagaatctttcggtaaattttaatagttatacagctaaaataaatgatgaaaaaatagatgtaaatgcaaaagaactcgaaatactaaaatgtttattggataatgatggacaagttttaacaagaatgcaaattattgattatgtctggaaggatagcgaagagatcccttatgatcgagtagtagatgtatatataaaagaacttagaaaaaaattacaattagactgtataactactataagaaatgtaggatataaattggagagaaaa

SEQ ID NO: 1344 - protein, 221 aa, Streptococcus agalactiae
MEVSMKILTVEDDKLIREGISEYLSEFGYTVIQAKDGREALSKFNSDINLVILDIQIPFINGLEVLKEIRKKSNLPILILTAFSDEEYKIDAFTNLVDGYVEKPFSLPVLKARIDSLIKKNFGHLEKFEYKNLSVNFNSYTAKINDEKIDVNAKELEILKCLLDNDGQVLTRMQIIDYVWKDSEEIPYDRVVDVYIKELRKKLQLDCITTIRNVGYKLERK

SEQ ID NO: 1345 - DNA, 651 bp, Streptococcus pyogenes
atgtttaaaatattagtagttgaagatgatgataccatcagtcaagtgatttgtgagtttttaaaagcgaataactatgatccagattgtgtatttgatggccaagctgccttagacaagtggcagacaacgtcttatgatctgattattttagacatcatgctcccttccttaagtggcttagaagtgctaaaaacaattcgaaagacatcagatgtccctattattatgctaacggcattagatgacgagtacacacagcttgtaagcttcaaccatttgattagtgattatgtgaccaaaccattttcaccactcattttaatcaaacgtatcgaaaatgtattacgcgtctctactccagatgaaaagcgccaaatcggagacttacttgttgatgagaccgaacatagcgtctattggcaaggaacattggtcaaactaaccaaaaaagaatatgacattattgattatttagcaaaacgtcaccaaaaaattgtcaccagagaccaattgatggatgacatatggggctattctgaactggacacgcgtgtccttgacaaccacatcaagaaccttcgtaaaaaaatgacgggtattcccctcaagacaattacaggcatgggctatttattgggagagcgtgag

SEQ ID NO: 1346 - protein, 217 aa, Streptococcus pyogenes
MFKILVVEDDDTISQVICEFLKANNYDPDCVFDGQAALDKWQTTSYDLIILDIMLPSLSGLEVLKTIRKTSDVPIIMLTALDDEYTQLVSFNHLISDYVTKPFSPLILIKRIENVLRVSTPDEKRQIGDLLVDETEHSVYWQGTLVKLTKKEYDIIDYLAKRHQKIVTRDQLMDDIWGYSELDTRVLDNHIKNLRKKMTGIPLKTITGMGYLLGERE

SEQ ID NO: 1347 - DNA, 1374 bp, Streptococcus agalactiae
atgataaaaaatgcatttgcttatgtaactagaaaaagcttaaaatcattaattattatattagttattctatcaatggcaactttaagcatcattagtttatctattaaagatgccacagatagagcttctaaggaaacatttgctaatataacaaacagtttttctatggaaataaatagacaagtaaatccaggaacacctaggggtggaggaaatgtaaaaggtgaagatattaaaaagatatctcaaacaaacagtatagactcctatgtaaaaagaataaacagcgtcgcagacctagttgatcatgatataattgaaactcaagatacacttgcaaatcaatcacctgaaagagcaaagaattttaagagaacagttatgttaacaggggttaatgactcagcaaaagaaacaaaatttgtatcagaagcatataagttagtagaaggaaagcatttagaaaataaagataaaaataaaattttaatgcataaagatttggcaaaaaaaaacaatctcaaagttggagataaaataaaaataaaatctaatttgtttgatgctgacaatgaaaaagttgcaaatgaaactgtagaagtagaaattaaaggtttatttgatggtcataatagcggtggggtaagtgcagcacaagaactatacgaaaatacactaatcactgacgttcattcagctgctaaagtttatggtaatacagaagatacagccgtataccaagatgcaacattctttgtaaaaggtgataagaatcttgatagtgtaataaaagatcttgggaaactagatataaattggagagaatataatttgattaaaagttcatcaaattatcctgcgctgcaacaatctatatccggtatctattctatttcaaacaaattatttgttggctcattaatatttgcaggagttgtagtttcattattacttttcttatggatgaatgccagaaagaaagaaatagcagtattactatcattaggtatatctaaattagaaatttttggtcaatttataatcgagatggtatttatatccattcccgcacttcttggatcttatttcttagctcaatatacagctgataagctagggaataatatattgaataaagttactggcgatatagctaaacaaatagctagacaatctgcatctagtcaattaggcgggggggcagaagctgaaggattcaacaagactctttcaggtttagatataaatgtattacctaaattcataatttatgtagttatatttatgagttttgtacttcttgtatcattgattctttcttcaatttatacattaagaaagaatccaaaagagttattaattgataataat

SEQ ID NO: 1348 - protein, 458 aa, Streptococcus agalactiae
MIKNAFAYVTRKSLKSLIIILVILSMATLSIISLSIKDATDRASKETFANITNSFSMEINRQVNPGTPRGGGNVKGEDIKKISQTNSIDSYVKRINSVADLVDHDIIETQDTLANQSPERAKNFKRTVMLTGVNDSAKETKFVSEAYKLVEGKHLENKDKNKILMHKDLAKKNNLKVGDKIKIKSNLFDADNEKVANETVEVEIKGLFDGHNSGGVSAAQELYENTLITDVHSAAKVYGNTEDTAVYQDATFFVKGDKNLDSVIKDLGKLDINWREYNLIKSSSNYPALQQSISGIYSISNKLFVGSLIFAGVVVSLLLFLWMNARKKEIAVLLSLGISKLEIFGQFIIEMVFISIPALLGSYFLAQYTADKLGNNILNKVTGDIAKQIARQSASSQLGGGAEAEGFNKTLSGLDINVLPKFIIYVVIFMSFVLLVSLILSSIYTLRKNPKELLIDNN

SEQ ID NO: 1349 - DNA, 1218 bp, Streptococcus pyogenes
atggaaaattggaaattcgctcttagctcaatttgggggcataagatgcgctcaatcctgacaatgttgggaattatcatcggtgtagcagcagttgtgattattatggggttgggaaatgctatgaaaaatagtgtaacaagcacattttctagcaagcaaaaagatattcaactctattttcaagaaaaaggagaagaagaagacctgtatgccggattgcacacgcatgaaaataatcacgaagtgaagccagagtggttagaacaaattgttaaagatatcgatggtattgattcttattactttaccaattctgctacttctactatttcgtatgaaaaaaagaaagtagacaatgcttcgatcataggggtaagtaaagattattttaatataaaaaactatgatatcgtagctggtcgtacactaacagataatgattattctaatttttcgcgtatcattcttttagatacagtattagccgatgacctatttggcaaaggtaattataagtcagctttaaataaagtggtaagtttatctgataaagattatttagttattggtgtttataaaactgatcagacgccagtttcttttgatggattatcaggcggcgctgtcatggcgaatactcaggtagcttcagagtttggcaccaaagaaataggatctatctacattcatgtgaacgatattcaaaacagtatgaacttaggaaatcaagcagctgatatgctaaccaacatatcgcatattaaagatggacagtacgctgtccctgataatagcaaaatcgttgaagaaatcaatagtcagttcagtatcatgacaacagtcataggttcaattgcagcgatctctcttttagtgggaggaattggtgttatgaatattatgttggtatctgtcacagagcgaactagagaaattggtttacgtaaagcacttggtgcaacacgcctgaaaattttatcacaatttttgattgaatccgttgttctaacagttcttggaggcttgataggattattattagctcaattaagtgtaggggctttaggaaatgcgatgacattaaaaggagcttgtatttctcttgatgtggccttaatagcagttttattttctgcctcaataggtgtcttttttggaatgttgccagctaataaagctagtaagttagatccaattgaggcattacgttatgaa

SEQ ID NO: 1350 - protein, 406 aa, Streptococcus pyogenes
MENWKFALSSIWGHKMRSILTMLGIIIGVAAVVIIMGLGNAMKNSVTSTFSSKQKDIQLYFQEKGEEEDLYAGLHTHENNHEVKPEWLEQIVKDIDGIDSYYFTNSATSTISYEKKKVDNASIIGVSKDYFNIKNYDIVAGRTLTDNDYSNFSRIILLDTVLADDLFGKGNYKSALNKVVSLSDKDYLVIGVYKTDQTPVSFDGLSGGAVMANTQVASEFGTKEIGSIYIHVNDIQNSMNLGNQAADMLTNISHIKDGQYAVPDNSKIVEEINSQFSIMTTVIGSIAAISLLVGGIGVMNIMLVSVTERTREIGLRKALGATRLKILSQFLIESVVLTVLGGLIGLLLAQLSVGALGNAMTLKGACISLDVALIAVLFSASIGVFFGMLPANKASKLDPIEALRYE

SEQ ID NO: 1351 - DNA, 654 bp, Streptococcus agalactiae
atggatatattagaaataaagaatgtaaattacagttacgcaaattctaaagaaaaagttttgtcaggagtaaatcaaaaatttgaacttggaaagttttatgcgatagtagggaagtcaggaacaggaaaatccacacttctttccttacttgcaggacttgataaagttcaaacaggaaaaatcttgtttaagaatgaagatatagaaaagaaaggatatagtaatcacagaaaaaataatatatctttggtatttcaaaattataatttaatagattatttatcgccgattgaaaatattagactagtaaataaatcagtagatgagagtatcttgttcgaattaggtttagataaaaaacaaataaaaagaaatgttatgaaattatctggtggtcagcaacaaagggtagctattgctagggcactggtatcagatgccccaataatactagctgatgagcctaccggtaacctagacagtgttactgctggagaaataattaatatattaaaggaattagctcaagatagaaataaatgtgtaatagttgtaacacatagtaaggaagtagcagattctgcggatatcattttagaactaagtggtaaaaagttgaaaaaagtaaataaaatgaatttggaggttgaa

SEQ ID NO: 1352 - protein, 218 aa, Streptococcus agalactiae
MDILEIKNVNYSYANSKEKVLSGVNQKFELGKFYAIVGKSGTGKSTLLSLLAGLDKVQTGKILFKNEDIEKKGYSNHRKNNISLVFQNYNLIDYLSPIENIRLVNKSVDESILFELGLDKKQIKRNVMKLSGGQQQRVAIARALVSDAPIILADEPTGNLDSVTAGEIINILKELAQDRNKCVIVVTHSKEVADSADIILELSGKKLKKVNKMNLEVE

SEQ ID NO: 1353 - DNA, 711 bp, Streptococcus pyogenes
atggaggggcagatggcttttattgaattaaaacaggtttcaaaatcttatcagataggagagacgactgtttttgccaaccacgaagtgtcttttgagattaataaaggagaactagtggttattttgggagcatccggagctggtaaatcgacagtcctcaatattttggggggcatggacacagtagatgcaggtcaagtaattattgatggcaaagacattgctcattacacgtctaaggccttaactcagtatcgtcggaatgctattggtttcgtttttcaattttataatttggttcctaatttgacagctaaagaaaatgttgaattagcagttgaaattgtagcagatgctttagatcctgtgaccattttaaaggaagtaggactcagtcatcgtctggatcattttcctgctcagctctcaggtggtgaacagcaacgggtttcgatagcacgtgccttagctaaaaaccctaaattgcttctttgtgatgaacctacaggtgcccttgactaccaaacaggaaagcaaattctaaccctcttacaggatatggcacaaactaaggggaccacggtagttattgtaacccacaatgctgctattgctccgatagctgatcgtgtcatttttatgcatgatgcacaggttaccaagacagtcattaataaggaacctgcaagcattgagacaattgattat

SEQ ID NO: 1354 - protein, 237 aa, Streptococcus pyogenes
MEGQMAFIELKQVSKSYQIGETTVFANHEVSFEINKGELVVILGASGAGKSTVLNILGGMDTVDAGQVIIDGKDIAHYTSKALTQYRRNAIGFVFQFYNLVPNLTAKENVELAVEIVADALDPVTILKEVGLSHRLDHFPAQLSGGEQQRVSIARALAKNPKLLLCDEPTGALDYQTGKQILTLLQDMAQTKGTTVVIVTHNAAIAPIADRVIFMHDAQVTKTVINKEPASIETIDY

SEQ ID NO: 1355 - DNA, 105 bp, Streptococcus agalactiae
ttgtttaaggcaagctctgtagattctaaactaccagaatacattaaaattttatttgcaattctattattctctgatttatttaatatttcttggctagttgaa

SEQ ID NO: 1356 - protein, 35 aa, Streptococcus agalactiae
MFKASSVDSKLPEYIKILFAILLFSDLFNISWLVE

SEQ ID NO: 1357 - DNA, 1275 bp, Streptococcus agalactiae
gtgataaaaaatgctatagcatatattaccagaaaaaaaaatagaacacttattatatttgctattttaacaattgttctttcttgcttgtattcatgtttaacaataatgaaatcaagtaatgaaatagaaaaggctttatatgaaagttctaattcttcaatatcaattacaaaaaaagatggtaaatattttaatattaatcaatttaagaatattgaaaaaataaaagaggttgaagaaaaaatatttcaatatgatggattagcaaaattgaaagatcttaaagtagttagtggtgagcaaagtataaatagagaagatttatctgacgaatttaaaaatgttgtttcactagaagctacaagtaatactaaaagaaatcttttatttagtagtggagtatttagttttaaagaaggaaaaaatatagaagaaaatgataagaattcaattcttgttcatgaagaatttgctaaacaaaacaaactaaaattgggtgatgaaattgatcttgaattactagatacggaaaaaagtggaaaaataaaaagtcataaatttaaaattataggaatcttttctggtaaaaaacaggaaacatatacaggattatcatctgattttagcgaaaatatggtttttgtagattattcaactagccaagaaatattaaataaatcagagaataatagaattgcaaataaaattttaatgtattctggtagtttagaatctacagagcttgccttaaacaaattgaaagactttaaaattgataagtcaaagtattctattaagaaagataataaagcattcgaagagtctttagagtcagtgagtggaataaaacatataattaaaataatgacttattcgattatgttaggtggaatagttgttctttcattaatcttgattctatggttaagagaaagaatttatgaaataggtatatttttatctattggaacaactaagatacaaattataaggcaatttatatttgagttaatattcatatcaataccaagtataatatcctccttatttttagggaatctactattaaaagtaattgtagaaggatttattaactcagagaactcaatgattttcggtggaagtttaataaataaaagcagttttatgttaaacataacaacacttgcagaaagttatttaatattaataagtattattgttttatcagttgtaatggcctcttcattaatattatttaagaaaccaaaagaaatattatcaaaaataagt

SEQ ID NO: 1358 - protein, 425 aa, Streptococcus agalactiae
MIKNAIAYITRKKNRTLIIFAILTIVLSCLYSCLTIMKSSNEIEKALYESSNSSISITKKDGKYFNINQFKNIEKIKEVEEKIFQYDGLAKLKDLKVVSGEQSINREDLSDEFKNVVSLEATSNTKRNLLFSSGVFSFKEGKNIEENDKNSILVHEEFAKQNKLKLGDEIDLELLDTEKSGKIKSHKFKIIGIFSGKKQETYTGLSSDFSENMVFVDYSTSQEILNKSENNRIANKILMYSGSLESTELALNKLKDFKIDKSKYSIKKDNKAFEESLESVSGIKHIIKIMTYSIMLGGIVVLSLILILWLRERIYEIGIFLSIGTTKIQIIRQFIFELIFISIPSIISSLFLGNLLLKVIVEGFINSENSMIFGGSLINKSSFMLNITTLAESYLILISIIVLSVVMASSLILFKKPKEILSKIS

SEQ ID NO: 1359 - DNA, 1215 bp, Streptococcus pyogenes
atggaagatattattgcagctttaagctctatattatcacacaagatgcggtcaattttgacaatgctagggattattatcggtattggtgccattatcgcaatcttttcaatcatcgaaggtaataccgaaaataccaaaagacagttgattggtggcagcaataacactattaacattgtgtttaacaaaaaaagtagtattgaccctaaatttccagacaagtcaaatgctaaaaaaccagactatcttccttttatggctgaagaagagcttagcaaaatacagcaagtcaaaggcgtcaaaaatgccctgatctcatatggtattgatgacaaagtctaccatctaggccaaaaatcatctgcaaagatttctgccatcacaaaaaacgtagctgaagtgagacgcatgacatttattaaaggcagtgacttttcagacaaagactttattgaccaaaaacaggtgatttaccttgaaaaaagcttgtatgagtcactatttccaaaagacgatggccttggaaaatttgtcgaagtgatgggaaatcccttcagggtcattggggtgtttgaatcaaaagaacaaagtggcctcacaagtgggactgagaaaattgcttatatcccgctacatcagtggtataatattaatggtgtagtggatgcgacacctgagatcacgatccagacctatcgcgcagatgacctcaaacctgtagcaaagcgtgtcagtgatatgctcaatcaaacgatccctaaatcagattatatgtttggtgtcatgaaccttaaagaatttgaacgccaactagacaacctaaacaaatctaattttgtgttattagctggtattgctagtatctctcttattgtaggtggtattggtgtgatgaacattatgctagtatcagttaccgaaagaacgagagaaattgggatcaaaaaagcgcttggcgctagacgtaagcttattttaaaacaatttttaattgaagcggtcattctaaccttgctaggtggtgtgataggggttatttcagggatggtatcaggattgatcatcacaagatcactcgaatatccctatatcctatccttgttctcagttgtcttgagtttagcgttttgttgtattatagggattgtctttggactattaccagccattaaagcgtctaagctagacccaattgaagcattgcgatttgaa

SEQ ID NO: 1360 - protein, 405 aa, Streptococcus agalactiae
MEDIIAALSSILSHKMRSILTMLGIIIGIGAIIAIFSIIEGNTENTKRQLIGGSNNTINIVFNKKSSIDPKFPDKSNAKKPDYLPFMAEEELSKIQQVKGVKNALISYGIDDKVYHLGQKSSAKISAITKNVAEVRRMTFIKGSDFSDKDFIDQKQVIYLEKSLYESLFPKDDGLGKFVEVMGNPFRVIGVFESKEQSGLTSGTEKIAYIPLHQWYNINGVVDATPEITIQTYRADDLKPVAKRVSDMLNQTIPKSDYMFGVMNLKEFERQLDNLNKSNFVLLAGIASISLIVGGIGVMNIMLVSVTERTREIGIKKALGARRKLILKQFLIEAVILTLLGGVIGVISGMVSGLIITRSLEYPYILSLFSVVLSLAFCCIIGIVFGLLPAIKASKLDPIEALRFE

SEQ ID NO: 1361 - DNA, 159 bp, Streptococcus agalactiae
ttgggcggcattggagcgcataaattttacgcaggaaaaataggccaggtttttttatatattatttttagtattacctttattcctggaattatcgaccttatcgaagctttgatggctctcggaaaacaaactgatgaatatggaaatatcatcgtt

SEQ ID NO: 1362 - protein, 53 aa, Streptococcus agalactiae
MGGIGAHKFYAGKIGQVFLYIIFSITFIPGIIDLIEALMALGKQTDEYGNIIV

SEQ ID NO: 1363 - DNA, 93 bp, Streptococcus agalactiae
ttgaaaaacccaaagaaactttcagttggtgcattatcaatacatttgccaatccgggacatggataaggtcagaccagcttgttgtatgata

SEQ ID NO: 1364 - protein, 31 aa, Streptococcus agalactiae
MKNPKKLSVGALSIHLPIRDMDKVRPACCMI

SEQ ID NO: 1365 - DNA, 258 bp, Streptococcus agalactiae
ttgatgaacattctggggattagttcagtcattcgtcgtgttagccatgcttgtacaaaagctggtgacagattttacgaagaaaatattcttaatcgtgaatttacagccacagctcataaccagaaatggtgcacagatgtcacctatcttcaatacggtctgggagctaaagcttatctcagtgcgattaaagacctgtataacggttctattatcgcttatgagattagtcacaacaatgaaatccacttgtta

SEQ ID NO: 1366 - protein, 86 aa, Streptococcus agalactiae
MMNILGISSVIRRVSHACTKAGDRFYEENILNREFTATAHNQKWCTDVTYLQYGLGAKAYLSAIKDLYNGSIIAYEISHNNEIHLL

SEQ ID NO: 1367 - DNA, 90 bp, Streptococcus agalactiae
gtgttcaaggctaccttgatggaaaaggctctcttagagatatttgtaaatggtatgatatctcaagtcgctctgttctccaaaagtgga

SEQ ID NO: 1368 - protein, 30 aa, Streptococcus agalactiae
MFKATLMEKALLEIFVNGMISQVALFSKSG

SEQ ID NO: 1369 - DNA, 402 bp, Streptococcus agalactiae
ttgatatactccacattagctaaagaacagggtgttcaaggctaccttgatggaaaaggctctcttagagatatttgtaaatggtatgatatctcaagtcgctctgttctccaaaagtggataaaacggtatactagtggtgaagacttgaaagccactagtagaggatatagccgtatgaaacaaggaaggcaagccacatttgaagaacgtgtagagattgttaactacaccattgcccatgggaaagactatcaagcagctattgagaagtttggtgtttcctaccaacaaatttattcttgggtgcgtaagcttgagaagaatggctcacaaggtttggttgatagacgtgtgaaagggttggagagtaggcctgatttaaccgagattgagcaactt

SEQ ID NO: 1370 - protein, 134 aa, Streptococcus agalactiae
MIYSTLAKEQGVQGYLDGKGSLRDICKWYDISSRSVLQKWIKRYTSGEDLKATSRGYSRMKQGRQATFEERVEIVNYTIAHGKDYQAAIEKFGVSYQQIYSWVRKLEKNGSQGLVDRRVKGLESRPDLTEIEQL

SEQ ID NO: 1371 - DNA, 216 bp, Streptococcus agalactiae
atgatattgattacactaacaaatatttatcaattaataaaacttgggattatcatttcaaccaaagatacctgccaacaaaaaacaaaagtagtatcagaaatataccaattgacaatgatacattattttttttgcatgaatttacaaaaaataaaaacgacagattattcgacaaactttcaaataatgcagtcaataaaactatccgaaaaa

SEQ ID NO: 1372 - protein, 72 aa, Streptococcus agalactiae
MILITLTNIYQLIKLGIIISTKDTCQQKTKVVSEIYQLTMIHYFFCMNLQKIKTTDYSTNFQIMQSIKLSEK

SEQ ID NO: 1373 - DNA, 579 bp, Streptococcus agalactiae
ttgataaaaatttgtaaagaaaaatcacaacatcaatcgtatgcagcgttatacctcatcgctaaaactggcatgcgcttcgctgaatgtttaggtttaacagttaatgatattgattacactaacaaatatttatcaattaataaaacttgggattatcatttcaaccaaagatacctgccaacaaaaaacaaaagtagtatcagaaatataccaattgacaatgatacattattttttttgcatgaatttacaaaaaataaaaacgacagattattcgacaaactttcaaataatgcagtcaataaaactatccgaaaaataactggtcgcgaggtacgagtgcactctctcaggcatacatttgcaagctatctaatttccatctctcaagttttagatcacgagaatttaaatatcactttagaagtttacgcacatcaattacaagaacaaaaagataggaacgataaacttaatcagagaaatttggggcggatttggggcaaaatagctctaaaccgctatttacatgcaatgaatatgtcccctgccggaatctactactattgtacacaa

SEQ ID NO: 1374 - protein, 193 aa, Streptococcus agalactiae
MIKICKEKSQHQSYAALYLIAKTGMRFAECLGLTVNDIDYTNKYLSINKTWDYHFNQRYLPTKNKSSIRNIPIDNDTLFFLHEFTKNKNDRLFDKLSNNAVNKTIRKITGREVRVHSLRHTFASYLISISQVLDHENLNITLEVYAHQLQEQKDRNDKLNQRNLGRIWGKIALNRYLHAMNMSPAGIYYYCTQ

SEQ ID NO: 1375 - DNA, 177 bp, Streptococcus agalactiae
atgttatatatagatgagtttaaagaagcgattgataaaggctatatttcagggaacacagtagcgatagtgcgtaaaaacggaaagatatttgattatgtgttgccgcacgaggaagtgagagatgatgaagttgtgacagttgagagtgtagaagaggtgttgagggaattgaag

SEQ ID NO: 1376 - protein, 59 aa, Streptococcus agalactiae
MLYIDEFKEAIDKGYISGNTVAIVRKNGKIFDYVLPHEEVRDDEVVTVESVEEVLRELK

SEQ ID NO: 1377 - DNA, 201 bp, Streptococcus agalactiae
ttgtattttactttattaacaaggatgattgaaatggataaagaattaacacctcaagaaaaagcaaataaaaagtgggcagaaaacaatagagaacatagaacctatctatcaaaacgatctactgctcgtagttttattaacaaaaatgctacaaaagaagacttattagaattaaaacaattaattgaaagcaaactc

SEQ ID NO: 1378 - protein, 67 aa, Streptococcus agalactiae
MYFTLLTRMIEMDKELTPQEKANKKWAENNREHRTYLSKRSTARSFINKNATKEDLLELKQLIESKL

SEQ ID NO: 1379 - DNA, 198 bp, Streptococcus agalactiae
atgtcacaagaaaaactaaaatcaaaagttgaacaagcatcaggtagcctaaaagaaggagctggtaagctaactggcgataaagagttagaggcaaaaggttttgtcgaaaaaacaattgctaaaggtaaagaactagcagatgatgctaaagatgctgttgaagaggcagtagatgttgtcaaagaaaaactgaaa

SEQ ID NO: 1380 - protein, 66 aa, Streptococcus agalactiae
MSQEKLKSKVEQASGSLKEGAGKLTGDKELEAKGFVEKTIAKGKELADDAKDAVEEAVDVVKEKLK

SEQ ID NO: 1381 - DNA, 108 bp, Streptococcus agalactiae
gtgtactacttttacaaattcaaaaaaatagaaatttttagcaagaatcgcctgatactagctgttcttgcttttttatttgctaaagaaagatatagatgttataat

SEQ ID NO: 1382 - protein, 36 aa, Streptococcus agalactiae
MYYFYKFKKIEIFSKNRLILAVLAFLFAKERYRCYN

SEQ ID NO: 1383 - DNA, 1086 bp, Streptococcus agalactiae
ttgtggcttgacattatttttaaaaaaagtataattatcttaacaagacaaaccccccattcctttataggcagatacgttctgatatggggctttttttatatcgttaggagagttatgaaacaacctttagctttgacatgggaagatcaaattagactacttgaaaaacgtggattaattgttaaagctgatgatgtagagaaaatcaaacatatcagttattatagaattaaagaatttgcaaaaccacttgaaataaagcaacaagatggtgaggagcaggatattttatatgataatattgagtttgcagaagttttggcaagatattatcaggataaaaacttaagaatctatctactgcacgctattgaaaaaattgaagtgtctattaaaacaaaaatttcttttgttttgggggatagatatggggcgttcggatatttaaatttctcttcatgggctaataggaataagtttacaaaatatgatattgaaaaaagacaatttaggattaaaaagaatttattgaatactgtaagaaaatctcaactaactgagttacaaaaatcaattaaccttgatctagatggattcccaacagtgtggcttgctattgatttattgatgtttggtgacatcgtttcaatcttaacaatcatgagtgagaagaacattaaacagatttgtcaatattacagttgtacaccagaagaacttgtttcgtggcttaaatgtttgaatttcataagaaatgtatgtgctcataattcaaatgtactggatattcaaatcacaacaaagcctaaacttcgttcagaatggagaaattatattgatacagtaataattaaacataacgtgactaaaccttctaataagttatccgttattattgctattgtagtctatcttgtaaatactattaattccaaatatcaatggagaaatatacagtctagtttgaaggctctttgtaaagaagatgacagtagggcaaagcttttaggttttaaagattatgattctgttaaagcaatgattaatgggataaagtgtactacttttacaaattcaaaaaaa

SEQ ID NO: 1384 - protein, 362 aa, Streptococcus agalactiae
MWLDIIFKKSIIILTRQTPHSFIGRYVLIWGFFYIVRRVMKQPLALTWEDQIRLLEKRGLIVKADDVEKIKHISYYRIKEFAKPLEIKQQDGEEQDILYDNIEFAEVLARYYQDKNLRIYLLHAIEKIEVSIKTKISFVLGDRYGAFGYLNFSSWANRNKFTKYDIEKRQFRIKKNLLNTVRKSQLTELQKSINLDLDGFPTVWLAIDLLMFGDIVSILTIMSEKNIKQICQYYSCTPEELVSWLKCLNFIRNVCAHNSNVLDIQITTKPKLRSEWRNYIDTVIIKHNVTKPSNKLSVIIAIVVYLVNTINSKYQWRNIQSSLKALCKEDDSRAKLLGFKDYDSVKAMINGIKCTTFTNSKK

SEQ ID NO: 1385 - DNA, 744 bp, Streptococcus agalactiae
atgatgagtggaagaaaggtcaataatatggtaattaatattgagcaagctatcgcatggatggcatctagaaaaggtaaagttacttactcgatggactatcgaaatggtccttcatcttacgattgctctagctctgtctattttgctctacgctcagcaggcgcatcagataatggctgggcagtaaatacagaatatgagcacgattggttgataaaaaacggttatgttcttattgcagaaaatactaattggaatgcgcaaagaggtgatatttttatttggggtaaacgtggggcttcggctggagcttttggacatactggtatgtttgttgatccagacaatattattcactgtaattatggttataactcaattacagtgaataaccatgatgaaatctggggatataatggtcaaccttatgtttacgcttatcgttacgctaggaaacagtcaaatgctaaggttgataatcaatcagttgtatctaaatttgaaaaagagttagacgttaacacaccgctaagtaattcaaatatgccatattacgaagcaacaatttcagaagattattacgttgagtccaagcctgacgtcaatagcactgataaggagttgcttgttgctggtactagagttcgagtttacgaaaaagtaaaaggctgggcaaggataggcgctccacagtctaatcagtgggtagaagatgcttacttaattgatgcaacagatatg

SEQ ID NO: 1386 - protein, 248 aa, Streptococcus agalactiae
MMSGRKVNNMVINIEQAIAWMASRKGKVTYSMDYRNGPSSYDCSSSVYFALRSAGASDNGWAVNTEYEHDWLIKNGYVLIAENTNWNAQRGDIFIWGKRGASAGAFGHTGMFVDPDNIIHCNYGYNSITVNNHDEIWGYNGQPYVYAYRYARKQSNAKVDNQSVVSKFEKELDVNTPLSNSNMPYYEATISEDYYVESKPDVNSTDKELLVAGTRVRVYEKVKGWARIGAPQSNQWVEDAYLIDATDM

SEQ ID NO: 1387 - DNA, 1332 bp, Streptococcus pyogenes
atggctacatatcaggaatataaaagtcgttcaaatggcaatgcttacgatattgatggatcgcttggtgcgcaatgttgggatggctacgcagactactgtaagtatctaggactgccatacgcaaactgtacaaatacaggatatgcaaaggatatatgggaacaacgtcacaaaaatggtattttaaactactttgacgaagtagagactatgcaagctggagatgtcgcaatttttatggtagttgcaggtgttacaccgtatagccatgtggctatttttgatagtgatgcaggtagtggatacggatggtttttaggtcaaaaccagggtggagcaaacggagcatataatttagtaaaaataccatattcaacgacttatcctactgcatttagaccaaaagtttttaaaaatgcagttactgttataggtaatataggactaaataaaggcgattattttattgatgtatcagcttatcaacaagcagacttaaccgctacttgtcagcaagctggcactactaaaacgattatcaaagtatccgagtcactcgcttggctgtctgataggcatcagcaacaagctaatactagtgaccctattggttattatcactttggacgatttggaggagatagcaacttagcgcaacgagaagcagatttatttctgtccaatttaccaaccaaaaaagtctcttacttagtcattgattatgaagactctgcaagtgccgacaaagaagctaacactaatgcagttattgcgtttatggataaaattgcaaacgctggatataagcctgtttattacagctataaaccatttacgcttaataatattgattatcagcaaattatcgctaagtacccaaacagcatttggatagctggttatccagactacgaagtacgaacagagccactttgggagttcttcccttcaatggatggtgtgcgctggtggcagttcacaagtgtaggagtagcaggtggtttagataaaaatattgtattattagcagatgatagtagcaaagtggatatacctaagattgacaaaccacaaagccagcttacttttaatcaaaagctagatactaacactaaattagacaactcgaatgtaccttactacgaagcaacccttagaacagactattatgtagagtctaagccaaacgcaagtagcgctgataaagaatttatcaaggcaggaactcgtgtaagagtctatgaaaaagtgaatggatggtcacgtattaacgcttctcagtctgaccagtgggtcgaagataagtatttatctaatgcaacacaagta

SEQ ID NO: 1388 - protein, 444 aa, Streptococcus pyogenes
MATYQEYKSRSNGNAYDIDGSLGAQCWDGYADYCKYLGLPYANCTNTGYAKDIWEQRHKNGILNYFDEVETMQAGDVAIFMVVAGVTPYSHVAIFDSDAGSGYGWFLGQNQGGANGAYNLVKIPYSTTYPTAFRPKVFKNAVTVIGNIGLNKGDYFIDVSAYQQADLTATCQQAGTTKTIIKVSESLAWLSDRHQQQANTSDPIGYYHFGRFGGDSNLAQREADLFLSNLPTKKVSYLVIDYEDSASADKEANTNAVIAFMDKIANAGYKPVYYSYKPFTLNNIDYQQIIAKYPNSIWIAGYPDYEVRTEPLWEFFPSMDGVRWWQFTSVGVAGGLDKNIVLLADDSSKVDIPKIDKPQSQLTFNQKLDTNTKLDNSNVPYYEATLRTDYYVESKPNASSADKEFIKAGTRVRVYEKVNGWSRINASQSDQWVEDKYLSNATQV

SEQ ID NO: 1389 - DNA, 333 bp, Streptococcus agalactiae
atgaacgaatttataacacaaatcattacagtatcagtaccaatttttggtatcatcgcaggtattctcacgcacaaagtaaaaaaattacttataaaaaaaggtggagaaaaagctgttaaaattgcagaaattgtcgctcgtaatgctgttgaggcagttgaacaaatatctgtggaagttggtattaagggacaagataagctaacagaagctaaaacagctgttattgatggtttatcgcaatataatatcagtttaacagagactcagttagaaacatttatcgaagctgcggttaaacgcatgaatgatgagtggaagaaaggtcaa

SEQ ID NO: 1390 - protein, 111 aa, Streptococcus agalactiae
MNEFITQIITVSVPIFGIIAGILTHKVKKLLIKKGGEKAVKIAEIVARNAVEAVEQISVEVGIKGQDKLTEAKTAVIDGLSQYNISLTETQLETFIEAAVKRMNDEWKKGQ

SEQ ID NO: 1391 - DNA, 300 bp, Streptococcus agalactiae
atgacagtagaacaagcagaaagaatcgctcaatcacaatttgtgtgggctattctctttatcttgctttttatgattgtggttggttatctggtgcgaacgtctgataagcgtgagaaaaagctaatggatttccatgaccaatcaaaatcagaatctaacaaacgtgaagagtggctcaaaggtcacttagataaaaatacagaacagttacaggacatttctcagaccattggtgttgtccaaaaggagatgtcttatatgagtgaccgcattggtcgtctagaaaaagaggagaaa

SEQ ID NO: 1392 - protein, 100 aa, Streptococcus agalactiae
MTVEQAERIAQSQFVWAILFILLFMIVVGYLVRTSDKREKKLMDFHDQSKSESNKREEWLKGHLDKNTEQLQDISQTIGVVQKEMSYMSDRIGRLEKEEK

SEQ ID NO: 1393 - DNA, 210 bp, Streptococcus agalactiae
atgaagatcttattgctattggttagaatttttttacaggaagaagggatagatatgatgattaaattatttgcgattgacttatattatggacgtatggcttggtcaagttttgttaaaaagggattttcagagtttattaataacaaaacaaaagagcaacttgcaattatgtgcgatgaagaattacttgctgaaattttagcaagt

SEQ ID NO: 1394 - protein, 70 aa, Streptococcus agalactiae
MKILLLLVRIFLQEEGIDMMIKLFAIDLYYGRMAWSSFVKKGFSEFINNKTKEQLAIMCDEELLAEILAS

SEQ ID NO: 1395 - DNA, 375 bp, Streptococcus agalactiae
gtgtcgtgcactggtcaatataacagtcaatataacaaaggagacgatatgtttacaattaacacaaaattcccacaagttcttgaggataaaagtattatgggagtgactgcaattgtgtcagttgatttaccacacgtgaaaggtaacttaacttttgatttaccacctgagtctgaaaataaatcttttgcagaaacgcttgaaaagtgtgagcagatattttacgacgaaaagtataaagataaagctcagtctgaaaaaatgactgaactaagtacatcaacatcaacaggcacacaaacacttatcaatctgataagtacgctttacgcaaaagaggttttaaaagatgaagatcttattgctattggt

SEQ ID NO: 1396 - protein, 125 aa, Streptococcus agalactiae
MSCTGQYNSQYNKGDDMFTINTKFPQVLEDKSIMGVTAIVSVDLPHVKGNLTFDLPPESENKSFAETLEKCEQIFYDEKYKDKAQSEKMTELSTSTSTGTQTLINLISTLYAKEVLKDEDLIAIG

SEQ ID NO: 1397 - DNA, 2004 bp, Streptococcus agalactiae
atgggaactgctacatatagtaggtcgtgggggaataacctgacacttgaaatattgtctgcttggaataagccaaatatcgcaagtaatacaagcacagtcaatgtacaagtttttttaaaaatgtctagttatggctatatttcaataggtgaaactagacctttaaaaataacagttgatggtagagctgagaccatcaatgttaatccatcgataaattacggacagagaaaactattatttgctaaagattacattgttaatcataattcagatggaaataaaccactattcaatatttcagcatattatccaataaactttagcaattatggtgaagcgactgcaaatcagtctatctcgctacctaaaattaatagacttagtgtatcaagtgctattagtggtgtgctaggtaatgcagtaactatcacaatcaatagatattcaacgtcatttactcacaatttgaaatatgattttaagggtagtacaggtactatcgcaactggcgttggtactagctatttgtggactataccgccaacgtttgctaatttactgcctaatgaattaactggtacaggtaatctgattgttgagacgatggatggatcagcaaagattggtgagacaaaatatactttatcaataacaatacctaatacagctacttataagccaaaattgtcaagtatcactctatctgatacaaatactttaactagtagcattgttagtggaaacaattttgttaggattataagtaaagttaaagttgattttggctcagctattggaaacaacggttcaacaataacaagttataatgctgaaattgtcgggaaaagtaactcaattatcggtaatggtagcgtatttgataaattggacttttttggttcagcaacaatcagagcaacggtaactgatagcagaggtctaacatcagaaccagttgacacaaaaattaatgtcattgattattttttaccaattgttacaagtgcaaaagtagtcaggtctcagcaaaatcctgacattttacaagtcttgccatttgttaagattgcaccaattatagttggtggaatacaaaaaaaccaactcaaaatgtcggtatctgttgcaccatacaatactggtatctatgcagttgatagtggcgcagctacaaatacctggtcaacaatttcccaaatgtcaggcgcccctttaaatcttggcggcacttatgacaagtcaaaatcatggcttgttaagatttcggtgagtgataacctaatgtcagcaacaccaataatacaaccagttgcaagtgagtttgtacttgtaactaaagcaccttctggtgttgcatttgggaaaatttgggaacatggcattattgatgccaaaggcgatgtttatgttgacggtactatttattgtggcgataaggcgatacagcaaaaaccacttgctttaaataatggtggctcttttagacatgacgacaccgacctaaatagcttgcaagacacaggtttttattgtgtatttagaggtgctaatagaccggctggggcaggtcctgggtacgtaacagttgtaagacatgagacagcaaactatgcttatcaacaattttacgaccgcacaaataaaactatatttacgcgcttgctggaaaacggtgtttggagcggttggagtgagtatgttaaaaaagatagcttacaaacgactggctggataacaattggcaacggttttaaatataagcggaaaggtgatgacatagacttgatgtataattttgcttctaatggattacagagatggtctgttggtaatatgccatctggtttaatacctcaagagttgatgtttgcgataactggatggacacttgctccagacaaatcaatccacttacaaatcaatgcatcgggattgattgagtgtataaatcctggcgcttactcaaatacttacagaggtgtcgtgcactggtcaata

SEQ ID NO: 1398 - protein, 668 aa, Streptococcus agalactiae
MGTATYSRSWGNNLTLEILSAWNKPNIASNTSTVNVQVFLKMSSYGYISIGETRPLKITVDGRAETINVNPSINYGQRKLLFAKDYIVNHNSDGNKPLFNISAYYPINFSNYGEATANQSISLPKINRLSVSSAISGVLGNAVTITINRYSTSFTHNLKYDFKGSTGTIATGVGTSYLWTIPPTFANLLPNELTGTGNLIVETMDGSAKIGETKYTLSITIPNTATYKPKLSSITLSDTNTLTSSIVSGNNFVRIISKVKVDFGSAIGNNGSTITSYNAEIVGKSNSIIGNGSVFDKLDFFGSATIRATVTDSRGLTSEPVDTKINVIDYFLPIVTSAKVVRSQQNPDILQVLPFVKIAPIIVGGIQKNQLKMSVSVAPYNTGIYAVDSGAATNTWSTISQMSGAPLNLGGTYDKSKSWLVKISVSDNLMSATPIIQPVASEFVLVTKAPSGVAFGKIWEHGIIDAKGDVYVDGTIYCGDKAIQQKPLALNNGGSFRHDDTDLNSLQDTGFYCVFRGANRPAGAGPGYVTVVRHETANYAYQQFYDRTNKTIFTRLLENGVWSGWSEYVKKDSLQTTGWITIGNGFKYKRKGDDIDLMYNFASNGLQRWSVGNMPSGLIPQELMFAITGWTLAPDKSIHLQINASGLIECINPGAYSNTYRGVVHWSI

SEQ ID NO: 1399 - DNA, 4122 bp, Streptococcus agalactiae
atgttaacaattcatggaccggatttaaaacctgtcctttttttggataatgataaacaaggagctttgaactactttaaccacaagtggtatagaaagcaaaagactggctcgtctgtactagaattctccgtttacaaaaaagatttgcttggcgatagcccacttagtcataaatatcacgtactaaacgatcaagcatttgtctcttttgtgcacaaaggtaaagtacaattgttaaacatcatgaaaattgatgaagatgaaaaacaaattgattgttattgcgaaaaccttaatttagagttgctaaacgagtattgtaacgcatataaagcaactaaagcgatgtcgtttgaagagtatctcgtgcagtttgacattttgagctggggggctttgacagttggcacaaacgaagttaaggacaaaaaacttacattggaatggactagtcaagaaactaagttagctcgtcttttgtcaattgctaataatttcgatgcagaaattgagtttgagacaaagcttaatttcaatcacacgtttaagcaactcatcattaatatttacaaagaatacgaggagggcaaatcttatggtgtagatcgtgataagaccgacgtgatattacgctatcaaaaaaatatttctgggataaggaaaacagttgacaagcgccagatttataacgctattagaccatacggcaaaaaaactgttagaggcgagcgcgttatttctaatcctgtaactcgtaaagtcactaaaacggttggttcaaatcgcacgtacttaggcggagaccttaaatattatggtcatacaatcaaaaaagctaacgtacaagctattattaactacgcagtgcaatataatattttgccaagtggaatcatcacgcaactttatttagagagtttttggggtgattcgacagttggtaaacgtgacaacaactgggcaggtatgagcggtggagcacagacgcgtccaagtggagtaaaagtcactactgggatggctcgtcctgcaaacgagggtggaacatacatgcactatgcaagtgtagatgactttttaaaagattacacttatcttttagcaaaacaagggatttataatgtcgtcggcaaaaagaatatagcagactatacaaaagggctttttagagctggtggagctaaatatgactatgcagcagcaggatatcaaagctacacaaatttgatgactaatatccgaaatggtatcaataaagtaactggaaatatcctcaatacgattgataagctgtggcagactcctgtaaagcccataaccgccgtaaacgtcgctagaagagccactaaaacaatacaagctattaatgaggctactaagctgaaagggcgcagaatcggttctggacagtgttatgcgctatctgggtggtatgcaaaaaaattggatggcgcttggattgacagctcgattggtggtattagaggtcgtatcggaggcggtatggctgctgccttaatcggcactgattataactggggtgcatatgggtggaaggtagataaatcacctaacgctggaaacttaaaagctggtggtatttataatgtacgagcaaatcgaggcgctcctttttataccacaggctgggggcatacaggtattatcaagagtgtctccaagaccagagttactgttttggagcaaaactttgttggtcgcatgtatgttgtcgaaaactcatatgacattaactctttcgcatctggattacaaacagtatgttaccctcgtgaaatagcgcaaggtatgtctgttaacggcgcaacaacacagcaagtaagtggtgggacacagatatcgtacgaagaagtcgtacaagaggctcagacagaatcatacgaagaagaacaaatcatctatattgacaactctatctacaaagagtggaaagatgaaaacggtaaagtagagtactatctcaaaaatggatttttgtacgcaccactttcaagagaccgctatccatctgttttaaccggtaatgagacacgagacaactggatacgaaaagacatggaagtcgagactgatagtcaagaagtcttgatgtcaacaggtctaaaagacttaaaagcacacgcatatccagcaattacatacgaagttgatggctatgttgacttagaacttggtgatgttgtgcggatacaggacgacggatacgagccaccgctgattttgacagcacgagtagttgagcaagaaatatccataacaaatcccagctctaacaaaactaaattcagcaattttgtcgaaaaagaaagtcagttagcttctgatttaatcagtgatatgttgcgtctatacgatgagtcaattccatacgaaatcaaactagctacttcgaatggtgtcgcttttaaaaatggcactggtgaatctgtcctaactcctagcttgcaaaagaacgggaaagactatgaagcagtttatttttataaaaatggtgactcgctaattgatatcggaccatcgctaatcgttaaagcaagcgactttaaccacgttttaaatataacagttgaggcatatttaaatgaggaacttgtagcaagcacacaaatatcatttacagacactgaagacggtgctgacgggaaagatggcgcaccgggaccacaaggacctcccggtgtaaacggactgcaaggtccaaaaggtgaccaaggcattcaaggtccagctggtgctgacggtaaagcgacttatacgcatatagcatacgcccttgacgagaacggatcaactggctttagtgtatctgataacgttggcaaaacgtacataggtatgtatgttgatgataatatcatagactcaaacgaccctaaaaagtacaagtggaatttgataaaaggcgcagatggtgctagaggtatccaaggtccagctggtgctgacggtaagacaccttactggcatgtagcgtatgcaaacagctcagatgggacagttgactttagcgtgtctgatagtgcaaacaagcgctacattgggcaatatactgactacgatgcaatagattcaagtgaccctaaaaaataccgctggactgacatggttgggacggttgtcgtcgggacaaacaatctgattgatggtacaaaatcattttttgggactgattggtttacttctgcaacgctagaagacgagaacctctctaattgtcctttcacgcttaaaaaatggattagtgggcaaaaagtgtcgcatgcaaaagatatcatggtcgagcaaggtgtaacgtacacttttagtgcttatgttaaacgtgaggtagctgggaatttatatttttatctttatgatatagcagatggttttattactagcgataccccacgagagacaattataaaaaacgttgactctagtctcagacgttttgaaatcacttttacaccaactaagacaggtaggattagaccaaggttcgcgatggtgtcatcggagcaaggtagtttcagctctggtgggtttatgctcgttaggggaaataaaacaggcgactggcaggaatcagaagctgataaagcaagtaatcttgattcaaaagctgatcaagaattaacccaagcacaaattctagctcttgaagaaagaactgctatagcaagagaaaatgcaattgctgaggctatgcagaatacactcagtgaagttgaaactaagtggaagctttggtatgacttaaatacgatagacgaaaagcaaaaagttgcaaacgacatcgctcaattgtttgatcgtacaactgagtttaaacaactattaggtgaggcaagtgcaagatttagctttatcaacaatgaaacgttgattggtgaagagggcgttgctatcggtgacaaaggcggaaaagcaaagttatttctatcaaatgacagcatttcatttgtgacaaatggtgttgctcagatgacattgacaggtgataccttaacaataaaaaatggactgtttacagagcgtatacaaattggaaattttgttgaagaagtctatgacagaaatccattatttaatgttatcagagcaattagaaatagt

SEQ ID NO: 1400 - protein, 1374 aa, Streptococcus agalactiae
MLTIHGPDLKPVLFLDNDKQGALNYFNHKWYRKQKTGSSVLEFSVYKKDLLGDSPLSHKYHVLNDQAFVSFVHKGKVQLLNIMKIDEDEKQIDCYCENLNLELLNEYCNAYKATKAMSFEEYLVQFDILSWGALTVGTNEVKDKKLTLEWTSQETKLARLLSIANNFDAEIEFETKLNFNHTFKQLIINIYKEYEEGKSYGVDRDKTDVILRYQKNISGIRKTVDKRQIYNAIRPYGKKTVRGERVISNPVTRKVTKTVGSNRTYLGGDLKYYGHTIKKANVQAIINYAVQYNILPSGIITQLYLESFWGDSTVGKRDNNWAGMSGGAQTRPSGVKVTTGMARPANEGGTYMHYASVDDFLKDYTYLLAKQGIYNVVGKKNIADYTKGLFRAGGAKYDYAAAGYQSYTNLMTNIRNGINKVTGNILNTIDKLWQTPVKPITAVNVARRATKTIQAINEATKLKGRRIGSGQCYALSGWYAKKLDGAWIDSSIGGIRGRIGGGMAAALIGTDYNWGAYGWKVDKSPNAGNLKAGGIYNVRANRGAPFYTTGWGHTGIIKSVSKTRVTVLEQNFVGRMYVVENSYDINSFASGLQTVCYPREIAQGMSVNGATTQQVSGGTQISYEEVVQEAQTESYEEEQIIYIDNSIYKEWKDENGKVEYYLKNGFLYAPLSRDRYPSVLTGNETRDNWIRKDMEVETDSQEVLMSTGLKDLKAHAYPAITYEVDGYVDLELGDVVRIQDDGYEPPLILTARVVEQEISITNPSSNKTKFSNFVEKESQLASDLISDMLRLYDESIPYEIKLATSNGVAFKNGTGESVLTPSLQKNGKDYEAVYFYKNGDSLIDIGPSLIVKASDFNHVLNITVEAYLNEELVASTQISFTDTEDGADGKDGAPGPQGPPGVNGLQGPKGDQGIQGPAGADGKATYTHIAYALDENGSTGFSVSDNVGKTYIGMYVDDNIIDSNDPKKYKWNLIKGADGARGIQGPAGADGKTPYWHVAYANSSDGTVDFSVSDSANKRYIGQYTDYDAIDSSDPKKYRWTDMVGTVVVGTNNLIDGTKSFFGTDWFTSATLEDENLSNCPFTLKKWISGQKVSHAKDIMVEQGVTYTFSAYVKREVAGNLYFYLYDIADGFITSDTPRETIIKNVDSSLRRFEITFTPTKTGRIRPRFAMVSSEQGSFSSGGFMLVRGNKTGDWQESEADKASNLDSKADQELTQAQILALEERTAIARENAIAEAMQNTLSEVETKWKLWYDLNTIDEKQKVANDIAQLFDRTTEFKQLLGEASARFSFINNETLIGEEGVAIGDKGGKAKLFLSNDSISFVTNGVAQMTLTGDTLTIKNGLFTERIQIGNFVEEVYDRNPLFNVIRAIRNS

SEQ ID NO: 1401 - DNA, 1044 bp, Streptococcus pyogenes
atgttgacatcaaagcaccataatctcaacaaactagtctggcgctacgggctaacctcagccgctgccgtccttctagcctttggaggcggggcaagcagcgttaaggctgaggtttcttctacgactatgacgtcgagtcaaagagagtcaaaaataaaagagatcgaagaaagtcttaaaaaatatccagaagtgtccaatgagaaattttgggaaagaaagtggtatggaacctattttaaagaagaagattttcaaaaggagctaaaagattttactgagaagaggcttaaggagattctagatttaattggtaaatctggaatcaagggagaccgtggtgagactggtcctgctggcccagccggaccacaaggtaaaactggtgagaggggcgcccaaggtcctaaaggtgaccgcggtgagcaaggaatccaaggtaaagctggtgaaaaaggtgagcgcggtgaaaaaggcgacaaaggtgaaaccggtgaacgcggtgaaaaaggcgaagctggaatccaaggcccacaaggtgaagctggtaaagatggcgctccaggtaaagatggagctccaggcgaaaagggtgaaaaaggtgaccgcggtgaaaccggagctcagggtccagtaggcccacaaggtgaaaaaggtgaaacgggcgcccaaggcccagcaggcccacaaggtgaggcaggcaaaccaggtgagcaaggcccagcaggcccacaaggtgaagcaggccaaccaggcgaaaaagctccagaaaagagcccagaaggcgaagcaggccaaccaggcgaaaaagctccagaaaagagcaaagaggtaactccagctgcagaaaaacctgctgacaaagaagctaaccaaacgccagaacgccgcaatggcaatatggctaagacacctgtagccaacaaccacagacgtctaccagcaactggtgagcaagccaacccattctttacagcagcagcagtagcagtgatgacaacagctggtgtcctagccgttacaaaacgcaaagaaaacaac

SEQ ID NO: 1402 - protein, 348 aa, Streptococcus pyogenes
MLTSKHHNLNKLVWRYGLTSAAAVLLAFGGGASSVKAEVSSTTMTSSQRESKIKEIEESLKKYPEVSNEKFWERKWYGTYFKEEDFQKELKDFTEKRLKEILDLIGKSGIKGDRGETGPAGPAGPQGKTGERGAQGPKGDRGEQGIQGKAGEKGERGEKGDKGETGERGEKGEAGIQGPQGEAGKDGAPGKDGAPGEKGEKGDRGETGAQGPVGPQGEKGETGAQGPAGPQGEAGKPGEQGPAGPQGEAGQPGEKAPEKSPEGEAGQPGEKAPEKSKEVTPAAEKPADKEANQTPERRNGNMAKTPVANNHRRLPATGEQANPFFTAAAVAVMTTAGVLAVTKRKENN

SEQ ID NO: 1403 - DNA, 1518 bp, Streptococcus agalactiae
gtggtagattacaaaactgtaagatgtcattttggcgatgtcgaattgactaagtggattactattacagacggctttactgtctttagtggcgcagactacgacccggagctaaaagaaattggtggcaaagatggtagcatttttattggaacgaaaactaagcataaagtaataaaagtcccattctgggtaaaatacaatacaatagaagattacgatgccctacaattggctttatcttctaaaaagcctaagatgttgatgtttagccacatacctggacgctattatttagctgtccaggttggggatttgaactttaaagaaatcaagatgaacggctttggtgagataacgtttatagttgcagatgcatatgctcattcaacgtcatacagacgcattaaagactatactcaagacggaaataaaatgaccttcaagattaaaaataacgggacagcccctgcgtttccgatatttagaattaagcacttgggtgaaaatggctatattggaattacaaatgagactggagcatttgcggttggttctcctgaagaagaagacgggactatcgttcatcgtaacgaaaccctttttgattactcaaaagcgattgcacaagctttagaaggtgcgcccaacgtcgcaaaactcaactatatgccaccaacatttgactcggaattaaagcgcatgcgccttgataatattttaggctctggcaaaggtggagagtatgtagctattggtgctagaggaactacaccgggttacggcgagcatgttggaacacggacatttattattaatcctgactcaaacggcgaatatactctcaatgaacacttgtggtggaaacagatttttattgctaccgcgcaggatcaaaaaggatttttaaagctttgcgtgacaggtgaaaatgatgaattcctctatgggattgaaacttacaaacgcaaaaacggctttgaaacagagtataacttttttgctcttgatgatgatggcgttggatggcgcttttataagcagtttgaattccaagcggatagaaattatcacaatcctttttcgatgaatagaagcagggcggttgagatttttagagaagaagataagtttcgtatttactttaacggtgcgcatcatcatgtaactgttccgtcccttaaaggaaaaaaatctcgcaagatacatcttgcgatggggacatgcagtgatagctctaaatatatcaactacaacctgtttgaaaaagtcaattttgaaaaaatgggagtgtctcattacaacaatattgtcaataagtaccaaccaggggatgaggttatcattaactttgaaaatgacactgtaagtacaaaagatatcgattcaatacaagatgtggtgttaggttctaagatgatttcgattccgccaggagagtcagaactagtcgtacacttgtctagctgggtcgcagcgctacctgatatatcaattgattttgaagagaggtacaaa

SEQ ID NO: 1404 - protein, 506 aa, Streptococcus agalactiae
MVDYKTVRCHFGDVELTKWITITDGFTVFSGADYDPELKEIGGKDGSIFIGTKTKHKVIKVPFWVKYNTIEDYDALQLALSSKKPKMLMFSHIPGRYYLAVQVGDLNFKEIKMNGFGEITFIVADAYAHSTSYRRIKDYTQDGNKMTFKIKNNGTAPAFPIFRIKHLGENGYIGITNETGAFAVGSPEEEDGTIVHRNETLFDYSKAIAQALEGAPNVAKLNYMPPTFDSELKRMRLDNILGSGKGGEYVAIGARGTTPGYGEHVGTRTFIINPDSNGEYTLNEHLWWKQIFIATAQDQKGFLKLCVTGENDEFLYGIETYKRKNGFETEYNFFALDDDGVGWRFYKQFEFQADRNYHNPFSMNRSRAVEIFREEDKFRIYFNGAHHHVTVPSLKGKKSRKIHLAMGTCSDSSKYINYNLFEKVNFEKMGVSHYNNIVNKYQPGDEVIINFENDTVSTKDIDSIQDVVLGSKMISIPPGESELVVHLSSWVAALPDISIDFEERYK

SEQ ID NO: 1405 - DNA, 2010 bp, Streptococcus agalactiae
atggctactaacttaggacaagcttacgtgcagattatgccgtcggctaaaggaatctctggatctataagtaagacgttagacccagaagcgtcaagcgcaggtagctctgcaggtagcctattaggaggtaaattgattgggatattggggagtgtcattgcagctgctaaaataggcgaaatggtcacaaaagcaatatcgtcatcaatttcagaaggagcggcgcttcagcagtcacttggaggagtagaaacccttttcaaaagcaacgcaaatttagtaaaaaaatatgcagacgaagcctataaaacaactggcttatcagcgaatgcgtatatggaaagtgtcaccggctttagtgctagtttgcttcagtcgctcggaggggatacggccaaagcggcaaaagtcgcaaatatggctatgatagacatggctgataactctaacaagatgggtacatctatggaaagtattcagtacgcttatcaaggttttgcgaagcaaaattacacgatgttggacaatttgaaactcgggtatggcggtacgcaagaagaaatgaaacgtttgctttcagatgcccaaaagctaactggaaaaaaatatgatatttcaaatctctcagatgtatatgaagctattcacgctattcaagggaaaatagggataaccggaacaaccgctaaagaggcagcaacaacgttcacaggttcttttgaagctatgaaagcagcttcgaaaaacttgttggggaaaatggctttaggtgaggatatcaaaccatcgctaaaagcgctgtttgatacaacaagcaactttgtattgaataactttataccaatgctaacaaatgtttttaaaggatttggttcggttatttcgttaactttctcagagctaatacctaaaattgttggttttatgcaaacaagcggtccgtcgctaatgcaatctggcattagctttattattagctttgttaacggatttctaacagcctatcctgcatttttaacagtggcaggaaaaatatttacagatttcgtatcttttgtaatgcaaagtatacctggactcttgcaagctggggctactctcgtcctgaatctaatagatggaatattagctaacttacctcaaatagcaacttcggcagtatctgtgatatcaagctttatatcaatgttgcaagcaaattacccggcaattttaaaaaaaggttttgaaattttaagttacttagtgcaagggattatagcaagattacctgatatcgttattactgttggaaaactcatagcgattttagcaggagcgatagcaagtaatctacctaaagtgctagctcttggagttcagttactcatcacttttgttaaagggattctgagtgtcataggtaaaataaacgaaacagctaacaatattggtgaaaagcttatcaatgcaatcaaatcgattgatttgttgagtgcaggtagagctataatgcgaggtttcttacgaggtttagaggatgtttggggagatattcaaaattttgtcggagatattgcagggtggattaaagatcacaaaggaccaataagttacgatagacgtttacttattccagccggcaacgcaatcatgcaaggtctgcatcaaggacttgttgataaatttaaaccagttaaaaacttagttaacggaatggccgaagaaattcagtcttcattcggaaatcctcaactagcttttgatatggatactaacgtaaacaatggctttgagcgaataggtactttaaataaaaatttatctagtcaagtgactagtacagataattacactagcggcaatgctgctttgttatctgccatcaaaaatttagccgatagacctattgttgtgtctgcgcaatttgataaaaatgaatttgccagagtcgttgctaagccaatagcagcgagacaaaaatttgacgaacagacagaagaaagactgagaggtataaacaggtgg

SEQ ID NO: 1406 - protein, 670 aa, Streptococcus agalactiae
MATNLGQAYVQIMPSAKGISGSISKTLDPEASSAGSSAGSLLGGKLIGILGSVIAAAKIGEMVTKAISSSISEGAALQQSLGGVETLFKSNANLVKKYADEAYKTTGLSANAYMESVTGFSASLLQSLGGDTAKAAKVANMAMIDMADNSNKMGTSMESIQYAYQGFAKQNYTMLDNLKLGYGGTQEEMKRLLSDAQKLTGKKYDISNLSDVYEAIHAIQGKIGITGTTAKEAATTFTGSFEAMKAASKNLLGKMALGEDIKPSLKALFDTTSNFVLNNFIPMLTNVFKGFGSVISLTFSELIPKIVGFMQTSGPSLMQSGISFIISFVNGFLTAYPAFLTVAGKIFTDFVSFVMQSIPGLLQAGATLVLNLIDGILANLPQIATSAVSVISSFISMLQANYPAILKKGFEILSYLVQGIIARLPDIVITVGKLIAILAGAIASNLPKVLALGVQLLITFVKGILSVIGKINETANNIGEKLINAIKSIDLLSAGRAIMRGFLRGLEDVWGDIQNFVGDIAGWIKDHKGPISYDRRLLIPAGNAIMQGLHQGLVDKFKPVKNLVNGMAEEIQSSFGNPQLAFDMDTNVNNGFERIGTLNKNLSSQVTSTDNYTSGNAALLSAIKNLADRPIVVSAQFDKNEFARVVAKPIAARQKFDEQTEERLRGINRW

SEQ ID NO: 1407 - DNA, 2355 bp, Streptococcus pyogenes
atggcaacagaacttggtcaagcgtatgtgcaaattatgccatccgctcgtggaataagtggagcaatctcgaagcaacttgatcccgaagcaaggtcggctggattgagcgctggttcgctcattggtggtaatctcgttaaaatgattggtggtgccattgcagctgctggaatcggtaagatgatttcgtctgccttgtccgctggtgctgatttgcagcaatcttttggtggtattgacacattgtataagggcgctgagactgctgtcaaagggtttgctaaagaggcatacaaagctggaatatcagcaaatacttatgcagagcaagcagtttcaatgggtgcatctctaaagcaatcacttggaggtgatgctgtcgcggctgccaaggctgctaacatggcaatcatggatatggccgacaactcggctaagatgggtactgatatcacatcaatccaaatggcttaccagggatttgctaagcaaaactatacaatgcttgataacctaagacttgggtacggcggcacaaaagaagagatgaagcgtcttttatcagacgctgaaaagttacctgccgctatgggcaagaagtttgatttgagtaattatgctgatgtggttgaggctatacacttggtacaggataacatgggtatcgctggagttgctgctgaagaagcaaaaactacattttcaggctcactagctgctatgaagtcctcttttacaaatgtaatggcaggtttatcactaggagatgatatcagaccggctttacgaggactggctgagacaacttctaatttcttatttggtaactttattccgatggtggcaaatatctttaaaggattaccatcggcaattggtacttttattggagccgcagctcctattatcacaagtcaattccaaggtctaatgagtagccttggaattagtattgatttaagtcctattactgctaaatttgcacagattggccaaaatttacaacctgtttttaacggtttaaaaacggcttttagtcagttgccatcattttttactagcattggtagtgcagttgcaccagtaatagacactattattagcggattagccagattagatttcagtggttttgaggctttaatttcagcaattttaccagccctacaggcaggtttttctaacttcgctgcgattgttggaccagctatctcaggagttgttgactcgtttgttggcatgtggaatgcagcacaacctttaatttcgatactaagtgatgccttgatgccagtatttcaaattttagggtctttcttaggtggtgttgtaaaaggtgcgcttatgggagttagctttgcctttgatgcagttaaagtggctatacaactagtcacaccaattattgacttgctggttcaaggtcttaattttgtacaacctgttctcagtgtcattgcagaatggattggagttgctatcggtatgtttggtaatttaggcacagccggccaaggcttgagcgcttttattaagagcgcttggactaacattcagactgcaatttcaactgctggaacaatcatatctacggttattgactacataaaattagcgttcagtggtgccggttctgcagttggcgtcctaaaaaacattttctcacttgcttggatggcaatgggagacgcaataaatgtggctaagggtatcataagctctgttataaatggcataaaatcagccttcagtagttttagtagcttagtgtctagtgttggttcagcagtaaatggagttatcgattcaatctcaagcacaattagaggtttggcaaacattgatatttctggagctggtgccgcaattatgaatggtttcttaaacggtttgaaatcagcttggggagccgtcaaaagttttgtgagcggtatcgccaactggattgcagaacataaaggacctatctcttatgatagagttctactaaaacctgctggtaaagcaattatgggtggacttaatacaagcttgattgacggctttaaagaggttaaatcaaatgtctctggcatggctgacgaccttgcaagcaccatgacaggtaaaagtctatctctcggtatcgatgctaaaccaagcgtcacagctgatgacttactatcaagcaatattagtactaaaactacagtcggttctgctacaagtgacttgtcattattctttgttaaggtgcttgctctgttgcaagatatccttgataaaaatacggatgtctatctagacaaagaaaaagtcagcgctattttatacgaagaatttgccaaaattatggctagagaggggattgta

SEQ ID NO: 1408 - protein, 785 aa, Streptococcus pyogenes
MATELGQAYVQIMPSARGISGAISKQLDPEARSAGLSAGSLIGGNLVKMIGGAIAAAGIGKMISSALSAGADLQQSFGGIDTLYKGAETAVKGFAKEAYKAGISANTYAEQAVSMGASLKQSLGGDAVAAAKAANMAIMDMADNSAKMGTDITSIQMAYQGFAKQNYTMLDNLRLGYGGTKEEMKRLLSDAEKLPAAMGKKFDLSNYADVVEAIHLVQDNMGIAGVAAEEAKTTFSGSLAAMKSSFTNVMAGLSLGDDIRPALRGLAETTSNFLFGNFIPMVANIFKGLPSAIGTFIGAAAPIITSQFQGLMSSLGISIDLSPITAKFAQIGQNLQPVFNGLKTAFSQLPSFFTSIGSAVAPVIDTIISGLARLDFSGFEALISAILPALQAGFSNFAAIVGPAISGVVDSFVGMWNAAQPLISILSDALMPVFQILGSFLGGVVKGALMGVSFAFDAVKVAIQLVTPIIDLLVQGLNFVQPVLSVIAEWIGVAIGMFGNLGTAGQGLSAFIKSAWTNIQTAISTAGTIISTVIDYIKLAFSGAGSAVGVLKNIFSLAWMAMGDAINVAKGIISSVINGIKSAFSSFSSLVSSVGSAVNGVIDSISSTIRGLANIDISGAGAAIMNGFLNGLKSAWGAVKSFVSGIANWIAEHKGPISYDRVLLKPAGKAIMGGLNTSLIDGFKEVKSNVSGMADDLASTMTGKSLSLGIDAKPSVTADDLLSSNISTKTTVGSATSDLSLFFVKVLALLQDILDKNTDVYLDKEKVSAILYEEFAKIMAREGIV

SEQ ID NO: 1409 - DNA, 369 bp, Streptococcus agalactiae
atgctaaaaatggacgaagatgctcttgtctgtgatttagctgaaacttatcacatatatgattacaaacagctaccacctctaaaagtagctgttttttctttaggcttgagagaagaatcaagaatcaatcgagttatttcaggtaatagagtctcatttgaaagacgaatactagctgggatgtttgacagacttggaatgctcatttggatgaaaacgacagatggccaaaaaggtaaaaatagaccagaaatggtttcaacaatgtttgataatcaacagaaagatagtgaagttgtttcattcggcagtggcaaggatttcgaagaaactagaaataacattcttgggtttggaggtgatagc

SEQ ID NO: 1410 - protein, 123 aa, Streptococcus agalactiae
MLKMDEDALVCDLAETYHIYDYKQLPPLKVAVFSLGLREESRINRVISGNRVSFERRILAGMFDRLGMLIWMKTTDGQKGKNRPEMVSTMFDNQQKDSEVVSFGSGKDFEETRNNILGFGGDS

SEQ ID NO: 1411 - DNA, 369 bp, Streptococcus pyogenes
atgatagcaaaagatgatgatgcattgacttgtgatttagctgaaacatacggcatatatgattacagacagctacctgcttatcaggtggctgtttttgctgtcggtttgagatctaactctaggataaaaatggcattatctggagagactgaggctttggatactgttttgttagctggtatttatgataatactaatttgctgttttggtctaaaactaaggatggtcaatctggtcaaaacaaacctaaatccgtggtggaagctatatctggatctaaatcacaaaaagctaatgatgtcatttcttttgtgtctggcgaggattttgaaaatgcacgtaaacaattactaggaggtgatggc

SEQ ID NO: 1412 - protein, 123 aa, Streptococcus pyogenes
MIAKDDDALTCDLAETYGIYDYRQLPAYQVAVFAVGLRSNSRIKMALSGETEALDTVLLAGIYDNTNLLFWSKTKDGQSGQNKPKSVVEAISGSKSQKANDVISFVSGEDFENARKQLLGGDG

SEQ ID NO: 1413 - DNA, 243 bp, Streptococcus agalactiae
atgaaaacatcgtcaggttttgaatataagattgaagaatcgcgtttaaaaaattatgaattagtagaggcactagcggatttagaaagcaatccgctgtctttaccgaaagttctacgtttgttgctaggtgaccaagtagaaagtttaaaaaatcatttacgcgctagcgacgggactgtttcgacggaggcgttgatggaagaagtgaaagaaatttttgaaagtggtcaattaaaaaaa

SEQ ID NO: 1414 - protein, 81 aa, Streptococcus agalactiae
MKTSSGFEYKIEESRLKNYELVEALADLESNPLSLPKVLRLLLGDQVESLKNHLRASDGTVSTEALMEEVKEIFESGQLKK

SEQ ID NO: 1415 - DNA, 261 bp, Streptococcus pyogenes
atggaaatcttaaaaggaaaaacaacatcaggatttgaatacgaaattcctaaaaaacgattaaaaaactttgaacttgttgaagctattgcagaagaggaaactgatccaacagcggtagttaaaatcgttaatttgttacttggtgatgctgctaagtctctaaaagaacatgtacgagatgcagaaggtatcgtagacgttgaagctatcggagtagaaatcaaagaaatttttgaaagtcaaaaagatttaaaaaac

SEQ ID NO: 1416 - protein, 87 aa, Streptococcus pyogenes
MEILKGKTTSGFEYEIPKKRLKNFELVEAIAEEETDPTAVVKIVNLLLGDAAKSLKEHVRDAEGIVDVEAIGVEIKEIFESQKDLKN

SEQ ID NO: 1417 - DNA, 555 bp, Streptococcus agalactiae
atggtagcaaattcatcaaacgttactacggctaaacctaaaattggtggtgctatttatactgcgccgctaggaacagaattacccaaagacacagcatcagagttaaatgaagcttttaagtcattagggtacatttccgaagacggcttatcaaacgaagataaacgagaatcagaagagatccaagcgtggggtggcgatgttgtagaatctgcccaaaaaagtaaagcagataaatttacatatacattgattgaagcattgaatattgaagtactcaaagaaatctatggcaaagataatgtaactggagaccttaaaaccgggattactgttaaatcaaattcaaaaccactagaggaacattgtttggttatcgagatgattttgaaaaacaatacagttaaacgtattgtaataccaaaagggaaagtatccgaagttggtgaaattaagtatgtcgacaacgaagcggctggttatgagacaacgttacaagcgtttcctgatgcggaaggaaacactcactatgaatatataaaaggagctggt

SEQ ID NO: 1418 - protein, 185 aa, Streptococcus agalactiae
MVANSSNVTTAKPKIGGAIYTAPLGTELPKDTASELNEAFKSLGYISEDGLSNEDKRESEEIQAWGGDVVESAQKSKADKFTYTLIEALNIEVLKEIYGKDNVTGDLKTGITVKSNSKPLEEHCLVIEMILKNNTVKRIVIPKGKVSEVGEIKYVDNEAAGYETTLQAFPDAEGNTHYEYIKGAG

SEQ ID NO: 1419 - DNA, 594 bp, Streptococcus pyogenes
ttgatgaataagaatgatactaaaaatgtaacatctgcaaagcccaagaccggtggggcgatttattcggcaccgcttggtactgaattgcccaaggatgcaaaatcagaattaaatactaaatttaagaatttgggttatgtatccgaggatggtgtggtcaatgaagatacacgttcatccgaaaatattaaagcgtggggtggagatattgtcggggctgtacagacagaaaaagaggataaatttacttataagctgattgagtcactaaatgtagaagtcttaaaagaagtttatggcgctgtcaatgttactggagatttaagtgggggaatccagattaaatcaaattcaaaagagttagaagctcacgtaattgttgttgacatgatcatgaatggcggcattcttaaacgaattgtcttaccaaatgcaaaagtcgatgaggtaggtgaaattaagtatgttgacggcgaagtcgttggttatgaaacaacactaaaatgtttcccggacaaggatggtgatacacaccgtgagtatattgtaaaacctggagaagctaataaaaaagaaaacagctttgaaatg

SEQ ID NO: 1420 - protein, 198 aa, Streptococcus pyogenes
LMNKNDTKNVTSAKPKTGGAIYSAPLGTELPKDAKSELNTKFKNLGYVSEDGVVNEDTRSSENIKAWGGDIVGAVQTEKEDKFTYKLIESLNVEVLKEVYGAVNVTGDLSGGIQIKSNSKELEAHVIVVDMIMNGGILKRIVLPNAKVDEVGEIKYVDGEVVGYETTLKCFPDKDGDTHREYIVKPGEANKKENSFEM

SEQ ID NO: 1421 - DNA, 234 bp, Streptococcus agalactiae
atgagtaagtttaaattcaagctcaataaagctggtgttgctgaattgatgaaatcatcagaaatgcagcaggtattaaccactaaggccacagccatcagagaacgttgtggcgatggttacgcccaagatatccatgtcgggaaaaatagggctaatgctatggtcagcgctaaaaccataaaggccaagaaagataactcaaaaaacaacacattgttgaaggcggtgcga

SEQ ID NO: 1422 - protein, 78 aa, Streptococcus agalactiae
MSKFKFKLNKAGVAELMKSSEMQQVLTTKATAIRERCGDGYAQDIHVGKNRANAMVSAKTIKAKKDNSKNNTLLKAVR

SEQ ID NO: 1423 - DNA, 234 bp, Streptococcus pyogenes
atgagtaagtttaaattcaagcttaatagagctggtgttgccgaattgatgaaatcatcagaaatgcagcaggtattaaccactaaggccacagccatcagagaacgttgtggtgatggttatgtccaagatatccatgttgggaaaaatagggctaatgctatggtcagtactaaaaccataaaggccaagaaagataactcaaaaaataacacactgttgaaggcggtgcga

SEQ ID NO: 1424 - protein, 78 aa, Streptococcus pyogenes
MSKFKFKLNRAGVAELMKSSEMQQVLTTKATAIRERCGDGYVQDIHVGKNRANAMVSTKTIKAKKDNSKNNTLLKAVR

SEQ ID NO: 1425 - DNA, 180 bp, Streptococcus agalactiae
ttgaccggaaaaaaagttgaatatatcttggcaattccaaaaggagataagcatgattgggaggataaagaggtttgcttttttgacaaaaagtggcgcactgtcggcctagctcttgaaggtattgaagagcttattccgcttgaatggaataagaaagttatggtggaaagatatgag

SEQ ID NO: 1426 - protein, 60 aa, Streptococcus agalactiae
MTGKKVEYILAIPKGDKHDWEDKEVCFFDKKWRTVGLALEGIEELIPLEWNKKVMVERYE

SEQ ID NO: 1427 - DNA, 327 bp, Streptococcus pyogenes
ttgaaagggataacagttgctttagccgataagtcgattagcggaaaagacccttttggaaatcctgtaacagttgattttgatatcaaaattgagaatgtgcttgttgcaccagcaactaccgaagatatcactaatcagttatctttgaccggaaaaaaggttgaatatgtcttggctataccaaaaggagacgaacacgattgggaaaataaggaagttagatttttcggcaaaaaatggcgcacagtaggaattccactagaaggtattgaagagcttataccactagactggaataagaaagttatggtggaaagatatgag

SEQ ID NO: 1428 - protein, 109 aa, Streptococcus agalactiae
LKGITVALADKSISGKDPFGNPVTVDFDIKIENVLVAPATTEDITNQLSLTGKKVEYVLAIPKGDEHDWENKEVRFFGKKWRTVGIPLEGIEELIPLDWNKKVMVERYE

SEQ ID NO: 1429 - DNA, 429 bp, Streptococcus agalactiae
atgacaaattttgcgacaacagatgacgtcattttattatggcgtcaattatccgttgacgaaatcaagcgtgctgaggctttgttagagactgtctctgacacgttgaggttagaagcaagtaaagtgggtaagaatctagatgaaatgattttggaaactccttactttgctactgtattgaaatcggtaactgtagatattgtagcgagaacgctgatgactgctacacaaggtgaaccgatgtcgcaagaaagtcaatcggcacttggctacacttggtctggaacttatttggttccaggaggtggtctttttattaaggatagtgagttgaagcgtctcggactaaaaaaacagcgatatggaggaattgagctttatggggaaattgaaaggaataacagttactttagtcgacaagacgat

SEQ ID NO: 1430 - protein, 143 aa, Streptococcus agalactiae
MTNFATTDDVILLWRQLSVDEIKRAEALLETVSDTLRLEASKVGKNLDEMILETPYFATVLKSVTVDIVARTLMTATQGEPMSQESQSALGYTWSGTYLVPGGGLFIKDSELKRLGLKKQRYGGIELYGEIERNNSYFSRQDD

SEQ ID NO: 1431 - DNA, 420 bp, Streptococcus pyogenes
gtgggcaatttcgcaacaacagatgacgtcattttgttatggcgtcccttatctgttgacgaattgaaacgtgcaaatgcactcttgaaagtcgtatcagatacattaagaatggaagctgacaaagttggcaaagacttagataaaacgatggttgataagccttattttgttaatgttattaaatcggttacggttgacattgtagcgagaacgctgatgacatctactcgaggcgaaccaatggcccaagagagccaatcagctttaggatacacatggtcaggcacttatttagttccaggcggcggtctttttattaaggacagtgagttgaagcgtcttggactaaaaaaacaacgatatggaggaattgaactttatggcgaaattgaaagggataacagttgctttagccga

SEQ ID NO: 1432 - protein, 140 aa, Streptococcus pyogenes
VGNFATTDDVILLWRPLSVDELKRANALLKVVSDTLRMEADKVGKDLDKTMVDKPYFVNVIKSVTVDIVARTLMTSTRGEPMAQESQSALGYTWSGTYLVPGGGLFIKDSELKRLGLKKQRYGGIELYGEIERDNSCFSR

SEQ ID NO: 1433 - DNA, 900 bp, Streptococcus agalactiae
atggcagaatcaattaaagcaggaacgttatttaaaccagaactagtaacagaaattatgagtaaagtgaaaggtcactctacgcttgcgaaattatctggtcaaacaccaatcccgttcaacggagtagaacaatttgttttcaacttggatggtaatgctcagattgttggtgaaggtgagcaaaaattagggaataccgcaaaggtcacttctaaaattattaaaccgctgaagtttgtttatcaggcacgtatgactgacgaatttaagtacgcctcagaagaaaaacgattgaatttcttaaaacattatgctgacggttttgctaaaaaaatggcggaggcttttgatattgcagctattcatggccttgaacctcgcacaatgacagatgcctcattcaaagctacaaactcatttgatggggtcgtgactggtaatgtcatcaaatacgaagcagataaaattgacgacaatattgatgcagctgttacaacgattgtagcaaatggaaatgatgtgacaggtatcgctttgtcaccacaggcaggacaagatatgtctaaacgaaaagataaatttgataatgtgatgtatcctgaatttcgattcgggcaacgtccaagcaacttctttaatatgactttagacatcaacaagacacttactatgaaaggtggcacagctaaagatgaccatgctattgtcggagatttccagaatatgttcaagtggggttatgctgaaaatatcccaatggaaatcattgagtatggagacccagatggctctggacgtgatctaaaggcttataatgaaatcctgctccgtacagaagcattcataggatggggaattttagatgagaaagcattctctcgcgttgaggtacaagga

SEQ ID NO: 1434 - protein, 300 aa, Streptococcus agalactiae
MAESIKAGTLFKPELVTEIMSKVKGHSTLAKLSGQTPIPFNGVEQFVFNLDGNAQIVGEGEQKLGNTAKVTSKIIKPLKFVYQARMTDEFKYASEEKRLNFLKHYADGFAKKMAEAFDIAAIHGLEPRTMTDASFKATNSFDGVVTGNVIKYEADKIDDNIDAAVTTIVANGNDVTGIALSPQAGQDMSKRKDKFDNVMYPEFRFGQRPSNFFNMTLDINKTLTMKGGTAKDDHAIVGDFQNMFKWGYAENIPMEIIEYGDPDGSGRDLKAYNEILLRTEAFIGWGILDEKAFSRVEVQG

SEQ ID NO: 1435 - DNA, 909 bp, Streptococcus pyogenes
atgggaacagaaacatcaaaagcgagcttatttgacaaacatttagtatcagatcttatcaataaagttaaggggcatagctcactagctaaactatctagccaaaaacctattccgtttaacggatctaaagaatttacgtttacattagattctgatattgatgtggttgctgaaaacggtaaaaaaacacacggtggcttatcgctagagcctgttactatcgtaccaatcaaggttgagtatggtgctcgtctttctgatgaatttttatatgcaacagaagaggaaaagattgatattttgaaagcttttaacgaagggtttgcgaaaaaactcgctcgtggtattgacctaatggcgatgcatggtatcaatccacgtacaaaaaaagcgtctgacgttatcggcacgaatcactttgatagtaaagtgacgcaagtggttaaatttacagagagcgaagacgctgatgcaaatatcgaagcagctgttaatctaattcaggggtctgaaggtgtagtgacagggcttgcgatggatacagagttttcaacagcactggcgaaagttaccaatggggagatggggcctaaaatgtaccctgaacttgcttggggagcgaatccagatagcatcaatggcttgaaatcgtccgtcaatactactgttggtgctggagctgatgaagcagaatccaaagatttagtaattattggcgattttgaaagcatgtttaagtggggttatgcaaaacaaattccaatggaaatcattaaatacggtgatcctgataattcggggaaagaccttaaagggtataaccaaatttacttacgtgctgaggcgtatatcggctggggtattttggacgctaagagctttgctcgtgtcactaaaggagaagta

SEQ ID NO: 1436 - protein, 303 aa, Streptococcus pyogenes
MGTETSKASLFDKHLVSDLINKVKGHSSLAKLSSQKPIPFNGSKEFTFTLDSDIDVVAENGKKTHGGLSLEPVTIVPIKVEYGARLSDEFLYATEEEKIDILKAFNEGFAKKLARGIDLMAMHGINPRTKKASDVIGTNHFDSKVTQVVKFTESEDADANIEAAVNLIQGSEGVVTGLAMDTEFSTALAKVTNGEMGPKMYPELAWGANPDSINGLKSSVNTTVGAGADEAESKDLVIIGDFESMFKWGYAKQIPMEIIKYGDPDNSGKDLKGYNQIYLRAEAYIGWGILDAKSFARVTKGEV

SEQ ID NO: 1437 - DNA, 588 bp, Streptococcus agalactiae
ttgttacacaacgaagccaaaaagaaagcaaagaaccagctgttaaaaaacgacatccggaagggtgtttttttactgctaaaaaatctaccgaactgccgggaaagcaggagaaaggacgttaatatgtcagaatttaaagttattgaaacacaagaagagttggacacgattgtgaaagctcgcattgctcgagaacgtgagaagtatcaagattacgaccaactgaaaactcgtgttgaagaactagaaaccgaaaacagcagcttacaaactgctttgaatgatgctaaatcaaacactgatagctatacagagaaaattaccactttggaaaatcaaatcgctggttatgaggcagcaaatttacggacaaaggtagcgttacagtatggcttaccaatcgatttagctaatcgtttgcaaggcgatgatgaagacgggctcaaggtggatgcagaacgcttagcatcttttatcaagccgtctcaaccacaaccgccaacaaagtcaaatgaaccgattattaccgaccaaaaagaagcaggttggattgaaatggcacgtaatttagttaacaaaggagaa

SEQ ID NO: 1438 - protein, 196 aa, Streptococcus agalactiae
MLHNEAKKKAKNQLLKNDIRKGVFLLLKNLPNCRESRRKDVNMSEFKVIETQEELDTIVKARIAREREKYQDYDQLKTRVEELETENSSLQTALNDAKSNTDSYTEKITTLENQIAGYEAANLRTKVALQYGLPIDLANRLQGDDEDGLKVDAERLASFIKPSQPQPPTKSNEPIITDQKEAGWIEMARNLVNKGE

SEQ ID NO: 1439 - DNA, 459 bp, Streptococcus pyogenes
atgtcagaatttaaagttattgaaacacaagaagagttggacacgattgtgaaagctcgcattgctcgagaacgtgagaaatatcaagattacgaccaactgaaaactcgtgttgaagaactagaaaccgaaaacagcagcttacaaactgctttgaatgatgctaaatcaaacactgatagctatacggaagagattagcaccctgaagaatcaaattgccgattatgagacggcaaatttacggacaaaggtagcgttacagtatggcttaccgattgatttagctgatcgtttgcaaggagatgatgaagatggactcaaagtagatgcagaacgcttagcatcctttattaagccatcccaaccacaaccgccagcaaaatcaaacgaaccaaatatcgatagtaatgcagacgcaaattacagagcgttagtgcaaggattaagtacagaagat

SEQ ID NO: 1440 - protein, 153 aa, Streptococcus pyogenes
MSEFKVIETQEELDTIVKARIAREREKYQDYDQLKTRVEELETENSSLQTALNDAKSNTDSYTEEISTLKNQIADYETANLRTKVALQYGLPIDLADRLQGDDEDGLKVDAERLASFIKPSQPQPPAKSNEPNIDSNADANYRALVQGLSTED

SEQ ID NO: 1441 - DNA, 1413 bp, Streptococcus agalactiae
atggttactaagacgaaagcaaagcttggcaatcagcgacctactcaatcggtaaatttacattttgctaaaactctagctcatgaagccatcaattactacaaaaaaacaggtctaagttgctacttgtggcaagagaatatgctcatacctatgatggctatcaacgaagataacctgtgggtgcatcaaaaatacggctacgctattcctcgacgaaacggaaaaacagaagtcgtttacatacttgagctgtgggctttgcataaaggattgaaaatcttgcatactgctcacagaattagcacttctcactcttcgtttgaaaaagtaaaaaaatatcttgaaatgtcaggatatgttgacggagaagattttatatcaaacaaagccaaagggcaggagcgtattgagtttaaatctagcggttctgttatccagtttaggactaggacatcaaatggaggtcttggtgagggatttgacctactaattattgatgaggcgcaagaatacactgccgagcaagaatcagcgttgaaatacacggtaactgatagcgataacccaatgactattatgtgtggaacgccaccgaccatggtatctactggtacagtctttgaatcttatcgtaaagagtgtttaaaaggtgacagacgctactctggatgggcagaatggtctgttgacgaaatgcaaccaatacatgacgtaaaaagttggtatgttgccaacccgtccatgggataccacttaaatgagcgtaaaattgaagctgaattaggtgaggatgaaattgatcacaatatccagcgcttaggatattggccgtcatttaaccagaaatcagttatatctgaaaaggagtgggctaaactaaaagttgagcaagtaccagaactcaaaagtaagttatttgttgggattaagtttggccaagacggtaacaacgtatcattgtcaattgcagcaagagcatcagaaaataaagtatttgttgaggctattgactgtttatccgttagaaatggaactcaatggattattaactttttgaaatcggctgacattgctaaagttgttgttgatggcgcaagcggtcaagaattacttgctcaagagatgagagagcatggtttaaagaaaccagaattgcctaaagttgctgaaattatcacagctaacacgatgtgggaacaaggtatcatgcaagagactatctgccacaacgaccagccatctttgacagcggtagttacaaactgcgaaaaaaggcaaattggctcgaatggtggttttgggtataaatcgctttatgatgatagagacattagcttaatggacagtgcattgcttgcgcactggatttgttacacaacgaagccaaaaagaaagcaaagaaccagctgt

SEQ ID NO: 1442 - protein, 471 aa, Streptococcus agalactiae
MVTKTKAKLGNQRPTQSVNLHFAKTLAHEAINYYKKTGLSCYLWQENMLIPMMAINEDNLWVHQKYGYAIPRRNGKTEVVYILELWALHKGLKILHTAHRISTSHSSFEKVKKYLEMSGYVDGEDFISNKAKGQERIEFKSSGSVIQFRTRTSNGGLGEGFDLLIIDEAQEYTAEQESALKYTVTDSDNPMTIMCGTPPTMVSTGTVFESYRKECLKGDRRYSGWAEWSVDEMQPIHDVKSWYVANPSMGYHLNERKIEAELGEDEIDHNIQRLGYWPSFNQKSVISEKEWAKLKVEQVPELKSKLFVGIKFGQDGNNVSLSIAARASENKVFVEAIDCLSVRNGTQWIINFLKSADIAKVVVDGASGQELLAQEMREHGLKKPELPKVAEIITANTMWEQGIMQETICHNDQPSLTAVVTNCEKRQIGSNGGFGYKSLYDDRDISLMDSALLAHWICYTTKPKRKQRTSC

SEQ ID NO: 1443 - DNA, 1428 bp, Streptococcus pyogenes
ttgaaaggaataagtatggttactaagacgaaaacaaagcttggcaatcagcgacctactcaatcggtaaatttacattttgctaaatctctagcgcatgaagctattaattactacaaaaaaacagggctaagctgctatccatggcaagtaaatatgcttatcccaattatggccatagatgaaaatggtctgtgggttcatcaaaagtatgggtatgctatcccacggcgtaacggtaagacggaagtagtctatattgttcagctgtgggctttgcataaaggtttaaaaatcttgcatacagctcatcgaattagcacatctcatgcatcattcgaaaaggtaaaaaaataccttgagatgtcaggttatgttgatggagaagactttatatcaaataaagccaagggtcaagagcgtatagagttcaaagccagcggcgctgttatccagttccgaactaggacatcaaacggtggacttggtgagggatttgacttacttatcattgacgaggcacaagaatacacatctgagcaagaatcagcattgaagtacacagttactgatagtgataatccaatgactattatgtgtggaacgccgccaacgatggtatctactggtacagtatttgaagcatatcggaaagattgcttaaaaggcaataagcgttattctggttgggctgaatggtcagttcctgagatggttaagattaacgatgtatcttcctggtatatttccaacccatctatgggattccacctcaacgagaggaaaatcgaagctgaattaggtgaagatgagattgatcacaacatccaacgcttaggttattggccatcctttaaccaaaaatcagttatatccgaaaaagaatgggcaaaactcaaagttgagcaagtgccagaactcaaaagcaagctttttgtcggtatcaagtttggtcaagatggcaacaacgtatcactatcaattgcagcaagaacatcagaaaataaggtatttgttgagactattgactgtttatcggtcagaaatggaactcaatggattattaattttttgaaatcggctgatatcgctaaggttgtcattgatggtgcaagtggtcaagaattacttgctcaggagatgaaagatcaaggtctaaagaaaccagaattgcctaaagttgctgaaattatcacagctaacatgatgtgggagcaggggatcatgcaggaaaccatttgtcatagtgatcagccatctttgacagcagtagtcacaaactgtgaaaagaggcaaattggctctaatggtggttttgggtataaatcgctttatgatgatagagacattagcttaatggacagtgcattgcttgcgcactggatttgttacacaacgaagccaaaaagaaagcaaagaaccagctgt

SEQ ID NO: 1444 - protein, 476 aa, Streptococcus pyogenes
LKGISMVTKTKTKLGNQRPTQSVNLHFAKSLAHEAINYYKKTGLSCYPWQVNMLIPIMAIDENGLWVHQKYGYAIPRRNGKTEVVYIVQLWALHKGLKILHTAHRISTSHASFEKVKKYLEMSGYVDGEDFISNKAKGQERIEFKASGAVIQFRTRTSNGGLGEGFDLLIIDEAQEYTSEQESALKYTVTDSDNPMTIMCGTPPTMVSTGTVFEAYRKDCLKGNKRYSGWAEWSVPEMVKINDVSSWYISNPSMGFHLNERKIEAELGEDEIDHNIQRLGYWPSFNQKSVISEKEWAKLKVEQVPELKSKLFVGIKFGQDGNNVSLSIAARTSENKVFVETIDCLSVRNGTQWIINFLKSADIAKVVIDGASGQELLAQEMKDQGLKKPELPKVAEIITANMMWEQGIMQETICHSDQPSLTAVVTNCEKRQIGSNGGFGYKSLYDDRDISLMDSALLAHWICYTTKPKRKQRTSC

SEQ ID NO: 1445 - DNA, 186 bp, Streptococcus agalactiae
atggaattattgcagtacaataataagaaaatttcacttgttgacattgatgatgagatatggactggaacagcatactattgcgatgctgatacaaatgagacccccgaggacgtcttagtcgtaaaaaacgagagaggatatacagaaatttctgaatcagaaatcaaatcaattgaaatcatt

SEQ ID NO: 1446 - protein, 62 aa, Streptococcus agalactiae
MELLQYNNKKISLVDIDDEIWTGTAYYCDADTNETPEDVLVVKNERGYTEISESEIKSIEII

SEQ ID NO: 1447 - DNA, 1218 bp, Streptococcus agalactiae
atggttgatgatgtcttacctaagctactaaaatctgttcaacaggattttgaaaagcattttggcaaaagtgaggtcgttgctaaggcttttgcagaattgcaagctaaaaaagcgacttataagacagtcaacgagtttgctgtagaggttggacggcttttgtcgttggctctggcaaactctgttatttctgatgagttaccagatggtaaaatgtattataatattgctaatcgtctcgtgaatgatacactgagacataattataagttaatttctgattatgcaggcgatgtccagcaaaatttaaacaaacaggctaaaattagtttaaaaattcaacgtccaccgcttaatcaagataaaattgacgggttagtcaatcgtttggcgagtgaacctgtatttgacgatgtcaagtggcttctcgatgagccaattgttaattttagtcaatctatcgttgatgattgtatcagagctaatgctgatttccactttaaaacgggactgaaaccaactatagaacgtatatcaacaggtaagtgctgcgattggtgtgaccgattagctggtcgctacgtttaccacgaagaaccaaaagatttttacaagaggcatcaacattgtcagtgtgttatcgactatcatcctaaaaacggcaagcgtcagaattcatggtcgaaaaagtggacaaaagaaactactgatatactagaacgacgcaaacagatgaatattgacatcagagacaataaccgtaagtctgatatcaaagaatataaggaaatagtatccattttaggtacaaaagcccctatttctctagctaaattccaagacttgaagtataatgatggtataagatatgagcgattaaaagaccaagcacacatccaaggaaactttaaaaacggaagttggctagataaggtaaatcctgaaaaacaagctcggcatatcaaatcaaccgctggagaaggtaagagttatttcttcgatgatgtggataccgatgttttataccaaaagtataaacagactggtgaattaatcaagaatagaaggggacggactcataaggaacttattgatttaccagaagatatttcgataggtattgatatttactcaggaaatttagtaaatggcctgactattcattacggaaagaccggatcgcacattgttccaacttatcatgaaaggagagag

SEQ ID NO: 1448 - protein, 406 aa, Streptococcus agalactiae
MVDDVLPKLLKSVQQDFEKHFGKSEVVAKAFAELQAKKATYKTVNEFAVEVGRLLSLALANSVISDELPDGKMYYNIANRLVNDTLRHNYKLISDYAGDVQQNLNKQAKISLKIQRPPLNQDKIDGLVNRLASEPVFDDVKWLLDEPIVNFSQSIVDDCIRANADFHFKTGLKPTIERISTGKCCDWCDRLAGRYVYHEEPKDFYKRHQHCQCVIDYHPKNGKRQNSWSKKWTKETTDILERRKQMNIDIRDNNRKSDIKEYKEIVSILGTKAPISLAKFQDLKYNDGIRYERLKDQAHIQGNFKNGSWLDKVNPEKQARHIKSTAGEGKSYFFDDVDTDVLYQKYKQTGELIKNRRGRTHKELIDLPEDISIGIDIYSGNLVNGLTIHYGKTGSHIVPTYHERRE

SEQ ID NO: 1449 - DNA, 1491 bp, Streptococcus pyogenes
atggttgatgatgtcttacctaagctactaaaatctgttcgacaagattttgaaaagtattttggcgaaagtgatgttgtaaccaaggcttttgcagaattgcaagctaaaaaagtgacctataaaacagtcaatgagtttgctattgaagtcggaagacttttatctttggctctgacaggttctgttagctcggataaattaccagacggtaaaatgtattacaatatcgctaagcgtctcttagatgagactatgggacggaattacaaattgatttcaggttatgctggtgatgttcagcggattttaaatgagaatgctcagattggtctaaaggtgcaacgtccaccgctaaatcgagacaagattaacgggatggtaaatcgtttggatagcgagaatacatttgatgatgtaaaatggctgtttggtgaaccgattgttaatttttcgcagtccattgtggatgataccatcaaggcaaatgcggatttacaatataaaacaggtatgacgccacaggttgtcagaacagaaagtggcaactgttgtgaatggtgtcgtgaggttgttggcacttatagttatccaaaagtccctaaggacgtatggagaagacatcagcggtgtcgatgtacgcttgactatgacccgaagaatggaaaagttcagagtgcttggagtaaaatctggcgaaagaaagaaaaaactcaagaatctatagaaagggttgaaaaatttaaggaaagtgctctagtagaatctatcaaaaatgatatcgctaagttagatatgacaaaggttggtccgagtgatataattgatatagggaaacgtatcaattatcactttagagtttcagaacatataggagataaagagaaattaaaagaaattttctcaaattttcgtgaaatcggtggagaaatacctaaaaatacttgggcaaaaggttcatctaaacttgttaaagaccagctacaagaggcttttcaaaattatccaactgagtgggcagctgttccggacggtattggtaaaaaactaaaagctataaaaaggaagcgcggttacttcgatggatatgatgaagatttagttattgctacaaatggaacaagaaaaacaacaccttaccatgagataggacatatgattgaactggttaatcctgatttagtaagattagagaaagcctgggtagataaaagaactgctaatgaagctgaggttcgcttgaaagatatttttccaagttcaaattatggtattggggaagttactaagaaagatgactttatatcaccatatattggtaaatactacagcgatgcagctgaagttttcactatgggattacaaggtatttttgttcctgaagaacgatttgctaagtcctttgacaaaaaaacatggaaatatgactacaagacaatcaatgacgaccctgaatttttgaattttattattggattatttgtgaaagtg

SEQ ID NO: 1450 - protein, 497 aa, Streptococcus pyogenes
MVDDVLPKLLKSVRQDFEKYFGESDVVTKAFAELQAKKVTYKTVNEFAIEVGRLLSLALTGSVSSDKLPDGKMYYNIAKRLLDETMGRNYKLISGYAGDVQRILNENAQIGLKVQRPPLNRDKINGMVNRLDSENTFDDVKWLFGEPIVNFSQSIVDDTIKANADLQYKTGMTPQVVRTESGNCCEWCREVVGTYSYPKVPKDVWRRHQRCRCTLDYDPKNGKVQSAWSKIWRKKEKTQESIERVEKFKESALVESIKNDIAKLDMTKVGPSDIIDIGKRINYHFRVSEHIGDKEKLKEIFSNFREIGGEIPKNTWAKGSSKLVKDQLQEAFQNYPTEWAAVPDGIGKKLKAIKRKRGYFDGYDEDLVIATNGTRKTTPYHEIGHMIELVNPDLVRLEKAWVDKRTANEAEVRLKDIFPSSNYGIGEVTKKDDFISPYIGKYYSDAAEVFTMGLQGIFVPEERFAKSFDKKTWKYDYKTINDDPEFLNFIIGLFVKV

SEQ ID NO: 1451 - DNA, 1266 bp, Streptococcus agalactiae
atgaactatatgggtatgggctatcttcagaggaagttagctctttttaagactggtgtagataaaagatatcgctattatgctatggacgacagagacaacacacgaagtattgtcatgcctgacaatgtgcgtgagatgtacaggtctgtgattgaatggaccgctaaaggagttgatagtctggcagatcgcattatttttagggaattcgctaatgatgattttaatgcttgggaaatttttaaagctaataacccggatatcttttttgatacggctattcaatcggcgctaattgcatcttgttgctttgtgtatattatgccagggaaggaagatagcctgcccaaaatgcaagttattgaagcgagtaaagcaacaggcattcttgacccgactacatttttgctgacagaaggttatgcagtcttagagtcggattcaaatgagaaccctacattagaagcttattttacaggcgaaaaaacctggtactatcccaaagatgagaaaccatatagcattgataactcgacaggacaccctttgcttgtccctgtaattcataggccagatgctgtacgtcccttcggacgtagtcgtataaccaaagctgggatgtatcaccaaaaggccgccaaacgtactttagagcgtgcggaagttactgcagagttttatagtttccctcaaaagtatgttctcggaatggatcctgatgcagaacctatggaaaaatggcgtgctactgtttcgacgttattagagatatcaaaagatgaagatggagacaaaccaacagttgggcaatttacaacagcaagcatggcccctttcatggatcatttaaaaatgtacgcttcattattcgcgggtggctctggacttactcttgatgaccttggtttcccttctgacaatccatcatcagtggaagccattaaagcagcgcatgagaatttaagagcggcaggacgcaaagctcaacgctctttctcttctggttttttaaatgtggcttatattgctgtttgtttgagagatgatttcccttatcttcgtaatcagttcatggatactgaaattaaatgggaacctctttttgaagctgatgcaaatatgctaactttggtcggtgatggtgctattaagcttaatcaagctattcctggtttcatggatgcagacgttattcgggacttaactggtgtaaaaggttctgacaatccaattccaaaagctacggaggtgacaactgatggt

SEQ ID NO: 1452 - protein, 422 aa, Streptococcus agalactiae
MNYMGMGYLQRKLALFKTGVDKRYRYYAMDDRDNTRSIVMPDNVREMYRSVIEWTAKGVDSLADRIIFREFANDDFNAWEIFKANNPDIFFDTAIQSALIASCCFVYIMPGKEDSLPKMQVIEASKATGILDPTTFLLTEGYAVLESDSNENPTLEAYFTGEKTWYYPKDEKPYSIDNSTGHPLLVPVIHRPDAVRPFGRSRITKAGMYHQKAAKRTLERAEVTAEFYSFPQKYVLGMDPDAEPMEKWRATVSTLLEISKDEDGDKPTVGQFTTASMAPFMDHLKMYASLFAGGSGLTLDDLGFPSDNPSSVEAIKAAHENLRAAGRKAQRSFSSGFLNVAYIAVCLRDDFPYLRNQFMDTEIKWEPLFEADANMLTLVGDGAIKLNQAIPGFMDADVIRDLTGVKGSDNPIPKATEVTTDG

SEQ ID NO: 1453 - DNA, 1266 bp, Streptococcus pyogenes
atgaattatatgggtatgggctatcttcgtaggaagttagctctttttaaaactggagttgataaaagatatcgttattatgccatggatgacagagacgacacacgaagtattgtcatgccaaataatgtgcgtgaaatgtacaggtctgtgttagaatggaccgctaaaggggttgatagccttgcggaccgtattattttcagggagtttaccaacgatgattttaatgcttgggaaatttttaaagcgaataaccctgatatcttttttgatacagccatacagtcagcattaattgcatcttgttgctttgtgtacatcatgccaggagcggaagacggcttacctaaaatgcaagttatcgaagctagtaaagcgacggggatacttgacccaactacatttttattaacagagggttatgcaattttagagtctgactcaaacggtaatcctacgttagaggcctatttcacagacaaagacatctggtattatccaaaaaaagggaaaccatataatattaaaaatccaacaggtcaccccttgcttgtacctatcattcacagaccagacgcagttagaccatttggtcgcagtcgcattaccaaggctggaatgtatcatcaaaaggcagcgaagagaacgcttgagagagcagaggttacggctgagttttactcattcccacaaaaatatgttttgggaatggatccagacgctgaaccgatggaaaagtggcgtgctacggtgtcaacgttactcgaaatctcaaaagacgaggatggcgacaagccaacagttgggcaattcacaacagcaagcatggcccctttcatggaacacttgaaaatgtatgcttcgctatttgctggtggttccggtctcactcttgatgaccttggttttccatctgacaacccatcgtctgttgagtcaataaaagcggcacatgagaatttgagagcagcaggacgcaaagctcaacgttctttttcttctggatttctaaatgtggcgtatattgctgtttgtttaagagatgaatttccttatcttcgtaatcaattcatggatacagtaattaaatgggagcctctctttgaagctgatgcaaatatgctaactttagtaggggatggagctatcaaacttaatcaagctatccctggtttcatggatgcagatgttatccgtgatttaacgggagtaaaaggggctgataaacctatacctgctatcacggaggtaacaactgatggt

SEQ ID NO: 1454 - protein, 422 aa, Streptococcus pyogenes
MNYMGMGYLRRKLALFKTGVDKRYRYYAMDDRDDTRSIVMPNNVREMYRSVLEWTAKGVDSLADRIIFREFTNDDFNAWEIFKANNPDIFFDTAIQSALIASCCFVYIMPGAEDGLPKMQVIEASKATGILDPTTFLLTEGYAILESDSNGNPTLEAYFTDKDIWYYPKKGKPYNIKNPTGHPLLVPIIHRPDAVRPFGRSRITKAGMYHQKAAKRTLERAEVTAEFYSFPQKYVLGMDPDAEPMEKWRATVSTLLEISKDEDGDKPTVGQFTTASMAPFMEHLKMYASLFAGGSGLTLDDLGFPSDNPSSVESIKAAHENLRAAGRKAQRSFSSGFLNVAYIAVCLRDEFPYLRNQFMDTVIKWEPLFEADANMLTLVGDGAIKLNQAIPGFMDADVIRDLTGVKGADKPIPAITEVTTDG

SEQ ID NO: 1455 - DNA, 354 bp, Streptococcus agalactiae
ttgaaaaagaaatgtttaatttgtaaaaagactttccaagctaaaaccaacagaagtttatattgttcagaagaatgccgcaaaaagggcattcgtgagaaacaacgcaaattgatgaagcaaaaacgagccgataaaaagaaagagaaaattaaggttctaaatactaacgcagatgtgacagaaaagcctaaaaaaatacgtaatttggtacaacactataaaaaactaaagagggaaattttagacaatgagtctgaatttggttttacaggaatcgcgcttgttgagggtatagatattcacgaagaaaactttgtagatttagttatgcaaaaaataaaggagcaacaa

SEQ ID NO: 1456 - protein, 118 aa, Streptococcus agalactiae
MKKKCLICKKTFQAKTNRSLYCSEECRKKGIREKQRKLMKQKRADKKKEKIKVLNTNADVTEKPKKIRNLVQHYKKLKREILDNESEFGFTGIALVEGIDIHEENFVDLVMQKIKEQQ

SEQ ID NO: 1457 - DNA, 354 bp, Streptococcus pyogenes
ttgaaaaagaaatgcttaatttgcaaaaaaaacttccaagcaaaaaccaatagaactttatattgctctgaagaatgccgtaagaaaggcaatcgtgagaaacaacgtaaattgatgaaacaaaaacgggctgaacagaggaaagaaaaaaagaaagtcctaaatcctaacacagatgtgacagaaaagcctaaaaaaatacgtaatttagcgcagcactataaaaaactaaaaaaggaaattttggcaaatgaatctgaatttggttttactggaataacacttattgaaggaatagatgtacatgaagaaaactttgtagatttagtcatgcaaaaaataaaggagcagaaa

SEQ ID NO: 1458 - protein, 118 aa, Streptococcus pyogenes
LKKKCLICKKNFQAKTNRTLYCSEECRKKGNREKQRKLMKQKRAEQRKEKKKVLNPNTDVTEKPKKIRNLAQHYKKLKKEILANESEFGFTGITLIEGIDVHEENFVDLVMQKIKEQK

SEQ ID NO: 1459 - DNA, 417 bp, Streptococcus agalactiae
gtggttcgaatccactcacacgctttactcagtcatcacattgtggtggctttttattacaattgtaagaggggatgttgcaaactgcgtgcagataaaaaaggtacccaccgggtcgcgttcgaaaaaaataaacgccggctgctaaaaaccgcccacctatgcggtatctgtggccggccagtagataagtcattgaagtatccacatccgctaagtgcagcaattgatcatattgttcctattgcaaaaggtggtcatccgtcatcaatagataacttacagttaacacattggcaatgtaataggcaaaagtctgacaagttatttatcaatcagacagccgtacgggctactgttgtaggaaatagaaacttacctcaaagccgagactggtcgtcctacgcatctaaagaa

SEQ ID NO: 1460 - protein, 139 aa, Streptococcus agalactiae
MVRIHSHALLSHHIVVAFYYNCKRGCCKLRADKKGTHRVAFEKNKRRLLKTAHLCGICGRPVDKSLKYPHPLSAAIDHIVPIAKGGHPSSIDNLQLTHWQCNRQKSDKLFINQTAVRATVVGNRNLPQSRDWSSYASKE

SEQ ID NO: 1461 - DNA, 342 bp, Streptococcus pyogenes
atgtctcagttaagggcagataaaaaaggtacccaccgggtagcatttgacagaaataaaaagaagttactaaaggcagccactgtctgtggtatctgtggcaagccagtggacaagtctcttaagtatccacatccattaagcgcagcaatagatcatatagttcctatcgcaaaaggtggtcatccatcagcgcttgagaacttacagttaactcactggcagtgcaacaggcagaagtctgataagttgtttgctaaccaagcaagcaacgagccaaagacaattggcaacagaaaccttcctcaaagtcgagactggtcatcttttgcatttaaaaag

SEQ ID NO: 1462 - protein, 114 aa, Streptococcus pyogenes
MSQLRADKKGTHRVAFDRNKKKLLKAATVCGICGKPVDKSLKYPHPLSAAIDHIVPIAKGGHPSALENLQLTHWQCNRQKSDKLFANQASNEPKTIGNRNLPQSRDWSSFAFKK

SEQ ID NO: 1463 - DNA, 264 bp, Streptococcus agalactiae
atgaaagaaaaaacaatttttatatcaaaaaaatatgcaaatgactttaacaatgacaaatataatttgtcctctggctattattttagaagtggtgaaaaacatgatattgctattgttaaatatggtgaaaaagattatttaaaaaatactgatttagcatatgttgtatgcgataagatcgttgacgcagactctataagcttcgtttatcatggtgaatatgaaacttggcattttaaactattaaacacagaagcaaat

SEQ ID NO: 1464 - protein, 88 aa, Streptococcus agalactiae
MKEKTIFISKKYANDFNNDKYNLSSGYYFRSGEKHDIAIVKYGEKDYLKNTDLAYVVCDKIVDADSISFVYHGEYETWHFKLLNTEAN

SEQ ID NO: 1465 - DNA, 531 bp, Streptococcus agalactiae
atgaatattgaagaagcgaagaaattgatagacaaacagtctattggtaaaggtggtgtcggcgacattccagtagtgaaaacacatattgtaaaagtattactcgaccagattgaccaacctcaaccagaagtgccacggtttgtggctgattggtacgagaagcataaagatagcttagagtgcgatttatatttatatcacatgtcgatatacgatgaagaagtcgaaaaagatgacttctattactggatgcaaacatcaaaaaatccagtctacacacttattaatatgcaccaattcggctacaccatccaaaaagagaagctgtatacggttgagatacctaatccgaatgaaagacagttaagttttgtgctgatgagacaacttagcggaaatgtaagtatcaaagttatgcatagagataacttagacttactaaagacagataatgatttacaactaacagaatccgaaatccgcaaagatttcgactgggcgtggcagtttagagaagaggtggtggaa

SEQ ID NO: 1466 - protein, 177 aa, Streptococcus agalactiae
MNIEEAKKLIDKQSIGKGGVGDIPVVKTHIVKVLLDQIDQPQPEVPRFVADWYEKHKDSLECDLYLYHMSIYDEEVEKDDFYYWMQTSKNPVYTLINMHQFGYTIQKEKLYTVEIPNPNERQLSFVLMRQLSGNVSIKVMHRDNLDLLKTDNDLQLTESEIRKDFDWAWQFREEVVE

SEQ ID NO: 1467 - DNA, 459 bp, Streptococcus pyogenes
atgaatatagaagaagcgaaagaattagtagataattcaaaattttatggaaagactagcagtgttataaaagccgaggttcgcgacattatagaccagttaaaccaaccaaaaccagaagtaccgcagtgtgtggcggattggatagaagagtgcaaagaagaagatttaactttaaaaggcttgttttctaacagcgatatgcctgcaaaaatttttgattggatttttggtagtgacgaaaattgtaggttaatggctgaagcatggattaacggctacacagtagaaaaagaaaagctctacactgtcgacttaccaaacggtcaacctttagtgcgcggcataaacactttgtattttagtcaaaatctagcaaccgaaaatgtaaaactcaccgaatccgaaatccgcaaagattttgaatgggcgtggcagtttgctgaagaggtgactgaa

SEQ ID NO: 1468 - protein, 153 aa, Streptococcus pyogenes
MNIEEAKELVDNSKFYGKTSSVIKAEVRDIIDQLNQPKPEVPQCVADWIEECKEEDLTLKGLFSNSDMPAKIFDWIFGSDENCRLMAEAWINGYTVEKEKLYTVDLPNGQPLVRGINTLYFSQNLATENVKLTESEIRKDFEWAWQFAEEVTE

SEQ ID NO: 1469 - DNA, 330 bp, Streptococcus agalactiae
ttgtcattaattgatgaagtaaaagaatgcggttcagaatctcacaaaaaatggtttgataggtactttgatggtttaaaaatcgaggagaaacttaaacagtctgcgatgaaaggattctctggttataaaatctctattccaaaaaatgatgaatacttagctagacgacttgatagccaaaaaacaatagatttactaaaataccgacttggtgacggttttgatgtcgaaataaaaaatcttgaatcatcatataaaatctttggtaaaccagttgtactaagtagagatttatttattttttggaggacaggagataagaatgga

SEQ ID NO: 1470 - protein, 110 aa, Streptococcus agalactiae
MSLIDEVKECGSESHKKWFDRYFDGLKIEEKLKQSAMKGFSGYKISIPKNDEYLARRLDSQKTIDLLKYRLGDGFDVEIKNLESSYKIFGKPVVLSRDLFIFWRTGDKNG

SEQ ID NO: 1471 - DNA, 288 bp, Streptococcus agalactiae
gtggatagaggagatgacgaaatgactgaacaacagatgattgattgcttgctttatgagttagcaaaaaaagacaaattgaacattagacgaaacaatatcataacgtttttatcgattgtgctgatggctatatctattttaaacgtcgcactgcaagaccactacaagtcgcaaattacagaattacggacacagttaagcaggacacaaaagcagcttaaacgtgctagtgatgatagagctagacagacaaaacggattgctgagctgactggaaatggggga

SEQ ID NO: 1472 - protein, 96 aa, Streptococcus agalactiae
MDRGDDEMTEQQMIDCLLYELAKKDKLNIRRNNIITFLSIVLMAISILNVALQDHYKSQITELRTQLSRTQKQLKRASDDRARQTKRIAELTGNGG

SEQ ID NO: 1473 - DNA, 267 bp, Streptococcus pyogenes
atgactgaagaacagatgattgattgcttgctttatgagttagtaaaaaaagacaaagcaatcaaaaagaaaagcatcattatcgctgcactaacagttatgctgattgtcgtatcagggctttgcgtatcgcttaaaagctattatgaaccgcaaatatacggactacgtacacagctaagcaggacacaaaagcagcttaaacgtgcgagtgagcaaaatcagagacagacaaagcggattgctgatttaacgaataacggaggg

SEQ ID NO: 1474 - protein, 89 aa, Streptococcus pyogenes
MTEEQMIDCLLYELVKKDKAIKKKSIIIAALTVMLIVVSGLCVSLKSYYEPQIYGLRTQLSRTQKQLKRASEQNQRQTKRIADLTNNGG

SEQ ID NO: 1475 - DNA, 162 bp, Streptococcus agalactiae
atgacaaaagaagaagtaattgcatttctgacagaacagcgtgatttgcggcttgttggatatgagtggggaaaagacaatctgtccgtttttgcgagatggcaattagaacaagcaaatatgtatttagatgtcattgagtggatagaggagatgacgaaa

SEQ ID NO: 1476 - protein, 54 aa, Streptococcus agalactiae
MTKEEVIAFLTEQRDLRLVGYEWGKDNLSVFARWQLEQANMYLDVIEWIEEMTK

SEQ ID NO: 1477 - DNA, 414 bp, Streptococcus agalactiae
atgataccgaattttagagcgtttaataaagagaccaaaaagatgtatggtgttgacggctttgaattaagtgtgcgcaaaatatatagatgcagcttagcagatgatgagtttcgttgtggtcgcttagagacgtttcattttgtcgaggataactttgacgattatatcctcatgcaatcaacaggaatgtttgacaaaaacggtgttgagatttttgatggtgatatagttttaacaacacgtctcatagattacacatataaaaattttaaaggtgtagtaaaaatgttagaaggtcgctggttaattgacacaggtaaagatgcggttggtttgtggactgaagttgatgagaacgaagcaatcggaaacatatatcaaaacagcgaattactagaaagcgtggaagaa

SEQ ID NO: 1478 - protein, 138 aa, Streptococcus agalactiae
MIPNFRAFNKETKKMYGVDGFELSVRKIYRCSLADDEFRCGRLETFHFVEDNFDDYILMQSTGMFDKNGVEIFDGDIVLTTRLIDYTYKNFKGVVKMLEGRWLIDTGKDAVGLWTEVDENEAIGNIYQNSELLESVEE

SEQ ID NO: 1479 - DNA, 243 bp, Streptococcus pyogenes
atgataccaaattttagagggtttaacaaaaaaactaaaaaaatgtatagcattgatggctttaaatcaagtgaacgcaaaatatacagatgcagcttagcagatgatgagtttcgctctggtcgcttagagacattccattttgtagaggataatcttgtggaaaagtgcaacagaccacctgaacgattttatcgacaaaaacaagtacgcaaaagtgacaggcgacttatggcaaggcag

SEQ ID NO: 1480 - protein, 81 aa, Streptococcus pyogenes
MIPNFRGFNKKTKKMYSIDGFKSSERKIYRCSLADDEFRSGRLETFHFVEDNLVEKCNRPPERFYRQKQVRKSDRRLMARQ

SEQ ID NO: 1481 - DNA, 354 bp, Streptococcus agalactiae
ttgaagagattgacagatgaattaataaatcaattttacaaaatttttgacaatgggattgtaaggcaaattaaaaagctagatgtagattgtaaaaaagccgagcaaataagatgtagcgttacaaataacagacgtcgaaaaaccctgccaagaccgtacgttatcgaagcgtttaaagattattttgacgaagatacctatgcacagatgtatatcaaatcatatcgtgagtatcacaacccaaatgaccacgagacggaactttttgtaaaactaaaaagagcgcacaaagatactaagttagagcattacaaggaagttaagcgattgatgtacgcagcaatgaccttt

SEQ ID NO: 1482 - protein, 118 aa, Streptococcus agalactiae
MKRLTDELINQFYKIFDNGIVRQIKKLDVDCKKAEQIRCSVTNNRRRKTLPRPYVIEAFKDYFDEDTYAQMYIKSYREYHNPNDHETELFVKLKRAHKDTKLEHYKEVKRLMYAAMTF

SEQ ID NO: 1483 - DNA, 486 bp, Streptococcus agalactiae
ttgaagaggaatatgacttttaagacagaatttgaaataccaatcgaaccaaaacctcaaactagacctaagttcagcaaatttggtacgtacgaagatccaaagatgaagagatggcgaaaagaggtttctggatggatagaaaaaaattatgatggaccgtttttcgatgattgcataaaggtagaggtaaccttttacatgaaagcccccaaaacgctatcaaaagagcctacacaacgttctaaaggtaaaacaatacaaatatatcagaacttcgtgcgtgagcttatatggcacgctaagaagcctgatattgataatctgattaaagctgtttttgatagtatttccgatgcaggttacgacagaatacagaaatcaggtatcgtttggtcagatgacaatatcgtatgcgatttaagagcaaagaaaaaatacagtcagaatccaagaataaaagtgaggattgaagagattgacaga

SEQ ID NO: 1484 - protein, 162 aa, Streptococcus agalactiae
MKRNMTFKTEFEIPIEPKPQTRPKFSKFGTYEDPKMKRWRKEVSGWIEKNYDGPFFDDCIKVEVTFYMKAPKTLSKEPTQRSKGKTIQIYQNFVRELIWHAKKPDIDNLIKAVFDSISDAGYDRIQKSGIVWSDDNIVCDLRAKKKYSQNPRIKVRIEEIDR

SEQ ID NO: 1485 - DNA, 291 bp, Streptococcus agalactiae
ttgggaaagccgtgtaagggaaaaccttacgcacggtttgacgaggggtttctgaggagatggctcaaatcagcgacctactctacaaaaatgacgaagccgaggaaacaaaggatatatgcaatatatgatgacgacaaatttgtcgacgttggcacaaaagaagagttatcggcacggcttggaattaaaaaagcaacaatagaacagtacatgactaaatcatatcaagcgttagctagctcaaaacgaattgcattgttggtagggattgaagaggaatatgacttt

SEQ ID NO: 1486 - protein, 97 aa, Streptococcus agalactiae
MGKPCKGKPYARFDEGFLRRWLKSATYSTKMTKPRKQRIYAIYDDDKFVDVGTKEELSARLGIKKATIEQYMTKSYQALASSKRIALLVGIEEEYDF

SEQ ID NO: 1487 - DNA, 1317 bp, Streptococcus agalactiae
atgattgctcagaaagctataaacatctttgaaaaggttcaagtatttcaacggaagatatatctatcgaccaaggcagataataagcgaaagtttggtgttttatacgacaaagtatatcgtaaagatatcctgaaagttgcgtggttctatgtaaaaaggaataaaggttcggcaggcattgatgacttcacgattgaagaaattgaagcctacggtgtacagaaatttcttgatgaaatagaagaccagttgagaaacaagaaatatcaacctaaggcagtaaagcgagtttatattccaaaagcgaatggtaaaaagagaccgttgggaattccgacagtccgagatagagttgttcaaacagctgtgaaaatagttatagaaccgatattcgaagcggactttcaagaattttcttatggttttagacctaagcgaagtgctaaccaagctataagagagatatataaatatctcaattatggttgtgagtgggttattgatgccgacttaaaaggttactttgacacgatacctcatgataagttactacttttagttaaggaacgagtaactgataagtctattatcaagttacttagtttatggctagaagcaggtatcatggaagacaatcaagtgagaagtaatattttaggtactccacaaggaggtgtcatatcaccgttgttagcgaatatctacctaaatgctttagacagatattggaagaacaatcggttagaaggaagagggcatgatgcccacttgatacgttatgcggatgactttgttattctatgctcaaataatccgaagaaatattatcagtatgcgaaacagcgtattgataagctaggattaacattgaacgaagaaaagacaagaattgtgcatgcgacagagggatttgattttctaggctatacgcttaggaaatcaaaatctcacaaaagtggtaagtataaaacctactactatccttcaagaaaatctatgaaatcaataaaaggcaaagtaaaagatgttatccaaacaggacaacacctgaaccttcctgatgtcatggaaagattgaatccaatgttgagaggatgggctaattatttcaaagctgggaactctaagcaacacttcaagagtatagataactatgtcatatataatctaacaattatgcttagaaagaagcacaagaagtctggaaagggatggagggaacatccgccgtcatggtactataactactttggactggtttgtttaaggaagttgagtaccaatatcaatgatgatagtcagagatatggtaga

SEQ ID NO: 1488 - protein, 439 aa, Streptococcus agalactiae
MIAQKAINIFEKVQVFQRKIYLSTKADNKRKFGVLYDKVYRKDILKVAWFYVKRNKGSAGIDDFTIEEIEAYGVQKFLDEIEDQLRNKKYQPKAVKRVYIPKANGKKRPLGIPTVRDRVVQTAVKIVIEPIFEADFQEFSYGFRPKRSANQAIREIYKYLNYGCEWVIDADLKGYFDTIPHDKLLLLVKERVTDKSIIKLLSLWLEAGIMEDNQVRSNILGTPQGGVISPLLANIYLNALDRYWKNNRLEGRGHDAHLIRYADDFVILCSNNPKKYYQYAKQRIDKLGLTLNEEKTRIVHATEGFDFLGYTLRKSKSHKSGKYKTYYYPSRKSMKSIKGKVKDVIQTGQHLNLPDVMERLNPMLRGWANYFKAGNSKQHFKSIDNYVIYNLTIMLRKKHKKSGKGWREHPPSWYYNYFGLVCLRKLSTNINDDSQRYGR

SEQ ID NO: 1489 - DNA, 414 bp, Streptococcus agalactiae
atgattaacaacattgtactagtaggtcgcatgaccaaggatgccgaacttcgttatacaccaagtaatcaagcggtagctactttttcacttgcagttaatcgtaattttaaaaatcaatctggcgaacgtgaggctgattttattaactgtgttatttggcgccaacaagctgaaaacttggctaactgggcaaaaaaaggtgctttggttggaattacaggtcgtatccaaacgcgtaattatgaaaaccaacaaggtcaacgtatctatgtaacagaagttgttgcggaaaatttccaattattagaaagtcgcaatagccaacaacagactaatcaaagcggcaatagttctaattcttattttggcaatgccaacaaaatggatatttcagatgatgacttaccattc

SEQ ID NO: 1490 - protein, 138 aa, Streptococcus agalactiae
MINNIVLVGRMTKDAELRYTPSNQAVATFSLAVNRNFKNQSGEREADFINCVIWRQQAENLANWAKKGALVGITGRIQTRNYENQQGQRIYVTEVVAENFQLLESRNSQQQTNQSGNSSNSYFGNANKMDISDDDLPF

SEQ ID NO: 1491 - DNA, 489 bp, Streptococcus pyogenes
atgattaataatgtagtactagttggtcgtatgaccaaggatgcagaacttcgttacacaccaagtcaagtagctgtggctaccttcacacttgctgttaaccgtacctttaaaagccaaaatggtgaacgcgaggcagatttcattaactgtgtgatctggcgtcaaccggctgaaaatttagcgaactgggctaaaaaaggtgctttgatcggagttacgggtcgtattcagacacgtaactacgaaaaccaacaaggacaacgtgtctatgtaacagaagttgttgcagataatttccaaatgttggaaagtcgtgctacacgtgaaggtggctcaactggctcatttaatggtggttttaacaataacacttcatcatcaaacagttactcagcgcctgcacaacaaacgcctaactttggaagagatgatagcccatttgggaactcaaacccgatggatatctcagatgacgatcttccattc

SEQ ID NO: 1492 - protein, 163 aa, Streptococcus pyogenes
MINNVVLVGRMTKDAELRYTPSQVAVATFTLAVNRTFKSQNGEREADFINCVIWRQPAENLANWAKKGALIGVTGRIQTRNYENQQGQRVYVTEVVADNFQMLESRATREGGSTGSFNGGFNNNTSSSNSYSAPAQQTPNFGRDDSPFGNSNPMDISDDDLPF

SEQ ID NO: 1493 - DNA, 144 bp, Streptococcus agalactiae
gtgtttgttgtcgggtcctgcgaaaaagatatcccgttattggcaaaagctgttgtgattgcttctgtaacattttcaagcggcacgtatttgcttttgaaaaatgggttatccttatcttttagtggttgttttacctctagc

SEQ ID NO: 1494 - protein, 48 aa, Streptococcus agalactiae
MFVVGSCEKDIPLLAKAVVIASVTFSSGTYLLLKNGLSLSFSGCFTSS

SEQ ID NO: 1495 - DNA, 672 bp, Streptococcus agalactiae
atgaggaaatcagaaagtataacagaatatgctaaagccttttgtaaagctcagctagaggtaaaacaaccactaaaagataaggataacccatttttcaaaagcaaatacgtgccgcttgaaaatgttacagaagcaatcacaacagcttttgccaataacgggatatctttttcgcaggacccgacaacaaacacagaaaacggttatatcgatgttgcaacgcttgtcatgcacacgagcggcgaatgggttgagtacgggcctttaagtgttaaacctacaaaaaatgatgtacaaggcgctggttcggctatcacttacgcaaaacgctatgcactatcggcaatttttgggataacaagcgatcaagatgatgacggcaacgaagatagtaaaccaaacaattccaggcaatcgccaaaagctacaactaaaaaaacacaaaagacaggatatcaaacaccaaaaatcagcaatatccaaatcgagacttacaagtctgatttaaatgatattgcgaaagccacaaaccaaaacgttgaagagttaacaaaatggctaaccgatactttaaaagtgggggaactagaaaatttgcatacggaacacattgtttcagcagacgaattaatcaataaactcaaaaagaaagcaggactaaaaaatgat

SEQ ID NO: 1496 - protein, 224 aa, Streptococcus agalactiae
MRKSESITEYAKAFCKAQLEVKQPLKDKDNPFFKSKYVPLENVTEAITTAFANNGISFSQDPTTNTENGYIDVATLVMHTSGEWVEYGPLSVKPTKNDVQGAGSAITYAKRYALSAIFGITSDQDDDGNEDSKPNNSRQSPKATTKKTQKTGYQTPKISNIQIETYKSDLNDIAKATNQNVEELTKWLTDTLKVGELENLHTEHIVSADELINKLKKKAGLKND

SEQ ID NO: 1497 - DNA, 480 bp, Streptococcus agalactiae
atggcttatttatacgaattagaaggtatttacgcacaattacagtcaatggatttagacgaagaaacattccaagatacacttgacagcattgattttcagtcagacttagaaaataacattgagtattttgtcaaaatgttaaaaaatgtgcaggctgatgctgaaaagtataaagccgaaaaagaagctttttataaaaagcaaaaacaagcggaagccaaagcggaaaaatacaaagagacgatcaggcttgcaatggaattgagtcaaaagaaaaaagttgacgctggaatgtttaaggtgtctttgcgaagaagtaaaaaagttgagattttggacgaaacaaaaattcctcttgattacatgcaagaaaaaattgaatacaaaccaatgaaagctgaaatctcaaaagctttgaaatctggaattgatatatctggagttgaactaatcgaaacagaaagtttgcaggtaaag

SEQ ID NO: 1498 - protein, 160 aa, Streptococcus agalactiae
MAYLYELEGIYAQLQSMDLDEETFQDTLDSIDFQSDLENNIEYFVKMLKNVQADAEKYKAEKEAFYKKQKQAEAKAEKYKETIRLAMELSQKKKVDAGMFKVSLRRSKKVEILDETKIPLDYMQEKIEYKPMKAEISKALKSGIDISGVELIETESLQVK

SEQ ID NO: 1499 - DNA, 159 bp, Streptococcus agalactiae
gtgaacgaagaaatatatgagtctagtcgttactggcaaagtagatacagcgacttgatgtctgattatcttaaagaagctgaagaaaatatagagttaaagaaacagttgaagagattaaaagccgaaaattggcagctgaaacacagaaagaggaaa

SEQ ID NO: 1500 - protein, 53 aa, Streptococcus agalactiae
MNEEIYESSRYWQSRYSDLMSDYLKEAEENIELKKQLKRLKAENWQLKHRKRK

SEQ ID NO: 1501 - DNA, 273 bp, Streptococcus agalactiae
atgcgatttaggaagggatatatggttgaaatcagaattaacggtgagtcaatcacatttgatagcaattttagggatgcgcttatatttacggtagatcacctaaaaaattatgacgatccttctttgaggcagacttacaacgagtttaaagattatacagacgaggacttgatgggatatatcagcacagaatttgatgtagacccggaaatgtttgttgatactaattcagacagcagatggaaaattaaacaacgaattttagaggac

SEQ ID NO: 1502 - protein, 91 aa, Streptococcus agalactiae
MRFRKGYMVEIRINGESITFDSNFRDALIFTVDHLKNYDDPSLRQTYNEFKDYTDEDLMGYISTEFDVDPEMFVDTNSDSRWKIKQRILED

SEQ ID NO: 1503 - DNA, 138 bp, Streptococcus agalactiae
atgacaaaacaacatagagaaacgcttatctggtaccgagcaagtcatcaagagcgtgagaagctgcttgattttgggctagttgataaatcacagtacgtgacactattgcggcaattgcgcaagaaatatgcgatt

SEQ ID NO: 1504 - protein, 46 aa, Streptococcus agalactiae
MTKQHRETLIWYRASHQEREKLLDFGLVDKSQYVTLLRQLRKKYAI

SEQ ID NO: 1505 - DNA, 138 bp, Streptococcus pyogenes
atgacaaaacaacatagagaaacacttatctggtaccgagcaagtcatcaagagcgtgagagattgcttgattttggactagttgataaagcacggtacgtgacactattgcggcaattgcgtaagaaatatgcgatt

SEQ ID NO: 1506 - protein, 46 aa, Streptococcus pyogenes
MTKQHRETLIWYRASHQERERLLDFGLVDKARYVTLLRQLRKKYAI

SEQ ID NO: 1507 - DNA, 231 bp, Streptococcus agalactiae
atggatcaggagatttttaatttttttaacaaacaaatcaaaaaagattttggtaaaacggcgagtaaagagacttttgctaagtttgctagttactgcgccgaaggaatcgaaaaaaatggagttaagccaatttttaattggataaacctatacgcttttggaaccggtatgacaacagcagaagcagaccgattaagaatagagcgatataaacaggagaatacgtta

SEQ ID NO: 1508 - protein, 77 aa, Streptococcus agalactiae
MDQEIFNFFNKQIKKDFGKTASKETFAKFASYCAEGIEKNGVKPIFNWINLYAFGTGMTTAEADRLRIERYKQENTL

SEQ ID NO: 1509 - DNA, 231 bp, Streptococcus pyogenes
atggatcaggagatttttaatttttttaacaaacaaatcaaaaaagattttggtaaaacggcgagtaaagagacttttgctaagtttgctagttactgcgccgaaggaatcgaaaaaaatggagttaagccaatttttaattggataaacctatacgcttttggaactggtatgacaacagcagaagcagaccggttgagaatagagcgatataaacaggagaatgcgtta

SEQ ID NO: 1510 - protein, 77 aa, Streptococcus pyogenes
MDQEIFNFFNKQIKKDFGKTASKETFAKFASYCAEGIEKNGVKPIFNWINLYAFGTGMTTAEADRLRIERYKQENAL

SEQ ID NO: 1511 - DNA, 858 bp, Streptococcus agalactiae
atggcagataacaaaaagtattactatctaaaattaaaagaaaatttttttgaaagtgatgaagcaatcattttagaaagtatgcctgacggctatatctatagcaatattttgctcaagctatacctaagaagtttaaaaaatgacggtttattaatgtttaacaaccttatcccttacaacgcacaaatgcttgcaacgattacaagacatcaggttggcactgtcgaaaaggctattcaaatttttagagacctacaactaattgaaattcttgataatggtgctatatatatgacaaatattcaaaattttgtcggaaaatcaagcactgaggctgacaggatacgaaaactaagagcaaaaaataacagtggtgtacaaatgttgtacaaatgtacaccagagatagagatagagaaagataaaaagatagatataaatatagataaagagttagaactagaacaagataaagaagataggtttgttgatgttgttgaagcaaatcttggtagaggtcttgtaaagtttgagttcgacatgattaatgactatctcattggacaaaatgtctcaaaggatttgtttttggaagctgttaaagtagcagttgctaataatgtccgcaaatttaattacatcgctcgcattttggataattggattaatgatgggataaagactcctgaacaagcatatcaggctcaaagagactttaaagctaaaaaagctaacaaaacaatgcaatcacaatccaacgttcctagctggtctaatccagactacaaaggaccagatttaaaagaatttgcactaggaagcatagacgatatagaagatggatcaggagatttt

SEQ ID NO: 1512 - protein, 286 aa, Streptococcus agalactiae
MADNKKYYYLKLKENFFESDEAIILESMPDGYIYSNILLKLYLRSLKNDGLLMFNNLIPYNAQMLATITRHQVGTVEKAIQIFRDLQLIEILDNGAIYMTNIQNFVGKSSTEADRIRKLRAKNNSGVQMLYKCTPEIEIEKDKKIDINIDKELELEQDKEDRFVDVVEANLGRGLVKFEFDMINDYLIGQNVSKDLFLEAVKVAVANNVRKFNYIARILDNWINDGIKTPEQAYQAQRDFKAKKANKTMQSQSNVPSWSNPDYKGPDLKEFALGSIDDIEDGSGDF

SEQ ID NO: 1513 - DNA, 384 bp, Streptococcus pyogenes
atggacgaaaaaaagctttttgaaaatttccaattaacttttggacggatgatatcgccatttgaaatcgaagatattcaaaagtggattcacgaagataacatgccaattgaagttgtcaaccttgccttaagagaagcggtagaaaacaacaaaatcagttggaagtatatcaataaaatcttagttgattggtataaatctggagatacgacagtagaaaaggtcagagacaggttgcaacggtttgacgatagtaaaaaacaacgaagtgtaactacctcaaacgtcccaagctggtcgaatccagactacaaagaaccagatttagaagaatttgctctaggaagcatggacggtatagaagatggatcaggagatttt

SEQ ID NO: 1514 - protein, 128 aa, Streptococcus pyogenes
MDEKKLFENFQLTFGRMISPFEIEDIQKWIHEDNMPIEVVNLALREAVENNKISWKYINKILVDWYKSGDTTVEKVRDRLQRFDDSKKQRSVTTSNVPSWSNPDYKEPDLEEFALGSMDGIEDGSGDF

SEQ ID NO: 1515 - DNA, 246 bp, Streptococcus agalactiae
gtggatcgagaaaaggagtatgatatggaaaatccaatgacaggagtagcaatactagcatttatcgctttacttgcatatctcggcaatcgtaatagcaatcaaaagacaattactaagactgttgagacggtgttagataactaccaagttgtgcgaaaggttgagagaccaaaacgcacggattttatagagttacctaccccaggatcatgcgggaaagtttggggcaaggatagacctttt

SEQ ID NO: 1516 - protein, 82 aa, Streptococcus agalactiae
MDREKEYDMENPMTGVAILAFIALLAYLGNRNSNQKTITKTVETVLDNYQVVRKVERPKRTDFIELPTPGSCGKVWGKDRPF

SEQ ID NO: 1517 - DNA, 126 bp, Streptococcus agalactiae
ttgacaaggttggcggtcgttcaacaaaagttaaaaaatttgaagaatggagaaaattacaaaatgaaaaaattatttaactttattttcgcaaaacaaaaaagaagaaagaccaaaatggacaat

SEQ ID NO: 1518 - protein, 42 aa, Streptococcus agalactiae
MTRLAVVQQKLKNLKNGENYKMKKLFNFIFAKQKRRKTKMDN

SEQ ID NO: 1519 - DNA, 228 bp, Streptococcus agalactiae
atgctagcaaaacttaaaagcggtatcgaagtaccttacgaagagctttggcttaatgataacgacttatccgaatttattggaaagtcatttgaccaaacgcagcgattactaagaaagatgtacaaagacagaaattatcgcaaatacattgacaaggttggcggtcgttcaacaaaagttaaaaaatttgaagaatggagaaaattacaaaatgaaaaaattatt

SEQ ID NO: 1520 - protein, 76 aa, Streptococcus agalactiae
MLAKLKSGIEVPYEELWLNDNDLSEFIGKSFDQTQRLLRKMYKDRNYRKYIDKVGGRSTKVKKFEEWRKLQNEKII

SEQ ID NO: 1521 - DNA, 801 bp, Streptococcus agalactiae
atgatagacaaaatatttgttaataaaactaacaaaccgctagaaaggaactatatgaatcaactaataaacatcaccctaaacgaaaatcaagaaccagttgtcagtggtagagatttacacaatgtacttaatataaaaactcaatatactaaatggcttgaaaggatgtcggaatatggttttgaagaaaacgttgactatatagctattagtcaaaaaagactaacagctcaaggtaaccgtacagaatatatagaccacgttctcaagctagacatggcaaaagagattgctatgttacagcgaaacgagaaatcaaaacaggtacgcaaatacttcatccaggttgaaaaagacttcaatagtcctgagaaaatcatggcgagagccttgctcatggcagataagaaaatcactaacttaacgatggaaaataatcaattgcagttagatttaaaagaagctcaaaagcaagcgcgttatcttgatctaatcattgagagcaagggagctttgcgagtaacacagattgctgctgattatggtatgtctgtcaataaattcaataaaacactattagaatttggtgtgcagcacaaagtgaatggacaatggattctctataaacgacatatgggcaaaggttacacagacagtcacacatttgactatcaagacaaaaacggccatacaagagccaatgtgacgacgacgtggacacaaaaggggcgtctattcctgtacgagttgttgaaagacaacaatattttgccactaattgaacaggaagacattgta

SEQ ID NO: 1522 - protein, 267 aa, Streptococcus agalactiae
MIDKIFVNKTNKPLERNYMNQLINITLNENQEPVVSGRDLHNVLNIKTQYTKWLERMSEYGFEENVDYIAISQKRLTAQGNRTEYIDHVLKLDMAKEIAMLQRNEKSKQVRKYFIQVEKDFNSPEKIMARALLMADKKITNLTMENNQLQLDLKEAQKQARYLDLIIESKGALRVTQIAADYGMSVNKFNKTLLEFGVQHKVNGQWILYKRHMGKGYTDSHTFDYQDKNGHTRANVTTTWTQKGRLFLYELLKDNNILPLIEQEDIV

SEQ ID NO: 1523 - DNA, 726 bp, Streptococcus pyogenes
atgaatcaactaattaacgtaacactaaacgaaaatcaagaaccagttgtcagtggtcgtgatttgcacaaagtacttgaaattaaaacacaatatacaaaatggcttgagcgaatgagcgaatatggtttcgttgaaaacgaagacttcatggctattagtcaaaaaagactaacagctcagggcaatcaaacagaatatacagaccacgttctaaaactagacatggcaaaagaaatagctatgcttcaacgcaatgaaaaatctaaagaagtccgtaaatacttcatccaggttgaaaaagatttcaacagtcctgagaaaatcatggcaagggcgttgctgatggcggacaagaaagtgcataaattagaggctcagattgaggcagaccgtccaaaggtgctatttgctgatgccgtaagtgctagccatacctctatattggtcggagaacttgcaaagttactcaagcagaatggggtaaatattggagcgactcgtctcttcacttggcttcgtaaacacggctatcttatcaagcgtaatggccgagattggaatatgcctactcagaaaagcgtagagcttggacttataagggtcaaggaaactagcatcacccattctgatggccatattacagtaagcaagacacctctggtaaccggaaaaggtcagcaatactttatcaacaaatttcttaatcaggaatatctaccagtt

SEQ ID NO: 1524 - protein, 242 aa, Streptococcus pyogenes
MNQLINVTLNENQEPVVSGRDLHKVLEIKTQYTKWLERMSEYGFVENEDFMAISQKRLTAQGNQTEYTDHVLKLDMAKEIAMLQRNEKSKEVRKYFIQVEKDFNSPEKIMARALLMADKKVHKLEAQIEADRPKVLFADAVSASHTSILVGELAKLLKQNGVNIGATRLFTWLRKHGYLIKRNGRDWNMPTQKSVELGLIRVKETSITHSDGHITVSKTPLVTGKGQQYFINKFLNQEYLPV

SEQ ID NO: 1525 - DNA, 189 bp, Streptococcus agalactiae
atgcaacaatttaatctaaaacaactacgagagaaaaaaggatttactcaaaatgaattagctgataaagctaacgttagtcgttcgctcgtggttggtttagaaacaggttcatattcagagacatctacagcatctctgaagaaattggcgaaagctttggacgtaaagattaaggatttatttttt

SEQ ID NO: 1526 - protein, 63 aa, Streptococcus agalactiae
MQQFNLKQLREKKGFTQNELADKANVSRSLVVGLETGSYSETSTASLKKLAKALDVKIKDLFF

SEQ ID NO: 1527 - DNA, 204 bp, Streptococcus pyogenes
atgaagaacctcaaattaaaagcagcgcgtgcaggcaaagatttgtctcaacaagctctagcagatttggtaggcgtctccagacaaaccattgcggctgttgaaaaaggtgattacaacccaacgattaatctttgcattgccatttgtcgagtgcttgataagactttagatgaccttttttgggaagctgatgattctcgt

SEQ ID NO: 1528 - protein, 68 aa, Streptococcus pyogenes
MKNLKLKAARAGKDLSQQALADLVGVSRQTIAAVEKGDYNPTINLCIAICRVLDKTLDDLFWEADDSR

SEQ ID NO: 1529 - DNA, 804 bp, Streptococcus agalactiae
atgattgaaagtcttgatataaagacgattttgcttggttctgctactctcttaggaactactgccataaagaaagctgaaaatcctgcaagagctattgatgatttaatgacattaattggttttgaaaaattacatgaaatagctgaaaatcgaagaaataagtacattactaacagaaacgattttattcaaaaattagctaaagaaatacaagatgttgttagtaaaaatattgaaaatctacaagaacctagtctttcgatagctggaccggctttagaagcatctaaattttatttagaagaagaagaacttagaaatttatttacaaaattgattgcttcatctatggataaatcaaaaaatgaattcaaccatccatcttttattgagataataaaacagtttgataaaattgatgcacaaaatttcaaaattatctcagatttatactttaaaaaaggtttcgttgcaactggtacctactatacgacaataattggtcaagataagccgttagagcatattgctagtcatgtattcgtagataatttagaacaaaatgatatagctattcaaagttcatcattaactaatttagaaagactaggactaattcaaattaattacaaagcacacgtagatgagaaagaatattacaacattcttaataatagctttataactaaaaagaacagtgaattaaaagaacaaaacaaaagagtactaacaaatctaggaatgataactcttactttatttggtgttagattttcaaaaacttgtttacctgacgtttcg

SEQ ID NO: 1530 - protein, 268 aa, Streptococcus agalactiae
MIESLDIKTILLGSATLLGTTAIKKAENPARAIDDLMTLIGFEKLHEIAENRRNKYITNRNDFIQKLAKEIQDVVSKNIENLQEPSLSIAGPALEASKFYLEEEELRNLFTKLIASSMDKSKNEFNHPSFIEIIKQFDKIDAQNFKIISDLYFKKGFVATGTYYTTIIGQDKPLEHIASHVFVDNLEQNDIAIQSSSLTNLERLGLIQINYKAHVDEKEYYNILNNSFITKKNSELKEQNKRVLTNLGMITLTLFGVRFSKTCLPDVS

SEQ ID NO: 1531 - DNA, 837 bp, Streptococcus pyogenes
atgattgattttagtaatatcgaaacatattggccaatgacttctagtgcttttggtttgtttattacccaaggtggtctgaaacctatctttacatcgctaaaccacatgtggtattcaaaatatggatacctaactgagcgaaaagcaaaattaaaagagattgaaaatgaatacatctatgagattgaaaaaagaaaattagaaaatcaagaaaaattcaaaaatgagattgattgcgaattttctaaaataccgcaaactagtttaaaagaacccgttgagtatatcttatatcctgcgataaatgagtcagagcaatatttaagtaacgaaacacttagaaatatgttcgctagaacgatagcttcaacatttaatcaggacaaagaaaaggatcttcactcagcttttgttcaaatcatcaaacaaatgacaccacttgatgcacaaaatctattattgataaatcaagagggaaataatctcattgcaaatctacaaataggagtacactacagtaaagaaaacctttcaggaaccgttaacaaggcaaataatatatacttatcaaagttagattactcaccagatattattgcttcttctattgataatttaaccagattagggctaatcaaagttgattatcttcattatccattggattcaaattatgaatcaattaaacaaacaacaatttacaaatctcttgaaagtgaaattaacactcttaatttattcaaaacatcaaacacaaaatatgatattaagattgaaaaaggaaaggtctccttaacagatttcggaaaaaaatttatttcagtttgtctagaa

SEQ ID NO: 1532 - protein, 279 aa, Streptococcus pyogenes
MIDFSNIETYWPMTSSAFGLFITQGGLKPIFTSLNHMWYSKYGYLTERKAKLKEIENEYIYEIEKRKLENQEKFKNEIDCEFSKIPQTSLKEPVEYILYPAINESEQYLSNETLRNMFARTIASTFNQDKEKDLHSAFVQIIKQMTPLDAQNLLLINQEGNNLIANLQIGVHYSKENLSGTVNKANNIYLSKLDYSPDIIASSIDNLTRLGLIKVDYLHYPLDSNYESIKQTTIYKSLESEINTLNLFKTSNTKYDIKIEKGKVSLTDFGKKFISVCLE

SEQ ID NO: 1533 - DNA, 186 bp, Streptococcus agalactiae
atggagtttatttatttactaattataccatcaatagtttcatttgttgtatctatcttttggtcaaaactagtcttcaaaaaagtagtagaaattatgacaaaaatggatgttgatcaacaagagctgaatgaaacaatgagagctcaaattttagaagaaatcaaaacattacgaaacgtcagg

SEQ ID NO: 1534 - protein, 62 aa, Streptococcus agalactiae
MEFIYLLIIPSIVSFVVSIFWSKLVFKKVVEIMTKMDVDQQELNETMRAQILEEIKTLRNVR

SEQ ID NO: 1535 - DNA, 156 bp, Streptococcus agalactiae
atgaattggaaaaaactaatgctaggcgatttagaacacacgtttactagtcgtgatggcaaggaaaaaacaagcgttgaatttgaaggcggcgtattgccagcactgttagtgctaggtggtatcacttggctgatcgcttggcttattacaaaa

SEQ ID NO: 1536 - protein, 52 aa, Streptococcus agalactiae
MNWKKLMLGDLEHTFTSRDGKEKTSVEFEGGVLPALLVLGGITWLIAWLITK

SEQ ID NO: 1537 - DNA, 156 bp, Streptococcus pyogenes
atgaattggaaaaaactaatgtttggcgatttagaacacacgtttactaatcatgatggcaaagaaaaaacaagcatcgaatttgaaggtggagttttaccagctctgttagtgttgggcggtattgcttggatgatcgcttggtttattacaaaa

SEQ ID NO: 1538 - protein, 52 aa, Streptococcus pyogenes
MNWKKLMFGDLEHTFTNHDGKEKTSIEFEGGVLPALLVLGGIAWMIAWFITK

SEQ ID NO: 1539 - DNA, 222 bp, Streptococcus agalactiae
atggctaaaaatcaacatgtcgtacctaaccctaatggcggttgggatataaaaggtgcaggcaacagtcgtgcgaccaaacacacaacaacccaagccgaagctgtcgaaatcgctactggtatcgctaaaaacaatagcagtgaagttattatccatggcaaaaatggacgaattcgcgaacgtaacagctatggtaacgatccattcccacctaaaggt

SEQ ID NO: 1540 - protein, 74 aa, Streptococcus agalactiae
MAKNQHVVPNPNGGWDIKGAGNSRATKHTTTQAEAVEIATGIAKNNSSEVIIHGKNGRIRERNSYGNDPFPPKG

SEQ ID NO: 1541 - DNA, 141 bp, Streptococcus agalactiae
gtggaagaatctatattgaactctaagcgctacacaaaacttgtcgtagagacagaagatggcaaaaaaatagcagaagttactttgacggaagcaacccctgctgatggatacgtgattaggttaacccctaattatgac

SEQ ID NO: 1542 - protein, 47 aa, Streptococcus agalactiae
MEESILNSKRYTKLVVETEDGKKIAEVTLTEATPADGYVIRLTPNYD

SEQ ID NO: 1543 - DNA, 888 bp, Streptococcus agalactiae
ttgtcaagtatgttggacaaaaaacttgaaaaaaatttttttgtactgtataatatgtttaaaatgttagacattatattaaaggaattcgatatgcatctaggaaaatatataaaaaagtatcgagataccaataatctgagcatggctgaattcgctaaagaatcaggcatcagcaaagcttacgtttctattcttgaaaaaaacagagatcctcgtaacggaaaagaaatcatcccatctattccgattataaagaaagtttctgacacaattggcatctcttttgatgatttattaaattcgctagacgaaaatcagatagtcgcgttaaatgaaacgaaaactgaaaaaaatctaacttcctctaccctacaaaaaatcacttctacttcttctcaattagaacaacctagacaagaaaaagtccttagcttcgctaacgaacaattagaagaacaaaataaagttgtttctatgttcgatagaaaagttgaggagacagaaaattatatcactgactacgttgaggggttagttgctgctggtctgggggcataccaagaagacaatttacatatggaagttaaactacgggctgatgatgtccccgataagtatgatactattgcgaaagtagctggtaattcaatggaaccacttattcaagataacgatttactgttcgtcaaggtatctagtcaagtcgatatgaatgatatagggatattccaagtcaatggaaaaaactttgtaaaaaaactcaaacgtgattatgacggcgcttggtacttgcaaagtttaaataaaagctatgaggaaatctatctttcagagaacgacaacatccgcacgataggagaagtcgtagatatttacagggagaat

SEQ ID NO: 1544 - protein, 296 aa, Streptococcus agalactiae
MSSMLDKKLEKNFFVLYNMFKMLDIILKEFDMHLGKYIKKYRDTNNLSMAEFAKESGISKAYVSILEKNRDPRNGKEIIPSIPIIKKVSDTIGISFDDLLNSLDENQIVALNETKTEKNLTSSTLQKITSTSSQLEQPRQEKVLSFANEQLEEQNKVVSMFDRKVEETENYITDYVEGLVAAGLGAYQEDNLHMEVKLRADDVPDKYDTIAKVAGNSMEPLIQDNDLLFVKVSSQVDMNDIGIFQVNGKNFVKKLKRDYDGAWYLQSLNKSYEEIYLSENDNIRTIGEVVDIYREN

SEQ ID NO: 1545 - DNA, 813 bp, Streptococcus pyogenes
ttgatttataatcatggttttgatataatttacttatcaaaattaaaaaggaggtatcctatggagcaattaggggaccgaataagaaagttgagagaagggcgcaacatgactcagactgaactttcagaaatattgggcatgaaaacctatactactgtttcaaagtgggagaagaatgaaaattttccaaaaggtaaagacctaaaaaaactagcagagattttcaacgttacctctgactatcttttaggactcacagatagtaaacttgggaaaatcacaatacagaacgaacaacctgaaatcgtttctatatacaaccaactagaacaacctagacaagaaaaagtcctcaacttcgctaacgaacaattagaagaacaaaataaaaccgtttctatattcgataaaaaatctgaggagacagaagattatatcactgactacgttgagggattggttgccgctggtcttggggcataccaagaagacaatttacacatgaaagttaaactacgttctgatgatgtccccgatgagtatgatactattgcaaaagtagctggcgattcaatggaaccacttattcaagacaacgatttgctattcatcaaggtatctagccaagtcgatatgaatgatatagggatattccaagtcaatggtaaaaactttgtaaaaaaactcaagcgtgattatgatggcgcttggtacttgcaaagtttaaataaaagctatgaggaaatctatctatcaaaggatgacgacatccgcacaatcggtgaagttgtggatatttatagggaatat

SEQ ID NO: 1546 - protein, 271 aa, Streptococcus pyogenes
LIYNHGFDIIYLSKLKRRYPMEQLGDRIRKLREGRNMTQTELSEILGMKTYTTVSKWEKNENFPKGKDLKKLAEIFNVTSDYLLGLTDSKLGKITIQNEQPEIVSIYNQLEQPRQEKVLNFANEQLEEQNKTVSIFDKKSEETEDYITDYVEGLVAAGLGAYQEDNLHMKVKLRSDDVPDEYDTIAKVAGDSMEPLIQDNDLLFIKVSSQVDMNDIGIFQVNGKNFVKKLKRDYDGAWYLQSLNKSYEEIYLSKDDDIRTIGEVVDIYREY

SEQ ID NO: 1547 - DNA, 555 bp, Streptococcus agalactiae
atgctggaaaaagttgaacgcttaatctcggaaattaatagaatacaccttgtttattcgcaagattattttgaaactgggaaagttgaaaagattaatctaaaacataccttttcaaaagtacctgttcaagcgattttagattaccgcttgaatttacacgaatctatcaatgattacttgatgaaagctgatgttaaggatattccttatgtctatcgcgtaaaaacatcggaaagtatcttagacaaaattgaacgtttttccaaaagacaagatggttatcctgtgaattctattctcaatgacatttttggcgctcgtatcattttatcttctgaggatatttcacaagtgatggaacaacttgatgaatggaaagataagtttgacttaaaaaactggtatttacgagataaagataattacacaggaatacacgtttatttcaagaataagagcaatcactactatccttgggagttgcaaatttgggatgagaaagatgttgatcagaacattgaaagccataaattatttaaacgtcattttgta

SEQ ID NO: 1548 - protein, 185 aa, Streptococcus agalactiae
MLEKVERLISEINRIHLVYSQDYFETGKVEKINLKHTFSKVPVQAILDYRLNLHESINDYLMKADVKDIPYVYRVKTSESILDKIERFSKRQDGYPVNSILNDIFGARIILSSEDISQVMEQLDEWKDKFDLKNWYLRDKDNYTGIHVYFKNKSNHYYPWELQIWDEKDVDQNIESHKLFKRHFV

SEQ ID NO: 1549 - DNA, 213 bp, Streptococcus agalactiae
ttgaaaatttatggagattatcacacgcacttatttagacactcgcatatatcatttttagcagaaaaagggataccgctaaatgcgataatggatagagttggtcacagcgatccaaaaacaacattatctatttacagtcacacaactgtaaatatgaaagaaattataaataaacaaactgccccttttgtgccccttttaaaatcggaa

SEQ ID NO: 1550 - protein, 71 aa, Streptococcus agalactiae
MKIYGDYHTHLFRHSHISFLAEKGIPLNAIMDRVGHSDPKTTLSIYSHTTVNMKEIINKQTAPFVPLLKSE

SEQ ID NO: 1551 - DNA, 282 bp, Streptococcus pyogenes
ttgaaaatttacggagattatcacacgcacttatttagacactcgcatatatcatttttagcagaaaaagggataccgctaaatgcgataatggatagagttggtcacagcgatccaaaaacaacattatctatttacagtcacacaactgtaaacatgaaagaaattataaataaacaaactgacccttttaaaaccggaataaaacaaaaagcctttgatgtaaaggctttttcagtgacaataatgacccctgccggaatcgaaccagcaactactcct

SEQ ID NO: 1552 - protein, 94 aa, Streptococcus pyogenes
LKIYGDYHTHLFRHSHISFLAEKGIPLNAIMDRVGHSDPKTTLSIYSHTTVNMKEIINKQTDPFKTGIKQKAFDVKAFSVTIMTPAGIEPATTP

SEQ ID NO: 1553 - DNA, 417 bp, Streptococcus agalactiae
gtgatggacgcacaaaaaacggctaatccgctgagacaagtacttaagattagtaagagaaggagaataaaaatgaatccattaattcaaagtttgacagaaggtcaacttcgttctgatatccctgagttccgtgctggtgatactgtacgtgttcacgctaaagttgtcgaaggtactcgcgaacgtattcagatctttgaaggtgttgttatctcacgtaaaggtcaaggaatctcagaaatgtacacagtacgtaaaatttctggtggtatcggtgtagagcgtacattcccaattcacactcctcgtgttgataaaatcgaagttgttcgttatggtaaagtacgtcgtgctaaactttactacttacgcgcattgcaaggtaaagctgcacgtattaaagaaatccgtcgt

SEQ ID NO: 1554 - protein, 139 aa, Streptococcus agalactiae
MMDAQKTANPLRQVLKISKRRRIKMNPLIQSLTEGQLRSDIPEFRAGDTVRVHAKVVEGTRERIQIFEGVVISRKGQGISEMYTVRKISGGIGVERTFPIHTPRVDKIEVVRYGKVRRAKLYYLRALQGKAARIKEIRR

SEQ ID NO: 1555 - DNA, 345 bp, Streptococcus pyogenes
atgaatccattaatccaaagtttgacagaaggtcaacttcgctctgatatccctaacttccgtcctggtgacactgttcgcgttcacgcaaaagttgtcgaaggaactcgcgaacgtatccagatctttgaaggtgttgttatttcacgtaaaggtcaagggatctcagaaatgtacactgttcgtaaaatctcaggtggtatcggggtagagcgtacattcccaatccacacaccacgtgttgacaaaatcgaagttatccgccacggtaaagtccgtcgtgcgaaactttactacttgcgtgcattacaaggtaaagcagctcgtatcaaagaaattcgtcgt

SEQ ID NO: 1556 - protein, 115 aa, Streptococcus pyogenes
MNPLIQSLTEGQLRSDIPNFRPGDTVRVHAKVVEGTRERIQIFEGVVISRKGQGISEMYTVRKISGGIGVERTFPIHTPRVDKIEVIRHGKVRRAKLYYLRALQGKAARIKEIRR

SEQ ID NO: 1557 - DNA, 387 bp, Streptococcus agalactiae
atgaaggctcargcgattgtcacaagccaagggagaattgtttctttggatattgcagtgaactattgccacgatatgaagttgttcaaaatgagtcgcagaaacatcggacaagctgctaaaatcttggcagacagtggttatcaagggatcatgaagatgtattcacaagcgcaaactccgaggaaatcaagcaaacttaagccactaactcttgaagataaaacctataaccatacgctatccaaagagagaatcaaggttgagaatatttttgccaaagtaaaaacgtttaaaatattttcaacaacctatcgaaatcgacgcaaacggtttggattacgaatgaatttgattgctggaatgatcaaccgtgaactaggattt

SEQ ID NO: 1558 - protein, 129 aa, Streptococcus agalactiae; identical to SEQ ID NO: 690

SEQ ID NO: 1559 - DNA, 453 bp, Streptococcus agalactiae
ttgctaaacccatataaacggattttcacacttggattgttagctacttttttattgtttatcttccattttggacgatattcaggactgggaacaaatctaattgaggctagcttcactaataagaacctttatgattatgattggttgttaaaattgtgtttgacagttattactttggctgcaggttatcagggaggagaagtaactcccttatttgcaatcggagcaagtttaggagtgattattgcgcccattttaggtttgccagttattttagttgctgctttaggctatactagcgtttttgggagtgcaacgaatactctgttaggtcctatcttaataggaggcgaagtctttggctttgccaacactccttattttgttattgtatgtcttgttgcttactccatatcacatgctcatacgatttatggtgctcaatctaga

SEQ ID NO: 1560 - protein, 151 aa, Streptococcus agalactiae
MLNPYKRIFTLGLLATFLLFIFHFGRYSGLGTNLIEASFTNKNLYDYDWLLKLCLTVITLAAGYQGGEVTPLFAIGASLGVIIAPILGLPVILVAALGYTSVFGSATNTLLGPILIGGEVFGFANTPYFVIVCLVAYSISHAHTIYGAQSR

SEQ ID NO: 1561 - DNA, 1272 bp, Streptococcus pyogenes
gtggtgacattaatgattaaatcaattgcaacactgcctaaaccttccttgaaagaagtgttaggactagtaggattagcacttcccatagggggcgcggttggagtggttgatgttatttttggcaaagggcttttgtttctttccgaatatcgcgatcaccaccttttcttgcttcttccatttcttgccctagcaggccttgttatcgtttttctttacgataagttaggcaaagaggttcgtcaagggatgggattggtttttcaggtagggcatggtcaaaaaaatcagattcctcctatgctcattcctcttattttgttctcaacttgggtaacccacttatttggagcgagtgcgggtagagaaggggtagccgttcaaataggagctactatctctcattattgtcggagatttgtgactagtcaagaagccgcacgacatcttttgattatggggatggcagccggttttgcagggctttttcaaacgccaattgctgctgtcgtatttgccctcgaggttttattagtaggaacgcttcgttattccgctttattgccttccttagttgctgcttacgtggcttcttggacttcccatgccttgggattagagaaatttacgattgttcttgaagaaacattgaccataactcccttaacattggttaaattaattgggttaggccttatttttggtctggtgggaaatagttttgcctatttacttggctggtttaaaccttacctcagtcaaaagctaccaaatccttatttccggattgcttttatcggtgctttgttatctatctgtctgatgattggtcacgtcggaagatatagtggtctaggaaccaatttgattgcggcagctttttctggccaaactatcctaacttacgactggcttttaaaaatgatcgtgacggtgattagcttatctgcaggctttcaaggtggtgaagtgacgcctctatttgctattggagcttctttaggcatcgttttggccccttacttaggtcttcctgtactgttggttgctgcacttggttacaccacggtatttggaagtgcaacaaataccttttgggcccctatctttattgggatagaggtctttggtccagagaatgccctagcatattttgtcacctcggctgcagcctatatggttagtcacagacattccatttacagttatcaaaaagtagtcatgatcaatttaaaagacatgacggtaaatcagatggatttaaaaaaa

SEQ ID NO: 1562 - protein, 424 aa, Streptococcus pyogenes
VVTLMIKSIATLPKPSLKEVLGLVGLALPIGGAVGVVDVIFGKGLLFLSEYRDHHLFLLLPFLALAGLVIVFLYDKLGKEVRQGMGLVFQVGHGQKNQIPPMLIPLILFSTWVTHLFGASAGREGVAVQIGATISHYCRRFVTSQEAARHLLIMGMAAGFAGLFQTPIAAVVFALEVLLVGTLRYSALLPSLVAAYVASWTSHALGLEKFTIVLEETLTITPLTLVKLIGLGLIFGLVGNSFAYLLGWFKPYLSQKLPNPYFRIAFIGALLSICLMIGHVGRYSGLGTNLIAAAFSGQTILTYDWLLKMIVTVISLSAGFQGGEVTPLFAIGASLGIVLAPYLGLPVLLVAALGYTTVFGSATNTFWAPIFIGIEVFGPENALAYFVTSAAAYMVSHRHSIYSYQKVVMINLKDMTVNQMDLKK

SEQ ID NO: 1563 - DNA, 714 bp, Streptococcus agalactiae
gtgattaaacgatttgataattatgctcagtacgtacttgttttaggttttagcttactaattggtggtgtggttggggctattacagcagtctttggacgtgttctattattcctgacagcctttagaagtgattatatagcttacctactcccttttcttagcattgttggtttatttatagtttttgtctatcaaaaatttgggggtaagagtgttaaagggatgggattggtatttgaagtaggtcatggtaatgaggagactattccgaaacgtcttgttcctctcgtgatattaacaacttggttaacccacttatttggtggtagtgcaggtcgtgagggggttgctgtacagattggggctaccgtttcacactactttcaaaaatattgccgtttacaaaacgcttctcaacttttcctagtaatgggaatggcagcaggttttgctggtttatttcagactcctttagctgctactttttttgcgattgaagttttggtagtaggtcgtttaatggtttcgtatgtattaccaagtttaattgctgccctgacagcaaatttcgtctcacattctttaggtttagaaaaattttctcatagtatagcaacatcaatggcgttaacaccagatattattctaaaattattggttttaggactatgttttggtctgtgtggtaatttattgctttattttattggc

SEQ ID NO: 1564 - protein, 238 aa, Streptococcus agalactiae
MIKRFDNYAQYVLVLGFSLLIGGVVGAITAVFGRVLLFLTAFRSDYIAYLLPFLSIVGLFIVFVYQKFGGKSVKGMGLVFEVGHGNEETIPKRLVPLVILTTWLTHLFGGSAGREGVAVQIGATVSHYFQKYCRLQNASQLFLVMGMAAGFAGLFQTPLAATFFAIEVLVVGRLMVSYVLPSLIAALTANFVSHSLGLEKFSHSIATSMALTPDIILKLLVLGLCFGLCGNLLLYFIG

SEQ ID NO: 1565 - DNA, 273 bp, Streptococcus agalactiae
atggaattagaagagattcgtcaagaaatagatgaaatagatcagcaattagtaagccttttagaaactagaatgggtctaattttagaggtcatagcatttaaaaagaaacatcgacttccagttttagataataatcgtgaaaacgaagtgcttaacaatgtattgaagaaagtccaaaaccatcaatttgacgatgtgatacgagcaactttcaaagacattatgacagaatctcgtgtttatcaaaaggagaatattgtagacggtgat

SEQ ID NO: 1566 - protein, 91 aa, Streptococcus agalactiae
MELEEIRQEIDEIDQQLVSLLETRMGLILEVIAFKKKHRLPVLDNNRENEVLNNVLKKVQNHQFDDVIRATFKDIMTESRVYQKENIVDGD

SEQ ID NO: 1567 - DNA, 282 bp, Streptococcus pyogenes
atgcgtttagaaaagatacgacaagaaatcaatggtattgatcaccacttggttgccttattagaaaagcggatggcacttgtagagcaagtaacagcttataaactagccaatcacttgcctgtcttagatcaggcgagggaaaatcagatcctagatagggtttcttatctcgttaaagaccaagcatttgagccagctatccatgagacatttaaaaccattatgtctctttcacggcagtatcaaacgcaacacttaacaggtggtgacattaatgat

SEQ ID NO: 1568 - protein, 94 aa, Streptococcus pyogenes
MRLEKIRQEINGIDHHLVALLEKRMALVEQVTAYKLANHLPVLDQARENQILDRVSYLVKDQAFEPAIHETFKTIMSLSRQYQTQHLTGGDIND

SEQ ID NO: 1569 - DNA, 2487 bp, Streptococcus agalactiae
ttgatgtatgcaaccaatattttaagacttggagtttctatgacattaacctttgggaaaccttctataacgatacgccgtctaggagtgataactagtacatatatgatgctaggttttatcttattatgtggatttttgcatcctagtacaatttatagtgaggaaataaaatctgatataaactcttttatatcaatagatgatgaaaaaactactgttcccatatttgactctactttagataagcttactaattcaatagaggagaggcagttagaattagattctgatacatcggacagtttaatagtagatgatcaaaaagataaagatatggtaatagtcttaggtgattctgacagtcaagaaaaattgtcacctcctctaaaatcggaaatagcgacagaagaaaatcgtaaacaggcaaatttagcagaactaaatgcaactcaacctaataatagaactacctatattatacccgaaagcagtcattccattgcagaacaacagagattcctgatagaatcaaagggttattcggttgcattacttaatagcgatgaatttagaaagacagcgagagaggatagaggttttgaaagggataagttgaggtctttggatatcattcctaagggagatttatcgacaagtaatgtcataggtaatacggacattgctagtcagatatcgttgggctttaaaaagaatgcgatacaggaacaccatcttactaaaacattctctcaaaaggatggaaagttatcgtctgttatagaggggatgcttgctattggcaaagagaaagtagagaaggaaataaaatatagtggtaatttatggcaaaaattaaaagctaaggcacactgccttgtttgctgtgttgataatttgaattttgaagatataaaatcttattttcaatattattgtcatctaaaccatcagctcaaattacctaaaggtgctatactttctgctaaaacagaagtatataggggaggagattttgggagaaaaaataaagataatgtgtttggttaccgtatcccctcattattaaaaacggaaaaaggaactttacttgtgggagctgatgaaagaattgagcaagcttgtgattggggaaacataggaatggttattcgccgtagtgaggatgatggtgtcacttggggaaaaagagaaactattgtcaatctccgtaataaccctagagttccgctagttactagtggtgactatagtggctcacctattaatatggatatggcattagttcaagatactagctctaagacgaaacgtattttttcaatatatgatatgtttccagaaggaagaggcgttattagtattgctaacacacctgaaaaagaatatacccaaatcggaggacagtcttatcttaatttatataataatggaaagaaatcgaaggtttttactatccgtgacaaaggtattgtatataattttaaagggaaaaagactgattatcatgttataacagaaactactaaaagtgaccattcaaatctaggggatatttataagggaaaacagctacttggaaatatatattttacaaaacataaaacgtcaccatttcgtttagcaaaatcaagctatgtgtggatgtcatatagcgatgatgatggtaggacatggtcatcacctagagatataacagcaagtcttcgtcagaaaggcatgaaatttttaggaataggacctggaaaaggtatagttttaaaatgggggccacacgctggtcgtattattattcctgcctattctacgaattggaaatctcatctaagaggttcacaatcttcacgcctaatttattcagacgaccatggaaaaacgtggcatactggaaaagcagtcaatgataaccgtatactttctaatggtgaaaaaattcactccttaacaatggataataaaaaagaacaaaatacagaatccgtacccgttcaattgaaaaatggggacattaagttatttatgaggaatctaactggtaacctagaagtagccacaagtaaagacggcggggagacttggcaaaaccatgttaaacgatataaggaagttcatgatgcttacgtccaattatcagctattcgctttgagcatgacaaaaaagagtatattttattagtgaatgctaatgggccaggtaagaagcgtcaagatggatatgcacgtctagcgcaagttaatcgaaatggtagttttaagtggttatatcaccatcacattcaagatggttcgtttgcttacaactctgttcaacaacttaataatgataaatttggtgtcctttatgaacatagagaaaaacatcaaaatagttttactttaaattacaaagtttttaattggagttttcttagtcaaaatacagagaagcaaggcactttatgggagaaaatggcagcaaattggcatgttttgtttaaattttattta

SEQ ID NO: 1570 - protein, 829 aa, Streptococcus agalactiae
MMYATNILRLGVSMTLTFGKPSITIRRLGVITSTYMMLGFILLCGFLHPSTIYSEEIKSDINSFISIDDEKTTVPIFDSTLDKLTNSIEERQLELDSDTSDSLIVDDQKDKDMVIVLGDSDSQEKLSPPLKSEIATEENRKQANLAELNATQPNNRTTYIIPESSHSIAEQQRFLIESKGYSVALLNSDEFRKTAREDRGFERDKLRSLDIIPKGDLSTSNVIGNTDIASQISLGFKKNAIQEHHLTKTFSQKDGKLSSVIEGMLAIGKEKVEKEIKYSGNLWQKLKAKAHCLVCCVDNLNFEDIKSYFQYYCHLNHQLKLPKGAILSAKTEVYRGGDFGRKNKDNVFGYRIPSLLKTEKGTLLVGADERIEQACDWGNIGMVIRRSEDDGVTWGKRETIVNLRNNPRVPLVTSGDYSGSPINMDMALVQDTSSKTKRIFSIYDMFPEGRGVISIANTPEKEYTQIGGQSYLNLYNNGKKSKVFTIRDKGIVYNFKGKKTDYHVITETTKSDHSNLGDIYKGKQLLGNIYFTKHKTSPFRLAKSSYVWMSYSDDDGRTWSSPRDITASLRQKGMKFLGIGPGKGIVLKWGPHAGRIIIPAYSTNWKSHLRGSQSSRLIYSDDHGKTWHTGKAVNDNRILSNGEKIHSLTMDNKKEQNTESVPVQLKNGDIKLFMRNLTGNLEVATSKDGGETWQNHVKRYKEVHDAYVQLSAIRFEHDKKEYILLVNANGPGKKRQDGYARLAQVNRNGSFKWLYHHHIQDGSFAYNSVQQLNNDKFGVLYEHREKHQNSFTLNYKVFNWSFLSQNTEKQGTLWEKMAANWHVLFKFYL

SEQ ID NO: 1571 - DNA, 1446 bp, Streptococcus agalactiae
atgcaggtatttttaaatattgtcaataaattctttgatccaattatccatatgggttcgggagttgtgatgctaattgtcatgacaggtttagccatgatatttggagtgaagttttctaaagcacttgaaggtggtattaagttagctattgctcttacgggtattggtgctattattggtattttaactggtgctttttctgaatcacttcaagcttttgttaaaaatacaggaatcaatctaagcattattgacgttggttgggctccattagcaactattacatggggatcaccatatacgctttacttcttattaatcatgcttattgtcaatattgttatgattgttatgaaaaaaacggataccttagatgttgatatttttgatatttggcatttatctatcacaggtcttttaattatgtggtatgctaaaaaaaataatctaccaacacttttatctgtcattattgcaactgtagctattatcttcgttggtgttctaaaaattatcaattctgatttgatgaaacctacctttgatgatttattggggacaggtccaacttctcccatgacttcaacgcatatgaattatatgatgaaccccattattatggttttggataagctttttgataaagtttttccagggctagataaatatgactttgacgcggctaaattaaataaagccattggattctggggctctaagttctttattggtatgattttaggacttgtcatagggattatgggcaaccccgtgttctcatttgcagcattaggtggctggttttctctcggttttacagcaggtgcttgtttagagttgttctctttgattggttcttggttcattgctgcagtagaaccactttctcaaggaattactaattttgctaatggtaaaatgcatggtcgtcgtttcaatattggtttggactggccatttattgccggacgtgcagagatttgggcatgtgctaacattcttgcaccgattatgctagtagaagctattttactctctaaagttggtaatggtattctaccgcttgctggtattatcgcaatgggcgtaacccctgctttactggttgttacacgtggccgtttaattcgtatgattacctttggaacattgctattaccgctatttcttttatcaggaacaatgattgccccatttgcaactgaattagctaaaaaggtaggcgcattcccagctggggcgcgagcaggttcacttatcactcactctacactagaaggccctatggagaaaatctttggttacgttattggtaaagcgacaacaggtcaattatcagcgattataacattaattatttttgcgacagcttatcttggtttgtttatgtggtatgctaaacaaatgaaacgccgtaatgcagaatatgcagctaatcaaaaa

SEQ ID NO: 1572 - protein, 482 aa, Streptococcus agalactiae
MQVFLNIVNKFFDPIIHMGSGVVMLIVMTGLAMIFGVKFSKALEGGIKLAIALTGIGAIIGILTGAFSESLQAFVKNTGINLSIIDVGWAPLATITWGSPYTLYFLLIMLIVNIVMIVMKKTDTLDVDIFDIWHLSITGLLIMWYAKKNNLPTLLSVIIATVAIIFVGVLKIINSDLMKPTFDDLLGTGPTSPMTSTHMNYMMNPIIMVLDKLFDKVFPGLDKYDFDAAKLNKAIGFWGSKFFIGMILGLVIGIMGNPVFSFAALGGWFSLGFTAGACLELFSLIGSWFIAAVEPLSQGITNFANGKMHGRRFNIGLDWPFIAGRAEIWACANILAPIMLVEAILLSKVGNGILPLAGIIAMGVTPALLVVTRGRLIRMITFGTLLLPLFLLSGTMIAPFATELAKKVGAFPAGARAGSLITHSTLEGPMEKIFGYVIGKATTGQLSAIITLIIFATAYLGLFMWYAKQMKRRNAEYAANQK

SEQ ID NO: 1573 - DNA, 1449 bp, Streptococcus agalactiae
atgatgcaaccttttttagacattattaacaagattctgggatttcctattcagttgggatcaggtgtggtcatgctgattgtcatgacaggtttagccatgattttcggggttaaattcacaaaggcactggaaggtgggattaagttagccatcgctttgacagggattggagccattattggaattttgacgggggctttttcagagtctttacaggcctttgttaaaaatacagggatcagtttaaacattattgatgtcggttgggcaccgcttgcaacaattacctggggttccccttacaccctttatttcttgctggtgatgctggtggttaatattgtcatgattgtcatgaaaaaaacggacacccttgacgtcgatatttttgatatttggcatttgtccattacgggtctattgattatgtggtatgcggctcgtaaccatttaccagtctttgtgtctcttttgattgctactgtggcagttattcttgttggggtactgaaaatcattaactctgatttgatgaaaccgacctttgatgaccttcttgggacagggcctcaatcaccaatgacttcaactcacatgaactacatgatgaatccaatcattatggtcttagataagatttttgacaaggtctttccggggctggataaatatgactttgatgctgctaaattgaacaaaaaaattggcttctggggctctaagttctttatcggaatggctctaggttttgtgattgggattatgggagatcctcatttcactgttgaatctatcaaaaattggtttggcctaggctttaccgcgggtgcctgcttggaacttttctctttgattggctcttggtttatcgcagctgttgagcctttgtcacaagggattaccaattttgccaatgctagaatgcatgggcgtcgtttcaatatcggtttggactggcccttcattgctggtcgtgctgaaatctgggcctgtgccaatattcttgccccaatcatgttgattgaagccgttctcctatcaaaagttggcaatgggattttaccactggcaggaattattgctatggggatgacaccagctcttcttgtggtcacacgtggtcgtttgattcgcatgattatttttggttccctcttattgccattattcctcttgtcaggaactatgattgctccatttgcgacagagttggctaaaaaagtaggggcttttccagcaggtacaagcgctggttccttgattacgcattcaacacttgaaggaccaatggaaaaaatttttggttatgtgattggtcaagcgacaacaggtcagattgcctcaatcatcacgctaatcatctttgtggccatttacctaagtctctttgcttggtatgctaaccaaatgaaggcacgtaacgctgaatatgcgaaaacaatgaaa

SEQ ID NO: 1574 - protein, 483 aa, Streptococcus pyogenes
MMQPFLDIINKILGFPIQLGSGVVMLIVMTGLAMIFGVKFTKALEGGIKLAIALTGIGAIIGILTGAFSESLQAFVKNTGISLNIIDVGWAPLATITWGSPYTLYFLLVMLVVNIVMIVMKKTDTLDVDIFDIWHLSITGLLIMWYAARNHLPVFVSLLIATVAVILVGVLKIINSDLMKPTFDDLLGTGPQSPMTSTHMNYMMNPIIMVLDKIFDKVFPGLDKYDFDAAKLNKKIGFWGSKFFIGMALGFVIGIMGDPHFTVESIKNWFGLGFTAGACLELFSLIGSWFIAAVEPLSQGITNFANARMHGRRFNIGLDWPFIAGRAEIWACANILAPIMLIEAVLLSKVGNGILPLAGIIAMGMTPALLVVTRGRLIRMIIFGSLLLPLFLLSGTMIAPFATELAKKVGAFPAGTSAGSLITHSTLEGPMEKIFGYVIGQATTGQIASIITLIIFVAIYLSLFAWYANQMKARNAEYAKTMK

SEQ ID NO: 1575 - DNA, 303 bp, Streptococcus agalactiae
atgatcaaaatattagcagcttgtggtgcaggcgtaaactcaagtcatcaaattaaagatgctatcgagacacaattaggagatagaggttacaatgtacattgtgatgctgttatggttaaggatatcactgaggaaatggtcaacaaatatgatatctttactcctattgctaaaactgatttaggttttaatgtaccaattccagttgtagaagcaggacctattctttatcgcataccagttatgagcgaaccggtctttactgctttagaacaagttatcaaagaacacaatctatca

SEQ ID NO: 1576 - protein, 101 aa, Streptococcus agalactiae
MIKILAACGAGVNSSHQIKDAIETQLGDRGYNVHCDAVMVKDITEEMVNKYDIFTPIAKTDLGFNVPIPVVEAGPILYRIPVMSEPVFTALEQVIKEHNLS

SEQ ID NO: 1577 - DNA, 303 bp, Streptococcus pyogenes
atgattaaaattctagcagcctgcggtgcaggggttaactcaagccatcaaattaaagatgcgattgaaactcagatgagtgaccgtggttacgatgttcactgtgatgcggtgatggtcaaagacatcacagaagaattggtgtctcgttatgatatttttacgccgattgcaaaaactgacttgggatttgagatgccgattcccatagtagaagcaggaccgattctctatcgtatcccaatcatgagtgagcctgtttttgctgaattagagcgcgtgattaaagaaaatcatttgcag

SEQ ID NO: 1578 - protein, 101 aa, Streptococcus pyogenes
MIKILAACGAGVNSSHQIKDAIETQMSDRGYDVHCDAVMVKDITEELVSRYDIFTPIAKTDLGFEMPIPIVEAGPILYRIPIMSEPVFAELERVIKENHLQ

SEQ ID NO: 1579 - DNA, 471 bp, Streptococcus agalactiae
gtgtttgctgtgactcaagatattttatttattgatgcccattctcaggaagaattatttgacttagtatcaaaagcattgataaaacaacactatgttagtcctaactaccgacaggcagtaaaagaaagggagagagagtttccaacggggttaaaaattgatttaaaagatgggactcctattcaatatgttgctattccacacactgaaacgcagtattgtctagtagatagaatcttttatgtcaaaaatagtcagccaattactttcaaacatatgattaatccagaagaggagtgtagggttcaggattttttcttcatcattaatagtaggaatagtaaccaaagtgatattttatctaatttgattaccttctttattacaaaaggaaacctagatcggctacatgagcttggcgacaataaagaaaaaattaatcattatttaatagaaaaaggagtgttt

SEQ ID NO: 1580 - protein, 157 aa, Streptococcus agalactiae
MFAVTQDILFIDAHSQEELFDLVSKALIKQHYVSPNYRQAVKEREREFPTGLKIDLKDGTPIQYVAIPHTETQYCLVDRIFYVKNSQPITFKHMINPEEECRVQDFFFIINSRNSNQSDILSNLITFFITKGNLDRLHELGDNKEKINHYLIEKGVF

SEQ ID NO: 1581 - DNA, 471 bp, Streptococcus pyogenes
gtgtttcctaatattctatttactgaagcaaggacgcagccagagctttttgatcttgttgctagccacttggaaaaggttgggtatgtgacgcaagagtaccatcaggctttagtggagcgtgaggcggtatttccgacaggactcaaagtggacctcaaagatgggtcagatattttgtatgcggctattccgcatacagaaaccaagtattgcttggttgatcaagtggtctatgttagaaatagtcaagcccttacctttaagcacatgattaatccagaggaagactgtttggtaacggatttcttctttattatcaatagtcaaaacgagggtcaaacgacgattctatccaatctcattaccttctttattacgaaaggcaatcttagctatctagccagtctaaaagatgataaacaagctatttcaaactatttaatagaaaaaggagtgtttcagcatgat

SEQ ID NO: 1582 - protein, 157 aa, Streptococcus pyogenes
VFPNILFTEARTQPELFDLVASHLEKVGYVTQEYHQALVEREAVFPTGLKVDLKDGSDILYAAIPHTETKYCLVDQVVYVRNSQALTFKHMINPEEDCLVTDFFFIINSQNEGQTTILSNLITFFITKGNLSYLASLKDDKQAISNYLIEKGVFQHD

SEQ ID NO: 1583 - DNA, 774 bp, Streptococcus agalactiae
atgttaaagcgagaaagattacaaaaaataatagaaaaagtcaatataaatggcattgtcactgttaatgaaatcatggaagaacttgatgtatcagacatgactgttaggcgtgacttggatgaattagataaagcaggactgttaatacgcatccatggtggtgcacaaaaagtaaatgcatcaccaactccacaaaattatgaaaaatcaaacactgaaaaatacgatattcaaacaaatgaaaaattagaaattgcccaatttgcaaaacaattcatcaatgatggtgaaacaatctttattgggcctggaacaaccttagagaaattagccacgcaattacttgattttaaaattagggtagtaaccaatagccttcctgttttcaatattctgaatcaaagttcaacacttgaccttatccttgtagggggagagtacagagaaattactggtgcttttgtcggttctgttactattaactctattaaatcacttaatttttcaaaagctttcgttagtagtaatggtgtttttgaaaagtctatcgctacttacgacgagggagaaggtgaaattcagcgcattgctcttaataattcctttgaaaaattccttttagttgatagccaaaaatttggtaaatatgatttttatactttttatcaattagacgatattgattttgtattaacagatcataatattgataatgttgttaaggagcaatacagtagcttcaccaaaattttaactaataacaattacatg

SEQ ID NO: 1584 - protein, 258 aa, Streptococcus agalactiae
MLKRERLQKIIEKVNINGIVTVNEIMEELDVSDMTVRRDLDELDKAGLLIRIHGGAQKVNASPTPQNYEKSNTEKYDIQTNEKLEIAQFAKQFINDGETIFIGPGTTLEKLATQLLDFKIRVVTNSLPVFNILNQSSTLDLILVGGEYREITGAFVGSVTINSIKSLNFSKAFVSSNGVFEKSIATYDEGEGEIQRIALNNSFEKFLLVDSQKFGKYDFYTFYQLDDIDFVLTDHNIDNVVKEQYSSFTKILTNNNYM

SEQ ID NO: 1585 - DNA, 768 bp, Streptococcus pyogenes
atgttaaaaagagaaagacttctaaaaattaccgaaatagtcaatgagcaaggtattgttactgtgaatgatattattcagactttaaacgtttctgatatgacagttcgtagagacttagatgaactggaaaaagccggcaaattgatccgcatccatggaggtgcacaaagcattaccatgcctaataaaaaagagcggtcaaatattgaaaaacaaaccgttcaaacaaaggaaaaatgggaactagcttcatatgcgacacaactagtcaatgatggtgaaacaatctttattggtccaggaacaactttagaatgtttcgctgagcagttaaaaaatcgtcagattcgcattgtgaccaatagcctccctgtctttaacatccttcaggacagcgaaaccattgacctgattcttatcggtggtgaataccgatctattacaggagcttttgtagggtcccttgccagtcaaaatatctcatccttaaaatttgccaaggcttttattagctgtaatggtatttataaaaacgatattgcaacttatagcgaaactgaaggagagattcaaaagctagcttttaataattctattgaaaaatacctcttggtagataaccaaaaattcaatgcctacgacttcttcattttttaccatttaaacaacattgatgctgttgttacagattcgcaaataactgaggacgttatcgaacgttatagtcagttcacgcaattattagtagcccacgaaaacaaggag

SEQ ID NO: 1586 - protein, 256 aa, Streptococcus pyogenes
MLKRERLLKITEIVNEQGIVTVNDIIQTLNVSDMTVRRDLDELEKAGKLIRIHGGAQSITMPNKKERSNIEKQTVQTKEKWELASYATQLVNDGETIFIGPGTTLECFAEQLKNRQIRIVTNSLPVFNILQDSETIDLILIGGEYRSITGAFVGSLASQNISSLKFAKAFISCNGIYKNDIATYSETEGEIQKLAFNNSIEKYLLVDNQKFNAYDFFIFYHLNNIDAVVTDSQITEDVIERYSQFTQLLVAHENKE

SEQ ID NO: 1587 - DNA, 1137 bp, Streptococcus agalactiae
atgacacatgagcattgggtaccaaagaaagatttatcagagtcggaattaaaagcagctcaagaatttctttcaggaaaatctgaagcaaatcaagacaaaccaaaaacaggtaaaacagctcaagaaatctatgaggcaattgaaccaaaagcaattgttaaacctgaagatttattatttggaattgcacaagcgacagactataagaatggtacatttgtaattcctcataaagatcattaccattatgtggaattaaaatggtttgatgaagaaaaagatcttttagctgattcagataagacatattctttagaagactatttagctacggctaaatattacatgatgcacccagaaaaacgtcctaaagttgaaggatggggtaaagatgctgaaatttataaggaaaaggactctaataaagcagataaaccaagtcctgcaccaactgataataaatcaacatcaaattctagtgacaaaaacttaagtgctgcagaagtattcaaacaagcaaaaccagaaaaaattgtaccgcttgataaaattgctgctcacatggcatatgcagttggatttgaagatgatcaattgattgttcctcatcatgatcattatcataatgttcctatggcatggtttgacaagggtggtttatggaaagcaccagaaggctatacattacaacaactcttctcaacaattaaatactacatggaacatcctaatgaattaccaaaagaaaaaggttggggacacgacagtgatcataacaaaggctcaaataaagacaataaagccaaaaattatgctccagatgaagaacctgaagattcagggaaagtaactcacaactatggtttttatgatgttaataaagggtcagacgaagaagaaccagaaaaacaagaagatgaatcagagctagatgaatatgaactaggaatggcacaaaacgctaagaaatatggtatggatagacaatcttttgaaaagcaactcatccaattatcaaataaatatagtgtaagttttgaaagctttaattatattaatggtagtcaagttcaagttactaaaaaagatggctctaaagtgcttgttgatattaaaacactaacagaagtgaaa

SEQ ID NO: 1588 - protein, 379 aa, Streptococcus agalactiae
MTHEHWVPKKDLSESELKAAQEFLSGKSEANQDKPKTGKTAQEIYEAIEPKAIVKPEDLLFGIAQATDYKNGTFVIPHKDHYHYVELKWFDEEKDLLADSDKTYSLEDYLATAKYYMMHPEKRPKVEGWGKDAEIYKEKDSNKADKPSPAPTDNKSTSNSSDKNLSAAEVFKQAKPEKIVPLDKIAAHMAYAVGFEDDQLIVPHHDHYHNVPMAWFDKGGLWKAPEGYTLQQLFSTIKYYMEHPNELPKEKGWGHDSDHNKGSNKDNKAKNYAPDEEPEDSGKVTHNYGFYDVNKGSDEEEPEKQEDESELDEYELGMAQNAKKYGMDRQSFEKQLIQLSNKYSVSFESFNYINGSQVQVTKKDGSKVLVDIKTLTEVK

SEQ ID NO: 1589 - DNA, 2475 bp, Streptococcus pyogenes
gtgaagaaaacatatggttatatcggctcagttgctgctattttactagctactcatattggaagttaccaacttggtaagcatcatatgggttcagcaacaaaggacaatcaaattgcctatattgatgatagcaaaggtaaggcaaaagcccctaaaacaaacaaaacgatggatcaaatcagtgctgaagaaggcatctctgctgaacagatcgtagtcaaaattactgaccaaggctatgtgacctcacatggtgaccattatcatttttacaatgggaaagttccttatgatgcgattattagtgaagagttgttgatgacggatcctaattaccgttttaaacaatcagacgttatcaatgaaatcttagacggttacgttattaaagtcaatggcaactattatgtttacctcaagccaggtagcaagcgcaaaaacattcgaaccaaacaacaaattgctgagcaagtagccaaaggaactaaagaagctaaagaaaaaggtttagctcaagtggcccatctcagtaaagaagaagttgcggcagtcaatgaagcaaaaagacaaggacgctatactacagacgatggctatatttttagtccgacagatatcattgatgatttaggagatgcttatttagtacctcatggtaatcactatcattatattcctaaaaaggatttgtctccaagtgagctagctgctgcacaagcctactggagtcaaaaacaaggtcgaggtgctagaccgtctgattaccgcccgacaccagccccagccccaggtcgtaggaaagccccaattcctgatgtgacgcctaaccctggacaaggtcatcagccagataacggtggctatcatccagcgcctcctaggccaaatgatgcgtcacaaaacaaacaccaaagagatgagtttaaaggaaaaacctttaaggaacttttagatcaactacaccgtcttgatttgaaataccgtcatgtggaagaagatgggttgatttttgaaccgactcaagtgatcaaatcaaacgcttttgggtatgtggtgcctcatggagatcattatcatattatcccaagaagtcagttatcacctcttgaaatggaattagcagatcgatacttagccggccaaactgaggacgatgactcaggttcagatcactcaaaaccatcagataaagaagtgacacatacctttcttggtcatcgcatcaaagcttacggaaaaggcttagatggtaaaccatatgatacgagtgatgcttatgtttttagtaaagaatccattcattcagtggataaatcaggagttacagctaaacacggagatcatttccactatataggatttggagaacttgaacaatatgagttggatgaggtcgctaactgggtgaaagcaaaaggtcaagctgatgagcttgctgctgctttggatcaggaacaaggcaaagaaaaaccactctttgacactaaaaaagtgagtcgcaaagtaacaaaagatggtaaagtgggctatatgatgccaaaagatggcaaggactatttctatgctcgtgatcaacttgatttgactcagattgcctttgccgaacaagaactaatgcttaaagataagaaacattaccgttatgacattgttgacacaggtattgagccacgacttgctgtagatgtgtcaagtctgccgatgcatgctggtaatgctacttacgatactggaagttcgtttgttatccctcatattgatcatatccatgtcgttccgtattcatggttgacgcgcgatcagattgcaacaatcaagtatgtgatgcaacaccccgaagttcgtccggatatatggtctaagccagggcatgaagagtcaggttcggtcattccaaatgttacgcctcttgataaacgtgctggtatgccaaactggcaaattatccattctgctgaagaagttcaaaaagccctagcagaaggtcgttttgcaacaccagacggctatattttcgatccacgagatgttttggccaaagaaacttttgtatggaaagatggctcctttagcatcccaagagcagatggcagttcattgagaaccattaataaatctgatctatcccaagctgagtggcaacaagctcaagagttattggcaaagaaaaacgctggtgatgctactgatacggataaacccaaagaaaagcaacaggcagataagagcaatgaaaaccaacagccaagtgaagccagtaaagaagaagaaaaagaatcagatgactttatagacagtttaccagactatggtctagatagagcaaccctagaagatcatatcaatcaattagcacaaaaagctaatatcgatcctaagtatctcattttccaaccagaaggtgtccaattttataataaaaatggtgaattggtaacttatgatatcaagacacttcaacaaataaaccct

SEQ ID NO: 1590 - protein, 825 aa, Streptococcus pyogenes
VKKTYGYIGSVAAILLATHIGSYQLGKHHMGSATKDNQIAYIDDSKGKAKAPKTNKTMDQISAEEGISAEQIVVKITDQGYVTSHGDHYHFYNGKVPYDAIISEELLMTDPNYRFKQSDVINEILDGYVIKVNGNYYVYLKPGSKRKNIRTKQQIAEQVAKGTKEAKEKGLAQVAHLSKEEVAAVNEAKRQGRYTTDDGYIFSPTDIIDDLGDAYLVPHGNHYHYIPKKDLSPSELAAAQAYWSQKQGRGARPSDYRPTPAPAPGRRKAPIPDVTPNPGQGHQPDNGGYHPAPPRPNDASQNKHQRDEFKGKTFKELLDQLHRLDLKYRHVEEDGLIFEPTQVIKSNAFGYVVPHGDHYHIIPRSQLSPLEMELADRYLAGQTEDDDSGSDHSKPSDKEVTHTFLGHRIKAYGKGLDGKPYDTSDAYVFSKESIHSVDKSGVTAKHGDHFHYIGFGELEQYELDEVANWVKAKGQADELAAALDQEQGKEKPLFDTKKVSRKVTKDGKVGYMMPKDGKDYFYARDQLDLTQIAFAEQELMLKDKKHYRYDIVDTGIEPRLAVDVSSLPMHAGNATYDTGSSFVIPHIDHIHVVPYSWLTRDQIATIKYVMQHPEVRPDIWSKPGHEESGSVIPNVTPLDKRAGMPNWQIIHSAEEVQKALAEGRFATPDGYIFDPRDVLAKETFVWKDGSFSIPRADGSSLRTINKSDLSQAEWQQAQELLAKKNAGDATDTDKPKEKQQADKSNENQQPSEASKEEEKESDDFIDSLPDYGLDRATLEDHINQLAQKANIDPKYLIFQPEGVQFYNKNGELVTYDIKTLQQINP

SEQ ID NO: 1591 - DNA, 1398 bp, Streptococcus agalactiae
atgaatcgtaaaaaaacagttattattagtgctttatcagtagctctatttggtactggtgtaggtgcttaccaattaggtagctataatgcccaaaaatcagacaatagtgtttcttatgtgaaaacagataaatctgatagcaaagcacaagcaacagctgtaaataaaacgcccgaccaaatcagtaaagaagaaggcatatctgcagaacaaatcgttgttaaaattactgacgacggttatgtgacttctcatggagaccattaccattattacaatgggaaagtgccatatgatgccatcattagtgaagaattgattatgaaagaccctagctatgtctttaataaagctgatgtcattaatgaagtcaaagatggttatattatcaaagttaacggtaagtattacctctatcttaaagaaggtagcaaacgaacaaatgttcgtacaaaggaacaaatccaaaagcaacgcgaagaatggtctaagggtggttctaagggagaatcaggaaagcatagtagtgcaaaaactcaagctttatcagccagcgtacgtgaagcgaaagctagcggtcgctatactacagatgatggttatgtttttagtccaacagatgtcattgatgacatgggagatgcctttttagtaccacatggcgatcatttccattatatcccgaaagctgatttatctccatcagagttatcagccgcacaggcatattggaaccgcaagactggccgatcaggtaatagctcaaaaccatcaaattcaagttcatacattcatgcaagtgcaccaagcggtaatgtatcaacaggaagacatgctaatgcccctatttctattccaagagtcactcacgcaaatcactggtcaaaaccagctggtaatcatgctacggcaccaaaacaccatgcacctacaaccaaaccaatcaacaaagattctgctttagacaaaatgttgaaacgtttatatgctcaaccgttatatgctcgtcacgtagaaagtgatggtttggtttatgacccagcacaagttaatgctttcacagcaatcggtgtttctattccgcacggtaatcatttccactttattcactataaggatatgtctccattagagttagaagcaacaaggatggtggcagagcatagaggacatcatattgatgcattagggaaaaaagattctacagagaaaccaaagcatatttctcatgaacctaataaggaacctcacacagaggaagaacaccatgcagtaacaccgaaagaccaacgtaaaggcaaaccaaatagccagattgtctacagtgctcaagaaattgaagaggcaaaaaagctggtaaatacacaacatctgatggttacattatatgacaca

SEQ ID NO: 1592 - protein, 466 aa, Streptococcus agalactiae
MNRKKTVIISALSVALFGTGVGAYQLGSYNAQKSDNSVSYVKTDKSDSKAQATAVNKTPDQISKEEGISAEQIVVKITDDGYVTSHGDHYHYYNGKVPYDAIISEELIMKDPSYVFNKADVINEVKDGYIIKVNGKYYLYLKEGSKRTNVRTKEQIQKQREEWSKGGSKGESGKHSSAKTQALSASVREAKASGRYTTDDGYVFSPTDVIDDMGDAFLVPHGDHFHYIPKADLSPSELSAAQAYWNRKTGRSGNSSKPSNSSSYIHASAPSGNVSTGRHANAPISIPRVTHANHWSKPAGNHATAPKHHAPTTKPINKDSALDKMLKRLYAQPLYARHVESDGLVYDPAQVNAFTAIGVSIPHGNHFHFIHYKDMSPLELEATRMVAEHRGHHIDALGKKDSTEKPKHISHEPNKEPHTEEEHHAVTPKDQRKGKPNSQIVYSAQEIEEAKKLVNTQHLMVTLYDT

SEQ ID NO: 1593 - DNA, 921 bp, Streptococcus agalactiae
atgaaaaggatacggaaaagccttatttttgttctcggagtagttaccctaatttgcttatgtgcttgtactaaacaaagccagcaaaaaaatggcttgtcagtagtgactagcttttatccagtatattccattacaaaagcagtttctggtgatttgaatgatattaaaatgattcgatcacagtcaggtattcatggttttgaaccctcatcaagtgatgttgctgccatttatgatgctgatctatttctttatcattcgcacacactagaagcttgggcgagacgtttggaacctagtttgcatcactctaaagtatctgtaattgaagcttcaaaaggtatgactttggataaagttcatggcttagaagatgtagaggcagaaaaaggagtagatgagtcaaccttgtatgaccctcacacttggaatgaccctgtaaaagtatctgaggaagcacaactcatcgctacacaattagctaaaaaggatcctaaaaacgctaaggtttatcaaaaaaatgctgatcaatttagtgacaaggcaatggctattgcagagaagtataagccaaaatttaaagctgcaaagtctaaatactttgtgacttcacatacagcattctcatacttagctaagcgatacggattgactcagttaggtattgcaggtgtctcaaccgagcaagaacctagtgctaaaaaattagccgaaattcaggagtttgtgaaaacatataaggttaagactatttttgttgaagaaggagtctcacctaaattagctcaagcagtagcttcagctactcgagttaaaattgcaagtttaagtcctttagaagcagttcccaaaaacaataaagattacttagaaaatttggaaactaatcttaaggtacttgtcaaatcgttaaatcaa

SEQ ID NO: 1594 - protein, 307 aa, Streptococcus agalactiae
MKRIRKSLIFVLGVVTLICLCACTKQSQQKNGLSVVTSFYPVYSITKAVSGDLNDIKMIRSQSGIHGFEPSSSDVAAIYDADLFLYHSHTLEAWARRLEPSLHHSKVSVIEASKGMTLDKVHGLEDVEAEKGVDESTLYDPHTWNDPVKVSEEAQLIATQLAKKDPKNAKVYQKNADQFSDKAMAIAEKYKPKFKAAKSKYFVTSHTAFSYLAKRYGLTQLGIAGVSTEQEPSAKKLAEIQEFVKTYKVKTIFVEEGVSPKLAQAVASATRVKIASLSPLEAVPKNNKDYLENLETNLKVLVKSLNQ

SEQ ID NO: 1595 - DNA, 918 bp, Streptococcus pyogenes
atgaaaaaaggtttttttctcatggctatggtcgtgagtttagtaatgatagcagggtgtgataagtcagcaaaccccaaacagcctacgcaaggcatgtcagttgtaaccagcttttacccaatgtatgcgatgacaaaagaagtatctggagacctcaatgatgtgaggatgatccaatcaggtgcaggcattcattcctttgaaccgtctgtaaatgatgtggcagctatttatgacgcggatttgtttgtttaccattcacataccttagaagcttgggcaagggatctagaccctaatttaaaaaaatcaaaggttgatgtgtttgaagcgtcaaaacctttgacactagatagagtcaaagggctagaagatatggaagtcacacaaggcattgatcctgcgacactttatgacccacatacctggacagatcccgttttagctggtgaggaagctgttaatatcgctaaagagctaggacgtttggatcctaaacacaaagacagttacactaaaaatgctaaggctttcaaaaaagaagcagagcaactaactgaagaatacactcaaaaatttaaaaaggtgcgctcaaaaacattcgtgacgcagcacacggcattttcttatctggctaaacgattcggcttgaaacaacttggtatctcgggcatttccccagagcaagagccctctcctcgccaattgaaagaaattcaagactttgttaaagaatacaacgtcaagactatttttgcagaagacaatgtcaatcccaaaattgctcatgctattgcgaaatcaacaggagctaaagtaaagacattaagtccacttgaagctgctccaagcggaaacaagacatatctagaaaatcttagagcaaatttggaagtgctctatcaacagttgaag

SEQ ID NO: 1596 - protein, 306 aa, Streptococcus pyogenes
MKKGFFLMAMVVSLVMIAGCDKSANPKQPTQGMSVVTSFYPMYAMTKEVSGDLNDVRMIQSGAGIHSFEPSVNDVAAIYDADLFVYHSHTLEAWARDLDPNLKKSKVDVFEASKPLTLDRVKGLEDMEVTQGIDPATLYDPHTWTDPVLAGEEAVNIAKELGRLDPKHKDSYTKNAKAFKKEAEQLTEEYTQKFKKVRSKTFVTQHTAFSYLAKRFGLKQLGISGISPEQEPSPRQLKEIQDFVKEYNVKTIFAEDNVNPKIAHAIAKSTGAKVKTLSPLEAAPSGNKTYLENLRANLEVLYQQLK

SEQ ID NO: 1597 - DNA, 441 bp, Streptococcus agalactiae
atgaaaatcattattcaacgtgttaatcaagcaagtgtttctattgaagatgatgtagtcggatctattgagaagggtttagtacttctagttgggattgctccagaagatacaacagaagatattgcttatgcagttcgtaaaattactagcatgcgtattttttctgatgatgaggggaaaatgaacctttcaattcaagacattaaaggaagcgtcttatctatctcacaatttacactctttgcagataccaaaaaaggaaatcgtccagcttttactggggcagctgatcctgttaaagcgaatcagttttatgatatctttaatcaagaattagcaaatcatgtttcggtagaaacaggtcaatttggagctgatatgcaagtcagtctgattaatgatggaccagtaactatcgttttagatactaaaaataaa

SEQ ID NO: 1598 - protein, 147 aa, Streptococcus agalactiae
MKIIIQRVNQASVSIEDDVVGSIEKGLVLLVGIAPEDTTEDIAYAVRKITSMRIFSDDEGKMNLSIQDIKGSVLSISQFTLFADTKKGNRPAFTGAADPVKANQFYDIFNQELANHVSVETGQFGADMQVSLINDGPVTIVLDTKNK

SEQ ID NO: 1599 - DNA, 441 bp, Streptococcus pyogenes
atgaaacttgtcttgcaacgggtcaaagaggcctctgtttctattgatgggaaaattgctggcgctattaatcaagggttgttgttgttagtaggtgtgggaccagatgataatgcagaagatttggcttacgctgtgcgaaaaatagtcaacatgcgcattttttcagatgctgatggcaagatgaaccagtctatccaagacatcaagggcagtatcttatctgtgtcgcaatttaccctttatgctgacaccaaaaagggaaaccgtcctgcctttactggtgctgctaagccagatttggctagtcagttgtatgatagctttaatgaacaattggcagagtttgtgccagttgagcgtggcgtttttggggcagatatgcaggttagtctcatcaatgatggaccagttacgattattttagacacgaaatgtcac

SEQ ID NO: 1600 - protein, 147 aa, Streptococcus pyogenes
MKLVLQRVKEASVSIDGKIAGAINQGLLLLVGVGPDDNAEDLAYAVRKIVNMRIFSDADGKMNQSIQDIKGSILSVSQFTLYADTKKGNRPAFTGAAKPDLASQLYDSFNEQLAEFVPVERGVFGADMQVSLINDGPVTIILDTKCH

SEQ ID NO: 1601 - DNA, 2214 bp, Streptococcus agalactiae
atggtcaaagaaattaatttaacaggagaagaggttgttgcaatcacatcccagtacatgagtgagacggatgttgcttttgtaaaatttgccttaaattacgcaaccgcagctcattattatcaagcaagaaagtcgggcgagccctacattattcatccaattcaagtagcaggtattcttgcagatttacaccttgatgccgttacggtagcttgtggttttttacatgatgttgtagaagatacggaaattacccttgatgagattgaaactgattttggcaaggatgttcgcgatattattgacggcgtaacaaaattgggtaaagtggagtacaaatctcatgaagaacagttagcagaaaatcaccgtaaaatgttaatggctatgtctaaggatatccgtgttattttggttaagctcgctgaccgcttacataatatgagaacccttaaacacctcagaaaagataaacaagagcgtatttcacgtgagactatggaaatatacgctcctttagcgcatcgtttggggattagtcgtatcaagtgggaattagaagatttatcttttcgttacttgaatgagacggaattttataagatttctcatatgatgagtgaaaaacgtcgtgaacgcgaagagttggttgatataattgtcgataaaatcagatcctatactgaggaacagggtttatatggtgatatttatggtagaccaaaacacatttattctatttacagaaaaatgcgtgataaaaagaaacgctttgatcagatttatgatttaattgcgatacgctgtatcatggaaactgctagtgatgtttatgccatggtggggtatatccatgagttatggcgtcctatgccaggaaggtttaaagattatattgcggcaccaaaggccaatggttatcaatctattcacacgacggtttatggacctaaagggccaattgaaattcagattcgaactaaagaaatgcatcaagttgccgagtttggtgttgcagcccattgggcctataaaaaaggaatcaccagtaaggttaatcaagcagagcaatcggttggtatgggatggattcaagaattagttgagcttcaagatgaatcaaaagacgccaaggattttgttgactctgttaaggaagatatctttacagaacgcatctatgtttttaccccaaatggtgctgttcaggaattgccaagggaatctggaccaattgattttgcttatgctattcacacgcaagttggagaaaaagctactggcgctaaagtaaatggacgtatggttccattgactgctaagttaaaaacaggagatgttgttgagattatcacaaaccctaattcatttggaccaagtcgtgactggattaagattgttaagaccaataaagctcgcaataaaattcgtcagttcttcaaaaaccaagataaagaaacttctattaataaaggtagagaattactggttgattatttccaagaacaaggttatgtgcctaacaaatatttagataagaaacatattgaagaaatccttccacgtgtcagtgttaaaagtgaggaagctttgtatgcagccgtaggttttggtgatttgagtccgattagtatttttaataaactgacggaaaaagaacgccgtgaggaggaacgtgctaaggctaaagcggaagcagacgaacttattaacggtggtgaaatcaaaaccgataagcgtgatgttctcaaagttaagagtgaaaatggtgttatcattcaaggagcttcaggtttattaatgcgtattgcaaaatgttgtaatcccgttcctggagatctcattgaaggctatataactaaaggtagaggcgtggctatccatcgttcagattgtcaaaatttaaagagtcaggagaactacgaacaacgtttgattgatgttgagtgggatgatgatggatctaaaaaagagtacatggctgaaatcgatatttatggtttgaatcgtagtggcctccttaatgatgttcttcaaaccttatcaaatgcaacaaagctagtatcgacagtaaatgcacaaccaacaaaagatatgaaatttgctaatattcatgttagctttggaatttcaaatttagcacaattgacaactgtggttgataaaatcaaaattatcccagatgtttattctgttaaacgtacgaatggt

SEQ ID NO: 1602 - protein, 738 aa, Streptococcus agalactiae
MVKEINLTGEEVVAITSQYMSETDVAFVKFALNYATAAHYYQARKSGEPYIIHPIQVAGILADLHLDAVTVACGFLHDVVEDTEITLDEIETDFGKDVRDIIDGVTKLGKVEYKSHEEQLAENHRKMLMAMSKDIRVILVKLADRLHNMRTLKHLRKDKQERISRETMEIYAPLAHRLGISRIKWELEDLSFRYLNETEFYKISHMMSEKRREREELVDIIVDKIRSYTEEQGLYGDIYGRPKHIYSIYRKMRDKKKRFDQIYDLIAIRCIMETASDVYAMVGYIHELWRPMPGRFKDYIAAPKANGYQSIHTTVYGPKGPIEIQIRTKEMHQVAEFGVAAHWAYKKGITSKVNQAEQSVGMGWIQELVELQDESKDAKDFVDSVKEDIFTERIYVFTPNGAVQELPRESGPIDFAYAIHTQVGEKATGAKVNGRMVPLTAKLKTGDVVEIITNPNSFGPSRDWIKIVKTNKARNKIRQFFKNQDKETSINKGRELLVDYFQEQGYVPNKYLDKKHIEEILPRVSVKSEEALYAAVGFGDLSPISIFNKLTEKERREEERAKAKAEADELINGGEIKTDKRDVLKVKSENGVIIQGASGLLMRIAKCCNPVPGDLIEGYITKGRGVAIHRSDCQNLKSQENYEQRLIDVEWDDDGSKKEYMAEIDIYGLNRSGLLNDVLQTLSNATKLVSTVNAQPTKDMKFANIHVSFGISNLAQLTTVVDKIKIIPDVYSVKRTNG

SEQ ID NO: 1603 - DNA, 2229 bp, Streptococcus pyogenes
atgaggaacgaaatggcaaaaataatgaacgtaacaggagaagaagtcattgccttagcggccacctatatgaccaaggctgatgtggcttttgtggcaaaggctttagcatatgcaacagcggcccatttctaccaagtgagaaagtcaggcgaaccctatatcgtccatccgattcaggtggcggggattctggctgatttgcatctggatgctgtgacagttgcttgtggctttttacatgatgtcgtagaagatacggatattaccttagatgagatcgaagcagactttggccatgatgctcgtgatatcgttgatggtgtcaccaagttaggtgaagttgagtacaaatctcatgaggagcaactcgccgaaaaccatcgcaaaatgctgatggctatgtccaaagatattcgcgtgattttggtgaaattggctgaccgcctgcataatatgcgcaccctcaaacatttgcgcaaggacaaacaagagcgcatttcgcgcgaaaccatggaaatctatgcccccttggcgcatcgtttggggattagtcgcatcaaatgggaactagaagatttggcttttcgttacctcaatgaaaccgaattttacaaaatttcccatatgatgaaagaaaaacgtcgcgagcgtgaagctttggtagaggctattgtcagtaaggtcaaaacctatacgacacaacaagggttgtttggagatgtgtatggccgaccaaaacacatttattcgatttatcggaaaatgcgggacaaaaagaaacgattcgatcagatttttgatctgattgccattcgttgtgtcatggaaacgcaaagcgatgtctatgctatggttggctatattcatgagctttggcgtcccatgccaggccgcttcaaggattatattgcagctcctaaagctaatggctaccagtctattcataccaccgtgtatgggccaaaaggacctattgagattcaaatcagaactaaggacatgcatcaagtggctgagtacggggttgctgctcactgggcttataaaaaaggcgtgcgtggtaaggtcaatcaagctgagcaagccgttggcatgaactggatcaaagagctggtagaattgcaagatgcctcaaatggcgatgcagtggactttgtggattcggtcaaagaagacattttttctgaacggatttatgtctttacaccgacaggggccgttcaggagttaccaaaagaatcaggtcctattgattttgcttatgcgatccatacgcaaatcggtgaaaaagcaacaggtgccaaagtcaatggacgtatggttcctctcactgccaagttaaaaacaggagatgtggttgaaatcatcaccaatgccaattcctttggccctagtcgagactgggtaaaactggtcaaaaccaataaggctcgcaacaaaattcgtcagttctttaaaaatcaagacaaggaattgtcagtgaataaaggccgtgatttgttggtgtcttattttcaagagcagggctacgttgccaataaataccttgacaaaaaacgcattgaagccatccttccaaaagtcagtgtgaagagcgaagaatcactctatgcagccgttgggtttggtgacattagtcctatcagtgtctttaacaagttaaccgaaaaagagcgccgtgaagaagaaagggccaaggctaaagcagaagctgaagaattggttaagggcggtgaggtcaaacacgaaaacaaagatgtgctcaaggttcgcagtgaaaatggagtcattatccaaggagcatcaggcctcttgatgcggattgccaagtgttgtaatcctgtacctggtgatcctattgacggctacattaccaaagggcgtggcattgcgattcacagatcggactgtcataacattaagagtcaagatggctaccaagaacgcttgattgaggtcgagtgggatttggacaattcgagtaaagattatcaggctgaaattgatatctatgggctcaatcgtagtggtctgcttaatgatgtgctccaaattttatcaaactcaaccaagagcatatcgacagtcaatgctcagccgaccaaggacatgaagtttgctaatattcacgtgagctttggcattccaaatctgacgcatctgaccactgttgtcgaaaaaatcaaggcagttccagatgtttatagcgtgaagcggaccaatggc

SEQ ID NO: 1604 - protein, 743 aa, Streptococcus pyogenes
MRNEMAKIMNVTGEEVIALAATYMTKADVAFVAKALAYATAAHFYQVRKSGEPYIVHPIQVAGILADLHLDAVTVACGFLHDVVEDTDITLDEIEADFGHDARDIVDGVTKLGEVEYKSHEEQLAENHRKMLMAMSKDIRVILVKLADRLHNMRTLKHLRKDKQERISRETMEIYAPLAHRLGISRIKWELEDLAFRYLNETEFYKISHMMKEKRREREALVEAIVSKVKTYTTQQGLFGDVYGRPKHIYSIYRKMRDKKKRFDQIFDLIAIRCVMETQSDVYAMVGYIHELWRPMPGRFKDYIAAPKANGYQSIHTTVYGPKGPIEIQIRTKDMHQVAEYGVAAHWAYKKGVRGKVNQAEQAVGMNWIKELVELQDASNGDAVDFVDSVKEDIFSERIYVFTPTGAVQELPKESGPIDFAYAIHTQIGEKATGAKVNGRMVPLTAKLKTGDVVEIITNANSFGPSRDWVKLVKTNKARNKIRQFFKNQDKELSVNKGRDLLVSYFQEQGYVANKYLDKKRIEAILPKVSVKSEESLYAAVGFGDISPISVFNKLTEKERREEERAKAKAEAEELVKGGEVKHENKDVLKVRSENGVIIQGASGLLMRIAKCCNPVPGDPIDGYITKGRGIAIHRSDCHNIKSQDGYQERLIEVEWDLDNSSKDYQAEIDIYGLNRSGLLNDVLQILSNSTKSISTVNAQPTKDMKFANIHVSFGIPNLTHLTTVVEKIKAVPDVYSVKRTNG

SEQ ID NO: 1605 - DNA, 2400 bp, Streptococcus agalactiae
atgtcaaaacattatttttcaaaaagcgtattcgctttaactgtcttaacagctacagcaacaagtggtttagctgttcaagcagaagacattgttacaacaccaagttcaacctctacaaaggttgaatcaactacccccactagcacaattgcagaggaaaagtcaaacgttacttctactccaactgcaataactgatgcttcaacagccacaagcacaaataccactaccaataaccaaaatccacagcctgttgccacagaagccacaactagtgatctcaaacctattgaaggtgaaaaagttgaccttcgcatcatgtcaaccacagacctacacaccaatttagttaactatgattattatcaagataaagaatctcaaaaaatagggttagcaaaaactgctgtccttattgaagaagcaaaaaaagaaaatcctaataccgtcttagttgataacggagatgtcattcaagggacacctttaggaacttataaagcaatcgttaaacctgtcgcagaaaatgaagaacatcctatgtaccaagccatgaatgctcttggttatgatgcatcaacactaggtaatcatgagtttaattacggtttagattacctcaaaaaaatcattgctacagccaaccttccaatcctcaacgcaaatgttttggatttcaaaacacatcaaccagtttttaaaacttatgacatcattactaaaaccttcaaagattcaacaggaagagctgttgcactaaatattgggattacaggaattgtacctcctcaaatcttaaactgggacaaggctaacctagagggaaaggttattgtcaaagattcagttaaagcaatcgaagaaatcgttcctactatgcgtgctaaaggagcagatgtcattctcgttttatcacactctggcattggagatgatcgatatgaagaaggtgaagaaaacgttggctatcaaattgccagcatcaagggagtggatgccgttgttacgggacactcacacgctgaatttccatcaggtaacggtactggcttctatgaaaaatacactggagttgatggtatcaatggaaaaataaatggaacacctgttacaatggcaggcaagtacggggatcatcttggtattattgatttaggacttagttatactaatggaaaatggcaagtctccgaaagtagtgctaaaatccgtaaaattgatatgaactcaacaactgctgacgagcgtatcattgcattggctaaggaagcacacgatggcactatcaactatgttcgccaacaagtaggtacaacaactgcgccaattacaagttactttgcactagttaaagatgacccttcagttcaaattgttaacaacgctcaacgttggtacgttgcaaatgaattgaaaggaacacctgaggcaaatttaccacttctatctgctgcagcaccatttaaagctggaacacgcggcgatgctaccgcatatactgatattccagctggacctgttgcaattaaaaacgtagctgatctttacctttatgataatgttactgcacttttaaaagtgaccggagcagacttacgtgaatggttagaaatgtccgctggtcaatttaaccaaattgaccctaacaataaagcaccacaaaatattatcaataccgaatatcgtacctataattttgacgttattgacggcttgacttataaatttgatattacacaacctaataaatacaataaagatggaaaagttgttaatagtcaagctagtcgagtacgcgatttaatgtacaatggtaagcctgttgcagacaaacaagagtttatgattgtgaccaataactaccgtgctagtggtaccttccctggggctaaaaatgccacaatgaaccgtttgctgaacttagaaaatcgccaaactattatcaactatattatttcagagaaaaccatcaatcctacagctgataataactggggcttcacagagtctattaaagaccttgatttacgattccaaacagccgataaagctaaaaatcttgttactaatagcaaggatattcagtatatcgctagttctaccaaagatgaaggatttggtgattatcgatttgtctatactgaacaagaaaaagtagaccttactgagccatcacatcaagaaaagttaagccaaatagaaaaacaaaaaattcaccacatggttgcaactgcttatacaaaagcaaaagcttctccaaatattacaggcactgtctatacacaacagaaagaaaaaacattacctaaaactggacaagaaaaacaatcttatctggctttctttggtgtcgcaatacttggactcgtgggaagtttacttaaaaagaaacaaata

SEQ ID NO: 1606 - protein, 800 aa, Streptococcus agalactiae
MSKHYFSKSVFALTVLTATATSGLAVQAEDIVTTPSSTSTKVESTTPTSTIAEEKSNVTSTPTAITDASTATSTNTTTNNQNPQPVATEATTSDLKPIEGEKVDLRIMSTTDLHTNLVNYDYYQDKESQKIGLAKTAVLIEEAKKENPNTVLVDNGDVIQGTPLGTYKAIVKPVAENEEHPMYQAMNALGYDASTLGNHEFNYGLDYLKKIIATANLPILNANVLDFKTHQPVFKTYDIITKTFKDSTGRAVALNIGITGIVPPQILNWDKANLEGKVIVKDSVKAIEEIVPTMRAKGADVILVLSHSGIGDDRYEEGEENVGYQIASIKGVDAVVTGHSHAEFPSGNGTGFYEKYTGVDGINGKINGTPVTMAGKYGDHLGIIDLGLSYTNGKWQVSESSAKIRKIDMNSTTADERIIALAKEAHDGTINYVRQQVGTTTAPITSYFALVKDDPSVQIVNNAQRWYVANELKGTPEANLPLLSAAAPFKAGTRGDATAYTDIPAGPVAIKNVADLYLYDNVTALLKVTGADLREWLEMSAGQFNQIDPNNKAPQNIINTEYRTYNFDVIDGLTYKFDITQPNKYNKDGKVVNSQASRVRDLMYNGKPVADKQEFMIVTNNYRASGTFPGAKNATMNRLLNLENRQTIINYIISEKTINPTADNNWGFTESIKDLDLRFQTADKAKNLVTNSKDIQYIASSTKDEGFGDYRFVYTEQEKVDLTEPSHQEKLSQIEKQKIHHMVATAYTKAKASPNITGTVYTQQKEKTLPKTGQEKQSYLAFFGVAILGLVGSLLKKKQI

SEQ ID NO: 1607 - DNA, 2049 bp, Streptococcus pyogenes
ttgatctataacgattacgttaacttattaggagattttatgaaaaaatattttattttaaaaagtagtgtattgagtatcctgactagttttactctattagttacagatgttcaagcagatcaagttgatgtgcaattccttggcgtcaatgattttcacggcgctcttgataataccggaacagcttacacaccaagtggtaaaataccaaatgctgggacggctgctcaattaggtgcttatatggatgacgctgagatagacttcaagcaagcaaatcaagacggaacaagtatacgtgttcaagctggagatatggtcggagccagtcctgctaactctgcacttttacaagatgagcctactgtcaaagtctttaacaaaatgaaatttgaatatggcactcttggtaatcatgaatttgacgaaggactagatgaatttaaccgtatcatgacaggtcaagcgcctgatcctgaatcaacaattaatgatatcaccaaacaatatgagcacgaagcttcgcatcaaaccatcgtcattgctaatgttattgataaaaaaaccaaggatatcccctatggttggaaaccttatgctataaaagacatagccattaatgacaaaatcgttaagattggcttcattggtgttgtgactacagagattccaaatctcgttttaaagcaaaactatgaacactatcaatttttagatgtagctgaaaccattgccaaatatgctaaagaactacaagaacaacatgttcatgctattgtggttttagctcatgttcctgcaacaagtaaagatggtgttgttgatcatgaaatggctacggttatggaaaaagtgaaccaaatctatcccgaacatagcattgatattatttttgcaggacataatcatcaatacactaatggaactatcggtaaaacacgtatcgttcaagccctctctcaaggaaaagcttatgcagatgtccgtggtacgctagatactgataccaatgattttattaaaactccatcagcaaatgttgttgctgtagcaccaggtatcaaaacagaaaattcagatatcaaagctataataaatcatgctaatgatattgttaaaacagttactgaacgaaaaatcggaactgcaactaattcttcaactatttctaaaacagaaaatattgataaagaatctcctgtcggtaacttagcaacaacggctcagcttactattgctaagaaaacttttccaactgttgactttgctatgaccaataatggtggtattcgaagtgacctagttgtcaaaaatgaccggaccatcacctggggagctgcacaggctgtacaaccatttggtaatatccttcaagtcattcaaatgactggtcaacacatttacgatgtcctaaatcagcaatacgatgaaaaccagacctattttcttcaaatgtcaggtttaacatacacttatacagataatgatcctaagaactctgatacccccttcaagatagttaaggtttataaagacaatggtgaagaaattaacttaacaactacttacaccgttgttgtcaacgactttctttatggtggtggtgatggcttttcagcatttaaaaaagctaaattaatcggagctattaacacagatactgaagctttcatcacatatatcacaaatttagaagcatcaggtaaaactgttaatgctactataaaaggggttaaaaattatgtaacttcaaaccttgaaagttcgacaaaagttaatagtgctggtaaacacagtatcattagtaaggtttttagaaatcgtgatggcaatacagtgtctagtgaagtcatttcagaccttttgacttctactgaaaacactaataacagccttggcaaaaaagaaacaacaacaaacaaaaatactatctctagttccactcttccaataacaggggacaattataaaatgtctcctattatgacaatccttgccttgataagcttaggtggactaaacgcttttattaaaaaaaggaaatcc

SEQ ID NO: 1608 - protein, 683 aa, Streptococcus pyogenes
LIYNDYVNLLGDFMKKYFILKSSVLSILTSFTLLVTDVQADQVDVQFLGVNDFHGALDNTGTAYTPSGKIPNAGTAAQLGAYMDDAEIDFKQANQDGTSIRVQAGDMVGASPANSALLQDEPTVKVFNKMKFEYGTLGNHEFDEGLDEFNRIMTGQAPDPESTINDITKQYEHEASHQTIVIANVIDKKTKDIPYGWKPYAIKDIAINDKIVKIGFIGVVTTEIPNLVLKQNYEHYQFLDVAETIAKYAKELQEQHVHAIVVLAHVPATSKDGVVDHEMATVMEKVNQIYPEHSIDIIFAGHNHQYTNGTIGKTRIVQALSQGKAYADVRGTLDTDTNDFIKTPSANVVAVAPGIKTENSDIKAIINHANDIVKTVTERKIGTATNSSTISKTENIDKESPVGNLATTAQLTIAKKTFPTVDFAMTNNGGIRSDLVVKNDRTITWGAAQAVQPFGNILQVIQMTGQHIYDVLNQQYDENQTYFLQMSGLTYTYTDNDPKNSDTPFKIVKVYKDNGEEINLTTTYTVVVNDFLYGGGDGFSAFKKAKLIGAINTDTEAFITYITNLEASGKTVNATIKGVKNYVTSNLESSTKVNSAGKHSIISKVFRNRDGNTVSSEVISDLLTSTENTNNSLGKKETTTNKNTISSSTLPITGDNYKMSPIMTILALISLGGLNAFIKKRKS

SEQ ID NO: 1609 - DNA, 90 bp, Streptococcus agalactiae
ttggcctcagtttttagtgatgactatatttgtttctttttaagtaaacttcccacgagtccaagtattgcgacaccaaagaaagccaga

SEQ ID NO: 1610 - protein, 30 aa, Streptococcus agalactiae
MASVFSDDYICFFLSKLPTSPSIATPKKAR

SEQ ID NO: 1611 - DNA, 1125 bp, Streptococcus agalactiae
ttgaattgcgaggaacttctagcgacgttgaacgtatcgcaaatattatcgttgaaacattatcgaactttaaagcctaaaggaaatagtatggaaacaacattaaactacattaaaaccctgacatcaatcccttcaccaacagggtttacccaaacaatcatgacctatatcatcaaagaattggaagcgtttggctactcaccaattcgcacaaacaagggaggcgtcatggtttctctaaaaggaaaaaatgatactaaacatcgcatgataactgctcaccttgatacacttggtgctatggttagggccatcaaaccagatggtcggttaaaaattgaccttattggtggatatacatacaatgccattgaaggagaaaactgtactatacacctctcaaaaaatggtaaagaaatttctggaactgctcttattcatcaaactagtgtccatgtttacaaagacgctggaactgctgaacgtaatcaaacaaatatggaaattcgtttagatgagaaagtaacaactgctgacgaaacacgtgctttaggcatccaggtcggtgatttcatttcatttgatccgcgtacaatcataacagacagcggctttattaaatcacgttacctagatgacaaggtatccgctggtatcctaatggaacttctttctgtttacaagaaagaagacattcaacttccttatactactcatttctactttagtgcctttgaagagctaggacatggagcaaattcaagcatcccaaatgaaactgtagaatatctagcagttgatatgggagctatgggagacgatcaagaaactgacgaatatactgtctctatctgtgttaaagatgcttctggtccttatcattatgaattacgtcaacatcttgtttctctagctgaaaacaataatattccttataaacttgatatttatccttattatggtagtgacgcctccgctgccatgcgtgctggtgcggaagttaaacacgcgctacttggtgcaggtattgaatctagtcattcttatgaacgtacccatatcgattctattcaagcaactgaactcttagtggatgcctatctcaaaagcaatatggtggac

SEQ ID NO: 1612 - protein, 375 aa, Streptococcus agalactiae
MNCEELLATLNVSQILSLKHYRTLKPKGNSMETTLNYIKTLTSIPSPTGFTQTIMTYIIKELEAFGYSPIRTNKGGVMVSLKGKNDTKHRMITAHLDTLGAMVRAIKPDGRLKIDLIGGYTYNAIEGENCTIHLSKNGKEISGTALIHQTSVHVYKDAGTAERNQTNMEIRLDEKVTTADETRALGIQVGDFISFDPRTIITDSGFIKSRYLDDKVSAGILMELLSVYKKEDIQLPYTTHFYFSAFEELGHGANSSIPNETVEYLAVDMGAMGDDQETDEYTVSICVKDASGPYHYELRQHLVSLAENNNIPYKLDIYPYYGSDASAAMRAGAEVKHALLGAGIESSHSYERTHIDSIQATELLVDAYLKSNMVD

SEQ ID NO: 1613 - DNA, 495 bp, Streptococcus agalactiae
atggtagccacgctcattattatcaggggaaattcagctagcggaaagtctacaatagctaagcaacttcaagccgaattaggggaaaatacccttctcttatctcaggattaccttcgtagagagatgttaggaactaaggatggtgaaaatactactaccattccccttttgatcaatttactaaattatggttaccataactgttcctacatcatccttgaaggcatacttcgttctgattggtatacgcctgtttggaaacatattttaaaacataaccccaacaatacttatgcttattactatgatttaagctttcaagaaactgttaaaagacattcaactcgacttaaatctttagaatttggagaagattctcttgcaagatggtggcttgagaaagatttcttaaaagagatacctgaaaaaatattaacaaaagctatgagtttagaggatgtcaaaaaacttataatgaccgacgttttacct

SEQ ID NO: 1614 - protein, 165 aa, Streptococcus agalactiae
MVATLIIIRGNSASGKSTIAKQLQAELGENTLLLSQDYLRREMLGTKDGENTTTIPLLINLLNYGYHNCSYIILEGILRSDWYTPVWKHILKHNPNNTYAYYYDLSFQETVKRHSTRLKSLEFGEDSLARWWLEKDFLKEIPEKILTKAMSLEDVKKLIMTDVLP

SEQ ID NO: 1615 - DNA, 1035 bp, Streptococcus agalactiae
atgaaagaaaaacagtcgaaaaggcttatttatatactactggttgtttccattatttttataagtgtttttacatacagtattagccagccttctaaactacttccaccaaaagaattagttattctaagtccaaatagtcaagccattttaacaggaacgattccagcttttgaggaaaaatacggtataaaagttaagcttattcaaggtgggacagggcaactaatagatagattaagtaaggagggtaagcagttgaaggcggatattttctttggaggaaattatacgcaatttgaaagtcataaggcattgtttgagtcttacgtatcaaagaatgttcatactgttattccagactatatccatccaagtgatacggcgacaccttatactataaatgggagtgtcttgattgtaaataacgaattagctaagggacttaccatcaagagttatgaagatttattacagccttccttaaaaggtaaaattgcctttgcagatccgaatacttcctctagtgctttctcacaactcactaatatactcttggccaagggtggttacaccaatccaaaagcgtggaactatgttaaaaagctacaacataatattaatgctatcaaatcttctagctcttcagaagtttatcaatcagttgcagaaggaaaaatgattgtggggctgacttacgaagaccctagtgtcaatttgcaaaaaagtggtgccaatgtttctattgtatatccgacagaagggacagtttttgtcccatcttcggttgcaattataaagaatgctccttctatgaaagaagcaaagttatttattaattttatgctttctttagatgttcaaaatgcctttgggcagtcaacgagtaaccgacctattcgtaaagatgcccaaacgagtaatggcatgaaagctttaaaggatattgctactcttaaagaagattatcgctatgtcactaagcataagggccaaatccttaaaacctataatcgtattcgtagaaatgctgat

SEQ ID NO: 1616 - protein, 345 aa, Streptococcus agalactiae
MKEKQSKRLIYILLVVSIIFISVFTYSISQPSKLLPPKELVILSPNSQAILTGTIPAFEEKYGIKVKLIQGGTGQLIDRLSKEGKQLKADIFFGGNYTQFESHKALFESYVSKNVHTVIPDYIHPSDTATPYTINGSVLIVNNELAKGLTIKSYEDLLQPSLKGKIAFADPNTSSSAFSQLTNILLAKGGYTNPKAWNYVKKLQHNINAIKSSSSSEVYQSVAEGKMIVGLTYEDPSVNLQKSGANVSIVYPTEGTVFVPSSVAIIKNAPSMKEAKLFINFMLSLDVQNAFGQSTSNRPIRKDAQTSNGMKALKDIATLKEDYRYVTKHKGQILKTYNRIRRNAD

SEQ ID NO: 1617 - DNA, 1044 bp, Streptococcus pyogenes
atgttaaaactcaaacgcaaatggctattaagctttttgttagtaataattattctagcaatcgttaacgttgcaatgtatatattctcatcgtcaaaaaaagatagtgctaaagaattagttatcttgactcctaatagccaaactattttaacagggactattccagcctttgaggaaaagtatggggttaaagtaagattaatccaaggtgggacgggccaacttattgatcaattaggtcgaaaagataaaccattaaacgctgatattttctttggtggcaattacactcaatttgaaagccataaagatttatttgaatcttatgtttctccgcaggtttctactgtcatttcagattaccaattgcctagtcatcgcgcaaccccatatacgatcaatggcagtgtactgattgttaataacgaattagcaagaggacttcatattaccagttatgaggatttgctacaaccagctttaaaaggcaaaattgcttttgctgatcccaacagttcatcaagtgccttctcacagctgactaatatattgttagctaagggggggtacacaaacgctgacgcttgggcttacatgaagcgcttgttggtcaatatgaattctattagggctacgagttcttcagaagtctatcaatctgtcgctgagggtaagatgattgttgggctaacctacgaagatccttgtatcaacctgcaaaaaagtggtgccaatgtttccattgtttatccaaaagaaggaacggtgtttgtgccctcctctgttgctattatcaaacatgcgccaaacatgacagaggctaagctctttattaattttatgttatcacgtgatgtgcaaaatgcctttggccaatcaaccagtaaccgacccattcgtcaagatgcccaaaccagtcacgacatgaaagccttagaaacgatagctactttgaaagaggattatgcttatgttaccaagcacaagaaaaaaatagtggctacgtacaaccagttgcgccaacggttggaaaaagctaag

SEQ ID NO: 1618 - protein, 348 aa, Streptococcus pyogenes
MLKLKRKWLLSFLLVIIILAIVNVAMYIFSSSKKDSAKELVILTPNSQTILTGTIPAFEEKYGVKVRLIQGGTGQLIDQLGRKDKPLNADIFFGGNYTQFESHKDLFESYVSPQVSTVISDYQLPSHRATPYTINGSVLIVNNELARGLHITSYEDLLQPALKGKIAFADPNSSSSAFSQLTNILLAKGGYTNADAWAYMKRLLVNMNSIRATSSSEVYQSVAEGKMIVGLTYEDPCINLQKSGANVSIVYPKEGTVFVPSSVAIIKHAPNMTEAKLFINFMLSRDVQNAFGQSTSNRPIRQDAQTSHDMKALETIATLKEDYAYVTKHKKKIVATYNQLRQRLEKAK

SEQ ID NO: 1619 - DNA, 771 bp, Streptococcus agalactiae
atgtatagattacttatcgttgaggatgagcaccttattcgtaagtggttacgctatgctattgattatcaatcattgaatattttagtggttggtgaagcaaaagatggtaaagaaggagctcaattaattcaggaagagcagccagacattgttttaagtgatattaatatgccaattatgacagcattcgatatgtttgaggcaaccaaaggacaatcttatgccaaaattattttatctggctatgctgattttccaaatgcgcaatcagctattcactatggcgttcttgaatttttaacaaaaccactagaaaagcaagctttgattgattgtttaaaaacaattatggctagaattgaggaacataaggagaagcacctacaagagcatacagaattgtatttacctctaccacaagctaatgaccaagttcctgaagttattaaagatatgctagcatggattcatagccattttcatgggaaaattgtgattagccagttagctcacgatttaggttacagtgaaagttatctttacacagtcactaaaaagcaccttcatataactttgagtgattatataaatcaatatcgtattaatcaagccattcagttgatgtttagagaaccagacctaatggtttaccaaattgcagaagctgttggtatttatgattatcgttattttgatagggtttttaaaaagtacttgggtcagacagtaaaagcgtttaaggaagaacatatttttaaacaaatggat

SEQ ID NO: 1620 - protein, 257 aa, Streptococcus agalactiae
MYRLLIVEDEHLIRKWLRYAIDYQSLNILVVGEAKDGKEGAQLIQEEQPDIVLSDINMPIMTAFDMFEATKGQSYAKIILSGYADFPNAQSAIHYGVLEFLTKPLEKQALIDCLKTIMARIEEHKEKHLQEHTELYLPLPQANDQVPEVIKDMLAWIHSHFHGKIVISQLAHDLGYSESYLYTVTKKHLHITLSDYINQYRINQAIQLMFREPDLMVYQIAEAVGIYDYRYFDRVFKKYLGQTVKAFKEEHIFKQMD

SEQ ID NO: 1621 - DNA, 786 bp, Streptococcus pyogenes
atgtacaaattagtcattattgaagatgaacatattattaggaaatggttgcgatacgctattgattataaagctttagatattttggtcattggcgaggctaaagatggcaaagaaggagctgttttaatcaaagagagtcaaccagatatcgttttaaccgatattaacatgcccatcatgacagcttttgacatgtttgaagtaacaaaagatcaaacttacgccaaaattattttatctggctatgctgattttccaaatgcaaggtctgccatacactacggtgtacttgaatttttaacaaaaccgattgaaaaagcagctctttgggaatgtcttcaaaccattattgctaaaatagaaaagcaaaaggggtctaatcaaaaaacagatgcttgcgtctatattcccttaccccagatgactgatcagattcctgaagtagtcaaagatattttggagtgggtacatgctcattttcaagacaagatcagcacgagccgcctagctcatgacttagggtatagtgagagttatatctatcaaaatatcaaaaagcatcttcagatgcctttaagtgattacattaatcaatatcggattaatcaggcaattcaattgatgcaacaagaaccagatttaatggtatatgaaatagcacaagctgtaggtatttatgactatcgctattttgatagggtttttaaaaagtatctaggacaaactgtaaaggcttttaaagaagagcattttatgaaagataccgataggagtaagccatgt

SEQ ID NO: 1622 - protein, 262 aa, Streptococcus pyogenes
MYKLVIIEDEHIIRKWLRYAIDYKALDILVIGEAKDGKEGAVLIKESQPDIVLTDINMPIMTAFDMFEVTKDQTYAKIILSGYADFPNARSAIHYGVLEFLTKPIEKAALWECLQTIIAKIEKQKGSNQKTDACVYIPLPQMTDQIPEVVKDILEWVHAHFQDKISTSRLAHDLGYSESYIYQNIKKHLQMPLSDYINQYRINQAIQLMQQEPDLMVYEIAQAVGIYDYRYFDRVFKKYLGQTVKAFKEEHFMKDTDRSKPC

SEQ ID NO: 1623 - DNA, 135 bp, Streptococcus agalactiae
atggcgctagaattttttactgcgatgcgatcggctagaactctagatttttgtcgtaaaatcacaaaaataataactgatgatactagagaaaaaaggacgaccagagttactggtatcaggggacgatacatg

SEQ ID NO: 1624 - protein, 45 aa, Streptococcus agalactiae
MALEFFTAMRSARTLDFCRKITKIITDDTREKRTTRVTGIRGRYM

SEQ ID NO: 1625 - DNA, 1653 bp, Streptococcus agalactiae
atggaaatgagaggatatagaatggaagaacgctttaagaaacgactacaagatgatatctctaaacatttttcccgccagtctttaattttatccttgttattgattgcacttttcgtccttttttctttagcgcctcaacagataggtctttataaagatgttaattcagtttcctatagttataagcaattgattcaaaaacatgataccttattagatgacttaggtaaaaatagtttgaaaccatttgtctcaggacacttaggaagtgctgatttgagtaagcaatattatcatttaaggaatcatttacaaagtcaaacagaacttttagtattctcacctaatcaagaacttttgtttgctagtaattcacatttaggtaatttttttagtaagtctatttacattagtgaagttttagataaggctaaaataaatcaaaggctactaaaaattattgtggatagtgagggagggcattaccttgcactcattaagccaattatagttaataaaaaagtttcaggttatgcctttttattgatgaatgggaaagactttttacttccaacgaaggctattaactcagacttgattattgccgatcagctaaataatagctttacttttactaatcgtgattttatctcctctagtttagataaggtagatagtcaattcttaactagatattttagttttcacgatcatcgagcttttgttgttaggaaagtagctctgcaagacaatatcctactttacatgtatcgtcccctgataccagtaactctggtcgtccttttttctctagtatcatcagttattatttttgtgattttacgacaaaaatctagagttctagccgatcgcatcgcagtaaaaaattctagcgccataaatcaaatggtgctagatatggatgccatttcccgccaagaaaaatctagtattgagcttgatagtcaagatgaatttcaatatctatctgtgcaaatcaatcagatggtttcacggttaaaagatttacatgagaaaactcttgatttggaaacacaaaagttgttgtttgaaaagaggatgttagaagctcagtttaatcctcacttcctttataatacccttgagacaattttaataaccagtcactatgattcacaattaacagaaagaatcgttatacaactaacaaaattattgcgctatagccttagtggtagcacagaagcagctgtgcttaaggatgatttagcaatcattgaatcctaccttttgattaatcaagtgagatttgaagaattaacttacactatttcagtatctcctgaacttgaacacatgcgtgtaccaaaacttttcttgttaccgctaattgagaatgctattaaatatggcttaaaagaacgtcatgatgtagcaataaacatagatatttggcaagatagtgatggaatttggtttactgtttcaaataatggatcaggtattagtttggctaggcaacaagccatacgtacaatgttaagatcaactcactcgcatcatgggcttattaattcttatagacgattacaatatcaattttcaacagtattgttagagtttacgaagacagatgatgcttttcgagttagctatatagtaaaggag

SEQ ID NO: 1626 - protein, 551 aa, Streptococcus agalactiae
MEMRGYRMEERFKKRLQDDISKHFSRQSLILSLLLIALFVLFSLAPQQIGLYKDVNSVSYSYKQLIQKHDTLLDDLGKNSLKPFVSGHLGSADLSKQYYHLRNHLQSQTELLVFSPNQELLFASNSHLGNFFSKSIYISEVLDKAKINQRLLKIIVDSEGGHYLALIKPIIVNKKVSGYAFLLMNGKDFLLPTKAINSDLIIADQLNNSFTFTNRDFISSSLDKVDSQFLTRYFSFHDHRAFVVRKVALQDNILLYMYRPLIPVTLVVLFSLVSSVIIFVILRQKSRVLADRIAVKNSSAINQMVLDMDAISRQEKSSIELDSQDEFQYLSVQINQMVSRLKDLHEKTLDLETQKLLFEKRMLEAQFNPHFLYNTLETILITSHYDSQLTERIVIQLTKLLRYSLSGSTEAAVLKDDLAIIESYLLINQVRFEELTYTISVSPELEHMRVPKLFLLPLIENAIKYGLKERHDVAINIDIWQDSDGIWFTVSNNGSGISLARQQAIRTMLRSTHSHHGLINSYRRLQYQFSTVLLEFTKTDDAFRVSYIVKE

SEQ ID NO: 1627 - DNA, 1647 bp, Streptococcus pyogenes
atgcgaggtgaacaggtggaagaacattttaaaaaacaattacaagatgatatttctagacatttttcgtaccaatcgttaatgttatcattgttgctaattggtctttttattattttttcattagcgccacaacaattaggcctctatcgtgatatcaatgccactgcaacccgttatcaccgtttgattagcaaacaagaagccttgctggatgacttagggaaaaatagcttactaccttttttaaataaaaacctcagcactgctgatttaagcaagcactattttcatttgcgccatagcagccaaacgtcaccagaacttttactattttcacctagtcaagaccttttatttgctagtaacccacatttaggaaatgtttttagtaaatctgtttatattcaagaagtcttgagagcaactcattctccaaaaaccttgtttaaagatgctatggatagtgaagatggtcactacttgatgatcattatgccaatgatagatcaaaaccaactaaagggatatgcttttttagtgatgagtggcaaagattttcttcatcctacaaaaacattgacgtcagagttggtcattgctgataagctggacaatacgtttacgttttccaatcgtgagtttatagcatctagtctagataagatcaatagccagtatttacaccattattttgtttttcaagataatcgagcctttatcacaagaaaggttgccttacaaggaggtctttggctttacatgtataggcccttgattccaatggtatcggtgatgttattttcacttatttcatcagctgttatctttgtgattttgcaacgtaaatcaagtggtttagctaaccgaattgcagctaaaaattcaagagcaatcaatcaaatggttagagatatgagtgcgatctctcggcaagaaaaaagacgtattgaccttgagagtcaagatgaatttcaatatttatctgatcaaatcaatcaaatggtagagcgattgcaacagttacatgataaaacgttagatttggaaactcaaaaattattatttgaaaaacggatgttagaagctcaattcaatccgcatttcctctacaatacgctagaaaccattttgattacgagccattatgattctgccctaacagaaaaaattgttatccaattgacaaaattgttgcggtatagtctcacggattctagcaaacctgtcttgctcaaagatgatttaagtgtcatcgagtcttatttagtgattaatcaggtgcggtttgaagaattgcaatatagcattaacctatccccagaccttgatagtcttgaagtgcctaaattgttcttgttacctttgatagaaaatgccatcaaatatggcttgaaagaacgacacgatgtcaagattaacattgcttgttattatcaagatgaccacattattttttctgtgagagataatggttcgggaattgatgctcatcaccaaaaagtgattcgagagcaattggaagctggagagtcacaccatgggttaattaactcttatcgtcggcttaagtatcatttttcagaagtatccttggtttttgatcaaggtgataaacagtttaatgttagttaccatgttaaggag

SEQ ID NO: 1628 - protein, 549 aa, Streptococcus pyogenes
MRGEQVEEHFKKQLQDDISRHFSYQSLMLSLLLIGLFIIFSLAPQQLGLYRDINATATRYHRLISKQEALLDDLGKNSLLPFLNKNLSTADLSKHYFHLRHSSQTSPELLLFSPSQDLLFASNPHLGNVFSKSVYIQEVLRATHSPKTLFKDAMDSEDGHYLMIIMPMIDQNQLKGYAFLVMSGKDFLHPTKTLTSELVIADKLDNTFTFSNREFIASSLDKINSQYLHHYFVFQDNRAFITRKVALQGGLWLYMYRPLIPMVSVMLFSLISSAVIFVILQRKSSGLANRIAAKNSRAINQMVRDMSAISRQEKRRIDLESQDEFQYLSDQINQMVERLQQLHDKTLDLETQKLLFEKRMLEAQFNPHFLYNTLETILITSHYDSALTEKIVIQLTKLLRYSLTDSSKPVLLKDDLSVIESYLVINQVRFEELQYSINLSPDLDSLEVPKLFLLPLIENAIKYGLKERHDVKINIACYYQDDHIIFSVRDNGSGIDAHHQKVIREQLEAGESHHGLINSYRRLKYHFSEVSLVFDQGDKQFNVSYHVKE

SEQ ID NO: 1629 - DNA, 825 bp, Streptococcus agalactiae
atgaaatcacaggataatttgactaaagaagaccgtaaaatgcttcgctcagtcttctggcgctcatggacgatgaatgccagtcgtactggggcaacacaataccacgcagtaggagttatttatactttactaccagtcatcaatcgtttttataagactgataaggataaagcagaggcactggtccgtcatacaacatggtttaatgccaccatgcacattaataattttattatgggtcttgttgcatctatggaaaagaaaaacagtgaagatcctgattttgacgctagtgctatcaccgcagttaaggcttctttgatgggacctatatctggtgttggtgattcattcttttggggaattctaagggttattgcggcaggtatcggtatctccttagcaagtacaggctcagccatgggagctgttgtctttctactcttgtataacattccagcttttctgattcattattatagtctctatggaggttactctgtaggtgcagggtttatcaaaaaattgtatgaatcaggtggtattaaaattgttactaagacttcaagtatgcttggtttaatgatggtaggctcaatgactgcttcaaatgttaaattcaagacaatcttaacggtagcagctaaaggagctaaggaagcagcttccatacaaagttaccttgaccaattatttgttggcgtagtgccactgttggtaacgatattagccttctggcttctacgtaaaaaagtcaatatcaactggatcatgtttggtattatggtgttaggtattgtacttggtctcttaggtatttgc

SEQ ID NO: 1630 - protein, 275 aa, Streptococcus agalactiae
MKSQDNLTKEDRKMLRSVFWRSWTMNASRTGATQYHAVGVIYTLLPVINRFYKTDKDKAEALVRHTTWFNATMHINNFIMGLVASMEKKNSEDPDFDASAITAVKASLMGPISGVGDSFFWGILRVIAAGIGISLASTGSAMGAVVFLLLYNIPAFLIHYYSLYGGYSVGAGFIKKLYESGGIKIVTKTSSMLGLMMVGSMTASNVKFKTILTVAAKGAKEAASIQSYLDQLFVGVVPLLVTILAFWLLRKKVNINWIMFGIMVLGIVLGLLGIC

SEQ ID NO: 1631 - DNA, 825 bp, Streptococcus pyogenes
atgacatcacaagataatttgactaaagaagaccgtaaaatgcttcgctcagtcttttggcgctcatggacgatgaatgctagtcgtactggggcaacacaataccacgcagtaggggttatttacactttactaccagtcatcaatcgtttttataagactgataaggataaagcagaggcactggtccgtcatacaacatggttcaatgccaccatgcacatcaataactttatcatgggtcttgtggcatcgatggaaaagaaaaacagtgaagatcctgattttgatgctagtgctattacggcggtaaaagcatctctaatgggacctatctccggagttggagattccttcttctggggaattttaagggttattgcggcaggtatcgggatttccttggcaagtgcaggctcagccatgggagctgttgtcttcttactcttgtacaatattcctgcttttattattcactactatagcctttatggtggttattctgtaggtgcaggatttatcaaaaaactttacgaatctggtggtataaaaatcgtcactaaaacctcaagtatgcttgggttaatgatggtaggctcaatgacggcttcaaatgtaaaatttaaaacgattcttacagttgctgcgaaaggtgccaaagaagcagcttctattcaagattaccttgaccaattgtttattggtattgtaccattaatggtaacactagcagctttttggcttctacgaaagaaagtgaatatcatctggattatgtttggtatcatgttccttggcattatccttggacttttaggtatttgc

SEQ ID NO: 1632 - protein, 275 aa, Streptococcus pyogenes
MTSQDNLTKEDRKMLRSVFWRSWTMNASRTGATQYHAVGVIYTLLPVINRFYKTDKDKAEALVRHTTWFNATMHINNFIMGLVASMEKKNSEDPDFDASAITAVKASLMGPISGVGDSFFWGILRVIAAGIGISLASAGSAMGAVVFLLLYNIPAFIIHYYSLYGGYSVGAGFIKKLYESGGIKIVTKTSSMLGLMMVGSMTASNVKFKTILTVAAKGAKEAASIQDYLDQLFIGIVPLMVTLAAFWLLRKKVNIIWIMFGIMFLGIILGLLGIC

SEQ ID NO: 1633 - DNA, 807 bp, Streptococcus agalactiae
atgataatgccagcgacgatggcagctttagctgtattgatttgttttgggggaaattacttaacaggtcaaagtatgatggagagaccacttgtagttggtcttgtaacaggaatgctactaggtgatattaaggttggtatcctaatgggagcctccctagaagcgctatttttgggaaacgttaatattgggggtgttattgccgcagagccagtaacagcaacagcgatggcaacaacttttaccattatttcaaacattgatcaaaaagcagcaatgactctagctgttccgattggaatgttggcagcatttgttgttatgtttttgaaaaacgtcttcatgaatatctttgcaccgatggtggataaagctgcagccgcaaaccatcaaggtaaacttgtgatgcttcactatggtacatggattatttactatctcattatcgcttctatttctttcattggtattttagtaggtagtgggcctgttaatagttttgtccatcatattcctcaaaacctgatgaatggtttgagtgcggcgggaggcctccttccagctgttggttttgccatgctgatgaaattattatggacaaataaattagctgttttttacttgcttggttttgttttaacagcttatttaaaattaccagcggttgcagttgctgccctaggagcagttatttgcgtcattagttcacaacgtgatatagaattagacgcaattactagaggtgcgatcagtaaacagacaacctttgactctaaagaatcagaagaggaggacttcttcgca

SEQ ID NO: 1634 - protein, 269 aa, Streptococcus agalactiae
MIMPATMAALAVLICFGGNYLTGQSMMERPLVVGLVTGMLLGDIKVGILMGASLEALFLGNVNIGGVIAAEPVTATAMATTFTIISNIDQKAAMTLAVPIGMLAAFVVMFLKNVFMNIFAPMVDKAAAANHQGKLVMLHYGTWIIYYLIIASISFIGILVGSGPVNSFVHHIPQNLMNGLSAAGGLLPAVGFAMLMKLLWTNKLAVFYLLGFVLTAYLKLPAVAVAALGAVICVISSQRDIELDAITRGAISKQTTFDSKESEEEDFFA

SEQ ID NO: 1635 - DNA, 807 bp, Streptococcus pyogenes
atgttagtaccagcaacaatggcagctttagctgtattgatttgttttgggggaaattatttaaccggtcaaagcatgatggaaagacccctagtagttggactggtcacaggtcttcttttaggagatatgaaggtcggtatcttaatgggggcctctctagaagctcttttcctaggaaatgtgaatattgggggtgttattgcagctgagcctgtaacagcgactgccatggcaacaacctttaccattatttcacatattgaccaaaaagcagccatgaccctagctgttccaattggaatgttggcagcctttgtggttatgtttttgaaaaacgtcttcatgaatatctttgctccaatggttgataaagctgcagcagctaaccatcaaggtaaactagtgatgctccactatggcacttggattatctattacttaatcattgcctctatttctttcattggtatcttagtaggtagtggacctgttaatgcctttgtggaacacattcctcaaaatctcatgaatggcttgagtgctgcgggaggccttcttccagctgtcggttttgccatgctgatgaaattattgtggaccaacaaattagctgttttttacctattgggctttgtcttaacagcttatttgaaattaccagcggttgcagttgctgccctaggagcagttatttgcgtcattagttcccaacgtgatctagaattagacgcaattactagaggtgcaattagtaaacaaacaacctttgactctaaagaatcagaagaggaggacttcttcgca

SEQ ID NO: 1636 - protein, 269 aa, Streptococcus pyogenes
MLVPATMAALAVLICFGGNYLTGQSMMERPLVVGLVTGLLLGDMKVGILMGASLEALFLGNVNIGGVIAAEPVTATAMATTFTIISHIDQKAAMTLAVPIGMLAAFVVMFLKNVFMNIFAPMVDKAAAANHQGKLVMLHYGTWIIYYLIIASISFIGILVGSGPVNAFVEHIPQNLMNGLSAAGGLLPAVGFAMLMKLLWTNKLAVFYLLGFVLTAYLKLPAVAVAALGAVICVISSQRDLELDAITRGAISKQTTFDSKESEEEDFFA

SEQ ID NO: 1637 - DNA, 489 bp, Streptococcus agalactiae
atgattactcaaattcgtgttgacgaccgtttgattcacgggcaagtggcagttgtatggactaaagaattaaatgcaccacttttagtggtggctaatgatgaagctgcaaaaaatgaaatcacacagatgactcttaaaatggctgtgcctaatggcatgaaattattaatccgttcagttgaagaatcaatagctctatttaaagatccacgtgcaactgacaagcgcatttttgtgattgtcaattctgttaaagatgcctgtacaattgctaaaaatataaccgatttagaagcagtaaacgtcgctaatgtaggacgctttgataagtctgatccagctacaaaagtcaaactaacatcaagtctcttattaaatacagaagagttggaagccgcaaaagaattagccagcttaccagatttagacgtctttaaccaagtattgccttcaaatactaaggttaacttgagtcagttagtcaaa

SEQ ID NO: 1638 - protein, 163 aa, Streptococcus agalactiae
MITQIRVDDRLIHGQVAVVWTKELNAPLLVVANDEAAKNEITQMTLKMAVPNGMKLLIRSVEESIALFKDPRATDKRIFVIVNSVKDACTIAKNITDLEAVNVANVGRFDKSDPATKVKLTSSLLLNTEELEAAKELASLPDLDVFNQVLPSNTKVNLSQLVK

SEQ ID NO: 1639 - DNA, 489 bp, Streptococcus pyogenes
atgattacccaaattcgtgttgacgaccgtttgattcacgggcaagtggcagttgtatggaccaaagagttaaatgcgccgcttttagtagtggctaatgatgaagctgcaaaaaatgaaatcacacaaatgacgcttaaaatggctgtgccaaacggcatgaaactgcttattcgttcagttgaagactcgattaagctctttaatgatccacgcgccaaagacaagcgtatctttgtgattgtcaattctgttaaagatgcttgtgccattgctaaagaagttccagacttagaagctgttaatgtggctaatgtggggcgctttgataagtcagacccagcaagcaaagtcaaagtgacaccaagtcttttacttaacccagaagaaatggcagccgcaaaggaattagtcagtttaccagaacttgatgtctttaaccaagtcttaccatcaaataccaaggtccatttgagccaattagtcaac

SEQ ID NO: 1640 - protein, 163 aa, Streptococcus pyogenes
MITQIRVDDRLIHGQVAVVWTKELNAPLLVVANDEAAKNEITQMTLKMAVPNGMKLLIRSVEDSIKLFNDPRAKDKRIFVIVNSVKDACAIAKEVPDLEAVNVANVGRFDKSDPASKVKVTPSLLLNPEEMAAAKELVSLPELDVFNQVLPSNTKVHLSQLVN

SEQ ID NO: 1641 - DNA, 423 bp, Streptococcus agalactiae
atgaagcggaaattcctaatcggcagtcacggaaaacttgcgagtgggttgcagagttctattgatattctgacaggcaagggacaagagattcagacaatagatgcttacattgatgatagtgactatactaagtctattgtagaatttattgatgagattgcaccagatgaacaggggcttatttttacagatttgttaggtggcagcgttaatcagaaaatggcgactgctgtaatgaatagtgggaaaaataatatttttttaataacgaacagcaatttagcgaccttgttgtcattactatttttgaaacctgaagaggaattaactaaagaagaaattgtaaccgttatcaatgaatctcaagtgcagctggtagatcttagctttaaagcgggttcagaagatgactttttcgat

SEQ ID NO: 1642 - protein, 141 aa, Streptococcus agalactiae
MKRKFLIGSHGKLASGLQSSIDILTGKGQEIQTIDAYIDDSDYTKSIVEFIDEIAPDEQGLIFTDLLGGSVNQKMATAVMNSGKNNIFLITNSNLATLLSLLFLKPEEELTKEEIVTVINESQVQLVDLSFKAGSEDDFFD

SEQ ID NO: 1643 - DNA, 423 bp, Streptococcus pyogenes
atgaaacgaaaatttctcattgggagtcacggcagactagccagtggtttgcaaagctctattgacattttagcaggtatgggacaggcacttgaaaccattgatgcttatgttgatgatagtgactacactagccagattgatgactttatcgctggggtagcagcagatgagcagggccttatttttactgatttgttaggcggcagtgtgaatcagaaaatggtaaccgctgtaatgaacagtggcaaagacaatatctttttaatcacaaacagtaacttagccactttattgtcgttggtgtttttaaaaccaggcgaagcgcttactaaagatgaaattgtaaccgttatcaatgaatcgcaagttcagttagtggatttggtccctgagacaaattcagaagatgacttttttgat

SEQ ID NO: 1644 - protein, 141 aa, Streptococcus pyogenes
MKRKFLIGSHGRLASGLQSSIDILAGMGQALETIDAYVDDSDYTSQIDDFIAGVAADEQGLIFTDLLGGSVNQKMVTAVMNSGKDNIFLITNSNLATLLSLVFLKPGEALTKDEIVTVINESQVQLVDLVPETNSEDDFFD

SEQ ID NO: 1645 - DNA, 90 bp, Streptococcus agalactiae
gtgttaatgccaaggtcaccacaaaaatcacttttccttgatggtgtgcaactaaggaagttgattttaaacagtaagacactatgccaa

SEQ ID NO: 1646 - protein, 30 aa, Streptococcus agalactiae
MLMPRSPQKSLFLDGVQLRKLILNSKTLCQ

SEQ ID NO: 1647 - DNA, 1059 bp, Streptococcus agalactiae
atgttaaggatgaagagaagtcagtgcgtggataataagcagcataatacatcaatgattagtttgctacaataccttttttccatactggtcattttagttcatagtgggaggttatttagtcaggatgtcattcattttacctttaaaagtttcctaggtcggatggctgttccttattttttgatttgtactgctttctttttgagaggtcgtatacagcaaggtttgtgtaatcactcctactttcgtaaactgattaaaaagtatagcatgtggactatcatttatttgccttatggttatttcttttttgaatctctaaatatagcgaagatctatttgttgccggggtttattgtggcatttttgtatttaggtatgtcacataccctttggtacatccctgctgttattctaggttgggtcattattcaaggattattgaagtatgtaggaactagggggacatttatcacagttgttgtactctattgtattggagcagtagagacctattctgtctttatacagtcaacaaaattttatcccctgatgtccacttatatgtcaatttttcagacaacacgaaacggattattttacactccagtttatcttctagcaggatatttactctatgattattttaatactgacctatttaccaaatcgcgtggtcttaagtatattctcttccttttacttctagctttagagaatgttcttatttattttaatcaagggttggataaaaatttcttcttattagctcctttatgtgcagtattcttatttaactggagtatacgtacatcactgtttaaggaatatcgtttaagtcctttaaaacagttgagtgtctattatttcttccttccccctctttttattggcatagtgtcttactgtttaaaatcaacttccttagttgcacaccatcaaggaaaagtgatttttgtggtgaccttggcattaacacatgcttgtgctctactcataataaaggttgttaataagataccctatcaaaaaattattccattatctctttcgaaa

SEQ ID NO: 1648 - protein, 353 aa, Streptococcus agalactiae
MLRMKRSQCVDNKQHNTSMISLLQYLFSILVILVHSGRLFSQDVIHFTFKSFLGRMAVPYFLICTAFFLRGRIQQGLCNHSYFRKLIKKYSMWTIIYLPYGYFFFESLNIAKIYLLPGFIVAFLYLGMSHTLWYIPAVILGWVIIQGLLKYVGTRGTFITVVVLYCIGAVETYSVFIQSTKFYPLMSTYMSIFQTTRNGLFYTPVYLLAGYLLYDYFNTDLFTKSRGLKYILFLLLLALENVLIYFNQGLDKNFFLLAPLCAVFLFNWSIRTSLFKEYRLSPLKQLSVYYFFLPPLFIGIVSYCLKSTSLVAHHQGKVIFVVTLALTHACALLIIKVVNKIPYQKIIPLSLSK

SEQ ID NO: 1649 - DNA, 180 bp, Streptococcus agalactiae
atgataccaatctcttcagaagaatatctcaattatcccaaaaagtcattgaaacgccttaaatggtatctgataattattgttaataccttatcaaccatattaggaaataaaaaagctgatttcgcaaaagaaaatcagcttagaataatttcttgttcagataaccagtgggaacta

SEQ ID NO: 1650 - protein, 60 aa, Streptococcus agalactiae
MIPISSEEYLNYPKKSLKRLKWYLIIIVNTLSTILGNKKADFAKENQLRIISCSDNQWEL

SEQ ID NO: 1651 - DNA, 198 bp, Streptococcus agalactiae
gtgtctgtcgttgatactgagaaaatagttaataacttgtttatcacacctttattaaacatagccattaaaaagctaggagcaaaaaaggcaagcgttgaaacagcaaaagatgttaatggcgaatttgtgatacttgatataaagaaattaagactggctataaaaaggagtccaacaaattgtaagacaataata

SEQ ID NO: 1652 - protein, 66 aa, Streptococcus agalactiae
MSVVDTEKIVNNLFITPLLNIAIKKLGAKKASVETAKDVNGEFVILDIKKLRLAIKRSPTNCKTII

SEQ ID NO: 1653 - DNA, 1152 bp, Streptococcus agalactiae
atgatatcaatttttccttttgaattaaaaaaacttctacaacgtaaggcagcatttggggcttttattatcttccttcttgctatttttggtctattttaccagcatttttttgttgggcaaattagtggctattctgcagataaaatacatggtcgagaagcggttgccattaatcgtagaatagctgaaaaatattcaggggatttatctgaagaacgagtaacaaatattattaaaaactatgttaatccgccagcaggacgcccccctatatttgatgtttttagttattatgtggcagacacttttgatcgtgattttttaatttactataaccaattgaaagatgataaaacaattgattttaataaaataaatattaaagatcaaaaacagttgggttctgcgctaccactaaaacaactaaagctaggtaactttgctccttggaatcaacttttcgaagtaagtaatagtacttatattttaattgtcttatttactctattcttatcagctcctcttttttcaggagatagggctaagaagattaatcctatactactgacgactcggtatggacgtggtcagttgacctgggctaagttagctagtacaatgaccatcggtatttccacatttatcctagcatatgccctcattctgacggtatttgcagattattttggttttagtggttgggagacaagcgttcaactgaatttatactggacatcacctttggctaatattatgggatttcctgtacctatgacaatatcaactgcttttgttcatattattgtcttacaatttgttggactcctttttatagccagtcttaatttctttatatcaagtatcacaaattcgccattaacatcttttgctgtttcaacgcttgccttttttgctcctagctttttaatggctatgtttaataaaggtgtgataaacaagttattaactattttctcagtatcaacgacagacacttcagctttacttttaaaattatcacgtaatggtagtcatggctttttctttgatagtttttctgctaatgaaatctgtctgattagtctacgtatgttaattgcagtgttattgatagcctatacctatcgtttaatgcgacgaagaagttta

SEQ ID NO: 1654 - protein, 384 aa, Streptococcus agalactiae
MISIFPFELKKLLQRKAAFGAFIIFLLAIFGLFYQHFFVGQISGYSADKIHGREAVAINRRIAEKYSGDLSEERVTNIIKNYVNPPAGRPPIFDVFSYYVADTFDRDFLIYYNQLKDDKTIDFNKINIKDQKQLGSALPLKQLKLGNFAPWNQLFEVSNSTYILIVLFTLFLSAPLFSGDRAKKINPILLTTRYGRGQLTWAKLASTMTIGISTFILAYALILTVFADYFGFSGWETSVQLNLYWTSPLANIMGFPVPMTISTAFVHIIVLQFVGLLFIASLNFFISSITNSPLTSFAVSTLAFFAPSFLMAMFNKGVINKLLTIFSVSTTDTSALLLKLSRNGSHGFFFDSFSANEICLISLRMLIAVLLIAYTYRLMRRRSL

SEQ ID NO: 1655 - DNA, 864 bp, Streptococcus agalactiae
ttgaaaggagacaatactatgttattacagctagataatatcactaaaagctacgggaaaaaaatagtacttaaccagatttcctaccagtttactcctggtttgtatggactcttaggagcaaatggtactggcaaaacaaccttattaaatttgatgagccactttacattagcagatagtgggaatatttattggaatggacaggagcagtcggaagaattttatcgtcacattggttttttaccgcaacattttcgctattatgatcaatttactggcattgctttcttaaattatatcgctaccttaaaaggtgttgataaaaagaaagctaaacaagaaattcctagattactagagcttgttggtttaggcgatgtaggtaaaaagaagatttcatcatactccggtggtatgaagcaacgtttaggcattgctcaagcacttatcaatgatcctgaaatactcattctggatgaaccaactgttggacttgatcccaaggaacgggttaaatttcgccatattttgagtcagttatccaccaataaaattatcattttatcaacgcatattgtgtcggatgtggaagctgttgccaaagaaattatagtattaaaaaatggtaaatttatcgaacatggcaacaccgcacagctgttgaaaactattgagggaaaagtgtgggaaataacgactgaaccaggtttatctcagatacccaatattgctattgttaatgaaaaagtcttttcagatagtcgggtatttcgtgtagtgagtgatatttgtccgagtgattcggcacagttggttgttccgactctagaagatttctacatctatcattttagaggggag

SEQ ID NO: 1656 - protein, 288 aa, Streptococcus agalactiae
MKGDNTMLLQLDNITKSYGKKIVLNQISYQFTPGLYGLLGANGTGKTTLLNLMSHFTLADSGNIYWNGQEQSEEFYRHIGFLPQHFRYYDQFTGIAFLNYIATLKGVDKKKAKQEIPRLLELVGLGDVGKKKISSYSGGMKQRLGIAQALINDPEILILDEPTVGLDPKERVKFRHILSQLSTNKIIILSTHIVSDVEAVAKEIIVLKNGKFIEHGNTAQLLKTIEGKVWEITTEPGLSQIPNIAIVNEKVFSDSRVFRVVSDICPSDSAQLVVPTLEDFYIYHFRGE

SEQ ID NO: 1657 - DNA, 750 bp, Streptococcus agalactiae
gtgaatatttttatacttgaggatgattttgttcaacaagcccattttgaaaaaatcattaaagagattagagtacagtacaatctgcatttcaaaacagtagaaacgtttgctaaaccagttcaattattggaatcaatttatgaaataggtttacataatttatttttcttagatattgaaataaaaaatgatgagcagatgggcttagaggtagcaaaacaaattagacaagttgatccatatgctcagattgtttttgttacaactcattcagaattaatgcctttaacctttcgttatcaggtatcagctttagactatatcgataaaggactttcacaggaagagtttagccaaaggattgaggaagtattgttgtacgtagatggcatttgcaataagcccttagtggaaaattcattctactttaagtcgcgttacagccaggtacaattaccttttaacgatcttctttatatagaaacatcctcaagatcacatagagttgtcctttatactgaaaaagatagaatggaattcacagccactttgggggatattttaaaacaagaacctaggctctttcaatgtcatcgctcttttttagtaaatcccttaaatatttttaaagtggataggatagatagattagtttacttccaaaatggaacgacttgtctggtttcacgcaataaagtgagagatatagtatctatagtggataaatatcaaaaggatagaaaaaga

SEQ ID NO: 1658 - protein, 250 aa, Streptococcus agalactiae
MNIFILEDDFVQQAHFEKIIKEIRVQYNLHFKTVETFAKPVQLLESIYEIGLHNLFFLDIEIKNDEQMGLEVAKQIRQVDPYAQIVFVTTHSELMPLTFRYQVSALDYIDKGLSQEEFSQRIEEVLLYVDGICNKPLVENSFYFKSRYSQVQLPFNDLLYIETSSRSHRVVLYTEKDRMEFTATLGDILKQEPRLFQCHRSFLVNPLNIFKVDRIDRLVYFQNGTTCLVSRNKVRDIVSIVDKYQKDRKR

SEQ ID NO: 1659 - DNA, 738 bp, Streptococcus pyogenes
atgatgaacatttttattcttgaggatgattttatccagcagacacgcatagaatctatcgtagtaggcatcttaaaagagactagaataccatgtaatcagcttgaagtgttctcgactcctcaaaaattatttgagagtatccaagaaagaggagaccatcagctgtattttttagatattgaaattggtgaatatactcgttgtgggcttgaattagctgcagctattcgacaaaaagatcctaatgccgttattgtgtttgtcaccactcattcagaatttgctcctatttcttttaaatataaggtatccgctctagattttattgataaagcaggtggtcaaaaacagtttaaagaacaaatcgaagaatgtatccgatatacttacgatatgatgtctagtcgtgagtcaaaggacatgtttttatttgagactccacagacaagattaaaattgccctataaggatattttatactttgctacagccacaactcctcacaaagtttgtttatggactcagacagaaagattagagttttatggtaatctatctgagattcaagcagtagcaccgaaactttttttgtgccatagatcctaccttgtgaatctagataaggttgttcgaattgataagagtaagcagctcctttatttcgaaaatggtgattcttgtatggtatcacgattaaaaatgaaatgtctgtttgaacggtgggaggctcttcgc

SEQ ID NO: 1660 - protein, 246 aa, Streptococcus pyogenes
MMNIFILEDDFIQQTRIESIVVGILKETRIPCNQLEVFSTPQKLFESIQERGDHQLYFLDIEIGEYTRCGLELAAAIRQKDPNAVIVFVTTHSEFAPISFKYKVSALDFIDKAGGQKQFKEQIEECIRYTYDMMSSRESKDMFLFETPQTRLKLPYKDILYFATATTPHKVCLWTQTERLEFYGNLSEIQAVAPKLFLCHRSYLVNLDKVVRIDKSKQLLYFENGDSCMVSRLKMKCLFERWEALR

SEQ ID NO: 1661 - DNA, 828 bp, Streptococcus agalactiae
atgaaaggatactctatggcaaaatgcttaacgttaaatactcattcatggatggaagtaaatgctctaaagaaattatttgatttagcagagcatatcttccgtgaaaaatatgatatcatctgcctacaagaggtgaaccagagcatatcttcccctcttgctaagagtagtccaaattatcatccgattgaaggtacaccagctcttcatcaagataactttgccttgcaattagtgcattacctaaatcttcaaggtctacactatcattggacatgggcttataatcatattggttatagtaagtaccatgaaggggtagcgatactttctctgaaaccattaaagccagaggatattttagtttcagctgtagacgatgagactgattatcatactcgtcgtgctctggtagctgagaccactctgaatgacaaagtcgttacagtagttagcctccatttctcatggtttgagaaaggatttgcggaggagtggaaacgactagaaactaccctacttgaggtagaaactccacttttactcatgggtgactttaataatcctactggaaatcagggttatgaacttgttcttaatagtccattagcattaaaggatagccaccaaatagccaatcatgtatttggggaccatactattatggctgatattgatggttgggaagggaataaaaaggctcttaaagttgaccatatttttactagcgaagacctttcaatcagttcaagtcaagtagtttttgaaggtggtgaagcacctgtcgttagtgatcattacggcttggaaattaccatggatttc

SEQ ID NO: 1662 - protein, 276 aa, Streptococcus agalactiae
MKGYSMAKCLTLNTHSWMEVNALKKLFDLAEHIFREKYDIICLQEVNQSISSPLAKSSPNYHPIEGTPALHQDNFALQLVHYLNLQGLHYHWTWAYNHIGYSKYHEGVAILSLKPLKPEDILVSAVDDETDYHTRRALVAETTLNDKVVTVVSLHFSWFEKGFAEEWKRLETTLLEVETPLLLMGDFNNPTGNQGYELVLNSPLALKDSHQIANHVFGDHTIMADIDGWEGNKKALKVDHIFTSEDLSISSSQVVFEGGEAPVVSDHYGLEITMDF

SEQ ID NO: 1663 - DNA, 816 bp, Streptococcus pyogenes
atgaccaaggtattaacactgaatacccattcgtggatgcaagccaacactcttaaaaaattagttgctttggctgagcatattttagctgaaaaatacgatatcatttgcttgcaagaaatcaatcagttaatcgagagcgagctggccacagatttaccaagatatcaagctctttcagggacaccaagcattcataaagaccattttgcccttctcttgatccattatttacaaaaacgagggcagcactattattggtcttgggcttataaccatattggctatgacatttaccaggaaggcgtggcaatcttatcaaaacaacctattcatgtttcagatattctcgtgtcagcgatggatgatgaaacagactaccacaccagacgctcactcatagccaaaaccacgttagatggcaaagaagtcgctgttgtcaatgtgcacctatcttggtttgacaaggggtttttaggggagtgggagaaattagaaaaagaactgctcacactaaactgtcccttgctacttatgggagattttaacaatccaacggatcaagacggttatcaagtgatgatgggtagccccctagacctacaagatagccataagggtgctgaccacgtgtttggtgatcatagcatcgtggctgatattgatggctggcaaggtaacaaagaagccctcaaggtggaccatgtctttaccagtaaggacttcatcatccgatcttctaagattacctttgaaggcggagatgcgccagtcgtcagtgaccactatggtctagaagtgacattaggctggcgt

SEQ ID NO: 1664 - protein, 272 aa, Streptococcus agalactiae
MTKVLTLNTHSWMQANTLKKLVALAEHILAEKYDIICLQEINQLIESELATDLPRYQALSGTPSIHKDHFALLLIHYLQKRGQHYYWSWAYNHIGYDIYQEGVAILSKQPIHVSDILVSAMDDETDYHTRRSLIAKTTLDGKEVAVVNVHLSWFDKGFLGEWEKLEKELLTLNCPLLLMGDFNNPTDQDGYQVMMGSPLDLQDSHKGADHVFGDHSIVADIDGWQGNKEALKVDHVFTSKDFIIRSSKITFEGGDAPVVSDHYGLEVTLGWR

SEQ ID NO: 1665 - DNA, 2202 bp, Streptococcus agalactiae
gtgcataaaaggagattgaagatgaaaaataatgtcaaacagctctttagttttgaattttggcagaagtttgggaaggctttgatggttgttattgctgttatgccagcagcaggattgatggttagtattggtaactccattagtctattggatccatcaaatgttttattagggcgcatagctaatgttattgctcaaattggttggggagttattggtaacttacacatcttatttgcattggctattggtggtagctgggctaaagaacgtgccggtggtgcttttgcggctggcttatcctttattcttattaaccttattacagggaacttttttggtgttaaaacagatatgttagcagacagtaaagcaactgttcaaacggtatttggtgcaaccatcagagtttcagattactttgttaacgttcttgggcaacctgctcttaatatgggtgtatttgtcggtattatttcaggtttcgttggtgcaactgcctttaataaatattataactatcgtaaattaccagatgctttaacttttttcaatggaaaacgttttgttccatttgttgttatttatcgttcagtcattgttgcattaattttatcagtattttggccggttgttcaatcaggtatcaatggctttggtaaatggattgcaagttcacaagacagtgctccaatattagcaccatttgtctacggtacgttagagcgtttattgctcccatttggtttacaccatatgttaactattccaatgaactacacgcaactaggtggcacatacactgtccttacaggtgcaactaaaggagcacaggtgttgggacaagatccactgtggttagcatgggttggtgatttaattaacttaaaaggctcaaattcaagtcaataccatcacttattgacaagtgtcactccagcacgttttaaagtggggcaaatgattggtgcttcaggtattttgatgggattatcttatgctatgtatcgtaacgttgataaagataaaaaattgaaatacaagtcaatgtttatttcagcagcagcggctactttcttgacaggtgttactgagccaattgagtacatgttcatgtttgcagcaatgccactctaccttgtatatgctgtcgttcaaggatgtgcgtttgctatggcagatattgttaacctccgcgttcattcatttggtaatatagaatttttaacacgtgttcctatgggcataaaagcgggccttggtggtgatattttcaactttgtttgggtgacacttctttttgcagtattgatgtactttattgcaaactttatgattaaaaaattcaatttagcaacagcaggacgtaatggtaattatgataacgaagaggttgataatgctccttcaacagcttctggttctgctgatgcaaattctcaagttgtacaagttattaatttacttggtggtcgtgataacattgaagatgtagatgcatgtatgactcgtcttcgtgtcacagttaaagatggaaatagcgtgggttctgaagcagcttggaaaaaagctggtgcaatgggattggtgttaaaaggtaatggcgttcaagctatttacggacctaaagcagatgtccttaaatcagacattcaagatttgctagattcaggtacagttattccaatagttgatttagaaacaggtcaacctgtagcagcagccccagttacaacttataaaggaataacagaagaaattgtttcggtggctaatggtcaagtagaagcattggatgttgttaaagaccctgtcttttctcaaaaaatgatgggtgatggctttgctgtggaaccaactgatggcaatatttatgttccagtttcaggtacagttactagtgtctttccaacaaaacatgcttttggtttattaacagaaagtggcctagaagttttagtacatatcggtctagatacagtagctcttgatggtcaaccatttgaggttaaaatttctagtggtcaaaaagtggtagcaggcgatcttgctgtagtagcagatttggaagctatcaaagcagctggtaaagagacaagtgtgattatcgtctttacaaatgtttcagatataaaaactgttaaacttgaaaaatcaggtccacaaatagctaaaacagttgtggcaaaagtcgaactg

SEQ ID NO: 1666 - protein, 734 aa, Streptococcus agalactiae
MHKRRLKMKNNVKQLFSFEFWQKFGKALMVVIAVMPAAGLMVSIGNSISLLDPSNVLLGRIANVIAQIGWGVIGNLHILFALAIGGSWAKERAGGAFAAGLSFILINLITGNFFGVKTDMLADSKATVQTVFGATIRVSDYFVNVLGQPALNMGVFVGIISGFVGATAFNKYYNYRKLPDALTFFNGKRFVPFVVIYRSVIVALILSVFWPVVQSGINGFGKWIASSQDSAPILAPFVYGTLERLLLPFGLHHMLTIPMNYTQLGGTYTVLTGATKGAQVLGQDPLWLAWVGDLINLKGSNSSQYHHLLTSVTPARFKVGQMIGASGILMGLSYAMYRNVDKDKKLKYKSMFISAAAATFLTGVTEPIEYMFMFAAMPLYLVYAVVQGCAFAMADIVNLRVHSFGNIEFLTRVPMGIKAGLGGDIFNFVWVTLLFAVLMYFIANFMIKKFNLATAGRNGNYDNEEVDNAPSTASGSADANSQVVQVINLLGGRDNIEDVDACMTRLRVTVKDGNSVGSEAAWKKAGAMGLVLKGNGVQAIYGPKADVLKSDIQDLLDSGTVIPIVDLETGQPVAAAPVTTYKGITEEIVSVANGQVEALDVVKDPVFSQKMMGDGFAVEPTDGNIYVPVSGTVTSVFPTKHAFGLLTESGLEVLVHIGLDTVALDGQPFEVKISSGQKVVAGDLAVVADLEAIKAAGKETSVIIVFTNVSDIKTVKLEKSGPQIAKTVVAKVEL

SEQ ID NO: 1667 - DNA, 2184 bp, Streptococcus pyogenes
atgaaaacatcattcaagcaactgtttcgtttcgaattttggcaaaaatttgggaaatgtcttatggtcgttattgctgtcatgccagcggctggtttaatgatcagtatcggaaactctattccaatgattaaccacgactcagcatttttggcatctctaggcaacattatcgctcaaattggttgggctgttattgttaaccttcacttgctatttgccttggccattggtggtagttgggctaaagaaagagctggaggggcctttgcctcagggcttgcttttgtcttgatcaatcggataacaggtgctttttatggcgtgtctagtactatgctagctgatccagaagcaaaaatcacaagcctccttggcactcaaatgatcgttaaagattatttcaccagtgtcttggaatctccagctttaaacacaggggtttttgttgggattattgcagggttcgtaggagcaacggcctataacaaatactataattaccgtaaacttcctgaagttttgaccttctttaatgggaagcgttttgtaccatttgtcgttattttacgttctatttttgtagcccttattttggttgttgtttggccggtgatccagtctgggattaacagttttgggatgtggattgcctcttcacaagattcagctccaatcctagccccattcctatatggtaccttggaacgtctcttgttgccatttggtcttcaccacatgttgacgatcccaatgaactatacagctcttggtggaacttatgaggtcatgacaggtgcagcagcggggacaaaagtatttggtcaagaccctttgtggcttgcttgggtaactgaccttgttcaccttaaaggatcagacgcttcagcctatagtcacttaatggatagtgtgactccagctcgtttcaaagtaggacaaatgattggagctaccggaacattgatgggggttgccttagccatgtaccgtaatgtggatgccgataaaaaacacacatacaaaatgatgttcatctcagcagcggcagcggtctttttgacaggggtaactgagccacttgagtacctatttatgtttgcagcaatgccactttacatcgtctatgcccttgttcaaggagcttcatttgccatggcagaccttgtgaatctccgtgttcactcatttggaaatatagagctactaacccgcacccctatggctcttaaagcaggcctaggcatggatgtgattaactttgtttgggtttctgtcctctttgcagttatcatgtactttattgcagatatgatgatcaagaaaatgcatctcgcaacagctggccgtttaggcaactacgatgccgatatactgggtgaccgtaacactcaaacaagacctacccaagtagcagatagcaactctcaagtcgtgcaaatcgttaatctccttggtggggcaggcaatattgatgatgttgatgcttgtatgacgcgcttacgagtgacggtcaaagaccccgctaaggttggtgctgaggacgattggaaaaaagctggcgctataggcttgatccaaaaaggcaacggcgttcaagcggtctatggccctaaagcagatattttgaaatcagatattcaagatttgctggactcaggtgctcttattccagaagtcaatatgtcacagctcactagcaaaccgactcccgcaaaagattttaaacacgtgacagaagatgtgctatcagtggcagacgggatggttctcccaatcacaggtgtaaaagaccaggtgtttgcggctaagatgatgggagatgggtttgcggttgaaccaacccatggtaatatctatgcacccgtagctggccttgtgaccagtgtctttccgaccaagcatgcctttggtttactgacagataatggtcttgaagtgctggtgcacgtgggacttgataccgtcgccttaaatggtgtgcctttttcagtcaaagtctcagaagggcaacgggttcatgcaggtgacctattagtcgtagcagatcttgctgctattaaatcagcagagcgtgaaacaatcattgttgttgcttttaccaacacaacagagatccaagatgtgaccttgacatctttaggagctcagcctgctaagactaaagtagctaccgtagaactt

SEQ ID NO: 1668 - protein, 728 aa, Streptococcus pyogenes
MKTSFKQLFRFEFWQKFGKCLMVVIAVMPAAGLMISIGNSIPMINHDSAFLASLGNIIAQIGWAVIVNLHLLFALAIGGSWAKERAGGAFASGLAFVLINRITGAFYGVSSTMLADPEAKITSLLGTQMIVKDYFTSVLESPALNTGVFVGIIAGFVGATAYNKYYNYRKLPEVLTFFNGKRFVPFVVILRSIFVALILVVVWPVIQSGINSFGMWIASSQDSAPILAPFLYGTLERLLLPFGLHHMLTIPMNYTALGGTYEVMTGAAAGTKVFGQDPLWLAWVTDLVHLKGSDASAYSHLMDSVTPARFKVGQMIGATGTLMGVALAMYRNVDADKKHTYKMMFISAAAAVFLTGVTEPLEYLFMFAAMPLYIVYALVQGASFAMADLVNLRVHSFGNIELLTRTPMALKAGLGMDVINFVWVSVLFAVIMYFIADMMIKKMHLATAGRLGNYDADILGDRNTQTRPTQVADSNSQVVQIVNLLGGAGNIDDVDACMTRLRVTVKDPAKVGAEDDWKKAGAIGLIQKGNGVQAVYGPKADILKSDIQDLLDSGALIPEVNMSQLTSKPTPAKDFKHVTEDVLSVADGMVLPITGVKDQVFAAKMMGDGFAVEPTHGNIYAPVAGLVTSVFPTKHAFGLLTDNGLEVLVHVGLDTVALNGVPFSVKVSEGQRVHAGDLLVVADLAAIKSAERETIIVVAFTNTTEIQDVTLTSLGAQPAKTKVATVEL

SEQ ID NO: 1669 - DNA, 111 bp, Streptococcus agalactiae
ttgtttaaaggctctgatactttttttgctatatatcgtgcaattaatacagataaaataatagcaagtaagatgataattgctaagggacttatcataccaaggagaaga

SEQ ID NO: 1670 - protein, 37 aa, Streptococcus agalactiae
MFKGSDTFFAIYRAINTDKIIASKMIIAKGLIIPRRR

SEQ ID NO: 1671 - DNA, 1677 bp, Streptococcus agalactiae
ttggataccgtttggaggaaagacatgactaaaaaaattttccgtacaactttatctgctagtttgggaattgttttagttacaattttgatgattatgggatttctctataattacttcaatcacattcagcgagaacagttgagaacacaaacggcactggcgtcacaaggaatttcctttgaaggtaaagattattttgaaaatcttaaaacttcaaatgtgcgtattacttgggtagataataagggacaagtgctttatgatacccaatcagatgcaaaacatatgaaaaatcacgccaatcgtcaagaaattaaagaagctatcaagagtggttatggtgagagcacgaggtggtcagcgacacttactgagaagtctatctatgctgcgcaacgtttaaataatggaacgatagttcgtttatcagttgcgcaacaaactattttttatcttctccttggtatgataagtcccttagcaattatcatcttacttgctattattttatctgtattaattgcacgatatatagcaaaaaaagtatcagagcctttaaacaatattgacttagatcatcctttatcaaatgatagttacgaggagataacaccattattaaggcgtcttgatagccatcaggctaagattcaacatcaaaaactgttattacaaaagcgtcaaaaagaatttgataccattatttctaaaattaaggaaggaatgattcttttagatgatcaagcaagaatcgttagtatcaacgcagaagctttaaagttattccaaattaatgatgattggcatgggcgctttatgatggaagttagccgagatttaactctcaaagacttaatcgatcaaggactaaaagggaaaaagaaagaggctaatattggcattgaaaataatcattaccgcgtcttggtaagaccaactacagataacaaccgagtaacaggattggttgttctactgtttgatgtgactgatcaactccaaatggaacaacttcaacgtgaatttactgccaatgtctctcatgaattgaaaaccccgcttcatgttatttctggttactcagaactgttagctaatcaaatggttccaaacgaagaagtcccacaatttgcagctaaaattcataaagaatctgaacgattagttaaattggttgaggatattatcaacctttctcaccttgatgaacaagaaaaattaccgcaagagacagtaaatctgtatgacttaacacaaaaagttttagaaggtttacaagctaaagcagataagaagcacatacaaatcaattttaatggagaagaagctattttgcgagggaatccagttttattgaattccttggtgtacaacttgtgtgacaatgctatcacctataaccatgagaaaggtcaagtaaatgtgactttgaaaaattcacctgatacaattaccttagaagttagtgatacgggactaggcattgcagagaaggacaaaaaacgtattttcgaacgtttctatcgcgtcgataaaagtcgctcaaaaatagttggggggactggtttaggtttgtctattgtaaagagtgctttagattttcacaatggtagtataaaagtggacagccatttggggcagggaacaacaatgaccgttttacttcacaaacaa

SEQ ID NO: 1672 - protein, 559 aa, Streptococcus agalactiae
MDTVWRKDMTKKIFRTTLSASLGIVLVTILMIMGFLYNYFNHIQREQLRTQTALASQGISFEGKDYFENLKTSNVRITWVDNKGQVLYDTQSDAKHMKNHANRQEIKEAIKSGYGESTRWSATLTEKSIYAAQRLNNGTIVRLSVAQQTIFYLLLGMISPLAIIILLAIILSVLIARYIAKKVSEPLNNIDLDHPLSNDSYEEITPLLRRLDSHQAKIQHQKLLLQKRQKEFDTIISKIKEGMILLDDQARIVSINAEALKLFQINDDWHGRFMMEVSRDLTLKDLIDQGLKGKKKEANIGIENNHYRVLVRPTTDNNRVTGLVVLLFDVTDQLQMEQLQREFTANVSHELKTPLHVISGYSELLANQMVPNEEVPQFAAKIHKESERLVKLVEDIINLSHLDEQEKLPQETVNLYDLTQKVLEGLQAKADKKHIQINFNGEEAILRGNPVLLNSLVYNLCDNAITYNHEKGQVNVTLKNSPDTITLEVSDTGLGIAEKDKKRIFERFYRVDKSRSKIVGGTGLGLSIVKSALDFHNGSIKVDSHLGQGTTMTVLLHKQ

SEQ ID NO: 1673 - DNA, 675 bp, Streptococcus agalactiae
atgatatattgtgttgaagatgatgctgatattcgcgaaatgatgctctatactttgcaaatggcaggttttaaagctcaaggattttcgagttcagagcttttttgggaagctattcaggagaaagttccagacttgattttgcttgatattatgttgccgggagatgatggtttgactattttagagcgtttaaggagaaaacatcaaacggaaatgataccagtaatcatgacaactgctaaaggtagtgagtatgataaagttaaagggttagatcttggagcagatgattatctcgtcaaaccttttgggatgatggaaatgatttcacgaataaaagcagtcttgagacgtagccgccaagtagattcaaaagctcatattatcattggaaatttagagattgatccgactaattattgggtcaaaaggggaacggaaaaaatccacttaaccctaaaggaatttgagttattagtattattcttccgtaatcccaatagagtctttacaaggcaagaacttctggataaggtttggggagaacaatttttaggagaaactagaactgtggatgttcacattgggacactgcgaacaaaacttggtgaggatggctatttgattgctacagtaaggggagttggataccgtttggaggaaagacatgac

SEQ ID NO: 1674 - protein, 225 aa, Streptococcus agalactiae
MIYCVEDDADIREMMLYTLQMAGFKAQGFSSSELFWEAIQEKVPDLILLDIMLPGDDGLTILERLRRKHQTEMIPVIMTTAKGSEYDKVKGLDLGADDYLVKPFGMMEMISRIKAVLRRSRQVDSKAHIIIGNLEIDPTNYWVKRGTEKIHLTLKEFELLVLFFRNPNRVFTRQELLDKVWGEQFLGETRTVDVHIGTLRTKLGEDGYLIATVRGVGYRLEERHD

SEQ ID NO: 1675 - DNA, 654 bp, Streptococcus agalactiae
atgattcgttcacgatttgcaagtcaacttaatgaccttaataaagaaattatttttatgggggcattgtgtgaggacatcattgggaagtccttaggtgctctaacaaatagtaatgacgtttaccttgacgatatttctgaaacttatcacaagattgaacaaatggaacgggatattgaggagagatgtttaaaacttttactccgtcagcaaccagttgccaaggatttacgccgtatttcttctgcattaaaaatggtttatgatatgaaacgtattggtgctcaagcttatgaaattgcggaaattgttagtttaggtcatattatccaaggttcaggttctgaaagggatcaacttaacagcatgtctaataatgtcattagtatgctgactaagagtatagatgcttttatttatgacaatgaagaacaagcgcatcaagtaattgaacaagataggacagttaaccaggaatttgatacaataaagaaacagttagtgttatatttttcggtacaggatgttgatggtgaatatcccatagatgttttaatgatcgccaagtacctagagcgtattggtgatcatacagtaaatattgctaagtgggtgcttttctcaataacaggtaacctagatggagaagcg

SEQ ID NO: 1676 - protein, 218 aa, Streptococcus agalactiae
MIRSRFASQLNDLNKEIIFMGALCEDIIGKSLGALTNSNDVYLDDISETYHKIEQMERDIEERCLKLLLRQQPVAKDLRRISSALKMVYDMKRIGAQAYEIAEIVSLGHIIQGSGSERDQLNSMSNNVISMLTKSIDAFIYDNEEQAHQVIEQDRTVNQEFDTIKKQLVLYFSVQDVDGEYPIDVLMIAKYLERIGDHTVNIAKWVLFSITGNLDGEA

SEQ ID NO: 1677 - DNA, 651 bp, Streptococcus pyogenes
atgttaagaacgaaatttgaagaagaattagataaattgcataaccagttttattcaatgggaatggaagtattggcacaaatcaataaaactgttcgtgcctttgttagtcatgatcgtgaattggccaaagaagttatcgaagaagatgacactattaataattttgagacaaagcttgaaaagaaatcgctggaaattattgccctacaacagccagtttcgaatgatcttagaatggttattactgttttaaaggcatcaagtgatattgaacgtatgggtgaccatgctgcttcgattgccaaggccactattcgtatgaaaggtgaggagcgtattccagtggttgaagaacaaatcaaccttatgggaaaagctgtgaaacagatggtagaagaagcccttaatgcatatatcaatgctgacgatacaaaagcttatgaaatcgcagcttctgatgagattatcgatcaatatttccgtaatatccaaaccttagctgttgaagaaatccgtaagtctccagatgctgtttttgccggaaaagaatattttcaagtattaatgtatttggaacgtattggtgactatgctcgcaacatttgtgaatggattgtttatcttaaaactggaaaaattattgaatta

SEQ ID NO: 1678 - protein, 217 aa, Streptococcus pyogenes
MLRTKFEEELDKLHNQFYSMGMEVLAQINKTVRAFVSHDRELAKEVIEEDDTINNFETKLEKKSLEIIALQQPVSNDLRMVITVLKASSDIERMGDHAASIAKATIRMKGEERIPVVEEQINLMGKAVKQMVEEALNAYINADDTKAYEIAASDEIIDQYFRNIQTLAVEEIRKSPDAVFAGKEYFQVLMYLERIGDYARNICEWIVYLKTGKIIEL

SEQ ID NO: 1679 - DNA, 759 bp, Streptococcus agalactiae
gtgagtcgaacagtgagtaaattagtaattaataatttagatttgtattatggagaatttcacgctctgaaggatgttaatttagacattgaagaaaaagaaatcacagcctttattggaccttctgggtgcggaaagtctactctcttgaaaagtattaaccgtatgaatgatttggtcaaaaattgcaaaatcacaggggatattactttagaaggcgaggatgtctatagacaattggatattaaccaattgcgtaaaaaggttggaatggtgtttcaaaaacctaatccgtttccaatgagcatttatgataatgttgcttttggtccaagaacgcacggtattcattccaaagcagagttagatgatatcgttgaacgttcccttaaacaggcggctctatgggatgaggttaaagatcgtcttcacaaatctgctctgggtatgtctggcggacagcagcaacgtttgtgtattgcgcgtgctcttgctattgagcctgatgttttacttatggatgaacccacaagtgccttggatcctatttcaacagcaaaaattgaagaattggttatccaactgaagaagaactacactattgttatagtgacacataatatgcaacaagctgttcgtatttctgataaaacagcattctttctgatgggagaagtggttgaatataacaaaacgagccaactcttttcattgccacaagatgagcgtacagaaaactacattacagggagattcgga

SEQ ID NO: 1680 - protein, 253 aa, Streptococcus agalactiae
MSRTVSKLVINNLDLYYGEFHALKDVNLDIEEKEITAFIGPSGCGKSTLLKSINRMNDLVKNCKITGDITLEGEDVYRQLDINQLRKKVGMVFQKPNPFPMSIYDNVAFGPRTHGIHSKAELDDIVERSLKQAALWDEVKDRLHKSALGMSGGQQQRLCIARALAIEPDVLLMDEPTSALDPISTAKIEELVIQLKKNYTIVIVTHNMQQAVRISDKTAFFLMGEVVEYNKTSQLFSLPQDERTENYITGRFG

SEQ ID NO: 1681 - DNA, 801 bp, Streptococcus pyogenes
atgacagaatacaattggaatgaacgtcatatcatcacttttcctgaagaaacgcttgctctagctaccaaggatttacatgtttactatggtgcgaaagaagctatcaaagggattgatatgcagtttgaaaaacataaaataacagccttgattggtccatctggttgtggcaaatcaacttatcttcgtagtcttaaccgcatgaacgataccattgatattgctcgggttacaggtgagattctttatcagggcattgatgttaatcgaaaagacatgaatgtttacgagattcgcaagcacttaggaatggtttttcaaagacccaatcctttcgctaaatccatttataaaaacattacctttgcccatgaaagagctggtgtgaaagacaaaaaagttttagatgaaattgttgagacttcactgaaacaagccgcgctttgggatcaagttaaagatgaccttcacaaatcagccttcaccttatcagggggtcagcaacaacgcttgtgtattgctagagccatttctgtcaaacctgatattctattaatggatgaaccagcctctgcccttgacccgattgcaacgatgcagctggaagaaaccatgtttgaattgaagaagaattacacgattattattgtgacccacaatatgcaacaagcagctcgtgccagtgattacactgccttcttctatttaggcaacctcattgaatatgataagacacgtaatattttccaaaatgcgcaatgtcagtcaacaaacgactacgtttcagggcactttggt

SEQ ID NO: 1682 - protein, 267 aa, Streptococcus pyogenes
MTEYNWNERHIITFPEETLALATKDLHVYYGAKEAIKGIDMQFEKHKITALIGPSGCGKSTYLRSLNRMNDTIDIARVTGEILYQGIDVNRKDMNVYEIRKHLGMVFQRPNPFAKSIYKNITFAHERAGVKDKKVLDEIVETSLKQAALWDQVKDDLHKSAFTLSGGQQQRLCIARAISVKPDILLMDEPASALDPIATMQLEETMFELKKNYTIIIVTHNMQQAARASDYTAFFYLGNLIEYDKTRNIFQNAQCQSTNDYVSGHFG

SEQ ID NO: 1683 - DNA, 876 bp, Streptococcus agalactiae
atggaaaatattaaccaaagaacgtcaaaacaatatttagcatctttaaaaaaagatcccctttccttctttctttttgctattgtctatttgggagcaattctaagttttgctacaattgcatttgttgttatttatattttagttaaggggcttcctcatgtgaatactggcttgtttgcatggacttataatactcagaacgtttcactattaccagctttcattaacactatctttatcatcgccttaactttattatttgcagttccacttggtattggtggatcaatttatctaacggaatatgctagacgtgataatccttatctcaaaattatccgtgttgcaaccgagacattggcagggataccttcaattatttatggtttgtttggtgcattattttttgtaaaatacacacacttaggcttatctttgatatcgggttctctgactttgagcatcatgattttacctttgattatgaggacaactgaagaagctttactatctgttccggattcttatcgagaaggagcctttgcgcttggtgctggtaaattgagaaccatatttaaaatcgtattacctagtgctatgtctggtatttttgctggtattattttagcggtaggacgtatcattggtgagtcagcagcacttattttcacagctggaacagttgcaaaagtagcacattcggtatttagttcatctcgtactttagcagtacatatgtatgctatttcgggtgagggcttatatgttgaccaaacttatgcgactgcggtcatcttattgcttttagttattattgtcaattttgtatctggactagtagccaaacgattaggaagtgagtcgaacagtgag

SEQ ID NO: 1684 - protein, 292 aa, Streptococcus agalactiae
MENINQRTSKQYLASLKKDPLSFFLFAIVYLGAILSFATIAFVVIYILVKGLPHVNTGLFAWTYNTQNVSLLPAFINTIFIIALTLLFAVPLGIGGSIYLTEYARRDNPYLKIIRVATETLAGIPSIIYGLFGALFFVKYTHLGLSLISGSLTLSIMILPLIMRTTEEALLSVPDSYREGAFALGAGKLRTIFKIVLPSAMSGIFAGIILAVGRIIGESAALIFTAGTVAKVAHSVFSSSRTLAVHMYAISGEGLYVDQTYATAVILLLLVIIVNFVSGLVAKRLGSESNSE

SEQ ID NO: 1685 - DNA, 885 bp, Streptococcus pyogenes
atgaacgctaaaaaagtcgataaagtagcaactggtactctttataccattgctggaattattgtagctattttagcttccttaattctatatatccttgtccgtggcttgccacacatcagctggtcctttttaacaggaaaatcgtcttcgtacgaagctggtgggggaattggtatccagttgtataattccttcttcctattgattgttactttaattatttccattcctttatcaactggagcggggatttacttggctgaatatgccaaaaaaggacctgttaccaactttattagaacctgtattgagattctgtcttccctaccatctgtggttgtggggctctttggttacttgattttcgttgtgcagtttgaatatggcttttctattatttcaggggctcttgctttgacggtctttaatcttcctcaaatgacccgtaatgttgaagatagtttactgcatgttcatcatacccaaagagaagcaggattagctttaggcctgtcacgctgggaaacggttttttatgtggttatcccagaagctctcccgggaatggtaacaggtattgtcttagcttcaggtcgtatttttggtgaagcggcagcgcttatctatactgctggtcaatcagcaccagctctggattggtcaaattggaatccacttagtgttactagtccaatctctattttccgtcaatctgagacccttgctgttcatatttggaaagtcaatagcgaagggacaattccagatgctactcttgtatccgcaggaagtgcagcagtgctattaatttttatccttattttcaacttttcagctcactttattgggaagaaacttcattctaaaatgacagcagcgaaa

SEQ ID NO: 1686 - protein, 295 aa, Streptococcus pyogenes
MNAKKVDKVATGTLYTIAGIIVAILASLILYILVRGLPHISWSFLTGKSSSYEAGGGIGIQLYNSFFLLIVTLIISIPLSTGAGIYLAEYAKKGPVTNFIRTCIEILSSLPSVVVGLFGYLIFVVQFEYGFSIISGALALTVFNLPQMTRNVEDSLLHVHHTQREAGLALGLSRWETVFYVVIPEALPGMVTGIVLASGRIFGEAAALIYTAGQSAPALDWSNWNPLSVTSPISIFRQSETLAVHIWKVNSEGTIPDATLVSAGSAAVLLIFILIFNFSAHFIGKKLHSKMTAAK

SEQ ID NO: 1687 - DNA, 123 bp, Streptococcus agalactiae
atgctaacaattgttggtaaaatcataattcctagcaaaattgaagctgctaagactcccataccaaagccaccaatatattgccttatcatagggacaataacaacgagtccaaagaaacca

SEQ ID NO: 1688 - protein, 41 aa, Streptococcus agalactiae
MLTIVGKIIIPSKIEAAKTPIPKPPIYCLIIGTITTSPKKP

SEQ ID NO: 1689 - DNA, 843 bp, Streptococcus agalactiae
atgaaacaaacaaaagaaggtcttatgcaagctgtgtttttcatcacggcttgcgtcagtgttatatcagctattttaatttgcctctttctcttctctagtggtcttccagctattacgaaaatcggctggggaaattttatatttggtaaagtctggcatcctagtaataatatttttggcatctttccaatgattgtaggttccttatatgttacagcgggagctttacttttaggaggaccgataggtatccttactgctgtttttatggcttatttctgcccagaaaatatttataagcctttaaagtcagctatcaatttaatggcgggaatcccttcagttgtttatggtttctttggactcgttgttattgtccctatgataaggcaatatattggtggctttggtatgggagtcttagcagcttcaattttgctaggaattatgattttaccaacaattgttagcatttcagaatcttctttaagagctgttccagagagctattatgaaggcggtattgcccttggtgcctctcatgaacgaagtgtcttctttgctgttttaccagctgctaaacgtggcattttagcatcggttgttttgggaattggacgtgctattggtgaaacaatggctgtcatcatggtagcgggtaatcaagctgtcttgcctcaatcgctgacatcaggcgttagaactctaaccactaacattgttatggaaatgggctattcttctggtttgcatcgtcaagccttaattggtacagctgtggtactctttatctttatattaatgattaatatcagtttttcagcattacagaaagaggaa

SEQ ID NO: 1690 - protein, 281 aa, Streptococcus agalactiae
MKQTKEGLMQAVFFITACVSVISAILICLFLFSSGLPAITKIGWGNFIFGKVWHPSNNIFGIFPMIVGSLYVTAGALLLGGPIGILTAVFMAYFCPENIYKPLKSAINLMAGIPSVVYGFFGLVVIVPMIRQYIGGFGMGVLAASILLGIMILPTIVSISESSLRAVPESYYEGGIALGASHERSVFFAVLPAAKRGILASVVLGIGRAIGETMAVIMVAGNQAVLPQSLTSGVRTLTTNIVMEMGYSSGLHRQALIGTAVVLFIFILMINISFSALQKEE

SEQ ID NO: 1691 - DNA, 933 bp, Streptococcus pyogenes
atggaaaatcaggaattggctaaaaaattagcctcaccatcaaagaattcaaggcttgaaacctttggccgcaccattacgtttttgtgtctggctttgattgtttttatcgttgcgatgattctgatcttcgttgctcaaaaagggttgtcaaccttctttgttgacaaggttaatctttttgatttcttgtttggaaaggagtggcaaccaagtgtaaaaaatgcggccggcattccttatcttggtgctctgccaatgattacaggatcctttttggttaccattttatctgctattattgccaccccatttgccattggcgcagccgtttttatgactgaaatctcacctaaatatggcgctaaattattacagcctgcggttgagcttttggttggaattccttcggttgtttatgggtttatcggtttgcaagtgattgttccttttatgcgctctatctttggtggcacaggttttggaatcctatctggggtctgtgtcttgtttgttatgattttaccaacagtgacttttatgacaacagacagtctgcgggcggtgcctcgtcattaccgcgaagcgtctatggctatgggagcaacacgttggcaaaccatttggcgtgttgtccttaatgcagctcgtccaggaatttttaccgctgttatttttggaatggcaagagcttttggagaagccttggctatccaaatggtagtcggtaactctgctgtaatgccaagttcactaacgacaccagccgcaaccttaacgtctgtcttgacaatgggtattggtaacacggttatgggaacggtccaaaataatgtgctttggtcccttgccctagtcttattattaatgagtctggccttcaattcccttgtcaaattaatcacgaaagaaagaaagagaaattatgaacgc

SEQ ID NO: 1692 - protein, 311 aa, Streptococcus pyogenes
MENQELAKKLASPSKNSRLETFGRTITFLCLALIVFIVAMILIFVAQKGLSTFFVDKVNLFDFLFGKEWQPSVKNAAGIPYLGALPMITGSFLVTILSAIIATPFAIGAAVFMTEISPKYGAKLLQPAVELLVGIPSVVYGFIGLQVIVPFMRSIFGGTGFGILSGVCVLFVMILPTVTFMTTDSLRAVPRHYREASMAMGATRWQTIWRVVLNAARPGIFTAVIFGMARAFGEALAIQMVVGNSAVMPSSLTTPAATLTSVLTMGIGNTVMGTVQNNVLWSLALVLLLMSLAFNSLVKLITKERKRNYER

SEQ ID NO: 1693 - DNA, 879 bp, Streptococcus agalactiae
atgaaaaaacacaaaatgctatctcttttggcggtatctggtcttatgggaattggcatcctagcaggatgctcaaatgattcatcatcttcatctaaagggacaattaacattgtttctagagaggaagggtctggaactcgtggagctttcatagagttatttgggatcgagtcaaaaaataaaaagggcgaaaaagtagaccatacttctgatgcagcaactgttaccaattcaacttcagttatgctaaccactgtctctaaagacccgtcagctattggttattcttcactaggttcattaaatagtagcgttaaagtgcttaaaattgatggcaaaaatgcgactgtaaaagatattaaatcaggaagctataagatttctcgtcctttcaatattgtaacaaaagaaggtaaggaaaaagaagcaacaaaagattttattgattatatcttaagcaaagatgggcaagcagtcgttgagaaaaatggctatattccacttgacaatgctaaagcatatcaagcaaaagtgtcatctggtaaagttgttatagcaggttcaagttcagtaacgccggttatggaaaagattaaagaagcctatcataaagtaaatgcaaaagtagatgttgaaattcaacaaagtgattcttcaactgggattacaagcgcaattgatggatcagcagatataggtatggcatcacgtgaattggataagacagagtcatccaaaggggtcaaagctactgttattgcaacagatggtattgcagtagttgttaataagaaaaataaagttaatgatctatcaacaaaacaagtaaaagacatttttactggaaagacaacgtcttggtctgacttatcaaag

SEQ ID NO: 1694 - protein, 293 aa, Streptococcus agalactiae
MKKHKMLSLLAVSGLMGIGILAGCSNDSSSSSKGTINIVSREEGSGTRGAFIELFGIESKNKKGEKVDHTSDAATVTNSTSVMLTTVSKDPSAIGYSSLGSLNSSVKVLKIDGKNATVKDIKSGSYKISRPFNIVTKEGKEKEATKDFIDYILSKDGQAVVEKNGYIPLDNAKAYQAKVSSGKVVIAGSSSVTPVMEKIKEAYHKVNAKVDVEIQQSDSSTGITSAIDGSADIGMASRELDKTESSKGVKATVIATDGIAVVVNKKNKVNDLSTKQVKDIFTGKTTSWSDLSK

SEQ ID NO: 1695 - DNA, 864 bp, Streptococcus pyogenes
atgaaaatgaaaaaaaaattctttttgttaagtcttttggccctatcaactttctttttatccgcatgttctagctggattgataaaggtgagtcaataaccgctgtaggatcaacagcactacaacccttagtagaagcagtagctgatgaatttggaagcagtaatctaggcaagactgtcaatgttcaaggtggtggttcaggtacagggttgtctcaagttcaatcaggagctgtccaaattggaaatagtgatgtctttgcggaagaaaaagatggtattgatgcttctaaattagttgatcatcaagtagctgttgcaggacttgcagttattgccaatcctaaagtcaaggtttccaatctcagtagtcagcagttgcaaaagattttttcaggagaatataccaattggaaacaagttggaggagaagatcttgcgatttcagtgatcaaccgagcagcaagttctggctcacgagcaacctttgacagtgttatcatgaaaggggtcaacgctaaacaaagtcaagagcaagactccaatgggatggttaaatcgattgtttcacaaacaccaggtgccatttcttacctttcctttgcctacgttgattcatctgttaaatctttgcaattaaatgggtttaaggcaaatgctaagaacgtggctacaaatgattggccaatctggtcctacgaacacatgtataccaaagataaaccaacagggttgaccaaggaatttcttgattatatgttttcagatgaagtacaacagaacattgttacacatatgggatatatttcgataaatgatatggaagtggtcaaatctcatgatggaaaagtaacaaaaagg

SEQ ID NO: 1696 - protein, 288 aa, Streptococcus pyogenes
MKMKKKFFLLSLLALSTFFLSACSSWIDKGESITAVGSTALQPLVEAVADEFGSSNLGKTVNVQGGGSGTGLSQVQSGAVQIGNSDVFAEEKDGIDASKLVDHQVAVAGLAVIANPKVKVSNLSSQQLQKIFSGEYTNWKQVGGEDLAISVINRAASSGSRATFDSVIMKGVNAKQSQEQDSNGMVKSIVSQTPGAISYLSFAYVDSSVKSLQLNGFKANAKNVATNDWPIWSYEHMYTKDKPTGLTKEFLDYMFSDEVQQNIVTHMGYISINDMEVVKSHDGKVTKR

SEQ ID NO: 1697 - DNA, 585 bp, Streptococcus agalactiae
atgattattgctattcaaggtggtatggctgtagggaaaaccacagctttgaaaatcattgagaatgtttaccccaaaatcgctattagttttgaggatatttctccagtagttgataagattaataaacatcagcttgataacaataaattagacgattattgtgaaattcaacaactatttattcagcatgagcgagatagatacgaacttgttagagataatgaaatagtgttaatggattatggagctgaggaaattgctttttatacacaatactttccaaaggtggcgggttatagttggactttaccttctaatttgttactagaggtaaataggctaaaggaatgttttgctgattatattatttttctagatgcagatgagacggtcctataccaacgtcaaaaaaatgattttaatagacagcgtcattttttcaaatggtatactcatcacctgctgcctgctaaaaaacattatttagacacattttccaatgttattcatattaatacaaatcatttaaatgctgaggaagtggctgaaaaaatcattgacatcattcgtaagttaactcta

SEQ ID NO: 1698 - protein, 195 aa, Streptococcus agalactiae
MIIAIQGGMAVGKTTALKIIENVYPKIAISFEDISPVVDKINKHQLDNNKLDDYCEIQQLFIQHERDRYELVRDNEIVLMDYGAEEIAFYTQYFPKVAGYSWTLPSNLLLEVNRLKECFADYIIFLDADETVLYQRQKNDFNRQRHFFKWYTHHLLPAKKHYLDTFSNVIHINTNHLNAEEVAEKIIDIIRKLTL

SEQ ID NO: 1699 - DNA, 738 bp, Streptococcus agalactiae
atgcaacagtattttgtaaatggcgaagcaggtgcctatgtgaccatcgaggacaaggataccatcaagcacatgttcaatgtcatgcgattgacagaagatgaccaagtggtcttggtttttgatgatgccatcaagcgtctggcaaaggtggtggacagctctgctcatcgcttccaaattctagaagagctagacaacaatgttgaaatgccagttcaagtgaccattgcctcaggttttcccaagggagacaagttggattttgtgacgcaaaaggcaacagaattgggtgctgcggctatctggggattcccagctgactggtcagtcgtcaagtgggacggcaagaaactagctaaaaaagaagataagctggcaaaaattgctctgggcgcagcggagcagagcaagcgtaatcgtcttcctcaggttcgtttatttgagaagaaggctgattttcaagcggagcttgcaggctttgataagatttttatcgcctatgaagagtctgccaaggagggtgaattgtcagcgctagcccagaacttgcagactgtaaaagcaggtgacaagctcctcttcatctttggaccagaagggggcatttctccaaaagaaatcgcagcttttgaagaggttggagctatcaaggtgggcttggggccacgcatcatgcgcacagaaacagcgccgctctatgctctaagtgttattagttactcagcggagttatta

SEQ ID NO: 1700 - protein, 246 aa, Streptococcus agalactiae
MQQYFVNGEAGAYVTIEDKDTIKHMFNVMRLTEDDQVVLVFDDAIKRLAKVVDSSAHRFQILEELDNNVEMPVQVTIASGFPKGDKLDFVTQKATELGAAAIWGFPADWSVVKWDGKKLAKKEDKLAKIALGAAEQSKRNRLPQVRLFEKKADFQAELAGFDKIFIAYEESAKEGELSALAQNLQTVKAGDKLLFIFGPEGGISPKEIAAFEEVGAIKVGLGPRIMRTETAPLYALSVISYSAELL

SEQ ID NO: 1701 - DNA, 747 bp, Streptococcus pyogenes
atgcaacagtattttattaaaggcaaagcagaaaaaaaggtaacgattaccgataaagataccatcaagcacatgtttcaagtgatgcgcttggctgacgaggctgaagttgtcttggtctttgatgatggggtgaagtatttagctaaggtgaccaatagtatggctcatgagttagagattatagaggctttgccagatcaggtggaattgcctgttaaagtgactattgcttctggatttcctaaaggcgataagttagacacgattgcccagaaagtgactgaattgggagccagtgcgctatggggctacccagcagactggtcagtggtcaaatgggatggcaaaaaattagctaaaaaagaagacaaattggctaagattgtattaggagcggctgagcagagcaaacgaaatagggtgcctgaagttcacctttttgaacataaagcagagtttctaaaaagcctttctagctttgatcatatcttcattgcttatgaggaaacagctaaggcaggtcagctagcgaccttggcgcgtgaagtaaaagaagttaagccaggggcaaaaatcctctttatctttggaccagaagggggaatttccccaactgaaatcactcagtttgaggcagcaagtgccattaaggtgggcttaggccctcgcattatgcgagcagagacagcgccgctatatgccttaagtgctcttagttatgctttggaattgcaggcatcaaaa

SEQ ID NO: 1702 - protein, 249 aa, Streptococcus pyogenes
MQQYFIKGKAEKKVTITDKDTIKHMFQVMRLADEAEVVLVFDDGVKYLAKVTNSMAHELEIIEALPDQVELPVKVTIASGFPKGDKLDTIAQKVTELGASALWGYPADWSVVKWDGKKLAKKEDKLAKIVLGAAEQSKRNRVPEVHLFEHKAEFLKSLSSFDHIFIAYEETAKAGQLATLAREVKEVKPGAKILFIFGPEGGISPTEITQFEAASAIKVGLGPRIMRAETAPLYALSALSYALELQASK

SEQ ID NO: 1703 - DNA, 951 bp, Streptococcus agalactiae
atgaacacatggaatgaactaacggttcacgtgaatcgtgaggcagaggaagctgtctcgaatttattgattgaaactggcagtcagggggttgccattagcgattcggctgactaccttggacaggaggatcgtttcggtgagctttatcctgaggtggagcagtctgatatgattgctattactgcttattatcctgatacgcttgatattgaggcggttaaggctgatttggctgatcgtttagctaattttgaaggctttggtcttgcgacgggtagcgtcaaccttgacagtcaggaattggtcgaagaggactgggctgataactggaagaagtactatgagccagctcgcattacccatgatttgaccatcgtgccgtcatggacggactacgaggctaaggctggtgagaagattatcaagatggatcctggtatggcttttgggactgggactcacccaacgactaagatgagtctttttgccttggagcaagtgcttcgtggtggtgagacggttatcgatgtggggactggttctggcgttttgtctattgctagctctctcttgggtgccaaggacatctatgcctatgatttggatgatgttgcagtgcgcgtggctcaggaaaatatcgatatgaaccctggcactgaaaatattcatgtggctgctggtgatctgctcaaaggtgtccagcaagaggtagatgttattgttgccaatattttggcggatattttgatccatctgacagacgacgcctaccgtttggtcaaggatgagggctatctcatcatgtctggtatcatttctgagaagtgggacatggtgcgtgagagtgctgaaaaagctggtttcttccttgagactcacatggttcaaggtgagtggaatgcctgcgttttcaaaaagacagatgatatttcaggagtgattggcggc

SEQ ID NO: 1704 - protein, 317 aa, Streptococcus agalactiae
MNTWNELTVHVNREAEEAVSNLLIETGSQGVAISDSADYLGQEDRFGELYPEVEQSDMIAITAYYPDTLDIEAVKADLADRLANFEGFGLATGSVNLDSQELVEEDWADNWKKYYEPARITHDLTIVPSWTDYEAKAGEKIIKMDPGMAFGTGTHPTTKMSLFALEQVLRGGETVIDVGTGSGVLSIASSLLGAKDIYAYDLDDVAVRVAQENIDMNPGTENIHVAAGDLLKGVQQEVDVIVANILADILIHLTDDAYRLVKDEGYLIMSGIISEKWDMVRESAEKAGFFLETHMVQGEWNACVFKKTDDISGVIGG

SEQ ID NO: 1705 - DNA, 951 bp, Streptococcus pyogenes
atggaaacgtggcaagaagtgacggttcatgtgcatcgtgatgcgcaagaggctgtttcacatgtgttgattgagacaggcagtcaaggggttgctatcgcagatagcgcagactatattgggcaaaaggaccgctttggggagttatacccagatgtggagcagtctgacatgatagctatcacagcctattacccaagtagtactaatttggcggatattattgcgaccattaatgaacagttagcggagttagctagttttgggttacaggttggtcaggttactgtggacagtcaagaattggctgaggaagactgggcagacaattggaaaaaatactatgaaccagctcgcatcacgcatgatttaaccattgtccctagttggacggattatgacgcttctgctggggaaaaagtgattaaactagatcctggaatggcatttgggacagggacacatcccacaactaagatgagcctttttgccttggaacaaatccttcgtggtggtgagacagttatcgatgtagggaccggttcaggtgtcctctcgattgccagttccttactaggtgctaaaaccatctacgcttatgacttagatgacgtggctgttcgagtggctcaagacaacattgatttaaaccaaggaacagacaacattcatgtggctgctggtgaccttttaaaaggggttagccaagaagcggatgtgattgtagccaatatcttggcggatatcttagtcttattgactgatgatgcttaccgtttggtcaaaaaggaaggttaccttatcttatctggcatcatttctgagaaattggatatggttctggaagctgcctttagcgcaggctttttcttagaaactcacatggttcaaggtgagtggaatgcccttgtctttaaaaaaacagatgatatctcaggagtgattggcggc

SEQ ID NO: 1706 - protein, 317 aa, Streptococcus pyogenes
METWQEVTVHVHRDAQEAVSHVLIETGSQGVAIADSADYIGQKDRFGELYPDVEQSDMIAITAYYPSSTNLADIIATINEQLAELASFGLQVGQVTVDSQELAEEDWADNWKKYYEPARITHDLTIVPSWTDYDASAGEKVIKLDPGMAFGTGTHPTTKMSLFALEQILRGGETVIDVGTGSGVLSIASSLLGAKTIYAYDLDDVAVRVAQDNIDLNQGTDNIHVAAGDLLKGVSQEADVIVANILADILVLLTDDAYRLVKKEGYLILSGIISEKLDMVLEAAFSAGFFLETHMVQGEWNALVFKKTDDISGVIGG

SEQ ID NO: 1707 - DNA, 306 bp, Streptococcus agalactiae
atggggtattttacagtattttggcagaaagatggaaatggtaaaaatattcctttttatgaacaagatgaagtggaagatttgattattgtcattaaagatggtaggtggaaaggtttgttcatcattcccaaagaggttgcagtgagtaagggtattctttcatctgctaactctcaaggaaagatggctatgcgattttaccctccttggtgtagcgatttaaatagaacagctttggtgacacagcgatggcagttgaactattttattgatttaagtagaaataatgaaggagttactaca

SEQ ID NO: 1708 - protein, 102 aa, Streptococcus agalactiae
MGYFTVFWQKDGNGKNIPFYEQDEVEDLIIVIKDGRWKGLFIIPKEVAVSKGILSSANSQGKMAMRFYPPWCSDLNRTALVTQRWQLNYFIDLSRNNEGVTT

SEQ ID NO: 1709 - DNA, 714 bp, Streptococcus agalactiae
atgaaaacagttaaagaagtcagtatcttaagcggtgtaagtgtgcgcaccttgcatcactatgataaaatcggtttattcccacctaccgccctatccgaagcaggctatcgactttatgacgatgaagcattgattcgcctgcaagaaattttgctatttcgtgagttggaattccctctcaaagatatcaaatacctgcttgagcaagcaaaagaggaaaggcaagacttattagcccaacaaatcaaattgcttgaatggaaaagatcgcaccttgagcaggttatcacccatgcgaaacgattacaagaaaaaggagatgattatatgaatttcgatgtttataataaaacagaattagaacaattacaagctgaagcaaaagaaaagtggggacaaacagcagcctacaaagaatttgctcaaaaacatgcttcagatgactttgcacaaattagccaagaaatggcaaaaataatggtacaatttgggcaattaaagacacaaaatgtatctgatgaatctgttcaaatgtgtgtgaaacggctacaagactatatctctcagaatttttacacctgtaccaatgaaatccttgctggactaggacaaatgtatcaatcagatgaccggtttagtcaatcaattgacaaagctggtggagcaggaacaagtgaatttgtcagccaagctattgcttactattgccaa

SEQ ID NO: 1710 - protein, 238 aa, Streptococcus agalactiae
MKTVKEVSILSGVSVRTLHHYDKIGLFPPTALSEAGYRLYDDEALIRLQEILLFRELEFPLKDIKYLLEQAKEERQDLLAQQIKLLEWKRSHLEQVITHAKRLQEKGDDYMNFDVYNKTELEQLQAEAKEKWGQTAAYKEFAQKHASDDFAQISQEMAKIMVQFGQLKTQNVSDESVQMCVKRLQDYISQNFYTCTNEILAGLGQMYQSDDRFSQSIDKAGGAGTSEFVSQAIAYYCQ

SEQ ID NO: 1711 - DNA, 741 bp, Streptococcus pyogenes
gtggaaatgtctcaattctattcgactggagaattggccaacttagctggcgtttctattcgaactgtccaatactatgaccaacgtgggattttgattccgacagcattgacagcaggtggacggcgactctatacggattctgatttagaacaattacgcatgatttgctttctgcgcgatttgggattttccattgagcagattcgcaaagtcttagcagaggaaaatgcagcccaggtgctggaattgcttctagttgatcatattgcgactgccaaggaagacttggctgcaaaagagcaacaagttgacatagctgtcaagatacttgacagacttcgaaaacaagacccccagtcactagattttctgatggacatttcgcttagcatgaaaaatcaaaaagcttggaaaaaattacaatggaagatgggtatcagtatatttttagccattgtttcatatgtaggacttattttactatctagttatctgcaaaaattttggttagtttatgttgctatgggactatttctaccaggtttcagttggttggtaatttattttaggaagcaatttatttatctctgtccccattgtcatcagaaatttgaacctagctttaatgaatttgcccttgcaggccatacaccacgaaccagaaagttaacctgctcccattgccatcaaaaatcgtattgcttggaactggcaaaagaggacactgtctcaagaaga

SEQ ID NO: 1712 - protein, 247 aa, Streptococcus pyogenes
VEMSQFYSTGELANLAGVSIRTVQYYDQRGILIPTALTAGGRRLYTDSDLEQLRMICFLRDLGFSIEQIRKVLAEENAAQVLELLLVDHIATAKEDLAAKEQQVDIAVKILDRLRKQDPQSLDFLMDISLSMKNQKAWKKLQWKMGISIFLAIVSYVGLILLSSYLQKFWLVYVAMGLFLPGFSWLVIYFRKQFIYLCPHCHQKFEPSFNEFALAGHTPRTRKLTCSHCHQKSYCLELAKEDTVSRR

SEQ ID NO: 1713 - DNA, 468 bp, Streptococcus agalactiae
atgattactttacaaaaggcggaagctagtgatttagagaagattattgccattcagagagctagctttaaggcagtctatgagaaataccacgatcaatacgatccctatgtggaagaagttgagcagattcgatggaaactagtggagcgaccagattgtttctatcattttgtccttgttgatgagacaattgttggttttcttagattggttatcaaagacgaggagaagcgtgcttggcttggtacggcggctattcttccccaatatcaagggcagggctacggctcagcagcgatggctttattagagaaaacctatcctaagcttacaaagtgggatttatgtacgattgcgcaagaaaaactaatggtcagtttttatgaaaaatgtggttatcattcaacccataccgaacctgagcaagaaggaatggatatggtctatatgacaaagaagatagaa

SEQ ID NO: 1714 - protein, 156 aa, Streptococcus agalactiae
MITLQKAEASDLEKIIAIQRASFKAVYEKYHDQYDPYVEEVEQIRWKLVERPDCFYHFVLVDETIVGFLRLVIKDEEKRAWLGTAAILPQYQGQGYGSAAMALLEKTYPKLTKWDLCTIAQEKLMVSFYEKCGYHSTHTEPEQEGMDMVYMTKKIE

SEQ ID NO: 1715 - DNA, 456 bp, Streptococcus agalactiae
atggatatttttgatgagttatttgatttctcaggtgcaaagatcgctcttttctgcgagggaaagattttgaccagcctaagagatgattttccagatttgccctatgcaggcttttgggacttaccaggcggtggtcgtgaggacaatgaaacacctttggaatgtctttttcgtgaagttgatgaagaattaagtctgaccttaactcgaaaccatattgattgggtcaagacttataggggtatgttgaagcctgataaattatcagtttttatggttggacatatcagtcagaaagagtacgatagcattgttctaggcgatgaaggacaagactacaaactcatgtccattgacgaatttttaagccataaaaaggtcattcctcagttgcaggagaggttgagagattatttggaggtggaagatgattactttacaaaaggcggaagc

SEQ ID NO: 1716 - protein, 152 aa, Streptococcus agalactiae
MDIFDELFDFSGAKIALFCEGKILTSLRDDFPDLPYAGFWDLPGGGREDNETPLECLFREVDEELSLTLTRNHIDWVKTYRGMLKPDKLSVFMVGHISQKEYDSIVLGDEGQDYKLMSIDEFLSHKKVIPQLQERLRDYLEVEDDYFTKGGS

SEQ ID NO: 1717 - DNA, 468 bp, Streptococcus agalactiae
atggctaaatttggatttttatcggtactagaagaagaattggataagcatttacagtatgactttgccatggattgggataagaaaaatcatactgtagaagtcacttttatattagaagcacaaaacagctctgctattgaaaccgtggacgaccagggggagacgagtagcgaggacatcgtttttgaggactatgtactcttttacaaccctgtcaagtctcgctttgatgctgaggactatctggtgactatcccctatgagcctaagaagggcttgtcgcgtgagtttctggcttattttgcggagactctcaacgaggttgccactgaagggttgagcgacctcatggacttcctcaccgatgacagtatcgaagagttcggtctttcttgggatacggatgcttttgaaaatggcagagcagaactgaaagagacagagttttacccttatccgagatat

SEQ ID NO: 1718 - protein, 156 aa, Streptococcus agalactiae
MAKFGFLSVLEEELDKHLQYDFAMDWDKKNHTVEVTFILEAQNSSAIETVDDQGETSSEDIVFEDYVLFYNPVKSRFDAEDYLVTIPYEPKKGLSREFLAYFAETLNEVATEGLSDLMDFLTDDSIEEFGLSWDTDAFENGRAELKETEFYPYPRY

SEQ ID NO: 1719 - DNA, 468 bp, Streptococcus pyogenes
atggcaacatacggctttttatcagtattagaagaagaaatggataagcattttcagtatgactatgctatggattgggacaagaaaaatcatgcggttgaagtgacttttgtgttagaagctcaaaataaagaggctataaaaaccattgacgatagtggcgaagtgacccaagatgatattgtctttgaggactatgtgctcttttataaccctgccaagtctcaatttgatgcagcagattatttggttactattccttttgacgctaaaaagggcttttctcgtgaattcttagcttactttgcgcaatttctcaacgatgttgctattgaagggcacagcgatttgatggatttcttagcagatgacagcaaggctgatttcttcttggagtggaacgcgcaagcttttgaagaaggtcaacaaggactagaagaagcagcaagttacccttacccaaggtac

SEQ ID NO: 1720 - protein, 156 aa, Streptococcus pyogenes
MATYGFLSVLEEEMDKHFQYDYAMDWDKKNHAVEVTFVLEAQNKEAIKTIDDSGEVTQDDIVFEDYVLFYNPAKSQFDAADYLVTIPFDAKKGFSREFLAYFAQFLNDVAIEGHSDLMDFLADDSKADFFLEWNAQAFEEGQQGLEEAASYPYPRY

SEQ ID NO: 1721 - DNA, 489 bp, Streptococcus agalactiae
atgattatcagacctatgcaggactgcgaccgtgaggcagttctgaccttacaaaatactggctggactgctcttacctctcctgtctatgaccgcaagtggactgagagtgatttggagaagaatctggcaaatggcatgtccttctttgtcgctgaggtcgatgataagatcgctggcgtcttggactttggtccctactatcctttcccagctggcaagcatgttgccactttcggcattctcatcgctgaaccctaccaaggtcagggactgggtaaagctctcttgaaagctctgctaactgaggctaaagctcaaggttacatcaagattgccatgcatgtcatgggcaataacagcagagccatttccctctatcaaaaatacgggtttaccgaagaggctcgaatcactaaagcctttttcattgaaaatcattatgttgatgctttaattttcgcaaaagatttggagaataatcatggc

SEQ ID NO: 1722 - protein, 163 aa, Streptococcus agalactiae
MIIRPMQDCDREAVLTLQNTGWTALTSPVYDRKWTESDLEKNLANGMSFFVAEVDDKIAGVLDFGPYYPFPAGKHVATFGILIAEPYQGQGLGKALLKALLTEAKAQGYIKIAMHVMGNNSRAISLYQKYGFTEEARITKAFFIENHYVDALIFAKDLENNHG

SEQ ID NO: 1723 - DNA, 522 bp, Streptococcus pyogenes
atggttcagcaaagtctcgttattgaagaaggcgtacctcaagatgcaaaagctgtactttccttagtgacggcagctgccaaagaaacagattttataacaggcgtagagactatattagaggctactcctcaagaattgtcagactttttatcaagaagtcaaacctcttttattgatttttgcctgctagctagattagatgaaaaagtagtagggcttttaaatctttctggggaagtattatcccaaggccaagctgaagcagatgtatttatgttagttgctaagacttaccgtggttatggtatcggtcaattattgttagagattgctcttgattgggctgaagaaaacccttatatcgaaagccttaagttggacgttcaagtaagaaatactaaggctatttacctgtataaaaagtatggttttcgtattgaaagtatgcgaaaaaacgacatcaaatcaaaaaatggagatgacttagatgtttatcatatgcgtaaatctgtaagtcag

SEQ ID NO: 1724 - protein, 174 aa, Streptococcus pyogenes
MVQQSLVIEEGVPQDAKAVLSLVTAAAKETDFITGVETILEATPQELSDFLSRSQTSFIDFCLLARLDEKVVGLLNLSGEVLSQGQAEADVFMLVAKTYRGYGIGQLLLEIALDWAEENPYIESLKLDVQVRNTKAIYLYKKYGFRIESMRKNDIKSKNGDDLDVYHMRKSVSQ

SEQ ID NO: 1725 - DNA, 1266 bp, Streptococcus agalactiae
atggctgacaatcttgctctacgtatgcgtcctcgcaatattaatgaagttatcgggcagcaacatctcgttggtaatggcaaaattattgatcgaatggttgcagctaatatgttatcttccatgatcctatatggcccaccaggtattgggaagacttctattgcttctgctattgctggtactactaaatatgcctttcgtacttttaatgccactgttgatagtaaaaaacgtcttcaagaaattgcagaagaagctaaattttctggtggcttagttttattacttgacgagattcatagacttgacaagacaaaacaagattttcttttacctctacttgagaatggcaatattattatgattggagcaacaactgaaaatcctttcttttcagtaactcctgccattagaagtagggtacaaatttttgagttagaacctctttctaacgaggatattaaaaaagccattcagctagcaatttccgataaagaacggggatttccttttttagtgacaattgatgatgaggcgctagattttattgttaccgccacaaatggagacctacgatctgcttataattccttggatctagcagtcatgtctacttctcctaatgaagatggtagccgtcatattagtctagagacaatggaaaatagtctgcagtgtagttatattacaatggataaaaacggagatgggcattatgatatcctatcagccttacaaaaatcaattagaggttctgatgtcaatgccagcctgcactatgccgctcgtttagtagaagccggagatttacctagtttagcaagacgtttgaccattattgcttatgaagatatcggcttagctaaccccgaagcacaaatacatactgtgactgcattggaagctgcccaacgcattggttttccagaagctcgtattcttattgctaacattgttgtggatttagctctatcacctaaatcaaattcagcctatttggctatggatgcagctttagctgatttacgtcgttcaggaaatttacctattccacgtcacctaagagatggacattacagcggtagtaaaaccttgggcaatgcaagggattacaagtaccctcacgcctatcctgaaaaatgggttaaacaacaatacttaccagataaactagtaggacataattactttgaagccaatgaaactggtaaatacgaacgcgcacttggttcaaataaagagcgcattgataagctctcagac

SEQ ID NO: 1726 - protein, 422 aa, Streptococcus agalactiae
MADNLALRMRPRNINEVIGQQHLVGNGKIIDRMVAANMLSSMILYGPPGIGKTSIASAIAGTTKYAFRTFNATVDSKKRLQEIAEEAKFSGGLVLLLDEIHRLDKTKQDFLLPLLENGNIIMIGATTENPFFSVTPAIRSRVQIFELEPLSNEDIKKAIQLAISDKERGFPFLVTIDDEALDFIVTATNGDLRSAYNSLDLAVMSTSPNEDGSRHISLETMENSLQCSYITMDKNGDGHYDILSALQKSIRGSDVNASLHYAARLVEAGDLPSLARRLTIIAYEDIGLANPEAQIHTVTALEAAQRIGFPEARILIANIVVDLALSPKSNSAYLAMDAALADLRRSGNLPIPRHLRDGHYSGSKTLGNARDYKYPHAYPEKWVKQQYLPDKLVGHNYFEANETGKYERALGSNKERIDKLSD

SEQ ID NO: 1727 - DNA, 1266 bp, Streptococcus pyogenes
atgcctgatcatttagcgctcagaatgcgccccaaaaccatttcagaggtcatcggacaaaaacaccttgttggcgaaggcaaaatcatccgtcgcatggtggaagcaaatagactatcgtccatgatcctctatggccctccaggaatcggtaaaacttccattgcttctgctattgctggtactactagatatgcctttcggacctttaatgccaccattgacagcaaaaaacgtctccaagaaattgcggaagaagctaaattttctggtggcttggtattattactagacgagattcatcgccttgacaagacaaaacaagattttcttttacctttacttgagaatggcaccattatcatgattggcgcaaccactgagaaccccttcttttcagtgacacccgctatcagaagcagggtccaaatttttgaattggaaccactttctaacgaggatattaaaacagccattcagctagcaatttccgacaaagaacggggatttccttttttagtgacaattgatgatgaggcgctagatttcattgttaccgccacaaatggagacctacgatctgcttataattccttggatctagcagtcatgtctacttctcctaatgaagatggtagtcgtcatattagtctagagacaatggaaaatagtctgcagcgtagttatattaccatggataaaaacggggacgggcattatgatgttttatctgccttacaaaaatccattagaggttctgatgtcaatgctagcctgcactatgccgctcgtttagtagaagctggagacttgcctagtttagcaagacgattgaccattattgcttacgaagatattggcttagccaaccctgacgcccaagttcataccgtcaccgcactagatgccgcccaacgcattggttttccagaagctcgtattcctatcgctaacgtggtcattgatttggctctatcacctaaatccaattcagcttatttagctatggatgcagctttagctgatttgagaacatcaggcaacctccccattccaagacatcttagagacgggcattatgctggcagcaaggacctaggcaatgccaaagattacctctacccacacgcctaccctgaaaaatgggtcaaacaacaatacctaccagataaattagtaggacatcattattttgaagccaatgaaaccggtaaatacgaacgcgcacttggttcaaataaagagcgtattgataagctctcagac

SEQ ID NO: 1728 - protein, 422 aa, Streptococcus pyogenes
MPDHLALRMRPKTISEVIGQKHLVGEGKIIRRMVEANRLSSMILYGPPGIGKTSIASAIAGTTRYAFRTFNATIDSKKRLQEIAEEAKFSGGLVLLLDEIHRLDKTKQDFLLPLLENGTIIMIGATTENPFFSVTPAIRSRVQIFELEPLSNEDIKTAIQLAISDKERGFPFLVTIDDEALDFIVTATNGDLRSAYNSLDLAVMSTSPNEDGSRHISLETMENSLQRSYITMDKNGDGHYDVLSALQKSIRGSDVNASLHYAARLVEAGDLPSLARRLTIIAYEDIGLANPDAQVHTVTALDAAQRIGFPEARIPIANVVIDLALSPKSNSAYLAMDAALADLRTSGNLPIPRHLRDGHYAGSKDLGNAKDYLYPHAYPEKWVKQQYLPDKLVGHHYFEANETGKYERALGSNKERIDKLSD

SEQ ID NO: 1729 - DNA, 99 bp, Streptococcus agalactiae
ttggctttgtttctgaatcaacaacatgggattccattccttggtaactttgaaaaagccagagatgaaaaaggctacaatggtcatcagacaagctat

SEQ ID NO: 1730 - protein, 33 aa, Streptococcus agalactiae
MALFLNQQHGIPFLGNFEKARDEKGYNGHQTSY

SEQ ID NO: 1731 - DNA, 108 bp, Streptococcus agalactiae
atgggattccattccttggtaactttgaaaaagccagagatgaaaaaggctacaatggtcatcagacaagctattaatacgcctgcagttttacgaaagattacagag

SEQ ID NO: 1732 - protein, 36 aa, Streptococcus agalactiae
MGFHSLVTLKKPEMKKATMVIRQAINTPAVLRKITE

SEQ ID NO: 1733 - DNA, 759 bp, Streptococcus agalactiae
atgaccggattgatccccatgctcaaaaaagagtggctagaaaatagccgtagtcataaagctcttgcccttctccttatttcaatcattttcggaatattaggaccactcacagcattactgatgccagaaatcatggcagggattttgcctaagaaactgcaagaagctattcctgacccaacctaccttgattcttatagtcaatattttaaaaatattaatcagctaggattgattctattagtttttctttttagtggtagtttgactcaagaatttaccagaggtacacttattaatcttattaccaaaggactaagcaaaaaagccattatcttagcaaaatttatcatgatgacacttatttggagcatcagctatatactaggatcacttacccagtatgcttatacactttattattttaataatcatggtcagcataaacttattgtttacggtacatcctggatctttggattattattgctgagtctcattcttttttactctgtaatctttcgtaaaactgcaggcgtattaatagcttgtctgatgaccattgtagcctttttcatctctggctttttcaaagttaccaaggaatggaatcccatgttgttgattcagaaacaaagccaaatcctaagtggtcaatatgacatcaaagatttattacaaccaactctcttagtcatcggtattatcttaatcagtttgatatctgctaaagtcatttttgagaaaagtgaagtt

SEQ ID NO: 1734 - protein, 253 aa, Streptococcus agalactiae
MTGLIPMLKKEWLENSRSHKALALLLISIIFGILGPLTALLMPEIMAGILPKKLQEAIPDPTYLDSYSQYFKNINQLGLILLVFLFSGSLTQEFTRGTLINLITKGLSKKAIILAKFIMMTLIWSISYILGSLTQYAYTLYYFNNHGQHKLIVYGTSWIFGLLLLSLILFYSVIFRKTAGVLIACLMTIVAFFISGFFKVTKEWNPMLLIQKQSQILSGQYDIKDLLQPTLLVIGIILISLISAKVIFEKSEV

SEQ ID NO: 1735 - DNA, 900 bp, Streptococcus agalactiae
atgacagccatttctttacaaaatctgtccaaatcctttggggatcaaatcattttaaatcaggtttccttagagctagaagaaaataagatttatggctttgttggtccaaacggggccggtaaaaccaccaccattaagatgattttaggtttattgaaagtagactctggtaccatttcagtaatgggaaacccagtgacttttgggcagacaaaaagtaatcaagttattggttatttgcctgacgttccggagttttatgactatatgacggcacaagaatacttacaactttgcgctggcttagctcaaaacaaaaccagtttaccaattgctgatctgctagaacaggtcggcttagccgataatcagcaacgcattagcacctattctcgaggtatgaaacaacgcttaggtctagcccaagcactgattcacaatcctaaaattctgatttgtgatgaaccaacatcagccttagaccctcaaggacgacaagaaatcctctccattatttctcaactacgtggtcaaaagacagtcattttctcgacacacatcttatcagatgtggaaaaagtctgtgatcaagttctaattctaacaaaatcaggtatccataatctagaagatctaagagacaaagcgtcagccagtgtgaatcaactgaaccttttaataaaagtctcagacaatgaagcacaaaaattagctctgcgatttcctttaaatcaaaaagatcaatattataaggtacatttggaattgagtgaggcaaacaatcgtgaacaagcattagcaagtttttacaggtatttagttgagcaagaaatcacgccatacttcattgaattactggaagatagcctggaagacttctatttggaggtgattaaa

SEQ ID NO: 1736 - protein, 300 aa, Streptococcus agalactiae
MTAISLQNLSKSFGDQIILNQVSLELEENKIYGFVGPNGAGKTTTIKMILGLLKVDSGTISVMGNPVTFGQTKSNQVIGYLPDVPEFYDYMTAQEYLQLCAGLAQNKTSLPIADLLEQVGLADNQQRISTYSRGMKQRLGLAQALIHNPKILICDEPTSALDPQGRQEILSIISQLRGQKTVIFSTHILSDVEKVCDQVLILTKSGIHNLEDLRDKASASVNQLNLLIKVSDNEAQKLALRFPLNQKDQYYKVHLELSEANNREQALASFYRYLVEQEITPYFIELLEDSLEDFYLEVIK

SEQ ID NO: 1737 - DNA, 1077 bp, Streptococcus agalactiae
atgattggtgatactattttatttgaacgcacacgtcttggtatgactcaagaaaaactgagtgactatttgcatttaaccaaggctacaatttccaaatgggaaaacaatcaggcaaaacctgatatcgattacttgattctaatggcaaaactatttgatatgactttagatgagttggtaggttttcaaaaaacactaactgactctgaaagagggcatctttttgaacaattgcgaggacaaattgaccaacaaaatgggactgaattctttcataacattcaagacttagcaaaacattatatcaatgataacaaaacccttttactcctcgtccaactggttttgagcaatccagctcagattgatagtaacccttggtcattagaactaatcaatcggattatcagcaaaacaactgttgaatctgaacttcagtctgccatcatgttaaaagtagtaatactttttcaacaaaaaaaatacgatgatattatcgcactttatcagaatcgtccttataaacttggtgaggagttatttttggccaatagcttcgctgctaagggggaaacagagcaagcaaaacaagttttacaagttgaaatttaccagcaaattctgctgatttgccaatatctgttaagcctaacggcttttgaatgtcccgaacggcaagaattcattttggaacgactggaaaatcttatggccacatttgacctcaaaaagcttcatcctaatacagccatttcctcttactacagtttggcctgttatttcgctgaaagtcagccccaaaaagcaattagttacttaaatcaattggcagaggctacccgaaacctattaaaacaatttgaactgcatggcgacagcttttttgatgccatcgatccttggctccaacagttaccaacaggaattcagccaccaaccaattctcaaatcttaatccaaagggtaattgccctgtttcatagtccacagtttcaatacttacagcaagaaaagtccttccaagctcagcttgctgctttaaaaaaactcgaaaaggagatttcagatgaacac

SEQ ID NO: 1738 - protein, 359 aa, Streptococcus agalactiae
MIGDTILFERTRLGMTQEKLSDYLHLTKATISKWENNQAKPDIDYLILMAKLFDMTLDELVGFQKTLTDSERGHLFEQLRGQIDQQNGTEFFHNIQDLAKHYINDNKTLLLLVQLVLSNPAQIDSNPWSLELINRIISKTTVESELQSAIMLKVVILFQQKKYDDIIALYQNRPYKLGEELFLANSFAAKGETEQAKQVLQVEIYQQILLICQYLLSLTAFECPERQEFILERLENLMATFDLKKLHPNTAISSYYSLACYFAESQPQKAISYLNQLAEATRNLLKQFELHGDSFFDAIDPWLQQLPTGIQPPTNSQILIQRVIALFHSPQFQYLQQEKSFQAQLAALKKLEKEISDEH

SEQ ID NO: 1739 - DNA, 594 bp, Streptococcus pyogenes
gtgatatttatggaaattggtcagcaaattattcgctaccgtaaacaacaagcgctctcgcaagaaaaattagccgagaaagtctatgtaagccgtcagagcatatctaactgggaaaatgacaaaacttacccagacatccatagcctcttactcctaagtcaaatttttcaagtgagcttagaccaactcattaaaggagacattgagaaaatgaaatataccatcactcaggttgataaaaagaattttaaacgagataccaaagtaatggtaacattgatgatactattaatgatttcaagttatccattagtctatttcttagagtggctaggacttggcatttttgttttattatcgataattactatgacttatgctaatcgtgtggaacgttttaagaaaaaatatgatgtgcaaccttataaggaaatcctagctgtttcaaatggaaaattattagacgaaatcgaaaaacgagaagaaagagcaacacttccttatcagaaaccccttattgtcactgtatttttcctcattactgttgcttttgcttttgcaagtcgttttatgtttacatggttattccat

SEQ ID NO: 1740 - protein, 198 aa, Streptococcus pyogenes
VIFMEIGQQIIRYRKQQALSQEKLAEKVYVSRQSISNWENDKTYPDIHSLLLLSQIFQVSLDQLIKGDIEKMKYTITQVDKKNFKRDTKVMVTLMILLMISSYPLVYFLEWLGLGIFVLLSIITMTYANRVERFKKKYDVQPYKEILAVSNGKLLDEIEKREERATLPYQKPLIVTVFFLITVAFAFASRFMFTWLFH

SEQ ID NO: 1741 - DNA, 315 bp, Streptococcus agalactiae
ttggatataacagcttatcaaaaatgggttagtgaattttacaaaaaaagaaattggtaccagtataattcgtttataagaagtaattttttatgcgaagaggttggggaattagcgcaagctattcgaaaatatgaaattggtcgtgatagaccagatgaaatcgagaaatcaaacaacgaaaatttaaacgatatcaaagaagagcttggggatgtattggataatatttttattctcgcagatcaatataacatttccttagaagaaattattgaggcacataaaaacaaattagaaaagagatttgaagaa

SEQ ID NO: 1742 - protein, 105 aa, Streptococcus agalactiae
MDITAYQKWVSEFYKKRNWYQYNSFIRSNFLCEEVGELAQAIRKYEIGRDRPDEIEKSNNENLNDIKEELGDVLDNIFILADQYNISLEEIIEAHKNKLEKRFEE

SEQ ID NO: 1743 - DNA, 564 bp, Streptococcus agalactiae
atgaaaataactgtcttttgcggtgcaagcaacgggaataacccaatctacagtcagaaaatagtagaacttggtgaatggatgattaaaaataatcatgatttagtttatggtggcggaaaagttggcttaatgggagtaattgctgatactgttattaataatggtggccaagcaattggcgttatacctacatttttaaaagatagagagatcgcccacactaatttatcaaagcttattgttgtcgaaaatatgccacaacgaaaagggaaaatgatgtctcttggagaagcatatattgcattacctggtggaccaggaactttagaggaaatttcagaggtaatctcttggtctcgaattggtcaaaatgatagtccatgcattctttataatatcaatggttatttcaatcacctagaaagtatgtttgatcatatggtctctgaaggcttcctgagtcaaaatgatagaaataacgtactattctcagacgatatcattgaaattgaaaagtttattaaagattatcaatcacctacaattcgtaagtatagcaat

SEQ ID NO: 1744 - protein, 188 aa, Streptococcus agalactiae
MKITVFCGASNGNNPIYSQKIVELGEWMIKNNHDLVYGGGKVGLMGVIADTVINNGGQAIGVIPTFLKDREIAHTNLSKLIVVENMPQRKGKMMSLGEAYIALPGGPGTLEEISEVISWSRIGQNDSPCILYNINGYFNHLESMFDHMVSEGFLSQNDRNNVLFSDDIIEIEKFIKDYQSPTIRKYSN

SEQ ID NO: 1745 - DNA, 153 bp, Streptococcus agalactiae
atgatagatgaagaatttaaaaatttggtagaacaaaaaagtataggtaaaaaactaaatatcaataataaagaagctattgaagaattttttgtagatgaagatatttctgagtatgattctttattttcgaataaaattgaaaagttagaa

SEQ ID NO: 1746 - protein, 51 aa, Streptococcus agalactiae
MIDEEFKNLVEQKSIGKKLNINNKEAIEEFFVDEDISEYDSLFSNKIEKLE

SEQ ID NO: 1747 - DNA, 1125 bp, Streptococcus agalactiae
atggcaaatgcaagatatagaaggagaggaaaccagaatttatgggcttatgaaatccgagaggaaggtaaaacagttgcttataatagtggctttaaaacaaagaaactagcagaggcagaagcagagcctattctccaaaaattgagaactggtagcataatcacaaaaaatatttcattaccagaactttatcaagaatggctagatttaaaaatcatgcctagtaatagaagtgatgtgactaaaaagaaatatcttagtcggaaggtaacgcttgaaaagctatttggtgataaacccatttctcaaatcagacctagtgaatatcaacgaattatgaataactatggacaacgagttagtcgcaatttcttaggccggttaaatactggcgtgaaacagagtttgcaaatggctattgctgataaggttatgatagaagattttactcaaaatgtagaattattctcaacagtaaaaagtcaggatgcagatagtaaataccttcatagtgaaaaagcttatttggatctcattaatgctgtaaaagataaattcaattataagaaatcggtagtaccatatattatctattttttattaaaaacaggtatgagatacggagaattaattgctttaacttgggaagatattgattttgataagggaatctttaaaacatatagaagatttaactctgaaacaagtcagtttgttccacctaaaaataaaacctcaatcagaattgttccagttgataatgagtgtctagaaatcttgaaaaatcttaagattgaacaaaatcaatcaaataaagagcttggattacaaaatacaaacaatatggtatttcaacattttggttatcctaatagtgtaccgagtacaaacggtacaaataaggttttaagaggcatcgttcaagagttgaatatagaacccatcattacaacaaaaggtgctagacacacctatggaagcttcctatggcatagaggatatgatctaggaattattgcgaaaattcttggccataaagatatttctatgctaattgaagtctatggtcatactcttgaagaaaaaattcaagaagagtacaatgagataaaacaactatgg

SEQ ID NO: 1748 - protein, 375 aa, Streptococcus agalactiae
MANARYRRRGNQNLWAYEIREEGKTVAYNSGFKTKKLAEAEAEPILQKLRTGSIITKNISLPELYQEWLDLKIMPSNRSDVTKKKYLSRKVTLEKLFGDKPISQIRPSEYQRIMNNYGQRVSRNFLGRLNTGVKQSLQMAIADKVMIEDFTQNVELFSTVKSQDADSKYLHSEKAYLDLINAVKDKFNYKKSVVPYIIYFLLKTGMRYGELIALTWEDIDFDKGIFKTYRRFNSETSQFVPPKNKTSIRIVPVDNECLEILKNLKIEQNQSNKELGLQNTNNMVFQHFGYPNSVPSTNGTNKVLRGIVQELNIEPIITTKGARHTYGSFLWHRGYDLGIIAKILGHKDISMLIEVYGHTLEEKIQEEYNEIKQLW

SEQ ID NO: 1749 - DNA, 183 bp, Streptococcus agalactiae
atgacaaataatgtaatgactaataaagacttaattgaaatgggctattgtccttcaacagcaaaccatattatccatcaagctagaaatttaatggtggaacgtggttatactttctatgatcgtaaacgtcttatggttgtccctagaagtgcagtttcagaagtgattggacttgaggta

SEQ ID NO: 1750 - protein, 61 aa, Streptococcus agalactiae
MTNNVMTNKDLIEMGYCPSTANHIIHQARNLMVERGYTFYDRKRLMVVPRSAVSEVIGLEV

SEQ ID NO: 1751 - DNA, 1026 bp, Streptococcus agalactiae
ttgtttaacagcgttaagatagattatttcgctgttacagtaaaagatgtcactccagagtatgtaatagagaaacttttattaatacctttaaccaattttactttgaacgaatggggagtcaataagtatcaacgtcactatgcttgttcagagataaaagtttactttaacttagatcctaatagtagcatgggagttcatgttgaactaaaaggacaaggctgtcggcagtatgaggaatttatagaaggtaatgataataattggactagtttagtaaagagactaattgataataattcgaactttaccagattagatattgcgaatgatatttttgatgagtcgttaaatgttcaaaggctttatgagtatagtaaaaaaggcttatgtataacaactgcgagacatgcagagtaccatgaaaaattcgttattgattcaggtgaactcgttggtgaaacagttgtctttggtgcaagaggaaaccaacaatggtgtgtttataataaattaatggagcaaaatggaaaattacagacggatattgacattaattcatgggttcgagctgagctaagatgttggcaagagaaggctaatctaattgctcatcagctaaatgatatgcgccctctcgcctctatatattttgaggctatcaatggacattaccgttttgtttctccaaaagcaagagataaaaataaacgaagaagagaatctgtaagatggtggcaaaactatatcaatacagaggagaaaacacgactgagtattgtgagagaaaaaccaacattaaggcagtctgaagcgtggactgataaacaagtgtcaaagacaattgcaaaggtttatatggcaaaatacgaagcctacggtatcgatcaggcagaggtctttttacaagacttacttcgcaggggagttgaaaagtttactgataatgacgaaaaggagattgaacaatatgtacgtgaacagcaaagctctgaatattggggcataaaaaaagccgacttg

SEQ ID NO: 1752 - protein, 342 aa, Streptococcus agalactiae
MFNSVKIDYFAVTVKDVTPEYVIEKLLLIPLTNFTLNEWGVNKYQRHYACSEIKVYFNLDPNSSMGVHVELKGQGCRQYEEFIEGNDNNWTSLVKRLIDNNSNFTRLDIANDIFDESLNVQRLYEYSKKGLCITTARHAEYHEKFVIDSGELVGETVVFGARGNQQWCVYNKLMEQNGKLQTDIDINSWVRAELRCWQEKANLIAHQLNDMRPLASIYFEAINGHYRFVSPKARDKNKRRRESVRWWQNYINTEEKTRLSIVREKPTLRQSEAWTDKQVSKTIAKVYMAKYEAYGIDQAEVFLQDLLRRGVEKFTDNDEKEIEQYVREQQSSEYWGIKKADL

SEQ ID NO: 1753 - DNA, 417 bp, Streptococcus agalactiae
atggcaacaattaaattaacagatacagtaagtctaggtgacttaaacttggaaaaatctcaatttgaaattcccaaaaaagtaattatcttatccgcacgtattaacaataaatataataatatcaatggtgaatcagttcaaactgatgaaatttcaaaaataacttgccaagtacaagatgcggaaaaagttaaagtcttaaaagaaatgggaatgtctgccgacgacttaaaaacaattccattagaaatcttggataatcttgataagattagtaaaattgcaagcaatgatgggcttattgaaaaaacgattgaattgattaatccccaagttcgtctagcatggaatataaatcgaaaaggttggggtggaataaaactgactacctcagatatcaaaattataggtgaa

SEQ ID NO: 1754 - protein, 139 aa, Streptococcus agalactiae
MATIKLTDTVSLGDLNLEKSQFEIPKKVIILSARINNKYNNINGESVQTDEISKITCQVQDAEKVKVLKEMGMSADDLKTIPLEILDNLDKISKIASNDGLIEKTIELINPQVRLAWNINRKGWGGIKLTTSDIKIIGE

SEQ ID NO: 1755 - DNA, 612 bp, Streptococcus agalactiae
atgacatatataattcaaaatttcggtccaaatttgactagattacgaaaagaacgtggaatcagtcaagttgaactttccaatcaactccaaattggtaagcagtcaatttctgattatgaaaagcaaaaggcgtttcctacatttgctaatctagataaaattgcagaatattttcgtgcaacccccactcaactattcggaaccataaaagaaattgagctagagaatagtgtcttagaaacagatacttatacttcaaaagcagatcatattcttaagtctgttaaagaattttatgaactaactaattatcttaatgattttaatagcccagaattttacaccagcgaaacaattaataatttgtatcatcttattactccaaaaccaatattggatccagaaactgatgaacaacttatgagatttattccaactggaaaactagtacgagcagaagatattagcggaaatcccgaagactatgaattggcatttaaaccaagtccacttactcaaactttaagtagaatagatgaaataaatgaactttatgaaaaagtaaggtttgttgaagcttttaaacataataatgaaactaattctaga

SEQ ID NO: 1756 - protein, 204 aa, Streptococcus agalactiae
MTYIIQNFGPNLTRLRKERGISQVELSNQLQIGKQSISDYEKQKAFPTFANLDKIAEYFRATPTQLFGTIKEIELENSVLETDTYTSKADHILKSVKEFYELTNYLNDFNSPEFYTSETINNLYHLITPKPILDPETDEQLMRFIPTGKLVRAEDISGNPEDYELAFKPSPLTQTLSRIDEINELYEKVRFVEAFKHNNETNSR

SEQ ID NO: 1757 - DNA, 765 bp, Streptococcus pyogenes
atggctaaaaatagtccccaagatttaataaatagagaaattttctcaacaaatctcaacatgcttatggctaaaaagaatatcaaacagatagatattcacaacaaactaggaatacctaagagtacgataactggctatgttaaaggtcgttcactcccaactgctggaaacgttcaaaagctggcggacttcttcggagttctaaaatcagacattgacccccgttttgattctaataatattgaaacaaatagtaatattatcccatcaaccctacaaaaagtaacatctactttatctcagctagaacacaagcgacaattaaacgtccttgattatgctgaaacacaattagaacaacaaaacacagtagaagaaccacaagccacctactacacttacaattactacgaccacgcagcttcagctggtacaggtcagtatctaaatgatgtacaagtagaaacaattgaattaccagtcgattacgacgctgattttgtcataccggtttatggcgattctatggaacccgaataccattctggggactatgtatttatcaaactatctattaacctgtcagatggtgatataggagtttttgagtattacggtgatgcttatatcaaacaacttgttataaacgattctggagcatttctgcatagtctgaacgacaagtatgacgatatactcatagatagagatagtgatttccgtattatcggagaagttattgggagttttacatctaaatca

SEQ ID NO: 1758 - protein, 255 aa, Streptococcus pyogenes
MAKNSPQDLINREIFSTNLNMLMAKKNIKQIDIHNKLGIPKSTITGYVKGRSLPTAGNVQKLADFFGVLKSDIDPRFDSNNIETNSNIIPSTLQKVTSTLSQLEHKRQLNVLDYAETQLEQQNTVEEPQATYYTYNYYDHAASAGTGQYLNDVQVETIELPVDYDADFVIPVYGDSMEPEYHSGDYVFIKLSINLSDGDIGVFEYYGDAYIKQLVINDSGAFLHSLNDKYDDILIDRDSDFRIIGEVIGSFTSKS

SEQ ID NO: 1759 - DNA, 1554 bp, Streptococcus agalactiae
gtgaattttatagaacaaatcagtgaaaacaatcaattcccaattatatttgttggttcaggtattactcaaagatattttgagaatgcaccgacatgggagaaactattaaaagatatatggctagagttgtttgatgaagaatcatattatgcaaaagccttcgaattaagagaaagatttgaaaacaatgattttgatatttatactaatctagcttcattattagaaaaagaagtgtcaaaagcttttataaatggtaatattcaagttgataatttagacttaaagacagcttatgaattaaatatatctccatttaaacagttagtagcaaatagattctcaaacttaaaaattcgggaagagaaaattgaggagataaaacaattttctcaaatgttatctaaagcaagaataataattacaactaattacgataattttattgaagagtgtttaaaaacaataaatgtcagtgtgaagattaatgtaggaaataaggggctatttttaaagtcttctgattatggtgaattgtataagatacatggaactgtagatgatgcttcaacaataactataacaaaggaagactatgaaaagaatgtaacaaagtcagcattaattaatgcaaaaatactttcaaatttggtggagtcaccaatcctatttttgggctattcattaactgatgaaaatattagaaaattattgacagattttgcagaaaatagtccttttgatatatcggaatcagctcaaaaaataggtgtagttgaatatctaccagattctgaatctattgaaacagtggtctcaagcttacctgacttaagcgtttactattcgtgtttaaaaactgataattttaccaatatttatagattaatctctaagataaatcaaggatttttaccttcggaaatagcgaaatatgaaaatgtatttcgaaaaataatagaagttaaaggagagagcaaagatttaaaaactgtcttgactagttatgaagatttagcaaacctaacagaggatgaaattcgttcgaaaaatatagttgttgcctttggggatgaaagatacatatataagtttccagattttaaagagtatgttagatcatattttctagataaagaaacaattcctcaggaaattgttattcgatttattgcaacccaaccagtagcaagtcatcttccaataaaaaaatatatgtttgcaatgtcagaatatatttctaaagattcaaataagtacactgaaaacattaaaaaaagattatcaaaggaagaagagctatcattagatgactttactagtagtattggcgtcccattgctacactcaaaaacgttagaaagacaaacggaaattgttggcatacttgaagctgacgtaccggacaatgttagatataattttatagcaactcatattaaaaattttccaaaagaagaattatttttgctagttgaaaaaataattgatgaaggaatttttgaaacgtctagacgaagatttttgaaagcttttgatttattgcattac

SEQ ID NO: 1760 - protein, 518 aa, Streptococcus agalactiae
MNFIEQISENNQFPIIFVGSGITQRYFENAPTWEKLLKDIWLELFDEESYYAKAFELRERFENNDFDIYTNLASLLEKEVSKAFINGNIQVDNLDLKTAYELNISPFKQLVANRFSNLKIREEKIEEIKQFSQMLSKARIIITTNYDNFIEECLKTINVSVKINVGNKGLFLKSSDYGELYKIHGTVDDASTITITKEDYEKNVTKSALINAKILSNLVESPILFLGYSLTDENIRKLLTDFAENSPFDISESAQKIGVVEYLPDSESIETVVSSLPDLSVYYSCLKTDNFTNIYRLISKINQGFLPSEIAKYENVFRKIIEVKGESKDLKTVLTSYEDLANLTEDEIRSKNIVVAFGDERYIYKFPDFKEYVRSYFLDKETIPQEIVIRFIATQPVASHLPIKKYMFAMSEYISKDSNKYTENIKKRLSKEEELSLDDFTSSIGVPLLHSKTLERQTEIVGILEADVPDNVRYNFIATHIKNFPKEELFLLVEKIIDEGIFETSRRRFLKAFDLLHY

SEQ ID NO: 1761 - DNA, 1119 bp, Streptococcus agalactiae
atggcaacatatagacaaagaggtaaaaagaaattatgggattatagaatattcaatgaaaaaagtgagttagttgcttctggttcaggttttaagacaaagcgtgaagctatgaatgaagctatgaggatagagcaacaaaagttattagtaaattctatatcttctgatataacattgtatgatttgtggtttgaatggtacagtttaattataaagcctagcaatctagcagagactacaaagaacaaatattttacaagaggttctgttattcgtaaactttttggaaatcagaaagtaaataaaataaagcatagtgcgtatcagaggaaattaaatacgtacgctgaaaaatacactaaaaaccatgttagaaggttaaattcagatataaaaaaagctatccaatttgctaaaagagatggtgtcttattatctgattttactgatggagttgtcatagctggtaggaaatttgttaaggatgcagatgataaatatctacatagtatttttgattacaagaaagtgatatcttatttagaaaacaatttggattattcaaatagtatcgtttattatttattactggtgctatttaaaacaggtttacgagtgggtgaagctttagcattaacttgggatgatgttaattttgaagatctagaaattaagacgtatcgaagatttagtggcgataagggaacttttagtccacctaaaacaaaaacttctatccgcactattcctattagtcaatctttagcattaatcttaagagatttgaaggatgatcagcaagttatgttgaaaaacttaaaaattgtaaacatgaataatcaaatattttatgactatagatatggtgtttcgacaaatagtgcgataaataaaagtcttaaaaatgttttaaaaatattaaatattaattcaaaaatgactgcaacaggtgcaaggcatacttatggaagttacttattagcaaaaggtgtagatatttgggtagttgcaagattaatgggtcataaggatattacacagttacttgaaacttatggtcacgtcttgacagaagtaataaataaggaatatgaaacggtcagaagtttagtatct

SEQ ID NO: 1762 - protein, 373 aa, Streptococcus agalactiae
MATYRQRGKKKLWDYRIFNEKSELVASGSGFKTKREAMNEAMRIEQQKLLVNSISSDITLYDLWFEWYSLIIKPSNLAETTKNKYFTRGSVIRKLFGNQKVNKIKHSAYQRKLNTYAEKYTKNHVRRLNSDIKKAIQFAKRDGVLLSDFTDGVVIAGRKFVKDADDKYLHSIFDYKKVISYLENNLDYSNSIVYYLLLVLFKTGLRVGEALALTWDDVNFEDLEIKTYRRFSGDKGTFSPPKTKTSIRTIPISQSLALILRDLKDDQQVMLKNLKIVNMNNQIFYDYRYGVSTNSAINKSLKNVLKILNINSKMTATGARHTYGSYLLAKGVDIWVVARLMGHKDITQLLETYGHVLTEVINKEYETVRSLVS

SEQ ID NO: 1763 - DNA, 330 bp, Streptococcus agalactiae
atgagtatgcaacaggtttttaatgtgagtgttcctgtaccagatgatgttgttattatttcaaaagaagaatatttaaatttattaagtgataatgaacaaggcaagtggtgggatattgataacttgcaagagttattgggaattggaaggtcaaaattgattaatgatattttgttaaatccagatataaaaaaagaagtagatttatcaattaatccaaatggttttattgtttatccgaaaggtaaaggtagtcgatataaaatattagcaacaaaagctagaaaatattttgaagataattttggttctattttattaaatagt

SEQ ID NO: 1764 - protein, 110 aa, Streptococcus agalactiae
MSMQQVFNVSVPVPDDVVIISKEEYLNLLSDNEQGKWWDIDNLQELLGIGRSKLINDILLNPDIKKEVDLSINPNGFIVYPKGKGSRYKILATKARKYFEDNFGSILLNS

SEQ ID NO: 1765 - DNA, 630 bp, Streptococcus agalactiae
atgataggggattattcagtaatggattgggctactttaggtggtgttgtaggaattatttttacaaatgtgggagttttgatttcaaactctagggataataaagctattcaacgagaacttgagcttttagaagaaggtcaagagaaattggtagacgaattttccaaaatttcgacaaatcaatatgataaatatgttctgatacaaagcaatttatcaaacaatattgaaaagaataaacaagaattagttcaaaaaaactcatatgttaaagaagatactaaatatatccgtgatgaaatgcttattgagaaaaagtcaaaggaagaagtttataatcatgtgaaaaatggagataaacttattgaaaaaatggcttttgctaatgaattaattttgaagtttggtgaagtaagcagagaaaatcaaatgttaggcttaaaagttaattctttagaggaaaaaatagtcgatttatcaaatcaacctaaaaatgatgaaatatcaaaattacgtaaatcaatttcaagttttgaaagggaattatctaggtttgaggatgtcggttatagcgaagcagaagaaataaaaagtactttaagaagaatattaaatgatcttgaagga

SEQ ID NO: 1766 - protein, 210 aa, Streptococcus agalactiae
MIGDYSVMDWATLGGVVGIIFTNVGVLISNSRDNKAIQRELELLEEGQEKLVDEFSKISTNQYDKYVLIQSNLSNNIEKNKQELVQKNSYVKEDTKYIRDEMLIEKKSKEEVYNHVKNGDKLIEKMAFANELILKFGEVSRENQMLGLKVNSLEEKIVDLSNQPKNDEISKLRKSISSFERELSRFEDVGYSEAEEIKSTLRRILNDLEG

SEQ ID NO: 1767 - DNA, 789 bp, Streptococcus agalactiae
atgtcaaaagtaaaagttttaagtttaattactgtttcaggactatttttaatggctggtaatttatcagcaagtgcagatgttgtaattagtggaggtgatactataatgctatcaggggtagatgcaggtgtatctgattctataatgccaccaccatcaagtataaatccagtaacagataccacagaaccaagtgcgccaacaccaagtacagatccaataacagataccacagaaccaagtgcgccaacaccaagtacagatccaataacagataccacagaaccaagtgcaccaacaccaagtacagatcaaacaacaggtacgacagattcaagtactccatcatcaagtacaacaaatccagtagatggaattactgataatggtactaaaccaaatgccggtattgacaaaccttctacgaataaacctagtgatcattcagaatcatctataaaaccagtaacaaagccaactattaatcaacctattacaactgtaacaggagatcaagtcattggtactcaagatggtaaagttttagtacagacaccatcaggtacgcaattaaaagatgctgctgaagttggtggaaatgttcaaaaagacggtactgtagcaattaaaaaatcagatggaaaaatagaagtattgccaaaaactggtgagggtaagactatctttacaatagtaggtctcttgttaattgctggagcagtttggattggttttaaagataatataaaaaagtatttaacctttttcaaaaagaaaagtgaaaaa

SEQ ID NO: 1768 - protein, 263 aa, Streptococcus agalactiae
MSKVKVLSLITVSGLFLMAGNLSASADVVISGGDTIMLSGVDAGVSDSIMPPPSSINPVTDTTEPSAPTPSTDPITDTTEPSAPTPSTDPITDTTEPSAPTPSTDQTTGTTDSSTPSSSTTNPVDGITDNGTKPNAGIDKPSTNKPSDHSESSIKPVTKPTINQPITTVTGDQVIGTQDGKVLVQTPSGTQLKDAAEVGGNVQKDGTVAIKKSDGKIEVLPKTGEGKTIFTIVGLLLIAGAVWIGFKDNIKKYLTFFKKKSEK

SEQ ID NO: 1769 - DNA, 546 bp, Streptococcus agalactiae
atgaaacgtagaaaaatagttttatttttaatggtgttagtgatggcttttatagtttataaagttattcaaaaagataatccagtgattaaaacaagtggtaatcatacaaaagttgaacgagttgaaccgaaacataaggttaagtcttatgattcaactaaagaagcaaaatctactttggaagctagtgatcgtcaagtatctgataaggaaaaggagaaggttaaaagatctataactgtacctattgattaccttgtaaaaatcccaacacaatcagatattaagggtgattatcaaaataaattatccattacaaatcctacagttgcccaaactgtaaaaaccatgttgatggctggttatcattttgatttggaaagtttacaagtatatgagtcagatgcgagtaatgtttatcagtttactattaatttagtaacagataaaagagacaaattaagtttagctggtaattatgtattaggtacagaccaatttgagattgcgagtgtacatggtacacctgtaaatgtagtattt

SEQ ID NO: 1770 - protein, 182 aa, Streptococcus agalactiae
MKRRKIVLFLMVLVMAFIVYKVIQKDNPVIKTSGNHTKVERVEPKHKVKSYDSTKEAKSTLEASDRQVSDKEKEKVKRSITVPIDYLVKIPTQSDIKGDYQNKLSITNPTVAQTVKTMLMAGYHFDLESLQVYESDASNVYQFTINLVTDKRDKLSLAGNYVLGTDQFEIASVHGTPVNVVF

SEQ ID NO: 1771 - DNA, 1371 bp, Streptococcus agalactiae
ttgggaatactgattgtatttccttttttattggttttattgttgactgcttcgtcaagttctcaacaagattgtcaaattacaccagatgtatcttcacaagttgaaacctcaagtgagaatgcttccaatagtgattggacaaaaaakggaacagttgcaaatcaaacagcagagaaggtattcaatgcttgggtaagtaaaggcttatctggtgcgagtgcatcagggattgttggttgggttaattcagaaggtggatttgctatgataggtcgagcagaagggcattatggtaatgatttaaaaacaaattcaattgcctttaatgtgagacctactgggttatcttactatacgactgaagctggaggtggtatttatcaaatcacacctttcacaaagtatgccccattaggcgatcccaaatgggaagatgcagatgccatgaatgcctttgttatgaaatccattaaatcaggagactggaataaagcaatggatttatcaggtggaaatcattcttttgaagagatggcacagatgactgatcccaagcaggccactttagtttggaatgcttacgaacgaggaaatactgcatatattaataaagctcaaaagactgcggatgggcaaaaagcctatgaaatatttaatggttcaaaatataaatttgatgcagaaaaattttctaaaagttttggtggtggttcaaaaacgtcctcgtctggtaagagcgatataatttctgattctacagttttatctctttgtgattcagctagtaatgcggtacagggcttatttggtaaagataagtcagggaaagttaaatacacttcttataatgcatggaaaccagatcaattaccaagtgatttgaaaaagtatgcaatagatcctaagtcagttggtttattttatcgaacgtctagtggatggaatgcgatagcttctactggtggtcaatgtacagatctttcagcaagtttgatgtatggtttatggcttaaaggcggaatgcatccaacgcaaagaatgggaaatggtaatatggttgtttctaattgggtatctgcattcggtggacgctctgaaaatactccatcttctggagctgttttttcaagttcaggtacttctagtgctgggcatactggagtggttagtcatgtatttgaaaatggcgatatgttaatagtagagcaaaattattcaacttattctggagataatagaggatttggaccatattcatggaattatcgttatgtttctactttagaattaaaaaaagagcattatagtttttataatccctctaaagctggttataaattgtctgataaagtgaaaacggtaggtagt

SEQ ID NO: 1772 - protein, 457 aa, Streptococcus agalactiae
  MISC_FEATURE (1)..(457): Xaa = Any Amino Acid
MGILIVFPFLLVLLLTASSSSQQDCQITPDVSSQVETSSENASNSDWTKXGTVANQTAEKVFNAWVSKGLSGASASGIVGWVNSEGGFAMIGRAEGHYGNDLKTNSIAFNVRPTGLSYYTTEAGGGIYQITPFTKYAPLGDPKWEDADAMNAFVMKSIKSGDWNKAMDLSGGNHSFEEMAQMTDPKQATLVWNAYERGNTAYINKAQKTADGQKAYEIFNGSKYKFDAEKFSKSFGGGSKTSSSGKSDIISDSTVLSLCDSASNAVQGLFGKDKSGKVKYTSYNAWKPDQLPSDLKKYAIDPKSVGLFYRTSSGWNAIASTGGQCTDLSASLMYGLWLKGGMHPTQRMGNGNMVVSNWVSAFGGRSENTPSSGAVFSSSGTSSAGHTGVVSHVFENGDMLIVEQNYSTYSGDNRGFGPYSWNYRYVSTLELKKEHYSFYNPSKAGYKLSDKVKTVGS

SEQ ID NO: 1773 - DNA, 99 bp, Streptococcus agalactiae
atgataaccacgaacaagtggatcaaacgtttagaaaaatctccttttgaaaaaagatatgaaataaatattgaaaaagctgaaatcgcaaccaataaa

SEQ ID NO: 1774 - protein, 33 aa, Streptococcus agalactiae
MITTNKWIKRLEKSPFEKRYEINIEKAEIATNK

SEQ ID NO: 1775 - DNA, 1998 bp, Streptococcus agalactiae
atggacaaaatagatgatggtttgattgcttcgacctttgcgaaggtaaaagatgtggatatatttgcgttaaaggcttatatggagataactcacggagctgagactggagctcaaagcattttgttagatgtttttgttaattttccctttttcctacttaacttgattgttggtttattttctgttattctacgcttttttgaaaatttcagtttgtatgatacctataaacaaacagtttatcattcgtctcaaaaattatgggaaaatctatcaggtaatgggtcttatacaagctccttgctttatttattggttgcgatttcagctttttcaatatttatttcatatcttttttcaaaaggagatttttctaaacgtttgatccacttgttcgtggttatcattttaggtatgggttactttggtacgattcaatcaacatcaggtggtatttatattttagataccgttcatcaactagctggttcgttttcagatgcggtaactaatttatcactggataatccatcaggtggtaaaacaaagatcacacaaaaatcatcagtagctgataattatgtgatgaaaacttcttatacggcttatttgtttgtcaatactggtcagttaaatggtaagtttcacaataatcaaacaggtaaagaagaaaagtttgataacgaacaagttttaggtaagtacgataaatcaggtaaatttatcactccaaaacaaaaggatatattgaattatactgataatttgggagataaggcaaccgaaggggaggaaaaaaatagatggctttctgcagtaaatgattatctttggataaaatcaggctatgttatcttaaagatttttgaagcggttatactcgcagttccattaatactcattcagttaattgcttttatggcagatgttttagtgattatattaatgtttatttttccattagctttattagtttcatttttgcctagaatgcaagatatcattttcaatgttttgaaagtcatgtttggggctgtttcctttcctgccttagctggttttttaaccttgatagtcttctatactcaaactttaatagccacctttgttaagaaaaaatttacagatggttccctgcttagtggtagtaattttaaaggtcaggcaatactgtttatgttgctaataacagttttcgtccaaggttgtgtgttttggggaatttggaaatataaagaaactttcttaagactgattatagggtctagagcttctcaagtcattaatcagtctgtagataaaattaatgaaaaagcagaaaatctaggaattacgccaaaatccatttatgagagggcacacgatatgtcaagccttgccatgatgggagctggctatggtgttggtacaatgatgaatgcacaagataattggaatgctttcaaagaaagacaacaagctaatttagatgatggtcagtctaaaactaatgatgctgataagtatgatgaagctaatgcggatgatactgttatttctaaagaggctgagctgactaatgaaggtgaatatcaatcagagttacctaaagaagcaagtaaaaggattgaacaattgggaaaggaatcttcttatgagctatcgtttatatcagaaggtaattcaacagaggaaattttaaaaaatgttaagtcggataatcacacgtttcaagaaggagatggagatacttcattaacaaatcaggatatgataacaaatgatatagaaaatcattcaaataactatacttcaccattaaaacagcgaaagcttaataagctagagggtgaattaagtcaatttaatagtgatgtatccatgacaaaaaatcatggtaaaaatgcttttgaaaagggatttaatgccagtaaaactaaggaagttagaaagcaacataatcttgaacgacagtcaaaagttttggaagaactagaaaagctgagagaaggtaag

SEQ ID NO: 1776 - protein, 666 aa, Streptococcus agalactiae
MDKIDDGLIASTFAKVKDVDIFALKAYMEITHGAETGAQSILLDVFVNFPFFLLNLIVGLFSVILRFFENFSLYDTYKQTVYHSSQKLWENLSGNGSYTSSLLYLLVAISAFSIFISYLFSKGDFSKRLIHLFVVIILGMGYFGTIQSTSGGIYILDTVHQLAGSFSDAVTNLSLDNPSGGKTKITQKSSVADNYVMKTSYTAYLFVNTGQLNGKFHNNQTGKEEKFDNEQVLGKYDKSGKFITPKQKDILNYTDNLGDKATEGEEKNRWLSAVNDYLWIKSGYVILKIFEAVILAVPLILIQLIAFMADVLVIILMFIFPLALLVSFLPRMQDIIFNVLKVMFGAVSFPALAGFLTLIVFYTQTLIATFVKKKFTDGSLLSGSNFKGQAILFMLLITVFVQGCVFWGIWKYKETFLRLIIGSRASQVINQSVDKINEKAENLGITPKSIYERAHDMSSLAMMGAGYGVGTMMNAQDNWNAFKERQQANLDDGQSKTNDADKYDEANADDTVISKEAELTNEGEYQSELPKEASKRIEQLGKESSYELSFISEGNSTEEILKNVKSDNHTFQEGDGDTSLTNQDMITNDIENHSNNYTSPLKQRKLNKLEGELSQFNSDVSMTKNHGKNAFEKGFNASKTKEVRKQHNLERQSKVLEELEKLREGK

SEQ ID NO: 1777 - DNA, 2268 bp, Streptococcus agalactiae
atgtcggattttgaagcggatctagcagatgatgttaaagaattagggttagaaacactcgattttacagttgatacgttaacacatgaaatggagataccgtatcagtttgattggttaattggagttgatcttggtaaagggcaatacaatgctaatataaaagaatttatttataatcagtttgaatctatcgcatcaaacttcgcttctttagctggttatgaggtagaagtagatgaagattggtataaagaacattcagaagaagaattacttgtctatagtttattgtctaccctgaaagccaaaagattaacggatgttgatttattttattatcaacggatgcaatttttaagatatgttccccatactaaaagtgaggttatagctaatcggaatatgttaaatgtgacagatacgttgattaaatcactagaaggtggttttttaaaattggagagtgcttatgggagttcatttgtatccgttcttccagtaggtcggttctctaccatatttaatggctttcatcttggtgaactagttcaaagaatgagttttccggttgaattaagatttaaagcggaatttatagataagacaaaattgggtggcactatgggtcgctcaaatacacgctatgatcaaatcatgaaagaagcttataacacaaatacggttcaacaagatgatatcttgatgggagcatattcgcttaaggatcttatgaaaaaagttggaaataaggaagaaatcatagagtatggttgttatttggtagttgctggttctagtttaaatcaactaaaacaacgtagatatgccattttaagttactttgatgatatgaaagtcaatgtttatgaagccagtcatgatacaccatatttatttcaagcgttactttatggtcaagatttacaaaaaacaactcgtaagtggaatcatttagtaactgctcgaggtttttcggagttgatgctttttacaaatacccaatcaggtaacaggattggttggtatattggacgagtagataatcgtttaactgcttgggattctattgacgaagctattatgggatctaaaaatcttgtcttatttaatgcgacagtcgcgaataaagaagatgttgctggtaaggttactaaaaatcctcacgtgattataactggggcgacaggtcaagggaaatcatacttagcacagatgatctttttacatactgctcaacaaaatgttcgtgtcctttatgttgaccctaaacgagaactacggcaacactatttaaaagttgtttctgatccagagtatgcacgtaagtttcctctacgtaagaagcaaattgaggaaacgaattttgtcactcttgatagttctgtcaaagaaaatcatggtgtattagatcctattgttattcttgataaggaaggtgcttcctcaacggctaaaaatatgttgctttatttgttaaaaaacgctacagagattaaattagatcaaacaacagctttaacagaagcaattagtcaagtcattgcaaaacgtgaagctggtgaagtcgttggttttaatcaggttattgaagttcttattgattctgaaagtgatgaagttcagtcagttggtcgttattttaaagctattattcagaattctattttagagttggcattttcagatggtgatgttgctggtctttcttacgaagaacgtgtgacagttttagaagttgcggatttatcattgcctaaggacggttcagatcatatatctgatcatgaaagtaattcgattgctttaatgtttgctttaggtgcgttttgtaagcattttggtgagcgtagtgatgatgaaacagttgaaatttttgatgaagcatgggtacttatgcaatcctcagaaggtaaggctgttatcaagtctatgcgtcgtgttggtcgctctaagtataatgtgttgatgctagtatctcaatcggttcatgatgcagaaaacgatgatgatacgaccggctttgggacaattttttcattttatgaaaaatcggaacgtgaagatattttaagtcatgttggtttagaagtaacacctaagaatctagaatggattgataatatgatttcaggtcaatgtctttattatgatgtttacggtaacttgaatatgatttcgatacataacattcatccagatattgatccattgttaaaacctatgaagaaaacagtatcaagtcaccttgaaaataaatatgcttcg

SEQ ID NO: 1778 - protein, 756 aa, Streptococcus agalactiae
MSDFEADLADDVKELGLETLDFTVDTLTHEMEIPYQFDWLIGVDLGKGQYNANIKEFIYNQFESIASNFASLAGYEVEVDEDWYKEHSEEELLVYSLLSTLKAKRLTDVDLFYYQRMQFLRYVPHTKSEVIANRNMLNVTDTLIKSLEGGFLKLESAYGSSFVSVLPVGRFSTIFNGFHLGELVQRMSFPVELRFKAEFIDKTKLGGTMGRSNTRYDQIMKEAYNTNTVQQDDILMGAYSLKDLMKKVGNKEEIIEYGCYLVVAGSSLNQLKQRRYAILSYFDDMKVNVYEASHDTPYLFQALLYGQDLQKTTRKWNHLVTARGFSELMLFTNTQSGNRIGWYIGRVDNRLTAWDSIDEAIMGSKNLVLFNATVANKEDVAGKVTKNPHVIITGATGQGKSYLAQMIFLHTAQQNVRVLYVDPKRELRQHYLKVVSDPEYARKFPLRKKQIEETNFVTLDSSVKENHGVLDPIVILDKEGASSTAKNMLLYLLKNATEIKLDQTTALTEAISQVIAKREAGEVVGFNQVIEVLIDSESDEVQSVGRYFKAIIQNSILELAFSDGDVAGLSYEERVTVLEVADLSLPKDGSDHISDHESNSIALMFALGAFCKHFGERSDDETVEIFDEAWVLMQSSEGKAVIKSMRRVGRSKYNVLMLVSQSVHDAENDDDTTGFGTIFSFYEKSEREDILSHVGLEVTPKNLEWIDNMISGQCLYYDVYGNLNMISIHNIHPDIDPLLKPMKKTVSSHLENKYAS

SEQ ID NO: 1779 - DNA, 621 bp, Streptococcus agalactiae
atggtaaaaaaattggaatatccgattgatagaatacatcagaatttagctttacgaaaagataaagttgttgtcgcatactatcgtattccaaataccccaatcactattacagatagtgataagaaagatagtcacaaaacgaaagtagcacaggttatcaaaaaattagctaaatataaaaattttgatatttcattaatagacttcctgcgaaacaaaatatggtacaatagttctatgaattatgaagcaagcaaacaattaactgatgtacgatttaagcgccttgttggtgttcagcgcactacttttgaagagatgttagctgtgttaaaaacagcttatcaacgtaaacacgcaaaaggtggccgaacccctaagttaagcttagaagatctcctcatggctactcttcaatacatgcgagaataccgcacttatgaacaaattgcggctgattttggcattcacgaaagcaacttaatccgtcgaagtcaatgggttgaatcaactcttattcaaagtggttttacgatttcaaaaactcatcttagtgctgaggatacggtgattgtggatgcaacagaggtaaaaatcaatcgtcctaaaaaaatcaac

SEQ ID NO: 1780 - protein, 207 aa, Streptococcus agalactiae
MVKKLEYPIDRIHQNLALRKDKVVVAYYRIPNTPITITDSDKKDSHKTKVAQVIKKLAKYKNFDISLIDFLRNKIWYNSSMNYEASKQLTDVRFKRLVGVQRTTFEEMLAVLKTAYQRKHAKGGRTPKLSLEDLLMATLQYMREYRTYEQIAADFGIHESNLIRRSQWVESTLIQSGFTISKTHLSAEDTVIVDATEVKINRPKKIN

SEQ ID NO: 1781 - DNA, 408 bp, Streptococcus agalactiae
atggaagaagaaaaatattttgattacagcaggggcttgaatgctccttactggattcaggaagttaaaacggcaaaaggcaaagtgatttggtatttttctacacctatgcagttatcattttttattgttttctttatcatcttaatgttgatgctgacggtatgttctccattaatgcaggtgttaaatgctttaacgcattccgtttcaatgctcttgtattggtttgttccaagcaagttagcgaaattttatgtagaatatgaaccgcaaggaaaaaagatgcatatctttttgtgggattatctggtttatctcaaagattttgggttaaataaaaaaggtatctatcaaggagaacgtgttgatattgaagaagaaatagtttttgagaaaacgaaaata

SEQ ID NO: 1782 - protein, 136 aa, Streptococcus agalactiae
MEEEKYFDYSRGLNAPYWIQEVKTAKGKVIWYFSTPMQLSFFIVFFIILMLMLTVCSPLMQVLNALTHSVSMLLYWFVPSKLAKFYVEYEPQGKKMHIFLWDYLVYLKDFGLNKKGIYQGERVDIEEEIVFEKTKI

SEQ ID NO: 1783 - DNA, 264 bp, Streptococcus agalactiae
atgaatttagtaaaagtgaatagtgttattttagcaggtggtcccaacgtttcaggactaaagcaattttttcaaggtgatgggatttacctcattagtgtaattgctgtctttataattattaagaattggaaagaagctaattggttaaaagttttctcaaccttagctatttatgcgattattgtatcaatgcttaaaggtcaacagattctatcttttttgggtggaatgcttcgctggtttggtgttgagacggggtta

SEQ ID NO: 1784 - protein, 88 aa, Streptococcus agalactiae
MNLVKVNSVILAGGPNVSGLKQFFQGDGIYLISVIAVFIIIKNWKEANWLKVFSTLAIYAIIVSMLKGQQILSFLGGMLRWFGVETGL

SEQ ID NO: 1785 - DNA, 951 bp, Streptococcus agalactiae
atgattgatatacaaaaaataaaaaagtttctattgagatatacaaagaaagaagagggaggtaaacagcctaagacaaaagaagtaaagcaaaggacagccaattttattgtctatggtatcttaggtttgttatttattgtaggattttttggatcattgagggcaattggcttatctaatcaggtacaacatttaaaagaaacagttattgctgtagaaaaaaagtcaaaacataagaagactgatgattcattagatatatctagaattcagtattacatgaataattttgtctactactatatcaactattcacaagatactgcagatcaaagaaaaacagaattagaaaattattattctttctcaactgccagtatgacagatgatgttagaaagtctaggactttgcagacacaacgtttaataagtgttgaaaaagaaaaagattactatatagctttgatgcgtattggttatgaagttgataaaaaatcatatcagatgaacttggctgttccttttcagatgcaaagaggattgcttgcaatcgttagtcaaccttatactgtggcagaagatttgtatttaggtaaatctaaagcatttgagaagaaaacattagatcaagtcaaggaactatcgaaagaacaagtaagttctattcaaaagtttttaccagttttctttaataaatatgccttaattaacaagacagacttgaaactgttaatgaaaactccagaactgatggggaaaggatttaaagttagtgagctagatcttaataatgcgatttattatcaagaaaaaaagcatcaagtcgtgcaattatcagtaacttttgaagatcttgtaacaggtggcacacgatcagaaaactttacattatatttatttaaagcagacaatggttggtatgttgaagagatgtatcattattttaaa

SEQ ID NO: 1786 - protein, 317 aa, Streptococcus agalactiae
MIDIQKIKKFLLRYTKKEEGGKQPKTKEVKQRTANFIVYGILGLLFIVGFFGSLRAIGLSNQVQHLKETVIAVEKKSKHKKTDDSLDISRIQYYMNNFVYYYINYSQDTADQRKTELENYYSFSTASMTDDVRKSRTLQTQRLISVEKEKDYYIALMRIGYEVDKKSYQMNLAVPFQMQRGLLAIVSQPYTVAEDLYLGKSKAFEKKTLDQVKELSKEQVSSIQKFLPVFFNKYALINKTDLKLLMKTPELMGKGFKVSELDLNNAIYYQEKKHQVVQLSVTFEDLVTGGTRSENFTLYLFKADNGWYVEEMYHYFK

SEQ ID NO: 1787 - DNA, 252 bp, Streptococcus agalactiae
atgtttaattttactgaagaagcatggaaagattatgtttcttggcaacaggaagataaaaaaatcttgaaacgaattaatcgtttgatagaagatattaaaagagacccatttgaaggcattggaaaaccagaacctttaaaataccattattcaggggcttggtctcgaagaattacagaagaacataggttgatttatatgatagaagatggagaaatctattttttatcttttagagatcattataag

SEQ ID NO: 1788 - protein, 84 aa, Streptococcus agalactiae
MFNFTEEAWKDYVSWQQEDKKILKRINRLIEDIKRDPFEGIGKPEPLKYHYSGAWSRRITEEHRLIYMIEDGEIYFLSFRDHYK

SEQ ID NO: 1789 - DNA, 273 bp, Streptococcus agalactiae
gtgattaatatggaggctattgtttattcacattttagaaataatttaaaagattatatgaagaaggtcaatgatgaatttgagcctttgattgtagttaataaaaatcctgatgaaaatatagtggttttatctcaagatagctgggaaagtttacaagaaacgattcgtttgatggaaaatgattatctatcacataaggttattaatggtatatcacaagttaaagagaagcaagtcactaaacatggtttaattgaggtagaagatgtt

SEQ ID NO: 1790 - protein, 91 aa, Streptococcus agalactiae
MINMEAIVYSHFRNNLKDYMKKVNDEFEPLIVVNKNPDENIVVLSQDSWESLQETIRLMENDYLSHKVINGISQVKEKQVTKHGLIEVEDV

SEQ ID NO: 1791 - DNA, 471 bp, Streptococcus agalactiae
atgattgcaattataaggactcgtgaaaaaggtagaagtcaatttttatgtgagttagacatcatgcagtttacggaaaatcaagtaagaaaccgtatgatagaaaaaggcattaaggatgatgccttttttatttgtggtttttctgattggaatgttgataggattatgtcacttacagaagtctatcttttaaaaagatgtattgaaggactttatgatggtgatgactatattgttcaatatcttttgaaaaaaggtttatcagttcattcaatagtgacaaaatattatatatttttgtcaaataatgaaaataaagtaatgaaatatatcttaaggaaagttgaatttgattctttaattgatttttggcaacggtcagtaacttgggtaaatgctttaaatgcttatattgaagaaggaatagtattaaacacctcaaaaggtttttacgtgttaaaaacagaa

SEQ ID NO: 1792 - protein, 157 aa, Streptococcus agalactiae
MIAIIRTREKGRSQFLCELDIMQFTENQVRNRMIEKGIKDDAFFICGFSDWNVDRIMSLTEVYLLKRCIEGLYDGDDYIVQYLLKKGLSVHSIVTKYYIFLSNNENKVMKYILRKVEFDSLIDFWQRSVTWVNALNAYIEEGIVLNTSKGFYVLKTE

SEQ ID NO: 1793 - DNA, 489 bp, Streptococcus agalactiae
gtgtcaaaaatggatgttagtgcaattgttagagatataaaaactggtagagctacgttagtttgttttcctgtggaaatgagtgagcttaagttagctttggggcttcgtgaagaagatgatttagagtatattattgcagattcggattgtcagttactaaaagaacatgattctattgagatgattaatcaatttgttgaactggtagagaatgttgatagtgaacttgttaaagcagtgcatcaggtaataggttatactgcctcagactttgtggattatgattttaattttggtgattgttgtttactgtctgatgtcacaactagacgagaactaggtgaatattatttcgatgaattaggcgtacaaggagttggtaaagaggctctggagatgtattttgatcatgaagcttatggtcgagatattgacttagaaagccaaggtggtttttcagactacggatatgtcgaaatatcaggg

SEQ ID NO: 1794 - protein, 163 aa, Streptococcus agalactiae
MSKMDVSAIVRDIKTGRATLVCFPVEMSELKLALGLREEDDLEYIIADSDCQLLKEHDSIEMINQFVELVENVDSELVKAVHQVIGYTASDFVDYDFNFGDCCLLSDVTTRRELGEYYFDELGVQGVGKEALEMYFDHEAYGRDIDLESQGGFSDYGYVEISG

SEQ ID NO: 1795 - DNA, 270 bp, Streptococcus agalactiae
atgtcaggaacacgttcagaagcagataaaaagttgttagtggttactcaggagctttcagagctgttggtcagccatcagtatgaacagtcatgggaaaaagctggagagttaaatagcttacttaaaaagcgtgaagaattgactttaccaggttatatggtcgacatgattcaacaacatttgaaatcatactactaccaaaataatatgattaataaggctcataagtctatgtcagcgattggtcataaactacaagaatttcat

SEQ ID NO: 1796 - protein, 90 aa, Streptococcus agalactiae
MSGTRSEADKKLLVVTQELSELLVSHQYEQSWEKAGELNSLLKKREELTLPGYMVDMIQQHLKSYYYQNNMINKAHKSMSAIGHKLQEFH

SEQ ID NO: 1797 - DNA, 567 bp, Streptococcus agalactiae
atgagttttcgtaaatacacaaaagccatagtaattgttcacggtaaaagtgaactggattttgttaaacatattaaatcaaaactgaggcttcctcttgaaatatactcgaggtcaaatgggaaaacatctatacaaatatcttcgattaatgatattttaaaaaatagagattttaaaactaaaaaatgttttaaagaaaaatttttcaaggttgagtgcgataaaaaaggaaatcccaaaaacgttaaaatctttattatcatggatattgatgatacatcgcaggaaaagatagattcctataagagttctacattatttgtaaaagattggaaaaaagattttattgttcctatatggaatgatagcaatttcgaggaggtccttaatgatattggttattggtatgctaagaatgataaagaaaagagacactacaaaaagctgtttcctgtagaacgaggggagcaggatgtggagacgataaaagagctaagagataagttaatttcttcaaataagagtaatttagatgaatttttaactttctgtattgaatcctcg

SEQ ID NO: 1798 - protein, 189 aa, Streptococcus agalactiae
MSFRKYTKAIVIVHGKSELDFVKHIKSKLRLPLEIYSRSNGKTSIQISSINDILKNRDFKTKKCFKEKFFKVECDKKGNPKNVKIFIIMDIDDTSQEKIDSYKSSTLFVKDWKKDFIVPIWNDSNFEEVLNDIGYWYAKNDKEKRHYKKLFPVERGEQDVETIKELRDKLISSNKSNLDEFLTFCIESS

SEQ ID NO: 1799 - DNA, 1353 bp, Streptococcus agalactiae
atgcatatgtttagtaaaatagaatttaaaaactttatgtccttttcaaatttgacttttgatttgctgaatagaggaaaatgtaaggatattattgcaatctatggagaaaacggttcaggaaaaacaaatattgttgaagcttttaagttactagttttgtcattacaatcaatggaatccttaaatgaaaatacacgattacaatcattattaaaagaacaaacaaataaagaagaaaatcaaaaaactaactttggtgatatatcagaaatcttagataaaatcagtttcttcaccacttttaagggcatagcgaaaaatactcatagaattgcatctgaaggtaatacgattctaaaatattattttaatatcgaaaaagataatggttattaccttctagaatataatgaaaataatgaactagtaaaagaggagctagtatttaagataaaatccaataagggagttcatttcagtattactaacatagatggtttatctcaatcattaaataagacaatttttaagaatactatttttaaagatttgactgaacaaatagaaaaatattggggtaaacatacattcctatcaatatttaataattattgtctagaagtaaatgaagagtttattaatgaacaagtttctataaattttcaaaaagtagttgatgaatttgataaaatttttatttggagtggtaattttagaggtccttttcattcgacagaattattattgaaagatatttcaaaaggtaaaattgataagtcggaaaaagaaaaactttcctatactgaggaaattatttataaatattttagtgcattatatattgatataaaagatgttaaatataagcaggatgctcaaggtcaagaaataaaatatgaactcatgatccgaaaaaatattggaggtgatcttttagatgtaccaataagtttagaatctcagggaacaaaaaatcttctggatcttctaaaagtttttaacaatgtgttggatgggaaaatatgtatcgttgatgaaattgactcaggtattcatgatcttttaatgaatagtattctgaatgacttgaaaggaagtgtgaatggtcagttaatatttacaacgcatgatacaacgttattgaaggaattatcaccgagctcagcttattttttaaatgtagatattaaaggtaataaagttatcatttctggcaatgaggcagataaaaaaataggagtaaataacaatttagaaaaattatatttgtctggtttctttggtgctgtaccagatccattagatattgatttttcagatttatttcttgatcataatttaagcgaggac

SEQ ID NO: 1800 - protein, 451 aa, Streptococcus agalactiae
MHMFSKIEFKNFMSFSNLTFDLLNRGKCKDIIAIYGENGSGKTNIVEAFKLLVLSLQSMESLNENTRLQSLLKEQTNKEENQKTNFGDISEILDKISFFTTFKGIAKNTHRIASEGNTILKYYFNIEKDNGYYLLEYNENNELVKEELVFKIKSNKGVHFSITNIDGLSQSLNKTIFKNTIFKDLTEQIEKYWGKHTFLSIFNNYCLEVNEEFINEQVSINFQKVVDEFDKIFIWSGNFRGPFHSTELLLKDISKGKIDKSEKEKLSYTEEIIYKYFSALYIDIKDVKYKQDAQGQEIKYELMIRKNIGGDLLDVPISLESQGTKNLLDLLKVFNNVLDGKICIVDEIDSGIHDLLMNSILNDLKGSVNGQLIFTTHDTTLLKELSPSSAYFLNVDIKGNKVIISGNEADKKIGVNNNLEKLYLSGFFGAVPDPLDIDFSDLFLDHNLSED

SEQ ID NO: 1801 - DNA, 297 bp, Streptococcus agalactiae
atgaagaagttgactaattttccacaaaaactaaaagaattgcgtaaagaaaaaaaactaactcaaactgagctagcgtctaaattaaatataagtcaaaagtcatatagtaattgggaaagtggtaaagctgaacctactttagataatataataaagttagcaaatatcctagatgttactgtagattatttacttggtagaagtgataattttagtaatactattgtgctttcaaaaaacaatatgaaaagtttttctaaaagactgaaagagttaaggttagaaaaagaatat

SEQ ID NO: 1802 - protein, 99 aa, Streptococcus agalactiae
MKKLTNFPQKLKELRKEKKLTQTELASKLNISQKSYSNWESGKAEPTLDNIIKLANILDVTVDYLLGRSDNFSNTIVLSKNNMKSFSKRLKELRLEKEY

SEQ ID NO: 1803 - DNA, 375 bp, Streptococcus agalactiae
ttgtatagtaaccgagaatttgcttattgtgttaatagacgaaataatttagataaaatgattgatttactagtttttatgattcctgatcgtgagttttattatcctgagattcaaacaggtgagcttagagattatcagatagacatttatgatttgattaagattggttatgttggtgtttatgaaattcaaaaagactacgaagataagttaagggaacttgctgattttaaacggaaacttttaaagtttggtttgcttatgcaacctttagaaaagcaaaaagagatagttattcgtttagctggtaaatatcgtttggaaaaaagaattctgatgagaagggaaatgtttagagatgaagaagttgac

SEQ ID NO: 1804 - protein, 125 aa, Streptococcus agalactiae
MYSNREFAYCVNRRNNLDKMIDLLVFMIPDREFYYPEIQTGELRDYQIDIYDLIKIGYVGVYEIQKDYEDKLRELADFKRKLLKFGLLMQPLEKQKEIVIRLAGKYRLEKRILMRREMFRDEEVD

SEQ ID NO: 1805 - DNA, 1287 bp, Streptococcus agalactiae
gtgggtcattttagtgaaaaaagtgggtcactaatcctaagaaggagtttgtttattgtggatgctatctatttaaaaaaatttcgaaagaaaacaggtctaaaacaaaaggaatttgctttaagttctggtttgacattgaaatcacttagaaactatgagcaaggaaagcggaagttgacacttgaaaagtatcaagagataaaatcacattttggatatctagtagaaaatgatagttcacgattacaagtgatgattgactatgtcagaattacgttaaaggatgttagggatcttgaatttttctgtcgtaactttttgcactgtgcatttaaagaatttcagccttttgaatcgaagttgatgaattacaatcatctttggaaacgtggagatatttggatatttgattttgcggataaacatgagacaggtaattttcaaataactgttcaattgtctggtcgtggatgccgacaattggaattgttgatggaaactgaaaaatttacatggcatgattggttaagttatctaagaaattcatatcgtgatgatatgaatgtgacacgttttgatattgctattgatgaattgtatctgggtaaggatagagaaaatgaacagtttcatttgtcagatatgatttcaaaatattatcgtcatgagttagattttgaaagtttgagaacttggaattatataggtggcggttctttaaatttttcggatatggaagagattgagcagaatagacaaggaatatcgctttattttggtagtcgtcaatcagaaatgtattttaacttttatgaaaaacgttatgaaattgcaaagcaggaaggaattactgttgaagaagctttagaaatttttgaattgtggaatcgttatgagatacggttatctcaaagtaaagctaatgcggcagttgatgaatttatttctggagtgccgattggtgaaatatccagagggttaattgttagtaagattgacgtgtatgatgggaaaaatgaatatgggtcgtttcaagcagatagaaagtggcaattaatgtttggaggtgttgagcctttaaaatttgttacaaagccagaggcttatagtattgaacgaaccttacgttggttaagtgattctgtttctccgtctttagctatgataagagagtatgacatgattgtggatggtgactatttacaaaccattcttaattctggggaagtcaatgaacgtggggagaagatacttgacagtatcaaagctagcttaggtattttg

SEQ ID NO: 1806 - protein, 429 aa, Streptococcus agalactiae
MGHFSEKSGSLILRRSLFIVDAIYLKKFRKKTGLKQKEFALSSGLTLKSLRNYEQGKRKLTLEKYQEIKSHFGYLVENDSSRLQVMIDYVRITLKDVRDLEFFCRNFLHCAFKEFQPFESKLMNYNHLWKRGDIWIFDFADKHETGNFQITVQLSGRGCRQLELLMETEKFTWHDWLSYLRNSYRDDMNVTRFDIAIDELYLGKDRENEQFHLSDMISKYYRHELDFESLRTWNYIGGGSLNFSDMEEIEQNRQGISLYFGSRQSEMYFNFYEKRYEIAKQEGITVEEALEIFELWNRYEIRLSQSKANAAVDEFISGVPIGEISRGLIVSKIDVYDGKNEYGSFQADRKWQLMFGGVEPLKFVTKPEAYSIERTLRWLSDSVSPSLAMIREYDMIVDGDYLQTILNSGEVNERGEKILDSIKASLGIL

SEQ ID NO: 1807 - DNA, 1716 bp, Streptococcus agalactiae
ttggctcgtttaataccacaatatagagggattaaggtaaaaccatatatgaggtatatgagttattaccttttttcttttctatttattttgtttttgacacctgtaggcgtgtatagttattactatttagatttgttaaaaatgatggataaaatgtctatgatcagtgtaggtacaggtttgtttttagcattttttgtttcttggtatttgacttggtttttgcaagaagctaatccattatttaataaactagatcgattaaaaagaatgtctaagtttttatatgagaatggctatgtttatgaaaaacgtaaaaaatcaaataagaaaacgaagacaaaatatcgttttccaaaagtttatgtgaaacaaggtaagtatgatttaagtgtttcatttgaaatggctggaggaaaatttcaaaagaaatttaaggatattggtggagaattagaagatacttttttcatggattttatggaaaaaactgatgatccacgctttaaaatttacaaattagcttattcggctttcttatcacgtattacggttaaagatgtgatatggaataaagataagggaattaagttaatggatggctattattgggatttcatcaatgatcctcatttattagttgctggtggtactggtggaggtaaaacagtattactaaggtcaatccttcgttgtcttgcggaaattggagtttgtgatatatgtgaccctaaaagagccgattttgttactatgtcagatttatcagcttttgaaggtagaattgcctttgaaaaggctgatattattgagaagtttgaaaatgctgttacgataatgtttgcacgttatgattttgttcgaaatgaaatgaagcgtttaggtcataaagacatgaaaaagttttatgattatggattggaaccttatttttttgtatgtgatgaatataatgctttaatgagttctttgtcttatcaggaacgtgagattgtagataatgcatttactcaatatatattgttaggacgtcaggttggatgtaatgcgattatagcaatgcaaaagccgtctgcagatgatcttcccactaaaattagatctaatatgatgcaccatatctcggttggtcgtctcgatgatggtggttatgtgatgatgtttggtgatgaaaatagaaataaggaatttaggtttattaaatatcttgcaggtcgtcgtgtttatggtcgaggttattcagctgtttttggtgaagtagcaagagaattttattctcctttattacctaaaaatttctctttttatgatgcttttgaaaaaataaataggcatgagaatccttttgatcctacagaaaatcaggaagtttctaaggcgattcttaaagacgaatctttgagagagtttgtggaaaaaacgtctgaaaatgagttacttaagggttcagtagggtttgattttgatgatgaaatggaggaaatggaaaatatgagtattggtgatttagctaagaaaacaggtttttcatttggtaagattaagaatttaatagatatgattgaaaaagataattatatgacttttagtcgtgaagatgaaaaggttgtattaaatgattctgatgcagtcgtcttagaaagtttactgacacaaaaagatgaatttgagggtagctggaaagagttactattgaattattttaagggtgaa

SEQ ID NO: 1808 - protein, 572 aa, Streptococcus agalactiae
MARLIPQYRGIKVKPYMRYMSYYLFSFLFILFLTPVGVYSYYYLDLLKMMDKMSMISVGTGLFLAFFVSWYLTWFLQEANPLFNKLDRLKRMSKFLYENGYVYEKRKKSNKKTKTKYRFPKVYVKQGKYDLSVSFEMAGGKFQKKFKDIGGELEDTFFMDFMEKTDDPRFKIYKLAYSAFLSRITVKDVIWNKDKGIKLMDGYYWDFINDPHLLVAGGTGGGKTVLLRSILRCLAEIGVCDICDPKRADFVTMSDLSAFEGRIAFEKADIIEKFENAVTIMFARYDFVRNEMKRLGHKDMKKFYDYGLEPYFFVCDEYNALMSSLSYQEREIVDNAFTQYILLGRQVGCNAIIAMQKPSADDLPTKIRSNMMHHISVGRLDDGGYVMMFGDENRNKEFRFIKYLAGRRVYGRGYSAVFGEVAREFYSPLLPKNFSFYDAFEKINRHENPFDPTENQEVSKAILKDESLREFVEKTSENELLKGSVGFDFDDEMEEMENMSIGDLAKKTGFSFGKIKNLIDMIEKDNYMTFSREDEKVVLNDSDAVVLESLLTQKDEFEGSWKELLLNYFKGE

SEQ ID NO: 1809 - DNA, 459 bp, Streptococcus agalactiae
atggcaaaaattggtttaaactttggagaaaaattacaaattgcagataaggaatatcgtacctttaatgatggattggatgtaaatgttttgttaggagatttaacttggagacgatatgaagaaccagttcaatttacggaagatgatacgacacaaccaccagatcgatttggtcgttatccacaaaaaccaacaggtgaagtgaagtggaatgatattgcagtatttagtactgctcaaaatgaaacaatttttgtttcaattactgatatgccttcttatgcaatcgaggatttaggtcttaaattgggtgaccctattgaattaagtgatgttgttgtgacatggtctaacgtttcaggtggtatgtttaaaatttttgcatcatcacttaagaaaaaggatgttgcaaataatggaaacgcatcaaaaaatgaagcatctaaagttaataaa

SEQ ID NO: 1810 - protein, 153 aa, Streptococcus agalactiae
MAKIGLNFGEKLQIADKEYRTFNDGLDVNVLLGDLTWRRYEEPVQFTEDDTTQPPDRFGRYPQKPTGEVKWNDIAVFSTAQNETIFVSITDMPSYAIEDLGLKLGDPIELSDVVVTWSNVSGGMFKIFASSLKKKDVANNGNASKNEASKVNK

SEQ ID NO: 1811 - DNA, 324 bp, Streptococcus agalactiae
gtgcttcttatttttagaaaagaggaaattatgaaacaagaaacattagtgttacttccaaattttattggagatgcaatttatgaaggatttgaagctggacctgctcaattaaatggtaaaaaagggtcttatacaagacacattttgtttaatgaaaaacatggtaagttttatgtttatacaccagcatcttcacgtgtgattggaaatggaaaaatggtaactgttgaaaaaccgttattgtttattgacaatacaattaatggtagaaatattgaacctgcaaaaaatgtatgggctgaaaagcttattgaagtgaaa

SEQ ID NO: 1812 - protein, 108 aa, Streptococcus agalactiae
MLLIFRKEEIMKQETLVLLPNFIGDAIYEGFEAGPAQLNGKKGSYTRHILFNEKHGKFYVYTPASSRVIGNGKMVTVEKPLLFIDNTINGRNIEPAKNVWAEKLIEVK

SEQ ID NO: 1813 - DNA, 2505 bp, Streptococcus agalactiae
atgatcacgacattacagactagtcaagtgtctgctgatcaagttacaactcaagcaacaactcaaacagtaacgcaaaatcaagcagaaacagtaacatcaactcaacttgataaagcagtagctacagctaaaaaagcagctgtagctgttacaaccacagctgcagttaatcatgcgacaactactgatgcacaagctgatttagctaatcaaacacaaacagttaaagatgttactgcaaaagcacaagctaatacacaagctattaaagatgctactgctgaaaatgcaaaaattgacgcagaaaacaaagcagagtctcaacgtgtaagtcagttaaatgcacaaactaaagcaaaaattgatgctgaaaacaaagatgcacaagctaaagcagatgcgactaatgcacaattacaaaaagattatcaagctaaattagcgaaaatcaaatcagttgaagcttataatgcaggtgtacgtcaacgtaataaagatgcacaagctaaagcagatgcgactaacgcacagttacaaaaagactatcaagctaaattagcactttataatcaagctctaaaagctaaagcagaagcagataaacagtctattaataatgttgcttttgatatcaaagctcaagctaaaggtgttgataacgctgaatatggaaactcaatcatgactgcaaaaactaaacctgacggaagtttcgagtttaaccatgatatgatcgatggtgtgaagacaatcggctatgggaaattgacaggtaaagttaatcatcattatgttgctaacaaagatggctctgtgacagcatttgttgactctatcactctttacaagtacgagtatcgtaatgttgctcaaaatgctgctgttaatcaaaatattgctttcagagtcttaactaaagacggacaaatcatttttgagaagaaacataatggtaacaaaacttttgcagaaactttaaacaaaactttacaactcaatcttaaatatgagcttaaaccacatggttctagtggaagcgttgaagtctttaagattcatgatgactgggtacatgacacacatgggtctgctttagtgtcttatgttaataataatgatgttgttcctaacgttgttataccaaaacagccaacaccaccgtcaacagaaaaagtgactcctgaagcagaaaaaccagtacctgaaaaaccagttgagcctaaatttgtaacacctacattaaaaacttacactccagctcaaccaaaagtgaaaccacatgtgtctattcctgaaaagattaactactcagttagtgttcatcctgttttagttccagctgctaatccttcaaaagctgtcattgatgaagcaggtcaatctgttaatggtaaaaccgtattaccaaatgctgaattaaattacgttgctaaacaagactttagccaatataaaggaatgactgcatcacaaggtaaaatagctaaaaactttgtctttattgatgattataaagatgacgcactagatggtaagtctatgaaagtgaactcaatcaaagcatctgatggcacagatgtgtcacaactcttagaaatgcgacatgtgctttctacggatactttagatgagaaacttcaaacgcttattaaagaagcaggaatcagtcctgttggtgagttttacatgtggactgcaaaagatccacaagctttttataaagcttatgttcaaaaaggtctagatgttacttataacttatcatttaaagttaaaaaagagtttactaaaggtcaaattcaaaatggtgttgcacaaatcgactttggcaatggatatacaggtaatattgtagtcaatgatttgacaactccagaaatacataaagatgtgttagacaaagaagatggcaagtctatcaacaatggtactgtcaaattaggtgatgaagttacttacaaattagagggttgggtagttccaacaggtcgttcttatgatctatttgaatacaaatttgtggatcaattacaacgcacacctgatctttacttacgtgataaagtggtcgctaaagttgatgtgacattaaaagatggtacagtcattaaaaaagggactaatttaggagagtacacagaaacagtttacaacaaaaagacaggtctctatgaattagtcttcaagaaagacttccttgaaaaagttgcacgttctagtgaatttggggcagatgattttgtggtggttaaacgtatcaaagcaggtgatgtttacaataccgcagacttttttatcaatgggaataaggttaaaactgaaactgtggtaacacatactcctgagaaaccaaaaccagttgaaccacaaaaagcaactccaaaagctcctgctaaaggattacctcaaactggtgaagcaagcgttgcccctcttacagcacttggagcaatcatcttgtcagctatcggtttagcaggatttaaaaaacgcaaagaaaat

SEQ ID NO: 1814 - protein, 835 aa, Streptococcus agalactiae
MITTLQTSQVSADQVTTQATTQTVTQNQAETVTSTQLDKAVATAKKAAVAVTTTAAVNHATTTDAQADLANQTQTVKDVTAKAQANTQAIKDATAENAKIDAENKAESQRVSQLNAQTKAKIDAENKDAQAKADATNAQLQKDYQAKLAKIKSVEAYNAGVRQRNKDAQAKADATNAQLQKDYQAKLALYNQALKAKAEADKQSINNVAFDIKAQAKGVDNAEYGNSIMTAKTKPDGSFEFNHDMIDGVKTIGYGKLTGKVNHHYVANKDGSVTAFVDSITLYKYEYRNVAQNAAVNQNIAFRVLTKDGQIIFEKKHNGNKTFAETLNKTLQLNLKYELKPHGSSGSVEVFKIHDDWVHDTHGSALVSYVNNNDVVPNVVIPKQPTPPSTEKVTPEAEKPVPEKPVEPKFVTPTLKTYTPAQPKVKPHVSIPEKINYSVSVHPVLVPAANPSKAVIDEAGQSVNGKTVLPNAELNYVAKQDFSQYKGMTASQGKIAKNFVFIDDYKDDALDGKSMKVNSIKASDGTDVSQLLEMRHVLSTDTLDEKLQTLIKEAGISPVGEFYMWTAKDPQAFYKAYVQKGLDVTYNLSFKVKKEFTKGQIQNGVAQIDFGNGYTGNIVVNDLTTPEIHKDVLDKEDGKSINNGTVKLGDEVTYKLEGWVVPTGRSYDLFEYKFVDQLQRTPDLYLRDKVVAKVDVTLKDGTVIKKGTNLGEYTETVYNKKTGLYELVFKKDFLEKVARSSEFGADDFVVVKRIKAGDVYNTADFFINGNKVKTETVVTHTPEKPKPVEPQKATPKAPAKGLPQTGEASVAPLTALGAIILSAIGLAGFKKRKEN

SEQ ID NO: 1815 - DNA, 1260 bp, Streptococcus agalactiae
atgaataatatgtcagacttattatccctaccagacattaaaacaatagaaccgccacaagaaaatgaaaccgatatgatgtttaaagttgaagcagtcggaccacctgaacgttgtcctgaatgtggttttgacaagttgtacaaacacagttcaagaaatcaactaattatggatttgcccattcgtttaaagcgagtgggcttacatttgaaccgtagacgatacaagtgtcgtgaatgcggatctaccatatctgtagatgaaaagcgtagtatgaccaaaaggcttttaaagtccattcaagagcaatccatgtctaagacctttgtagaagtcgcagaaagcgttggtgttgacgagaaaaccattaggaacgtttttaaggactatgtggcactcaaagaacgtgaataccagtttgaaactcctaagtggcttgggatagacgagatacatattatccgtagacctcggcttgtattgactaatattgaacgcaggactatttatgacatcaagcctaaccgtaacaaggaaacagtcatccaacgtctttcagaaatcagtgacaggacttacattgagtacgtcacaatggatatgtggaagccctacaaagacgcagtgaacactatccttccacaagctaaagttgtcgtagataagtttcatgtagttagaatggctaatcaagccttagataacgtcagaaagtctttgaaagcccatatgagccaaaaagaaagacgtacccttatgcgtgaaaggtttatccttctaaagcgtaaacacgatctaaatgaacgtgaatcattcctcttagatacttggttaggtaatcttcctgctttaaaagaagcctatgaactcaaagaagagttttactggatatgggatactcctgatccagatgaaggtcatcttcgttatagtcaatggagacaccgttgtatgtccagcaactctaaagacgcatataaagacctcgtgagagccgtagacaactggcatgttgaaatattcaactactttgataaaaggctcactaatgcttatacggagtcaattaacagcattattaggcaggtagagcgaatgggtagaggttactcgtttgatgccttacgagccaaaatccttttcaatgagaagctccataaaaagcgtaagccacgatttaattcaagtgctttcaataaagctatgttatacgatactttcaattggtatgaagtgaatgatcacgacattacagac

SEQ ID NO: 1816 - protein, 420 aa, Streptococcus agalactiae
MNNMSDLLSLPDIKTIEPPQENETDMMFKVEAVGPPERCPECGFDKLYKHSSRNQLIMDLPIRLKRVGLHLNRRRYKCRECGSTISVDEKRSMTKRLLKSIQEQSMSKTFVEVAESVGVDEKTIRNVFKDYVALKEREYQFETPKWLGIDEIHIIRRPRLVLTNIERRTIYDIKPNRNKETVIQRLSEISDRTYIEYVTMDMWKPYKDAVNTILPQAKVVVDKFHVVRMANQALDNVRKSLKAHMSQKERRTLMRERFILLKRKHDLNERESFLLDTWLGNLPALKEAYELKEEFYWIWDTPDPDEGHLRYSQWRHRCMSSNSKDAYKDLVRAVDNWHVEIFNYFDKRLTNAYTESINSIIRQVERMGRGYSFDALRAKILFNEKLHKKRKPRFNSSAFNKAMLYDTFNWYEVNDHDITD

SEQ ID NO: 1817 - DNA, 1638 bp, Streptococcus agalactiae
atgaataaatttaaggtaaacatttcaggaatgacttgtacgggttgtgaaaaacacgtagaatcagcacttgaaaagataggtgctaaaaatattgagtctagttatcgtcgtggtgaagcagtatttgaactgcccgatgatattgaggttgaaagtgcaataaaggcgattgatgaagcaaattaccaagccggagaaattgaagaagtatcatcactagaaaacgtggcgttaattaatgaagacaattatgaccttcttattattggttctggtgctgctgccttttcttcggcaattaaagctatagaatacggtgcaaaagttggaatgattgagcgtggaacggttgggggaacctgtgtgaatattggctgtgttccgtcaaaaactcttcttagggcaggggaaatcaatcatttatcaaaagacaatccgtttataggtttacaaacatccgctggagaagtggatttagctagtttaatcacgcaaaaggataaattggtgagcgaacttcggaatcaaaaatatatggatttaattgatgaatataattttgatttaattaaaggtgaagcaaaattcgttgatgctagtacggttgaggtcaatgggacaaagttatctgcaaaacgctttttaattgcaacaggtgcatcgccttcgttgccccaaatttcaggacttgaaaaaatggactatttaactagtacaacacttcttgagttaaagaaaataccaaaacgattaactgtaattggttcaggatacattggaatggagcttggacaactatttcatcatttaggttcagaaataacgcttatgcaaagaagtgagcgacttttaaaggagtatgatcctgagatttcagagtcagttgaaaaagcgttaattgaacagggtataaaccttgtcaaaggggcaacttttgagcgtgttgaacaaagtggagagataaaaagggtttacgtaacagtaaatggcagtagagaagtcattgaatcagatcagttacttgttgccactggaagaaaaccaaatacggattctttaaatttaagtgcagcaggtgttgaaactggaaaaaataatgaaatcctgatcaatgattttggtcaaacaagtaatgaaaagatttatgcagcaggagatgtgactttaggaccacaatttgtatatgtagcagcctatgaaggtggaattattactgataatgctattggtggattaaacaaaaaaatagatttatcggtagttcctgctgttacgtttacgaatccgacggttgcaacggttggtttaacagaagaacaagcaaaagagaaagggtatgatgtgaagacatctgtattacctttaggtgctgttccaagagcaattgtaaaccgtgaaacaaccggtgtatttaaactagtagcagatgcagaaacactaaaagtattaggggttcatattgtatctgaaaatgcaggagatgtcatctatgcagcatcattagctgttaaatttggcttaacgatagaagatttaacagaaaccctagcaccatatttaacaatggctgaagggctaaaattagttgcacttacgttcgataaagatatttcgaaattatcttgttgtgcaggc

SEQ ID NO: 1818 - protein, 546 aa, Streptococcus agalactiae
MNKFKVNISGMTCTGCEKHVESALEKIGAKNIESSYRRGEAVFELPDDIEVESAIKAIDEANYQAGEIEEVSSLENVALINEDNYDLLIIGSGAAAFSSAIKAIEYGAKVGMIERGTVGGTCVNIGCVPSKTLLRAGEINHLSKDNPFIGLQTSAGEVDLASLITQKDKLVSELRNQKYMDLIDEYNFDLIKGEAKFVDASTVEVNGTKLSAKRFLIATGASPSLPQISGLEKMDYLTSTTLLELKKIPKRLTVIGSGYIGMELGQLFHHLGSEITLMQRSERLLKEYDPEISESVEKALIEQGINLVKGATFERVEQSGEIKRVYVTVNGSREVIESDQLLVATGRKPNTDSLNLSAAGVETGKNNEILINDFGQTSNEKIYAAGDVTLGPQFVYVAAYEGGIITDNAIGGLNKKIDLSVVPAVTFTNPTVATVGLTEEQAKEKGYDVKTSVLPLGAVPRAIVNRETTGVFKLVADAETLKVLGVHIVSENAGDVIYAASLAVKFGLTIEDLTETLAPYLTMAEGLKLVALTFDKDISKLSCCAG

SEQ ID NO: 1819 - DNA, 1761 bp, Streptococcus pyogenes
atggctgttgaaattattatgccaaaactcggtgttgacatgcaagaaggtgaaatcatcgagtggaaaaaacaagaaggtgatactgtcaatgaaggcgatattcttcttgaaatcatgtcagataaaaccaatatggaacttgaggcagaagactcaggtgttcttcttaaaattacacgtcaagcaggtgaaacagtacctgtaacagaagttatcggatatatcggtgctgaaggtgaatctgttgaggtttctagcccagctgcttcagatgtgaatgttgctcgtacaacagaagatttagaagctgctggacttgaagtgccaaaagcaccagctcaagctgcttcagctgcaccaaaagctgcacttgctgatgatgagtatgacatcatcgttgttggtggtggccctgcaggttattatgcagctattcgtggtgctcaacttggtggtaaaattgccatcgttgagaaatctgaatttggtggaacttgcttgaacgtagggtgtatcccaaccaaaacttaccttaaaaatgctgaaatccttgatggtattaagattgcagcaggacgtgggattaaccttgcctcaactaactatactattgacatggacaaaacagttgactttaaaaacaccgttgttaaaaccttaacaggcggcgttcaaggtcttctaaaagctaataaagtcactatctttaatgggcttggtcaagtcaaccctgacaagactgtaaccattgggtcacaaaccattaagggtcgcaacgttatccttgctacaggttctaaagtatcacgtatcaatatcccaggtattgactctaaacttgtcttaacgtcagatgatatccttgacctccgtgaaatgccaaaatcactagcagttatgggcggtggtgttgttggtatcgagcttggacttgtttgggcatcttacggtgtggatgttaccgttattgaaatggctgaccgtattatcccagctatggataaagaagtctctcttgaacttcaaaaaatcctttctaagaaaggcatgaagatcaaaacatctgttggtgtctctgaaattgttgaagcaaataaccaattgactttgaaacttaacaatggtgaagaagttgttgctgaaaaagctcttctttctatcggacgtgtatcacaaatgaacggtctggaaaatcttaaccttgaaatggatcgtaaccgtatcaaagttaatgactaccaagagacatcaattccaggtatctatgcgccaggtgacgttaacggaacgaaaatgcttgctcacgctgcttaccgtatgggtgaagtggctgcagaaaatgcgatgcatggcaacacaactcgtaaagctaaccttaaatacactccagcagctgtttacacacaccctgaagtggcaatggttggtttaactgaagaacaagcgcgtgaacaatatggtgatgtgcttattggtaaaaacagctttactggtaatggacgcgcgattgcttcaaatgaagcacatggttttgttaaagttattgctgatgccaaataccacgaaatcttaggtgttcatattattggtccagctgcagctgagatgattaacgaagcagctactattatggaatctgaattaaccgttgatgaattgttattatcaattcatggacacccaaccttctctgaagtgatgtacgaagcctttgcagatgtgcttggcgaagctatccataacccaccaaaacgtaag

SEQ ID NO: 1820 - protein, 587 aa, Streptococcus pyogenes
MAVEIIMPKLGVDMQEGEIIEWKKQEGDTVNEGDILLEIMSDKTNMELEAEDSGVLLKITRQAGETVPVTEVIGYIGAEGESVEVSSPAASDVNVARTTEDLEAAGLEVPKAPAQAASAAPKAALADDEYDIIVVGGGPAGYYAAIRGAQLGGKIAIVEKSEFGGTCLNVGCIPTKTYLKNAEILDGIKIAAGRGINLASTNYTIDMDKTVDFKNTVVKTLTGGVQGLLKANKVTIFNGLGQVNPDKTVTIGSQTIKGRNVILATGSKVSRINIPGIDSKLVLTSDDILDLREMPKSLAVMGGGVVGIELGLVWASYGVDVTVIEMADRIIPAMDKEVSLELQKILSKKGMKIKTSVGVSEIVEANNQLTLKLNNGEEVVAEKALLSIGRVSQMNGLENLNLEMDRNRIKVNDYQETSIPGIYAPGDVNGTKMLAHAAYRMGEVAAENAMHGNTTRKANLKYTPAAVYTHPEVAMVGLTEEQAREQYGDVLIGKNSFTGNGRAIASNEAHGFVKVIADAKYHEILGVHIIGPAAAEMINEAATIMESELTVDELLLSIHGHPTFSEVMYEAFADVLGEAIHNPPKRK

SEQ ID NO: 1821 - DNA, 390 bp, Streptococcus agalactiae
atgatttatcgcattagtgagtttgcagataaatgtggagttaataaagaaacgatcagatattacgagcgaaaaaatttattacaagaacctcaccgaacggaagctggttatcggatatattcatatgatgacgttaagcgtgttgggtttattaaacgaatacaggaacttggtttctctttaagcgagatttataaattacttggtgttgtagataaagatgaagttcgttgtcaagatatgttcgaatttgtttctaaaaaacaaaaggaagtgcaaaaacaaatagaggatttaaaacgaattgaaactatgttagacgacttaaaacaacgatgtccagatgaaaagaaattacattcgtgtccaataatagaaacattaaca

SEQ ID NO: 1822 - protein, 130 aa, Streptococcus agalactiae
MIYRISEFADKCGVNKETIRYYERKNLLQEPHRTEAGYRIYSYDDVKRVGFIKRIQELGFSLSEIYKLLGVVDKDEVRCQDMFEFVSKKQKEVQKQIEDLKRIETMLDDLKQRCPDEKKLHSCPIIETLT

SEQ ID NO: 1823 - DNA, 1566 bp, Streptococcus agalactiae
atgaatctacaaaaaaatgataaaacaaatagttttatccattatgcaaacggtccttccctagaagaaataaatgggacaattgaagttcctaaagatttgagcttttttaaaactttactagcttattctggaccgggtgcacttgttgctgttggttatatggatcctggaaattggtccacttccataactggcggtcaaaattttcaatatttactaatttcaattatcttaatgtctagtttaattgctatgctacttcaatacatgtcagctaagctaggtattgttactcagatggatcttgctcaagctatccgagcaaggaccagtaaacagttgggaattgtcttatggattctcactgagcttgctataatggcaacagatattgctgaagttattggtggggctattgcactttatttactgtttcatattccacttgcgattgctgttttcattacagtatttgatgtattactcttattattgttgacaaaaataggatttcgaaaaattgaagctctagtagttgctttaatattggttattttcttagtttttgcatatcaagtggctctttctcatcctatatggacggatatttttaaaggtttagtacctacatctgaagctttctcaacctctcatacagtaaatggacaaacaccactttcaggtgccttaggcattattggggcaactgttatgccacataatctttatctacattcttcagttgttcaaagtcgaaaactagatcataataacaaaaaagatatcgctagagcaattaggttttcaacttttgattcaaatattcaattaacagtagccttttttgttaattcactattactcattatgggcgttgctgttttcaaaacaggaagtgttactgatccatcattctttggtctatttaaagcactatctaattctactattatgagtaattctattttagctcatatagcaagttcaggtattttatcacttttatttgcaatagctttattagcatctggacagaattcaactattactggaacattaacaggtcaaattattatggaaggatttattcatatgaaagttccaatttggttccgtcgtatcattactcgcctaatttctgttattcctgtaatgatttgtgtcttagtaactagtggtagaagtactgttgaagaacatatagctattaataacttaatgaataactctcaagtcttcttagcatttgcattaccattctcaatgttacctctactaatatttactaatagtaaagttgaaatggatgatgattttaaaaatacttggataattaagattcttggttggctttcagttataggattaatttatctcaatatgaagggattgccaaatcaaattgaaggtttttggggagataacccaactcatcaacaaattattcttgcgcatcaaatagctcatatcatcattattagtgtaatactaactttaatatggactattgttgaattgtataaaggaaataaaaaatacagtacgatgcaacaaagtgcaact

SEQ ID NO: 1824 - protein, 522 aa, Streptococcus agalactiae
MNLQKNDKTNSFIHYANGPSLEEINGTIEVPKDLSFFKTLLAYSGPGALVAVGYMDPGNWSTSITGGQNFQYLLISIILMSSLIAMLLQYMSAKLGIVTQMDLAQAIRARTSKQLGIVLWILTELAIMATDIAEVIGGAIALYLLFHIPLAIAVFITVFDVLLLLLLTKIGFRKIEALVVALILVIFLVFAYQVALSHPIWTDIFKGLVPTSEAFSTSHTVNGQTPLSGALGIIGATVMPHNLYLHSSVVQSRKLDHNNKKDIARAIRFSTFDSNIQLTVAFFVNSLLLIMGVAVFKTGSVTDPSFFGLFKALSNSTIMSNSILAHIASSGILSLLFAIALLASGQNSTITGTLTGQIIMEGFIHMKVPIWFRRIITRLISVIPVMICVLVTSGRSTVEEHIAINNLMNNSQVFLAFALPFSMLPLLIFTNSKVEMDDDFKNTWIIKILGWLSVIGLIYLNMKGLPNQIEGFWGDNPTHQQIILAHQIAHIIIISVILTLIWTIVELYKGNKKYSTMQQSAT

SEQ ID NO: 1825 - DNA, 90 bp, Streptococcus agalactiae
ttgaggttatcaaaaatttcatttaaaatcgcaacgaatccacttcaaggaacactaaaagccccatccctagggctttttttgttgagt

SEQ ID NO: 1826 - protein, 30 aa, Streptococcus agalactiae
MRLSKISFKIATNPLQGTLKAPSLGLFLLS

SEQ ID NO: 1827 - DNA, 720 bp, Streptococcus agalactiae
atgttaggattggagtttagaaagtctataagaggtagaacattattttatattatatctactgtagctttgacctatgtattaggatatattttaccagtagggatagataaaataagacatttaactttgggagaattttactttagtacctacacagtatttacccaatttggatttttaatattcggctttgtcattgtatatttctttaataaagattactctgacaaatgtattttatatcactatttttcagggtatcatctaactaaatacttttatactaaactgttagtattattttcagaattttttattgctataatagtttgcaatatattagcttcattgctttggggatattcactattttattttttaacaactacaatcttattttcactcgttgttctacagtatctactagtcgtctcaactattagtatcctgttttctaatatgctagtttctattggagttactattttttattggattacatccattattttagtggcaattggaggaatttttaaagtatctgctatttttgatgcttcaaattctctctataaaataatagggaaacttttctcacatccgatgactattgatttaaccgacttttttataattgttccttatatgatatgccttagtgtaattagttttttgatagtgtgcttatcaaatagaagatggttattaaatggaatg

SEQ ID NO: 1828 - protein, 240 aa, Streptococcus agalactiae
MLGLEFRKSIRGRTLFYIISTVALTYVLGYILPVGIDKIRHLTLGEFYFSTYTVFTQFGFLIFGFVIVYFFNKDYSDKCILYHYFSGYHLTKYFYTKLLVLFSEFFIAIIVCNILASLLWGYSLFYFLTTTILFSLVVLQYLLVVSTISILFSNMLVSIGVTIFYWITSIILVAIGGIFKVSAIFDASNSLYKIIGKLFSHPMTIDLTDFFIIVPYMICLSVISFLIVCLSNRRWLLNGM

SEQ ID NO: 1829 - DNA, 615 bp, Streptococcus agalactiae
atgtttattaataattacaccttaaaaataggaaatagaatacttttagagaatactaacttagactttgaagaaggggaaataaatcatcttttaggtaggaatggatcaggtaaatctcaactagctaaagattttatcataaatagagggaattatttttcaaatgatatttatgaagacacgctgattatttcgagttattctaatcttcctagtgatgttaccattaacgatttagaaaggacaattccgtggaagctttctaaagaaatttatcagttattgaatattaatcaaataagtaaaacggttaagttaaagcaattaagtgatgggcagaaacaaaaggtgaaattattagttttgttgtctttagacaagcatattattatacttgatgaaattactaatgctttagataaaaagtctgttgatgagataaacgtatttttgcaaaactatattcagtattatcccgaaaaaattattattaatatttcacatgatatcaataatatcaggtctttaaagggaaactattttctaattgataatcaaaaaatttgtaaagtagacacattagatgatgctattagttggtatttaggagaa

SEQ ID NO: 1830 - protein, 205 aa, Streptococcus agalactiae
MFINNYTLKIGNRILLENTNLDFEEGEINHLLGRNGSGKSQLAKDFIINRGNYFSNDIYEDTLIISSYSNLPSDVTINDLERTIPWKLSKEIYQLLNINQISKTVKLKQLSDGQKQKVKLLVLLSLDKHIIILDEITNALDKKSVDEINVFLQNYIQYYPEKIIINISHDINNIRSLKGNYFLIDNQKICKVDTLDDAISWYLGE

SEQ ID NO: 1831 - DNA, 744 bp, Streptococcus pyogenes
ttgttttgcttactatacactaaacgctcagcaatatatagaatgggagtaactaatatgttgaaaatacaaaatctaaaaaaatcttatggtaagagaaccatattgaataatgtcaatatgaatattcctaagggaaaagtgtatgctttaatcggtccaaatggtgctggaaaatcaactattatgaaaattttgacaggcttagttagtaagacaagtggttctattatttttgaaggtagagaatggtcacgtcgggatctgcgaaaaatcgggagtattattgaagaaccaccactttataaaaatttgagtgcttacgataatatgaaggtagttacaacaatgcttggtgtttcagaaagcactatacttccattattaaataaagttggtctaggaaatattgacaagagaccagtaaaacaattttctcttggaatgaagcaacggttaggtatagctatctctttaataaattcacctaaactacttatattagacgaacctactaatggcttggacccaattggaattcaagaattaagggaaattatagagtcatttaaatcagaaggaatgacaattatgatttcaagccatatactgtcagaagttgaacatctagctgattttattggatttatctatgaaggaaagattattctggaaaaagaatatgacggctctgagaatcttgaagagttattcaataatcaaattttatttgaaaagaggagg

SEQ ID NO: 1832 - protein, 248 aa, Streptococcus pyogenes
LFCLLYTKRSAIYRMGVTNMLKIQNLKKSYGKRTILNNVNMNIPKGKVYALIGPNGAGKSTIMKILTGLVSKTSGSIIFEGREWSRRDLRKIGSIIEEPPLYKNLSAYDNMKVVTTMLGVSESTILPLLNKVGLGNIDKRPVKQFSLGMKQRLGIAISLINSPKLLILDEPTNGLDPIGIQELREIIESFKSEGMTIMISSHILSEVEHLADFIGFIYEGKIILEKEYDGSENLEELFNNQILFEKRR

SEQ ID NO: 1833 - DNA, 852 bp, Streptococcus agalactiae
atgagagatgagcaagaaatatataatttggtgttaaacatagcaaaccaagataagagaatcgaagctgtactattgaatggatctcgggctaacccaaatgtaccgaaagatgattttcaagattatgatattgtttttgttactaattttatagaagatattatttctgacactaattatcataaaaaattcggtgatattcttataatgcagaaaccaaatgagtttagaaataagacggaatacaattgctttgcttacttaatgcagtttcaagatctgacgaggattgatttaagacttattaaaccagaattcttggaggattatttagatgatgctttttcaaaagtacttttagataaaaagaataaatatcttgattataattttgaaagaagttctctgtacgaaacaaagcaattgtcagaagatgaaatcaacaaaattcttaatgaaatatattgggttagtacttatgtagtcaaggggatagcaagaaatgatattatttattcagagtttatgatatctaatcctattaaaaatgcttttattaaacttctaaaacaaaaaatattaatagaaaaagagcttgattcattatcttttggaaagctcgacaaggatatcttgcaatatattacagataaagatcaactattgaaaattttttcaaataaatctttaaaagacattgaggctaatttgcgatttttattggatgaaacaaatcaaatggcgaaatatatttctattaataggaaacttaatctgaaccaaggagaataccaatcagcaatgaaatttatgaatatctttttgtcaaattcatatcaaaatttcaac

SEQ ID NO: 1834 - protein, 284 aa, Streptococcus agalactiae
MRDEQEIYNLVLNIANQDKRIEAVLLNGSRANPNVPKDDFQDYDIVFVTNFIEDIISDTNYHKKFGDILIMQKPNEFRNKTEYNCFAYLMQFQDLTRIDLRLIKPEFLEDYLDDAFSKVLLDKKNKYLDYNFERSSLYETKQLSEDEINKILNEIYWVSTYVVKGIARNDIIYSEFMISNPIKNAFIKLLKQKILIEKELDSLSFGKLDKDILQYITDKDQLLKIFSNKSLKDIEANLRFLLDETNQMAKYISINRKLNLNQGEYQSAMKFMNIFLSNSYQNFN

SEQ ID NO: 1835 - DNA, 390 bp, Streptococcus agalactiae
atgcaaagccagaaattaaatgtccttcagagagttttaagggataaatttcttttacaaggattaggagtacccaacagtaatactgtgttaaacagatcttttactgctctattactagctttattattggaggactcaaataataaaagttggatatctgaagaagatcagataaaaattatgaatcaggcattctcctggcttatagatgaacctgattttagaggctttgacgaggagcttggatggatacatgcctttgctcatggagctgatttattaacagaaatagtcaagatgaaatgtttttcaaaagatgatagtttaaaaatcttaactatcataaaaagagtgatgataactgatgacatactaacattaaacggt

SEQ ID NO: 1836 - protein, 130 aa, Streptococcus agalactiae
MQSQKLNVLQRVLRDKFLLQGLGVPNSNTVLNRSFTALLLALLLEDSNNKSWISEEDQIKIMNQAFSWLIDEPDFRGFDEELGWIHAFAHGADLLTEIVKMKCFSKDDSLKILTIIKRVMITDDILTLNG

SEQ ID NO: 1837 - DNA, 621 bp, Streptococcus agalactiae
ttgggggagatagttatgataaagtttaaattattttttaaatccacagaaaaagaggaagaatggatcgataaggttcaaaaaagtggctatgcttttacaggcattaactcatttcttccagccttctattattttaagagagataaagaaaaagacaagatgtcaataaaaatggattttaaaaaatacatgtcgaaagatgactatgctaactatatcactttatttgaggacagtggatggaagcatattagcggtagtcgttggggagggctgcattattttcaaaaaataaagcctgaaaccagttcagagattttttctgatcaagaatcaaaatcagcgatggctatgagttattataaatatacttgtgagcatgcgtttttctctttattttatttctttctcttgataagaacaacttctatcaccatatttgatccaaaaagttggtatctgacgcaaggtctatgggaaatgcaagggaaaatattttggttagcattcttatttgaaacaccatttgccttattaagaatattacctatgttttactttttaatttctggaatatactatattacacgagctgtaaaacccaaggaaattataaat

SEQ ID NO: 1838 - protein, 207 aa, Streptococcus agalactiae
MGEIVMIKFKLFFKSTEKEEEWIDKVQKSGYAFTGINSFLPAFYYFKRDKEKDKMSIKMDFKKYMSKDDYANYITLFEDSGWKHISGSRWGGLHYFQKIKPETSSEIFSDQESKSAMAMSYYKYTCEHAFFSLFYFFLLIRTTSITIFDPKSWYLTQGLWEMQGKIFWLAFLFETPFALLRILPMFYFLISGIYYITRAVKPKEIIN

SEQ ID NO: 1839 - DNA, 336 bp, Streptococcus agalactiae
ttgatgaaaaggaataaacatttaccgttaacagaaactacctattatatcttattagctttgtttgaggaagcacatggctatgctattatgcaaaaagttgaagaaatgagtggcggtgatgttagaatagccgcagggacaatgtacggtgccattgaaaatttacttaaacaaaaatggataaagtctatcccaagtgacgatagaagaagaaaagtttatattattactgagacaggaaaagaaatagtagaacttgaaacgaatcgattaagaaagttacttaatactgctaatcagttgggttttgggggagatagttatgataaagtt

SEQ ID NO: 1840 - protein, 112 aa, Streptococcus agalactiae
MMKRNKHLPLTETTYYILLALFEEAHGYAIMQKVEEMSGGDVRIAAGTMYGAIENLLKQKWIKSIPSDDRRRKVYIITETGKEIVELETNRLRKLLNTANQLGFGGDSYDKV

SEQ ID NO: 1841 - DNA, 591 bp, Streptococcus agalactiae
ttgctgctatttgacttatctagatcaatatttccaactaatatgatatcctatgcatacctcattgcagaaatatactttaaagtcaaaataaggaaatatattatggaaattaaagaatacgagaataatccgtaccatttagcacagctagtagatttaattaattattgtcagaatatagaagctaaacttgatataaagatggctgaacaagacgatatttttcaaatagaaaattattatcaaaacagaaaaggtcaattttggattgccttagaaaatgaaaaagtagttggttcgattgcgttactgcgtattgatgataaaacagctgttctaaaaaaattttttacatatccaaaatatagaggaaatcctgttcgacttggtcgaaaattatttgaaagatttatgctttttgctcgagctagtaaattcacaagaattgtcttggatactccagaaaaagagaaaagatctcacttcttttatgaaaatcaaggatttaagcaaataacaagagatgaactagatgtagactacatttttccagatagagattcaaggatatatgtaaaacttcttgat

SEQ ID NO: 1842 - protein, 197 aa, Streptococcus agalactiae
MLLFDLSRSIFPTNMISYAYLIAEIYFKVKIRKYIMEIKEYENNPYHLAQLVDLINYCQNIEAKLDIKMAEQDDIFQIENYYQNRKGQFWIALENEKVVGSIALLRIDDKTAVLKKFFTYPKYRGNPVRLGRKLFERFMLFARASKFTRIVLDTPEKEKRSHFFYENQGFKQITRDELDVDYIFPDRDSRIYVKLLD

SEQ ID NO: 1843 - DNA, 759 bp, Streptococcus agalactiae
atgaaatctttagcagtaatgttaaaaaaagaatggatggagaatgttaggacatacaaagttatatctattctgattacttgttcaatatttggtatattaggtcccttaactgcacttatgatgcctgatattatggcaggaattttacctaaaaaactacagggagcgataccagagcctacctatattgattcttatattcagtattttaaaaatatgaatcagcttggtttagttattttagtatttttatttagtagtacactgacgcaagaattttcaaaaggaaccttaattaatctagttacgaagggattagccaaaaaagttataatccttgctaaatttatagtaattacccttctatggacagtgtcatacttattaagtgttgtcatccattttagttatacgttatattactttagtaacgaaggaagtcataaattaatggtttacggtgcaacatggtttatcggtattcttttcataagcttaatactctttttttcagttctttttcgtaaaactttagggggtttgttaggttgtctttttatggtggtgttatgtgtagtatctggattttttaaaatcagtaaaagctataatcctatgcttcttatccaaaaacaaggagaaatattaagtggaaagtttaaagttcaagacttaatggaaccgagcatattagtgtttttgcttattataatgacgttattacttagcatgtacatttttgaaaaaagtgaagtt

SEQ ID NO: 1844 - protein, 253 aa, Streptococcus agalactiae
MKSLAVMLKKEWMENVRTYKVISILITCSIFGILGPLTALMMPDIMAGILPKKLQGAIPEPTYIDSYIQYFKNMNQLGLVILVFLFSSTLTQEFSKGTLINLVTKGLAKKVIILAKFIVITLLWTVSYLLSVVIHFSYTLYYFSNEGSHKLMVYGATWFIGILFISLILFFSVLFRKTLGGLLGCLFMVVLCVVSGFFKISKSYNPMLLIQKQGEILSGKFKVQDLMEPSILVFLLIIMTLLLSMYIFEKSEV

SEQ ID NO: 1845 - DNA, 900 bp, Streptococcus agalactiae
atgaaagctatctcatttcaaaacgttacaaaatcttttggtcctaaaaaaatattaaataatgtttcttttgatttagaagaaaatatgatttatggattcgtaggaccaaatggagcaggtaaaacaacgacaataaaaatgattttaggattgttaaaatttgatacgggtttcataacaatttttggtaaaaaagttaattttggaagaacagataccaatcaactgattggctatctcccagatgttcccgagtactacgattatatgacagctctagaatatcttgatttatgttctggtttagcgagatcaaagcataagctttctaacaaagaactacttaggtcagttggacttgacgataatcaccaaaagattgctacttattctcgaggaatgaaacagcgtcttggattagcccaagcactggttcatgatcctaaaattattatttgcgatgaaccaacctctgcattagacccgaaaggtcgccaagatattttagatattatttcaaatcttagaggagaaaaaactgtgattttttctacccatattctctctgatgtcgaaaaaatatgtgatcatgttctggtgttaactaagtgtgggatttattctcttgaagagttaaaaggaaaaaaatcagaggaaaattattcggttcgtattttaataaaagtgacaaagtctgaagctaaggtactatctcataactatcagatagaaaagaaagataatgagtatgcactgactctcaaaggctctaaaatggataacaaagcagatttactagctggtttttaccaagatttagtttctttaaagattagcccatcagctattgaagtcattgacaatagtttagaggagctttatttggaggttaccaaa

SEQ ID NO: 1846 - protein, 300 aa, Streptococcus agalactiae
MKAISFQNVTKSFGPKKILNNVSFDLEENMIYGFVGPNGAGKTTTIKMILGLLKFDTGFITIFGKKVNFGRTDTNQLIGYLPDVPEYYDYMTALEYLDLCSGLARSKHKLSNKELLRSVGLDDNHQKIATYSRGMKQRLGLAQALVHDPKIIICDEPTSALDPKGRQDILDIISNLRGEKTVIFSTHILSDVEKICDHVLVLTKCGIYSLEELKGKKSEENYSVRILIKVTKSEAKVLSHNYQIEKKDNEYALTLKGSKMDNKADLLAGFYQDLVSLKISPSAIEVIDNSLEELYLEVTK

SEQ ID NO: 1847 - DNA, 1074 bp, Streptococcus agalactiae
atgcttggagagaatatctatttacaacgtactcagattggtatgacgcaagagaatttgagtgattatctgcatttaacaaaaactacaatttcaaagtgggaaaataatcaagctaaaccggatattgactatcttattttgatggctaatctttttgatattagcttggatgacttagtcggttatcaaaaaacattgtcagatgatcaaagaaatcagctcattaaggatctaaaaataaaagcaaatgtattgtctgagagagatttctttcaggaagttaaggaattatcaaaacagttccctaacgattttaagactctgttgataatgattaatatggtcttgagcaacctaaccaaccttaatgattcagaaatgaaagagtggtcactaagtacactaaataaaattattagtaaaacagtagttgagtctgacctccagacggcgataatgttcaaaacggtcgttctttttcacaaccttgaatatgatgaagtgataaacctttaccagaatagtccctataaattaggtgaagaattacttttagctaatagcttttttgcaaaagtcgatgtttaccgagctaagcaagtattacaggttgaaatttatcagcagattctacttgtatgcgagtatctattgagtttatcaacttttgaagttgaagaaaacaaaggcgatatttttgaaaggcttgaacatatgatagaagcgtttcaattaaactctttgcatcccaacacagtcatcaagtgttattatagtttagcttgtcattatagtaaaagtgatgatgataaggcattaggatacttaaaacaatgttttaaatctttaaaacaattgctccaaagatttgaattacacggtgatactttcttttataccatcgatgattggttagagacaatacctactggtattgcaccaccgacgagtcaattacaggtaatagaacgagttgaggacttatttcaaaattcacaatttaaagaactatcagggcataaagaatttcaacaaatgattcaaaaacttaacgatttaaaaaaggattac

SEQ ID NO: 1848 - protein, 358 aa, Streptococcus agalactiae
MLGENIYLQRTQIGMTQENLSDYLHLTKTTISKWENNQAKPDIDYLILMANLFDISLDDLVGYQKTLSDDQRNQLIKDLKIKANVLSERDFFQEVKELSKQFPNDFKTLLIMINMVLSNLTNLNDSEMKEWSLSTLNKIISKTVVESDLQTAIMFKTVVLFHNLEYDEVINLYQNSPYKLGEELLLANSFFAKVDVYRAKQVLQVEIYQQILLVCEYLLSLSTFEVEENKGDIFERLEHMIEAFQLNSLHPNTVIKCYYSLACHYSKSDDDKALGYLKQCFKSLKQLLQRFELHGDTFFYTIDDWLETIPTGIAPPTSQLQVIERVEDLFQNSQFKELSGHKEFQQMIQKLNDLKKDY

SEQ ID NO: 1849 - DNA, 612 bp, Streptococcus agalactiae
gtgaacaagaaatcctttttccagtgtgttatactacttgtttcttttttagtgttaacattagcagttaaatctcaaagtgatatgataagttatttggataatatcacttcagctttttttcaaagcatacgaaatcccgatttaactaacttaatgacgataatatcaacagttgtcagccctttgacaacgtcattaatagcacttgttatccttgggtatcaatattttttaaaccaaagaatagctgtgtggctatttatgttattttttggtaccaatgctttggcattgcttttaaaagatatcatcgcacgtcatagacctatgaatcaacttgtttttgattcgggttatagttttcccagtggacatacgatatcagcgtttttattaatgattcttgttttagtggttgcgagacagagattgagaagagtattgtcacaagtagttttcgtaatatttgcattagtgatccttgcatcagttattttttcaagactctatttagaaaatcattttttaacggatattttagggtcgttgttactaggagcatcgtcatattatggtttgtctgctattgtatctttgaaagagttacaa

SEQ ID NO: 1850 - protein, 204 aa, Streptococcus agalactiae
MNKKSFFQCVILLVSFLVLTLAVKSQSDMISYLDNITSAFFQSIRNPDLTNLMTIISTVVSPLTTSLIALVILGYQYFLNQRIAVWLFMLFFGTNALALLLKDIIARHRPMNQLVFDSGYSFPSGHTISAFLLMILVLVVARQRLRRVLSQVVFVIFALVILASVIFSRLYLENHFLTDILGSLLLGASSYYGLSAIVSLKELQ

SEQ ID NO: 1851 - DNA, 651 bp, Streptococcus pyogenes
atgatgacaaacaaacaaactcactttttaatagcttcttttgcattgctaatctttgttataataggctatacggtcaaattttttcctgaacgtttggcacttctagataatactattcaagcagagattagaggcaaccttcctatagtgctgacgcaattctttaggggtgttactgtatttggaaatgtcatgacacaagttttgttagttattgtgtcggtcctagttttattctttatgaagtggaaaattgaagccttgtttatcttgtcaaatggtgccattgcagcatttttgattacgactctcaagctcttttaccaaagaccaagacctgctattgagcatttggtttatgctggtggctattcgtttcccagtggccatgcgatgggtagcatgctgatttttggtagcctattgattatttgttatcagaggctacattcaaaactattacaatttgtgactagcatgatctttataatactaattttattaattgggttatctcgtatttatctaggagtacactacccaagtgatattttagcaggctttgtattaggatttggtattttgcactttatttatcctttttataagcaaaaacgatttgaatggcgatttcttttgaaacaagac

SEQ ID NO: 1852 - protein, 217 aa, Streptococcus pyogenes
MMTNKQTHFLIASFALLIFVIIGYTVKFFPERLALLDNTIQAEIRGNLPIVLTQFFRGVTVFGNVMTQVLLVIVSVLVLFFMKWKIEALFILSNGAIAAFLITTLKLFYQRPRPAIEHLVYAGGYSFPSGHAMGSMLIFGSLLIICYQRLHSKLLQFVTSMIFIILILLIGLSRIYLGVHYPSDILAGFVLGFGILHFIYPFYKQKRFEWRFLLKQD

SEQ ID NO: 1853 - DNA, 294 bp, Streptococcus agalactiae
atggatattacagattatcaaaaatgggtgagtgaattctataaaaaaagaaactggtatcaatacaattcttttattagaagtaactttctttcagaagaagtcggcgaattggctcaagccattcgcaaatatgaaattggacgtgacagacctgacgaaaccgaacaaactgatttggaaaacttaaatgatataaaagaagaactaggagatgtcttagataatatcttcatacttgctgatcagtataatatctcactagaagagattatcagcgcacatcgcactaat

SEQ ID NO: 1854 - protein, 98 aa, Streptococcus agalactiae
MDITDYQKWVSEFYKKRNWYQYNSFIRSNFLSEEVGELAQAIRKYEIGRDRPDETEQTDLENLNDIKEELGDVLDNIFILADQYNISLEEIISAHRTN

SEQ ID NO: 1855 - DNA, 558 bp, Streptococcus agalactiae
atgagaataactattttttgtggagcaagtactggggaaaatcctgtttatagtgaaaaaacagttgccttagcacaatggatggcacaaaacaaacattctctggtgtatggtggaggaaaagttggcttaatgggagtcatggctgatactgtgattgcaaatggtggctacactactggtgttattccgacatttttaagagatcgtgaaattgcacatgaaaatttatcagagcttatcatagtaaataatatgcctgaacgtaaggcaaaaatgatgctacttggagatgcctttatcgctctacctggtggacctggtacccttgaagaaatttccgaagttatctcttggtctcgcatcggtcaaaatgataatccttgcattttatataatgttaatggctactttaatgatttaaaaaatatgtttgatcatatggttggtgagggttttcttagtctggaagatagagaaaatgtcctattctcagatgatattactgaaatcgaagattttataacgaattataaagtccctagcacgcgccaatac

SEQ ID NO: 1856 - protein, 186 aa, Streptococcus agalactiae
MRITIFCGASTGENPVYSEKTVALAQWMAQNKHSLVYGGGKVGLMGVMADTVIANGGYTTGVIPTFLRDREIAHENLSELIIVNNMPERKAKMMLLGDAFIALPGGPGTLEEISEVISWSRIGQNDNPCILYNVNGYFNDLKNMFDHMVGEGFLSLEDRENVLFSDDITEIEDFITNYKVPSTRQY

SEQ ID NO: 1857 - DNA, 861 bp, Streptococcus agalactiae
ttgaatcaagaaaaaaagagacttaacctaatcgggctgatacttttagctcaggctattgttttaagtttggcgactacactatttgctgaaatcttacaaaatgatgtctggataggtatagcaagtactttaatcgccttactcattccttgtttttttatgggttttaaaaatttaaaaaaacatctaacggcaacccatcatacaatcactttcaccactattttattcttgttaagcattatatatactactaataatatagtctccacaatatgggatgttgtgctaaatcatctcaatattatggaatcggaaagtcaaaattatgatgccacattcaatatacttatgattagttattctgttgttgtaggtcctttttttgaagaagttttataccgaggaatagtattgaatttattatccaagtatggtaaatggtttgccattatcacttctggcatcctatttggtttaatgcaccaagacatttctcagctattgactacatctattgcgggtatcataatgggttttatcgcttaccattattcctttaaggtagccctactccttcatatctgcaataactttatcgtagaaattttcacccagctatcaacagtaaacgagttatacgggacttattttgaaaatatattgctaattttagcaatcttatttatattatattacctttttactcataggaatactgctcgccgtcgtataagtctgcactctaacgttcgagaggctgactcaataaactctaaacaacatacaaaattattacttactagttggccttttattctccttgtcatttacgacattgtcctaacaactattaat

SEQ ID NO: 1858 - protein, 287 aa, Streptococcus agalactiae
MNQEKKRLNLIGLILLAQAIVLSLATTLFAEILQNDVWIGIASTLIALLIPCFFMGFKNLKKHLTATHHTITFTTILFLLSIIYTTNNIVSTIWDVVLNHLNIMESESQNYDATFNILMISYSVVVGPFFEEVLYRGIVLNLLSKYGKWFAIITSGILFGLMHQDISQLLTTSIAGIIMGFIAYHYSFKVALLLHICNNFIVEIFTQLSTVNELYGTYFENILLILAILFILYYLFTHRNTARRRISLHSNVREADSINSKQHTKLLLTSWPFILLVIYDIVLTTIN

SEQ ID NO: 1859 - DNA, 1065 bp, Streptococcus agalactiae
  misc_feature (1)..(1065): n = a, c, g, or t
ttgcgctatcataaggttataaaaaatgctataatacgaataaaggaggcaagtatggcaagaatcccttatcagaaaacacttattttttgtgtagccgttattattgctatttttattttggggttatctaaggatttagcacaatctaaagggcaaaaggttgcaaataataatactgtaaaaacagcacgtgtggttgcaaacggagatattttgctgcacgatgtactatatgccagtgcgcgccaacccgacggcacttataattttactccttattttaaagaggtaaaatcttggattgagagcgctgatttagcgattggtgattatgaagggacgattagttcagaatatcctttagcgggctatcctttatttaatgctcctaatgagattgcaactactatgaaagaaactggatatgatgtcgttgacttagcacataatcatattctggattcacaactggcaggtgctatcaatactgtcaagacttttaatcgtctgggattggatactattggggtttatttaaaggatagaaataaagaagatatcttaattaagcatgtaaatggtattaaaattgctattttaggttattcgtatggctacaatggtatggaagctaatgtttcaaagagtgactatgaaaaacatatgtctgatttagatactaaaaagattaagcaagatattaaaaaggctgaaaaagaagcagatatcaccattgtcatgccacagatggggatagaatatcaaaaaaaacctactacagaacaagtaatgctttatcatagtatgattaaatggggggcagatattatattcggaggacaccctcacgttgttgaaccgtctgaagtgataaaaaaagatggccagaaaaaatttattatttactctatgggaaattttatttcaaatcagcgtttagaaacggttgatgatatctggacagaaagaggattattaatggatgtaaccatagagaaaaaaggtcaaaaaacagtaattaaaaaagttaaggcgcatccaacactagtagaagcannnnnt

SEQ ID NO: 1860 - protein, 355 aa, Streptococcus agalactiae
  MISC_FEATURE (1)..(355): Xaa = Any Amino Acid
MRYHKVIKNAIIRIKEASMARIPYQKTLIFCVAVIIAIFILGLSKDLAQSKGQKVANNNTVKTARVVANGDILLHDVLYASARQPDGTYNFTPYFKEVKSWIESADLAIGDYEGTISSEYPLAGYPLFNAPNEIATTMKETGYDVVDLAHNHILDSQLAGAINTVKTFNRLGLDTIGVYLKDRNKEDILIKHVNGIKIAILGYSYGYNGMEANVSKSDYEKHMSDLDTKKIKQDIKKAEKEADITIVMPQMGIEYQKKPTTEQVMLYHSMIKWGADIIFGGHPHVVEPSEVIKKDGQKKFIIYSMGNFISNQRLETVDDIWTERGLLMDVTIEKKGQKTVIKKVKAHPTLVEAXX

SEQ ID NO: 1861 - DNA, 1290 bp, Streptococcus pyogenes
atgatactattgaaaagcctctataagggcttttttgctgcaatgaaggaggaaaattttgaggcaagatgttataatagagaaaaaggagggtgtgtcttgattaaaactatgcaatacaaaaaaacgatggcaacagttgttgctcttatcgtcgcacttttgctatttggcttgatttatgatttacttggggttcaaaaaaatgagctagcagctcaaaaatctgctcagccaaaggtcaaaacagcgcgtgttgtagctaatggcgacattttaattcatgatattctctacatgagtgctagaaaagctgacgatacctatgatttcactccttattttgaatatgttaaggactggattagcggtgctgacttagctattggagattatgaagggaccattagcccagattatcccttagcaggctatcccttattcaatgctccagaagagattgcaggtgctctgaaaaatactggctatgatgtagtcgatttagcccataatcatatcttagattcccaattagacggtgcccttaacactaaaaaggtttttcatcaattaggtatagacagtattggcatctatgacaaggatcgttcaaaagaatccttcttaattaaaaatgtcaatggtatcaaaattgcaattttaggttattcttatggttataacggcatggaggccacacttagccaagaagactatgagaaacacatgtctgatttagatgaagctaagataaaaaaagaacttcagctagctgaaaaaaaggctgacgtgaccattgttatgccacaaatgggaacagaatatgccttagaaccgacagcagaacaaaaagaactttaccacaaaatgattgattggggagctgacgtcgtcctaggaggccatccgcatgttattgaaccttcagagacagttataaaaggtaggcaaaagaaattcattatttactctatgggaaattttatttcaaatcagcggcttgaaaccgtagatgatatctggactgagcgtggcctattgatggaccttacttttgagaaaaaagataacaaaacaaaaattaaaacagttgaggcccatccaaccatggttttagccaaaggtaaaggcattgtgggtaaagaaggttttgaactatacaattatcgaacaatggttttagaagattttatcaaaggtggaaaataccacgacaagattgatgaggaaaccaaagcaaaagtagcacttgcctatcaggaaattaatgatttagttaacctgaaatgg

SEQ ID NO: 1862 - protein, 430 aa, Streptococcus pyogenes
MILLKSLYKGFFAAMKEENFEARCYNREKGGCVLIKTMQYKKTMATVVALIVALLLFGLIYDLLGVQKNELAAQKSAQPKVKTARVVANGDILIHDILYMSARKADDTYDFTPYFEYVKDWISGADLAIGDYEGTISPDYPLAGYPLFNAPEEIAGALKNTGYDVVDLAHNHILDSQLDGALNTKKVFHQLGIDSIGIYDKDRSKESFLIKNVNGIKIAILGYSYGYNGMEATLSQEDYEKHMSDLDEAKIKKELQLAEKKADVTIVMPQMGTEYALEPTAEQKELYHKMIDWGADVVLGGHPHVIEPSETVIKGRQKKFIIYSMGNFISNQRLETVDDIWTERGLLMDLTFEKKDNKTKIKTVEAHPTMVLAKGKGIVGKEGFELYNYRTMVLEDFIKGGKYHDKIDEETKAKVALAYQEINDLVNLKW

SEQ ID NO: 1863 - DNA, 1242 bp, Streptococcus agalactiae
atgaaaaaactaagaaagttagaggataagatgcagtattcagaaattatgattcgttatggagaactctctactaagaagaaaaaccgtatgcgcttcatcaataagttaaaaaataatatggagcatgtactctccatttatccagatgtttcagtaaaaacagatcgtgatagaggacatgtatatctcaatggtacagattatcatgaagttgcagagtccttaaaagagatttttggtatccaagctttttctccatcttttaaagtagaaaaaaatgttgatacattggtaaaagctgtccaggaaattatgacttccgtttataaagatgggatgacttttaaaattaccgcaaaacgtagtgaccactcatttgaattggatagccgtgctctaaatcatactttaggagatgctgttttttcagtcttgccaaatattaaggctcagatgaagcaaccagatatcaatcttaaagtcgagatacgagatgaggctgcttatatttcatatgaggatattaggggtgcaggaggattaccagtaggaacatctggaaaagggatgctgatgttgtctggtgggattgattctccggtagcaggttacctagcgttaaaacgtggtgtagatatagaagcagtccattttgcaagtcctccttatactagcccaggtgcattgaaaaaagcacatgatttaacacgtaaattgacaaaatttggtggtaatattcaatttattgaagttccattcacagaaattcaagaggaaattaaggcaaaagctcccgaagcctacttgatgacgttaacacgtaggtttatgatgcgtattacagatcgtattcgtgaggaccgaaatggtcttgttattattaacggtgaaagtttaggacaggtggcaagccaaacgttagaaagtatgcaagctattaatgctgtcactgcaacaccgattattcgtcctgtggtcacgatggataagctagaaattattgatattgctcaaaaaatagatacttttgatatttcaattcaaccatttgaggattgctgtacgatttttgcaccagatcgcccaaaaactaaccctaaaattaagaatacagaacagtatgagaaacgtatggatgtagaaggtcttgtagagagggcagttgcagggattatggtaactactattcaacctcaagcagatagtgatgatgttgatgacttgattgacgatttatta

SEQ ID NO: 1864 - protein, 414 aa, Streptococcus agalactiae
MKKLRKLEDKMQYSEIMIRYGELSTKKKNRMRFINKLKNNMEHVLSIYPDVSVKTDRDRGHVYLNGTDYHEVAESLKEIFGIQAFSPSFKVEKNVDTLVKAVQEIMTSVYKDGMTFKITAKRSDHSFELDSRALNHTLGDAVFSVLPNIKAQMKQPDINLKVEIRDEAAYISYEDIRGAGGLPVGTSGKGMLMLSGGIDSPVAGYLALKRGVDIEAVHFASPPYTSPGALKKAHDLTRKLTKFGGNIQFIEVPFTEIQEEIKAKAPEAYLMTLTRRFMMRITDRIREDRNGLVIINGESLGQVASQTLESMQAINAVTATPIIRPVVTMDKLEIIDIAQKIDTFDISIQPFEDCCTIFAPDRPKTNPKIKNTEQYEKRMDVEGLVERAVAGIMVTTIQPQADSDDVDDLIDDLL

SEQ ID NO: 1865 - DNA, 1212 bp, Streptococcus pyogenes
atggactattcagaaattatggttcgccatggtgaactatcaactaaagggaagaatcgcatgcgattcattaacaaacttaaaaacaatattcaagacgtactggctcctttcccagccattactgtccgttcagatcgtgataggacccatgtgtctctaaatggcacagattatcagcctattgtagaagctttaaagctggtgtttggtgttcaagctctatctcctgtttataaacttgaaaaaagtgtccctcttttggtaacagctgttcaagatatcatgacttctctttatcgtgatggactgacgtttaagattgccactaagcgtagtgatcacgcgtttgaattggatagtcgtgagcttaacagtcttcttggtggagctgtttttgaggttttaccaaatatccaagcccagatgaaacatcccgatgtgactctcaaagtcgaaattcgtgatgaagcagcttacatttcttatgaagagattaagggagcaggcgggttaccggtaggaacgtcagggaaagggatgctgatgttatcgggcggtattgattcaccagtagctgggtatttagcccttaaacgtggccttgatattgaagttgttcattttgctagccctccgtacaccagtccaggtgccttggctaaagcccaagaccttactcgtcgattaactcgttttggtggaaatatccaatttatcgaggttccttttacagaaattcaagaagaaattaaaaataaggcaccagaggcttaccttatgacattaacccgccgctttatgatgcgcatcacagatgccattcgtgagcaacgtaagggtcttgttattgttaacggtgagagcctaggtcaggttgctagtcaaacccttgaaagcatgcaggccattaatgcggtaacatcaactccaattattagaccagtcgtgacaatggataaacttgaaattatcgagatggctcaggcgattgatacttttgacatttctattcaaccgttcgaagattgctgtactatttttgcaccagaccgtcctaaaaccaaccctaaactaggtaatgctgaaaaatatgaagaatgctttgatattgatggtcttgtccagcgtgctgtgtcaggaattgttgtcacagaaatcacacctgaaatcgtcaatgatgaggttgaaaatctcattgatgctttactt

SEQ ID NO: 1866 - protein, 404 aa, Streptococcus pyogenes
MDYSEIMVRHGELSTKGKNRMRFINKLKNNIQDVLAPFPAITVRSDRDRTHVSLNGTDYQPIVEALKLVFGVQALSPVYKLEKSVPLLVTAVQDIMTSLYRDGLTFKIATKRSDHAFELDSRELNSLLGGAVFEVLPNIQAQMKHPDVTLKVEIRDEAAYISYEEIKGAGGLPVGTSGKGMLMLSGGIDSPVAGYLALKRGLDIEVVHFASPPYTSPGALAKAQDLTRRLTRFGGNIQFIEVPFTEIQEEIKNKAPEAYLMTLTRRFMMRITDAIREQRKGLVIVNGESLGQVASQTLESMQAINAVTSTPIIRPVVTMDKLEIIEMAQAIDTFDISIQPFEDCCTIFAPDRPKTNPKLGNAEKYEECFDIDGLVQRAVSGIVVTEITPEIVNDEVENLIDALL

SEQ ID NO: 1867 - DNA, 1143 bp, Streptococcus agalactiae
atgatttattttgataattcggcaactactattccctatccagaagttttaaggacttatcaagaagtagctagtaaaatctatggaaacccctcaagtttacatgagctaggaacaacatcttctcggattttagaggctagccgtaaacaaattgctagtttacttgagcttaaagcaaatgaaattttctttacctctggtggtacagaggccgataattgggttattaagggtcttgcgtttgagaaacaacattttggaaatcatattattgtttctgatatcgaacacccagctgttaaagagtctgctaaatggcttggagagtatgggtttgagattgattatgcgccagtagatgataaaggatttgtagacgtagaagcactggtcaaattaattaaaccagaaacgattcttatttcaattatggcaataaacaatgaaattggttctattcagccaataaaagctatttcagacttgttgtcagataaacctactatatcgtttcatgttgatgctgttcaagcaataggtaagataccgactaaagattatttgactgagcgagttgattttgcatctttttctagtcataaatttcacggcgttcgtggggttggctttctatatattaaagaaggaaaacgtatttcaccattactaacaggtggtggacaagaaactgatttacgttcaactactgagaatgtcgcagggattgcagctactgctaaagctttacgaatggttatggacaaggaagtagtagctattcctaaaataagtaaaatgaaaaccattattcatgatgaattagccaaatatgaggatattacgttattttcgggtaaggaagatttttcacctaacattatcacgtttggtatcaagggtgtccgaggagaagttcttgtccatgcctttgagggacatgatatttttatctcgacaactagcgcttgctcttctaaagcaggtaaaccagcaggaactcttatagcaatgggaatttcaactaagttagcccaaactgctgtacgtatcagcttagatgatgataatgatatgggacaagtagagcaatttttaactatttttaaacaagtttatgaaaaaactaagaaagttagagga

SEQ ID NO: 1868 - protein, 381 aa, Streptococcus agalactiae
MIYFDNSATTIPYPEVLRTYQEVASKIYGNPSSLHELGTTSSRILEASRKQIASLLELKANEIFFTSGGTEADNWVIKGLAFEKQHFGNHIIVSDIEHPAVKESAKWLGEYGFEIDYAPVDDKGFVDVEALVKLIKPETILISIMAINNEIGSIQPIKAISDLLSDKPTISFHVDAVQAIGKIPTKDYLTERVDFASFSSHKFHGVRGVGFLYIKEGKRISPLLTGGGQETDLRSTTENVAGIAATAKALRMVMDKEVVAIPKISKMKTIIHDELAKYEDITLFSGKEDFSPNIITFGIKGVRGEVLVHAFEGHDIFISTTSACSSKAGKPAGTLIAMGISTKLAQTAVRISLDDDNDMGQVEQFLTIFKQVYEKTKKVRG

SEQ ID NO: 1869 - DNA, 1119 bp, Streptococcus pyogenes
atgatttattttgataatgcagccacaaccataccttatggagaggctcttaaaacttaccaagaagtagcaacaaaaatatatggcaatccctcaagtctgcaccaattagggacaaatgcgtctcgcattttagaagcttcccgtaaacagattgctggtttgttgggtgttaagtcagaagaaatcttttttacgtctggtgggactgaaagtgctaattgggctattaagggaattgcttttgaaaaaaacgcttttggcaaacatattattatctcagccattgaacaccctgccgtgagtgaaagtgtcaaatggcttctcacacaaggattcgaagtttcttatgctccagtgacaacacagggagttgttgatgtgaatgctttagctgagctgattagaccagacaccatcttaatctcgattatggctgttaataatgaaatgggagctatccaaccgattagagccatttcaaacctattggctaaccaaccaacgatcacctttcacgttgatgctgttcaagccattggtaaaataccactctgtgattatatgactaatcgtgtggatttggcttctttttcagggcacaaatttcatagtgttcgtggtgttggcttcctttataaaaaagcaggcaagcgactcaatcctctcttgtcaggcggcggccaagagcaggagttacgttcaaccactgaaaatgttgcaggaattgctagcatggccaaagcattaagaatagtcactgaaaaacaagtgagcgtcttacctaaactaacagcgatgcgagatgtgatttacaaatctttgtccgcttacccagatgtgacagtattttcagctcaagaaggctttgcgcccaatattttgacctttgggattagaggggttcgaggagaagttattgtccacgcctttgaaaaatatgagatttatatttcgaccacaagtgcatgttcgtccaaagcaggtgagccagcaggaagcctagtggctatggggattcctgtaaaaactgcccagacagccgttcgtattagtctagacgatgacaacgatatgggacaagtagagcagtttttgaccatattccaaacagattta

SEQ ID NO: 1870 - protein, 373 aa, Streptococcus pyogenes
MIYFDNAATTIPYGEALKTYQEVATKIYGNPSSLHQLGTNASRILEASRKQIAGLLGVKSEEIFFTSGGTESANWAIKGIAFEKNAFGKHIIISAIEHPAVSESVKWLLTQGFEVSYAPVTTQGVVDVNALAELIRPDTILISIMAVNNEMGAIQPIRAISNLLANQPTITFHVDAVQAIGKIPLCDYMTNRVDLASFSGHKFHSVRGVGFLYKKAGKRLNPLLSGGGQEQELRSTTENVAGIASMAKALRIVTEKQVSVLPKLTAMRDVIYKSLSAYPDVTVFSAQEGFAPNILTFGIRGVRGEVIVHAFEKYEIYISTTSACSSKAGEPAGSLVAMGIPVKTAQTAVRISLDDDNDMGQVEQFLTIFQTDL

SEQ ID NO: 1871 - DNA, 96 bp, Streptococcus agalactiae
atgatcaaacaaataatactactaccgatacctcaactattgaaaatacaacaacaccttaaaaaagctaggttccctagctttttttgtattctt

SEQ ID NO: 1872 - protein, 32 aa, Streptococcus agalactiae
MIKQIILLPIPQLLKIQQHLKKARFPSFFCIL

SEQ ID NO: 1873 - DNA, 1347 bp, Streptococcus agalactiae
atgtcaaaacaatatgattatatcgttattggtggaggtagtgcaggcagtggtaccgctaatagggcagccatgtatggagcaaaagtcctgttaattgaaggtggacaagtaggtggaacttgtgttaacttaggttgtgtaccgaagaaaatcatgtggtatggtgcacaagtttctgagacactccataagtatagttcaggttatggttttgaagtcaataatcttaattttgattttactactctaaaagctaatcgcgatgcttacgtgcagcggtctagacagtcgtatgccgctaattttgagcgtaatggagtcgaaaagattgatggatttgctcgttttattgataaccatactattgaagtgaatggtcagcaatataaagctcctcacattactattgcaacaggtggacaccctctttaccctgatattattggaagtgaacttggtgagacttctgatgatttttttggatgggagaccttaccagattctatattgattgttggggcgggctatatcgcggcggaacttgctggagtggttaatgaattaggcgttgaaacccatcttgcatttagaaaagaccatattctacgcggatttgatgacatggtaacaagtgaggttatggctgaaatggagaaatcaggtatctctttacatgctaaccatgtacctaaatctcttaaacgcgatgaaggtggcaagttgatttttgaagctgaaaatgggaaaacgcttgtcgttgatcgtgtaatatgggctatcggccgtggaccaaatgtagacatgggacttgaaaataccgatattgttttaaatgataaaggttatatcaaagcagatgaatttgagaatacttctgtagatggcgtgtatgctattggagatgttaatgggaaaattgccttgacaccggtagcaattgcagcaggtcgtcgcttatcagaaagactttttaatcataaagataacgaaaaattagattaccataatgtaccttcagttatttttactcaccctgtaattgggacggtaggactttcagaagcagcagctatcgagcaatttggagaagataatatcaaagtctatacatcaacttttacctctatgtatacggctgttaccactaatcgccaagcagttaagatgaagctcataaccctaggaaaagaggaaaaagttattgggcttcatggtgttggttatggtattgatgaaatgattcaaggtttttcagttgctatcaaaatgggggctactaaagcagactttgatgatactgttgctattcacccaactggatctgaggaatttgttacaatgcgc

SEQ ID NO: 1874 - protein, 449 aa, Streptococcus agalactiae
MSKQYDYIVIGGGSAGSGTANRAAMYGAKVLLIEGGQVGGTCVNLGCVPKKIMWYGAQVSETLHKYSSGYGFEVNNLNFDFTTLKANRDAYVQRSRQSYAANFERNGVEKIDGFARFIDNHTIEVNGQQYKAPHITIATGGHPLYPDIIGSELGETSDDFFGWETLPDSILIVGAGYIAAELAGVVNELGVETHLAFRKDHILRGFDDMVTSEVMAEMEKSGISLHANHVPKSLKRDEGGKLIFEAENGKTLVVDRVIWAIGRGPNVDMGLENTDIVLNDKGYIKADEFENTSVDGVYAIGDVNGKIALTPVAIAAGRRLSERLFNHKDNEKLDYHNVPSVIFTHPVIGTVGLSEAAAIEQFGEDNIKVYTSTFTSMYTAVTTNRQAVKMKLITLGKEEKVIGLHGVGYGIDEMIQGFSVAIKMGATKADFDDTVAIHPTGSEEFVTMR

SEQ ID NO: 1875 - DNA, 1359 bp, Streptococcus pyogenes
gtgataaaaatggttattccttatgattatattgttattggtggagggagtgcaggtattgcttctgcgaacagggcagccatgcatggggccaaagtattgttagctgaaggtaaagagattgggggaacctgtgttaacctaggctgcgttcctaaaaaagtcatgtggtatggcgctcaagtagcagatattttagggacttacgctaaggattatggatttgactttaaagagaaagcatttgattttaaacaattgaaagcaaatcgtcaagcttatattgatcggattcatgcttcttatgagcgaggctttgagcagaatggtgttgaccgtatttatgattatgctgttttcaaagatgctcatacggtagaaattgcagggcagctttataccgcaccgcatattttgattgctacaggaggacatcctgtttttccagatattgagggggcacaatacggtatcagctcggacggcttttttgccttagatgaggtaccaaaacgtacggctgtggttggggcaggctatattgctgtggaacttgctggtgttttgcatgctttgggatcgaagacggatttgtttatccgtcacgatcgacctttaagaagttttgacaaaaccattgttgatgtcttagttgatgaaatggcagttaatgggccgcgtttacacactcatgcagaagtggcaaaggttgtcaaaaatactgatgagtccttgaccctttacctcaaagatggccaagaagttgaggttgaccagctcatttgggctatcggtcgcaagcctaatctagaaggttttagtcttgacaaaactggagtgacgttaaatgataaaggttatattgagacagatgcctatgaaaacacgtctgtcaaaggtatttatgccgtgggagatgttaatgggaaactggctttaactccagttgctgtggcagctggacgtcgcctatcagagcgtcttttcaatggcaaaacagacgagaaattggactaccaaaacgttgctactgtgatttttagtcaccctgttattggctctgttggcttgtcagaagaagcagcagtcaaacagtatgggcaagaagcagttaaaacatatcaatcacgttttacgtctatgtttactgctatcactaaccatcgccaaccttgtctgatgaagttggtaacagtcggagataccgaaaaaatagttggtcttcacggaatcggatacggggttgacgaaatgattcagggctttgcagtagccatcaaaatgggagcaaccaaggcggattttgataacaccgttgctattcacccaactggctcagaagaatttgtcaccatgcgc

SEQ ID NO: 1876 - protein, 453 aa, Streptococcus pyogenes
VIKMVIPYDYIVIGGGSAGIASANRAAMHGAKVLLAEGKEIGGTCVNLGCVPKKVMWYGAQVADILGTYAKDYGFDFKEKAFDFKQLKANRQAYIDRIHASYERGFEQNGVDRIYDYAVFKDAHTVEIAGQLYTAPHILIATGGHPVFPDIEGAQYGISSDGFFALDEVPKRTAVVGAGYIAVELAGVLHALGSKTDLFIRHDRPLRSFDKTIVDVLVDEMAVNGPRLHTHAEVAKVVKNTDESLTLYLKDGQEVEVDQLIWAIGRKPNLEGFSLDKTGVTLNDKGYIETDAYENTSVKGIYAVGDVNGKLALTPVAVAAGRRLSERLFNGKTDEKLDYQNVATVIFSHPVIGSVGLSEEAAVKQYGQEAVKTYQSRFTSMFTAITNHRQPCLMKLVTVGDTEKIVGLHGIGYGVDEMIQGFAVAIKMGATKADFDNTVAIHPTGSEEFVTMR

SEQ ID NO: 1877 - DNA, 333 bp, Streptococcus agalactiae
atggctaatgtatatgatttagcaaatgaattagaacgtgctgttcgtgctttaccagaataccaagcagttttaactgcaaaatcagctattgaaagtgatgcggatgcacaagtgctttggcaagactttttggctacccaatcaaaagttcaagaaatgatgcaatctggccaaatgccaagtcaagaagaacaagatgaaatgtctaaacttggggaaaaaattgaatccaatgaccttttaaaagtttattttgaccaacaacaacggttgtctgtctatatgtctgatatcgaaaaaattgtctttgcacccatgcaggacttgatg

SEQ ID NO: 1878 - protein, 111 aa, Streptococcus agalactiae
MANVYDLANELERAVRALPEYQAVLTAKSAIESDADAQVLWQDFLATQSKVQEMMQSGQMPSQEEQDEMSKLGEKIESNDLLKVYFDQQQRLSVYMSDIEKIVFAPMQDLM

SEQ ID NO: 1879 - DNA, 339 bp, Streptococcus pyogenes
atgtcacaagaaatttatgactatgctaatcaacttgaaagagcagttcgtgctctgccagaataccaaaaagtgttagaagtaaaagaggccattcaagcagacgttagtgctagcgaactgtttgatgagtttgtcgctatgcaagaaaaaatccaagggatgatgcaatcaggccaaatgccaacggctgaagaacaaacaagcattcaagaacttagccaaaagattgaagctaatgaccagctaaaagcttattttgaagcgcagcaggccttatctgtttacatgagtgatattgagcgtattgtatttgctccgttgaaagatttagtcaag

SEQ ID NO: 1880 - protein, 113 aa, Streptococcus pyogenes
MSQEIYDYANQLERAVRALPEYQKVLEVKEAIQADVSASELFDEFVAMQEKIQGMMQSGQMPTAEEQTSIQELSQKIEANDQLKAYFEAQQALSVYMSDIERIVFAPLKDLVK

SEQ ID NO: 1881 - DNA, 1164 bp, Streptococcus agalactiae
atgagatatttaactgctggtgagtcacatggacctagtttaacagctattatcgaagggattcctgcgggactgaaattatctgctaaagatattaatgaagatttaaaacgccgccaaggtggttatggtcgtgggaatcgaatgaaaattgaaactgatcaagtgatcattagttctggtgtgcgccatggaaaaaccttgggttcacctattacactgacagtaactaataaggatcatagcaaatggctggacatcatgtcagtcgaagacattgaagagcgcctaaagcaaaaacgtcgtattaagcatcctagacctgggcacgcagatttagtaggtggaattaaataccgtttcgatgatttgagaaatgctttagagcgttcttcggctcgtgagaccacaatgcgagtagctattggtgcgattgctaaacgtatcttgaaagaaattggtatcgaaattgccaaccatattgtagtttttggtggcaaggagattactgtccctgataagctaacagttcaacaaatcaaagtgttatctagtcaatcgcaagtagctatcgtcaatccatccttcgaacaagaaatcaaggattatattgacagtgtgaaaaaggctggagatactatcggaggagtggttgaaactatcgttggaggagttcccgttggtttaggctcttatgtacactgggatagaaagttagatgctaagatagcgcaagcagttgtatctatcaatgcttttaaaggtgttgaatttggtctaggttttaagtcagggtttttaaaaggaagtcaagtaatggactccatatcatggacaaaggaccaaggttatatacgtcagtcaaataatttaggcggttttgaaggcggtatgactaatggagagcctattatcgttaggggagtaatgaaaccaattcctacgctttacaagccactaatgtcagttgatattgatactcacgagccttatagagctacagtggaacgttctgatcccacggcacttccggctgcaggtgtcgttatggaagctgtagtagccaccgtcctggtgacagaagtgctagaaaaattttcttcagacaacatgtatgaactaaaagaagctgtaaaactatatcgcaattatgttgatcatttt

SEQ ID NO: 1882 - protein, 388 aa, Streptococcus agalactiae
MRYLTAGESHGPSLTAIIEGIPAGLKLSAKDINEDLKRRQGGYGRGNRMKIETDQVIISSGVRHGKTLGSPITLTVTNKDHSKWLDIMSVEDIEERLKQKRRIKHPRPGHADLVGGIKYRFDDLRNALERSSARETTMRVAIGAIAKRILKEIGIEIANHIVVFGGKEITVPDKLTVQQIKVLSSQSQVAIVNPSFEQEIKDYIDSVKKAGDTIGGVVETIVGGVPVGLGSYVHWDRKLDAKIAQAVVSINAFKGVEFGLGFKSGFLKGSQVMDSISWTKDQGYIRQSNNLGGFEGGMTNGEPIIVRGVMKPIPTLYKPLMSVDIDTHEPYRATVERSDPTALPAAGVVMEAVVATVLVTEVLEKFSSDNMYELKEAVKLYRNYVDHF

SEQ ID NO: 1883 - DNA, 1164 bp, Streptococcus pyogenes
ttgcgttatttaacagcaggagaatctcatgggccatccttaacagctattattgaaggtataccagcaggattaactcttcatccagcggatattgatcacgaattacagcgacgtcaaggaggttatggccgtggtgccagaatgtctattgagactgatcgggttcaaatatcctcaggagttcgtcatggtaaaacaacaggggcccccattaccttaacggtaattaataaggaccaccaaaaatggctagatgtcatggctgtaggagacattgaagagactctcaagttaaagcgtcgtgttaagcatcctagaccaggacatgcggatttggtaggaggtattaaatatcattttaacgatttaagagatgctttagagcgttcctcggctagagaaacaacgatgagagtggctgtaggcgctgttgctaaacgtatcttagctgaacttggaattgatatgttacatcatatcttaatatttggtggtataacgatcacaataccttctaagctctcttttagagagctgcaagaaagggctctccattcagaattatctattgttaatccaaagcaagaagaagaaattaaaacgtatattgataagataaaaaaagaaggggataccattggtggtattatcgaaacgatagttcaaggggtgccagcaggtcttggatcttatgtccaatgggataaaaaattagatgccaagctggctcaagcagttctttccattaatgcttttaaaggggtggaatttggagctgggtttgatatgggattccaaaagggctctcaggtaatggatgaaatcacctggacacctacccagggctatggtcgtcaaacaaaccacttaggtggctttgaaggtggcatgaccacaggacaacctcttgttgttaaaggggttatgaagcccattcctactttgtataaaccactcatgtcggtagatattgatagtcatgaaccttataaagcaacggtggaacgctctgatccgacggccttaccagctgcaggggttatcatggaaaatgtggtggcgacggtgcttgccaaagagattttagagactttttcttctactaccatgtctgaattgcaaaaagctttttcggactatcgtgcctacgtcaagcaattt

SEQ ID NO: 1884 - protein, 388 aa, Streptococcus pyogenes
LRYLTAGESHGPSLTAIIEGIPAGLTLHPADIDHELQRRQGGYGRGARMSIETDRVQISSGVRHGKTTGAPITLTVINKDHQKWLDVMAVGDIEETLKLKRRVKHPRPGHADLVGGIKYHFNDLRDALERSSARETTMRVAVGAVAKRILAELGIDMLHHILIFGGITITIPSKLSFRELQERALHSELSIVNPKQEEEIKTYIDKIKKEGDTIGGIIETIVQGVPAGLGSYVQWDKKLDAKLAQAVLSINAFKGVEFGAGFDMGFQKGSQVMDEITWTPTQGYGRQTNHLGGFEGGMTTGQPLVVKGVMKPIPTLYKPLMSVDIDSHEPYKATVERSDPTALPAAGVIMENVVATVLAKEILETFSSTTMSELQKAFSDYRAYVKQF

SEQ ID NO: 1885 - DNA, 1065 bp, Streptococcus agalactiae
atgcaggttgaagttgacttaccgaatcacccttatcatattaaaattgaagaaggatgtttttctgaggctggtgactgggtatcacatttatggcagaaacaaatgataactattatcacagatagtaacgtagaaatattatacggggagtcgcttgtcaaccagttaaaaaaacaaggttttacagtacatgtttttagttttgctgcgggtgaagctagtaaaactttggaagttgctaatcgtatttatgcttttttagcaaagcatcatatgaccagaagcgatgggatcattgcacttggtggaggcgtcgtcggagatttagcagcgtttgttgcttctacttatatgcggggaatccattttcttcaaattccaactagtttaacagcacaggttgattcttccattggcggaaaaacaggagtcaacacttcattcgctaaaaatatggtaggtacttttgcacaacctgatggtgtactgatagatcctgttactctaaaaacattgggcaatcgtgaattagttgaaggtatgggagaagtcatcaaatatggcttgattgatgatataaaactctggcatattttagaagagatggatgggactattgatagtatccttgataatgcattagctattatttatcactcttgtcaagttaaacgaaagcatgttttagctgatcaatatgataaagggttaaggatgcatttgaattttggccacactatcggtcatgctatcgaagtacatgctggctatggagaaataatgcatggagaagctgttgcaattggaatgatccagctttctcgtgtggctgagcgtaaaaatcttatgccaagaggtatcagtcaagatatttataatatgtgtttaaaatttggccttccggtccactatgcggaatgggataaggacgtcttatttgacatattgagtcatgataaaaaagcaagtggacaatttattaaaattgttatactgcctcaattaggtagtgcaacagtccaccaaatacctttagaagaaatgagagattatttggagaaa

SEQ ID NO: 1886 - protein, 355 aa, Streptococcus agalactiae
MQVEVDLPNHPYHIKIEEGCFSEAGDWVSHLWQKQMITIITDSNVEILYGESLVNQLKKQGFTVHVFSFAAGEASKTLEVANRIYAFLAKHHMTRSDGIIALGGGVVGDLAAFVASTYMRGIHFLQIPTSLTAQVDSSIGGKTGVNTSFAKNMVGTFAQPDGVLIDPVTLKTLGNRELVEGMGEVIKYGLIDDIKLWHILEEMDGTIDSILDNALAIIYHSCQVKRKHVLADQYDKGLRMHLNFGHTIGHAIEVHAGYGEIMHGEAVAIGMIQLSRVAERKNLMPRGISQDIYNMCLKFGLPVHYAEWDKDVLFDILSHDKKASGQFIKIVILPQLGSATVHQIPLEEMRDYLEK

SEQ ID NO: 1887 - DNA, 1071 bp, Streptococcus pyogenes
atgccacaaacacttcatgtccattctcgggtcaaggattatgatatcctgtttaccgaccatgttttaaaaaccttagcagattgccttggtgagcgcaagcagcgtaaactcttgtttatcaccgatcaaacggtctaccacttgtatcagactctctttgaagaatttgctcagcaatacaacgcttttgtccatgtctgccctccgggaggtcaatccaaatccttggaacgtgtcagtgctatctacgaccagctcatcgctgaaaatttttccaaaaaagatatgattgttactattggtggtggtgttgttggggatctgggtggttttgtcgctgcaacctattaccgtggtattccctacattcaaatcccaacgactttacttagtcaggtggatagcagtatcgggggcaaagttggagtccattttaaaggtctaaccaatatgattggcagcatttaccctccagaagctatcattatttcaaccacctttttggagaccttaccgcaacgggaattctcctgcggcatcagtgagatgctcaaaatcggcttcattcatgatagaccgctttttcagcagttacgtgattttcaaaaagaaaccgataagcagggacttgaacgtctgatttaccaatccatttccaataaaaaacggattgttgaacaagatgaatttgaaaatggtttgcgcatgtctttaaattttgggcataccttgggccacgcgattgaatcgctctgccaccatgatttttaccatcacggtgaagccattgctatcggtatggtggttgatgctaaactggctgtttccaaaggactcttgccaaaagaggacttggatagcctccttcaagtttttgaacgttaccagttaccaacaacacttgaaagagctgatgtctctgcgacatccctctttgacgtctttaaaacagataagaagaattctgagcaacatattatctttatattacccacagaaaccggttttaccaccctagccattaacaaagacgatcaccaatttgtcgagaagctcgacagtttatta

SEQ ID NO: 1888 - protein, 357 aa, Streptococcus pyogenes
MPQTLHVHSRVKDYDILFTDHVLKTLADCLGERKQRKLLFITDQTVYHLYQTLFEEFAQQYNAFVHVCPPGGQSKSLERVSAIYDQLIAENFSKKDMIVTIGGGVVGDLGGFVAATYYRGIPYIQIPTTLLSQVDSSIGGKVGVHFKGLTNMIGSIYPPEAIIISTTFLETLPQREFSCGISEMLKIGFIHDRPLFQQLRDFQKETDKQGLERLIYQSISNKKRIVEQDEFENGLRMSLNFGHTLGHAIESLCHHDFYHHGEAIAIGMVVDAKLAVSKGLLPKEDLDSLLQVFERYQLPTTLERADVSATSLFDVFKTDKKNSEQHIIFILPTETGFTTLAINKDDHQFVEKLDSLL

SEQ ID NO: 1889 - DNA, 675 bp, Streptococcus agalactiae
atgaaaatagtagtaccagtaatgcctcgcagtcttgaagaggctcaagaaatagatttatcaaaatttgatagtgttgatattattgaatggcgagctgatgccttaccaaaggatgacattattaatgtagctccagctatttttgagaaattcgcaggtcatgaaattatttttactcttcgtacaacgcgtgaaggtggtaatattgtcttatctgatgctgagtatgttgagttaatccagaaaattaattctatctacaatccagattatattgattttgagtatttttcacataaagaagtttttcaagaaatgctagaatttccaaatttagtcctgtcttatcacaattttcaagagacaccggagaatattatggagatattttcagaattaacagccctagcaccacgagttgtgaaaatcgcagtaatgccaaagaatgaacaagatgtcttagacgttatgaattacactcgcggtttcaagactattaatcctgatcaagtttatgcgacggtatctatgagtaaaattggacgtatttctcgttttgctggtgatgtaactggatctagttggacatttgcatatttagattcatctatcgcacccggacaaattactatttcagagatgaagcgtgtcaaagcattgcttgacgctgac

SEQ ID NO: 1890 - protein, 225 aa, Streptococcus agalactiae
MKIVVPVMPRSLEEAQEIDLSKFDSVDIIEWRADALPKDDIINVAPAIFEKFAGHEIIFTLRTTREGGNIVLSDAEYVELIQKINSIYNPDYIDFEYFSHKEVFQEMLEFPNLVLSYHNFQETPENIMEIFSELTALAPRVVKIAVMPKNEQDVLDVMNYTRGFKTINPDQVYATVSMSKIGRISRFAGDVTGSSWTFAYLDSSIAPGQITISEMKRVKALLDAD

SEQ ID NO: 1891 - DNA, 684 bp, Streptococcus pyogenes
atgagaattgtagcaccagtcatgccaagacattttgacgaggctcaagccattgatatttctaaatatgaagatgttaatttaattgaatggcgagcagactttcttcccaaggatgagattgtcgcagtagcaccagctatttttgaaaaatttgccggaaaagaaattatctttacccttcggaccgttcaagaaggggggaatattaccctttcaagtcaggagtatgttgatattatcaaagaaatcaatgctatttataatccagactatattgactttgagtattttacgcacaagtcagtatttcaagaaatgcttgattttccaaatcttattttgtcttatcacaactttgaagagactcctgaaaatttaatggaagctttttcagaaatgaccaagttggcaccgcgtgtggttaaaattgctgtgatgccccagagtgaacaagatgttctagatttgatgaactataccagaggctttaagacgctcaatcctgagcaagaatttgcaactatatctatggggaaattaggaagattgtctcgttttgcgggagatgtcattggctcttcctggacatacgtttcattagatcatgttagcggtccaggtcaagtgactctcaatgatatgaaacgtattattgaggtcttagaaatggatatctctaac

SEQ ID NO: 1892 - protein, 228 aa, Streptococcus pyogenes
MRIVAPVMPRHFDEAQAIDISKYEDVNLIEWRADFLPKDEIVAVAPAIFEKFAGKEIIFTLRTVQEGGNITLSSQEYVDIIKEINAIYNPDYIDFEYFTHKSVFQEMLDFPNLILSYHNFEETPENLMEAFSEMTKLAPRVVKIAVMPQSEQDVLDLMNYTRGFKTLNPEQEFATISMGKLGRLSRFAGDVIGSSWTYVSLDHVSGPGQVTLNDMKRIIEVLEMDISN

SEQ ID NO: 1893 - DNA, 165 bp, Streptococcus agalactiae
gtgtatgaaaacatatttagaacttttttaccttctgatagattagttgctaaggcttttctgacatcatgttggtcaaggaaaatacctgtcattaatccatcattcaaaaagacactatatttgatattattttctaaaatcaaaaatgattcaggagcctct

SEQ ID NO: 1894 - protein, 55 aa, Streptococcus agalactiae
MYENIFRTFLPSDRLVAKAFLTSCWSRKIPVINPSFKKTLYLILFSKIKNDSGAS

SEQ ID NO: 1895 - DNA, 1155 bp, Streptococcus agalactiae
atgaataaacttaaagtgaattctgtcgttgaaagaaaaatcaaatcaggtgctcagttactggaaaaaaaagattttgataccagtttagttaaccagttggttcaacttttttcacagtcaaatcaattcttagggatggcctatctttcaccacaaaataaaggtattggttggttactatcaagacaagtttttgattttaaccatgattactttgtatcgctattcgaaaaatctagagagaagcgtcaaaaatttgaaaaatctagccaaacaacagcctaccgcttgtttaatcaggatggagataactttggtggcctaactatagatttttatagtgactatgctcttttttcgtggtacaatgaatttgtttatactaatcgacaaatgattgttgcagcctttaagcaggtctatcctaatattaaaggggcatatgaaaaaattcgtttcaaaggtttagactttgaaagtgctcatttgtacggtcaagaggctcctgaatcatttttgattttagaaaataatatcaaatatagtgtctttttgaatgatggattaatgacaggtattttccttgaccaacatgatgtcagaaaagccttagcaactaatctatcagaaggtaaaaaagttctaaatatgttttcatacactgcggctttttctgtagctgcagctgttggaggagcattagagacaacttctgttgatttagcaaaacgctcgcgtgaactttcaaaagcacactttgatgctaatcagattgtcacagataaccatcgatttatcgttatggatgtttttgaatattataagtatgccaaaagaaaacatctatcatatgatgtgattgttattgatccaccaagttttgctcgaaataaaaaacaaactttttcggttactaaagattactataaattaattgaacaagctttagatattttaacccctggtggaactatcattgcatcaactaacgcagctaatctaaccgtatcacaatttaagaaacaattggaaaaggggtttggtaaagcttcacataattacattagcttacagcagttgcctgaagatttcactataaatgataaggaccaacaaagtaattatttaaaagtatttacaataaaggtaaaa

SEQ ID NO: 1896 - protein, 385 aa, Streptococcus agalactiae
MNKLKVNSVVERKIKSGAQLLEKKDFDTSLVNQLVQLFSQSNQFLGMAYLSPQNKGIGWLLSRQVFDFNHDYFVSLFEKSREKRQKFEKSSQTTAYRLFNQDGDNFGGLTIDFYSDYALFSWYNEFVYTNRQMIVAAFKQVYPNIKGAYEKIRFKGLDFESAHLYGQEAPESFLILENNIKYSVFLNDGLMTGIFLDQHDVRKALATNLSEGKKVLNMFSYTAAFSVAAAVGGALETTSVDLAKRSRELSKAHFDANQIVTDNHRFIVMDVFEYYKYAKRKHLSYDVIVIDPPSFARNKKQTFSVTKDYYKLIEQALDILTPGGTIIASTNAANLTVSQFKKQLEKGFGKASHNYISLQQLPEDFTINDKDQQSNYLKVFTIKVK

SEQ ID NO: 1897 - DNA, 1161 bp, Streptococcus pyogenes
atgaataaactctatattgattcttttgtcgaaaagaagctgacagcaggggtacaattattagatgaaaaagatttttctaatataaaggaaaaaaatcagttggttcaactggtgaccaagtccaatcgtcccattggaacagcatatatctctaagcaaaataaaggaattggttggtatctaggaccagaaaaaatcgacttgtctatctcttattttgttagtctattttcagttgctaaggccaaaagacaagattttgctcaatcggacgagaccaatgcttatcgcctttttaatcaagaaggagacggttttggtggagtaacaattgatctttataaagattttgcagtcttttcatggtacaatgcctttgtctatgacaaaaaagaaatgattatggaggcttttcaacaggtttttcctgaagtcaaaggagcttatgaaaagtgtcgctttaaaggtccagatactgaaactgctcatctgtatggtgagctggcacaagaaaccttttcgattttagaaaatggcatagcctatcaagtcttcttgaatgagggcttaatgacaggtatttttctagaccagcatgatgttagaagagcactagtagatggtttagctatgggcaagtcccttcttaacctattttcctatacagctgccttttctgtagcagctgctatgggtggtgctatcgagaccacttctgtggacttggctaaacgatcgagagaattatcactagctcattttgagcataaccagttaaacttagcctcacatcattttgtggtgatggatgtttttgaatacttcaaatatgccaaacggaaaaaattaatctttgatgtgattgtgattgacccaccaagctttgctagaaataaaaaacaaactttctctgtgagcagggactaccacaaattaatcacagaggccttggacatattgagtcctaagggaactattatagcttcaacaaatgctgctaatatgactgttagccagttcaaaaagcaaattatcaaaggatttggaagtcgtcgtcctgagtctatgactctccagcagcttccgagtgactttactatcaataaagcagatgaaagaagtaactatttaaaggtatttactataaaggtacgagaa

SEQ ID NO: 1898 - protein, 387 aa, Streptococcus pyogenes
MNKLYIDSFVEKKLTAGVQLLDEKDFSNIKEKNQLVQLVTKSNRPIGTAYISKQNKGIGWYLGPEKIDLSISYFVSLFSVAKAKRQDFAQSDETNAYRLFNQEGDGFGGVTIDLYKDFAVFSWYNAFVYDKKEMIMEAFQQVFPEVKGAYEKCRFKGPDTETAHLYGELAQETFSILENGIAYQVFLNEGLMTGIFLDQHDVRRALVDGLAMGKSLLNLFSYTAAFSVAAAMGGAIETTSVDLAKRSRELSLAHFEHNQLNLASHHFVVMDVFEYFKYAKRKKLIFDVIVIDPPSFARNKKQTFSVSRDYHKLITEALDILSPKGTIIASTNAANMTVSQFKKQIIKGFGSRRPESMTLQQLPSDFTINKADERSNYLKVFTIKVRE

SEQ ID NO: 1899 - DNA, 2142 bp, Streptococcus agalactiae
gtgaaaaaaattaaagattttgctagccgtgcgatcaatacacgactcggctttattttattgttagtagttatatattggttaaagacaatttgggcttaccatactgattttaatttaggtttagaaaattcctatcagttgtttttgaccattataaaccccatccccttaggactcttaatcataggtttggccttatatgttaagcgaaccaaagctttttatattaccgcttttatcacctatgctatcgtaaatatccttctaattgcaaacgcaatctactatagagagttttccgatttcattacagttagcgccgtcttggctagtagtaaaacttcggctggccttggagactctgctcttaatctattgagaatttgggatcttgtctacgttttcgatttcattatccttattttcttatttgcaaccaagaaaatccacttagatgatcgtccatttaataaacgtgctagtttttctatcacagctttgtctggtttactcttttcaattaacttattcttagctgaaattgatcgtccagaactactaagtcgtggtttttcaaacacctatattgttaaagctcttggcttgccatcattttcgatttatagtggtaatcaaacttatcaagcacagaaagaaagaaatggtgccactgcacaagaattagcgactgccaaaaaatatgtagcagagcattatgccaaacccaatccagaatattatggtatcggaaaagggcgaaacgttatcatgattcatttggagagttttcaacaattcttgattgactataaattaaatattgatggtaaagaacatgtggttactccatttattaacagcctttatcattcgaaagagactgtctccttctctaacttcttccatcaagtcaaagctggtaagacatccgatgctgagacactcatggaaaactcactttttggtctaagtagtggttcattcatggttaattatggtggtgaaaatacacaatttgctgctccacatatcttagctcaaaatggaggttacagtagtgcggtcttccacggaaacgtcggaacattttggaatagaaataatgcttacaaacagtggggttatgactacttctttgactctagctacttctcaaaacaaaccaaagataattcattccaatacggtttgaatgataaatatatgtttgctgactctatcaaatatctagagcacatgcaacaaccattttatactaaatttattacagtaagtaaccattacccttacacaagtttgaagggagagtctgacgaagagggattcccacttgcaaagactaacgatgaaacgattaacggttattttgccacagcaaactaccttgatacagctcttaaatcattttttgaatatctaaaagctgctggtgtgtatgataattctattattgtaatgtatggggatcactacggtatttctaatacacgcaatcctagcttagctgaattattaggtaaagaccctgaaacatggtctgaatacgacaacgctatgttacaacgtgttccatatatgattcacattcctggctattcaaaaggttttatcagtaatacatacggtggtgaggtagataatttaccaactttacttcatattctaggaatagatacgtctaaatatactcagttaggacaagacttattatctaaagataataaacaaatggtcgctatgagaacaactggtcagtatattactcctaaatacactaactatagtggacatctctattacactgattcaggacaagaaatcacaaatcctgatgaaacaactaaagctgaaataaaagctattcgagatgctactaataaacaattatctacaagtgattcgattcaaactggagatttactacgatttgatgaaaacaatggtttgaaaactgtagaagttgaaaaattcaattacacacattctcttaaagcactcaaagctaaagaacgtaaattgaaagatcgttcaacaagcatatacagcaaacataacaacaaatcaacagttgatctcttccatgctccaagttacttggaattgcaagatcctaataagacacataaaacatctaaaaaa

SEQ ID NO: 1900 - protein, 714 aa, Streptococcus agalactiae
MKKIKDFASRAINTRLGFILLLVVIYWLKTIWAYHTDFNLGLENSYQLFLTIINPIPLGLLIIGLALYVKRTKAFYITAFITYAIVNILLIANAIYYREFSDFITVSAVLASSKTSAGLGDSALNLLRIWDLVYVFDFIILIFLFATKKIHLDDRPFNKRASFSITALSGLLFSINLFLAEIDRPELLSRGFSNTYIVKALGLPSFSIYSGNQTYQAQKERNGATAQELATAKKYVAEHYAKPNPEYYGIGKGRNVIMIHLESFQQFLIDYKLNIDGKEHVVTPFINSLYHSKETVSFSNFFHQVKAGKTSDAETLMENSLFGLSSGSFMVNYGGENTQFAAPHILAQNGGYSSAVFHGNVGTFWNRNNAYKQWGYDYFFDSSYFSKQTKDNSFQYGLNDKYMFADSIKYLEHMQQPFYTKFITVSNHYPYTSLKGESDEEGFPLAKTNDETINGYFATANYLDTALKSFFEYLKAAGVYDNSIIVMYGDHYGISNTRNPSLAELLGKDPETWSEYDNAMLQRVPYMIHIPGYSKGFISNTYGGEVDNLPTLLHILGIDTSKYTQLGQDLLSKDNKQMVAMRTTGQYITPKYTNYSGHLYYTDSGQEITNPDETTKAEIKAIRDATNKQLSTSDSIQTGDLLRFDENNGLKTVEVEKFNYTHSLKALKAKERKLKDRSTSIYSKHNNKSTVDLFHAPSYLELQDPNKTHKTSKK

SEQ ID NO: 1901 - DNA, 2214 bp, Streptococcus pyogenes
ttggagatgacatctttaggaaaaaacgataaggaagttgctactgtgaagaaatttaaaacacttatcacaggttttatcaacacaagattgggttttataattactctactcttttgttactggataaagaccctgtgggcatatcatacagacttttcactagatttgggaaatatataccaagtctttctaactattatcaatccaatcccactagcttttttacttttgggggttgctctttacgttaagaatacccgagccttttatatctgttcttgggtggtttatattatccttaacattctcttgatatcaaattctatatattaccgagaattttcagactttattacagtgagtgccatgctagctagtagtaaagtctccgctggattaggggactctgctttaaaccttttacgcatctgggatattatctatattcttgattttattattctaattagtttatctatcgctaaaaaaatcaaaaatgatcaacgtccttttaacaagcgcgcagcatttgccatcaccgctttatctagtctattgctttctattaatctttttttagcagaaattgatcgtccggaactattaacacgtggcttttcaaatacttatattgtgagagctttaggactaccagcgtttaccctctatagcggcaatcaaacctatcaagctcaaaaagaacgaaatggagctactgcagaagaattaattgatgttaaaacttatgtcaaaggacattatgcagcacctgatcctcagtattttggaattggaaaaggcaaaaatattattgttcttcatttagaaagctttcaacaattcttaatagattataaactaaaagaaggagataaagaatatgaggtaacgccttttatcaactcactttatcactcaaatgctaccttagcattccctaacttttttcatcaggttaaagcaggtaaaacttctgatgctgaaaccatgatggagaattccttatttggtttaaatagtggttcttttatggtgaactacggtggtgaaaatacacaatttgctactccaagtattttagcccaaaaaggtggctataccagcgctgtctttcatggtaacgttggaactttctggaatcgcaataatgcttataaacaatggggctataattatttttttgattctagctacttctctaaacaaaatagtaagaactcttttcaatatgggttaaatgataagtacatgtttaaggattccataaaatatcttgaacagatgcaacaacctttttataccaagtttatcactgtgagtaatcactatccttatactagtctaaaaggcgaaagtagtgaagaaggttttcctttagccaaaacagacgatgaaacgatcaatggttactttgctactgccaattatttagacgctgcccttaaatctttttttgattacttgaaagccactggtttgtacgacaattctatttttgttttatatggtgatcattatggtatttcaaattctcgtaattctagtcttgctccacttcttggtaaagattctgaaacttggtctgaatatgataatgctatgctacaacgagtcccgtatatgatccatattccaggttatacgaatggtagtatcaaagaaacctttggcggtgaaatcgatgctcttcctactttactccacatacttggtattgacactagtcagtttgttcaattaggacaagatttattatcacctcaaaatagccagattgtggcacaacgaacatctgggacttatatgactcctgaatacactaactatagtggacgtctgtacaacacgcaaacaggtttagaaatcactaatcccgatgaaatgactatagccaaaactaaggaaattcgctctgctgttgctcaacaactagcagctagcgacgctattcaaacgggtgatctcctgcgctttgatactcaaaatggtctaaaagctattgatcctaaccagtttatctacactaagcagttaaaacaactgaaagatatttcagcaaaactcggatcagagtcaacaagtttatacagtaaaaatggtcataaatcaactcagaaactttttaaagcaccatcttacttagaactaaatcccgtagaagctgacgcggcaacttctgaactaaaagaggataaccccaaaaataaagaa

SEQ ID NO: 1902 - protein, 738 aa, Streptococcus pyogenes
LEMTSLGKNDKEVATVKKFKTLITGFINTRLGFIITLLFCYWIKTLWAYHTDFSLDLGNIYQVFLTIINPIPLAFLLLGVALYVKNTRAFYICSWVVYIILNILLISNSIYYREFSDFITVSAMLASSKVSAGLGDSALNLLRIWDIIYILDFIILISLSIAKKIKNDQRPFNKRAAFAITALSSLLLSINLFLAEIDRPELLTRGFSNTYIVRALGLPAFTLYSGNQTYQAQKERNGATAEELIDVKTYVKGHYAAPDPQYFGIGKGKNIIVLHLESFQQFLIDYKLKEGDKEYEVTPFINSLYHSNATLAFPNFFHQVKAGKTSDAETMMENSLFGLNSGSFMVNYGGENTQFATPSILAQKGGYTSAVFHGNVGTFWNRNNAYKQWGYNYFFDSSYFSKQNSKNSFQYGLNDKYMFKDSIKYLEQMQQPFYTKFITVSNHYPYTSLKGESSEEGFPLAKTDDETINGYFATANYLDAALKSFFDYLKATGLYDNSIFVLYGDHYGISNSRNSSLAPLLGKDSETWSEYDNAMLQRVPYMIHIPGYTNGSIKETFGGEIDALPTLLHILGIDTSQFVQLGQDLLSPQNSQIVAQRTSGTYMTPEYTNYSGRLYNTQTGLEITNPDEMTIAKTKEIRSAVAQQLAASDAIQTGDLLRFDTQNGLKAIDPNQFIYTKQLKQLKDISAKLGSESTSLYSKNGHKSTQKLFKAPSYLELNPVEADAATSELKEDNPKNKE

SEQ ID NO: 1903 - DNA, 267 bp, Streptococcus agalactiae
ttgttccgtactgcaaaagaacaagtaatgaattcttactactatgcataccgtgaccgtcgtcagaaaaaacgtgacttccgtaaattatggatcactcgtatcaatgcggctgctcgtatgaatggtttatcatattcacaattgatgcacggtttgaaattagctgaaatcgaagttaaccgtaaaatgcttgctgatttagcagttaacgatgcagcagctttcacagctcttgcagatgcagctaaagctaaacttggtaaa

SEQ ID NO: 1904 - protein, 89 aa, Streptococcus agalactiae
MFRTAKEQVMNSYYYAYRDRRQKKRDFRKLWITRINAAARMNGLSYSQLMHGLKLAEIEVNRKMLADLAVNDAAAFTALADAAKAKLGK

SEQ ID NO: 1905 - DNA, 357 bp, Streptococcus pyogenes
atggcacgtgttaaaggtggcgttgtttcacgcaaacgtcgtaaacgtattttaaaattagctaaaggttactatggagcaaaacacatcttgttccgtactgcaaaagagcaagtgatgaactcttactactatgcataccgtgatcgccgtcagaaaaaacgtgatttccgtaaactatggatcactcgtatcaatgcggctgctcgtatgaacggtttgtcatactcacaattgatgcacggtttgaaacttgctgaaatcgaagtaaaccgtaaaatgcttgctgatttagcagtagctgatgcagcagctttcacagctcttgctgatgcagccaaagcaaaacttggcaaa

SEQ ID NO: 1906 - protein, 119 aa, Streptococcus pyogenes
MARVKGGVVSRKRRKRILKLAKGYYGAKHILFRTAKEQVMNSYYYAYRDRRQKKRDFRKLWITRINAAARMNGLSYSQLMHGLKLAEIEVNRKMLADLAVADAAAFTALADAAKAKLGK

SEQ ID NO: 1907 - DNA, 171 bp, Streptococcus agalactiae
atgcctgcgttggttctttcttcctcgacgaacctagtcattgttgttaaggttactaatgctgcgactaaatataaaataatggggaaaagattactgattttagaagtgctatttgtactggagtcaaaagtgttatatccttgtcctccaggaaaggtagtacggttg

SEQ ID NO: 1908 - protein, 57 aa, Streptococcus agalactiae
MPALVLSSSTNLVIVVKVTNAATKYKIMGKRLLILEVLFVLESKVLYPCPPGKVVRL

SEQ ID NO: 1909 - DNA, 2571 bp, Streptococcus agalactiae
  misc_feature (1)..(2571): n = a, c, g, or t
atgggaaagacattttggaaagatatctatcgatcaattacgacttcaaaaggtagattttcatcaatcctcttacttatgatgttaggctcatttgcttttataggactgaaggtctcagcacctaatatgcaaagaacagcacaaaattaccttgctcatcatcatgttatggatattaccgttttcaattcttggggacttgacaaacatgatcaaactgttttagaaagcttaaaaggatcacaagttgaattttcttactttgtagatacaacccctcaacagaatagtaaatcttatcgattgtattccaataccaaaacgatatcaacctttgatcttgttaagggacgtctccctttaaataaatcagaaattgctctctcatttcaggaacgaaaaaaatatgcaataggtgataaaattaattttaaacaagataaaaacaaactgttttcaaatacaggtcctctaactattgtaggttttgttaattctaccgagatttggtctaagacaaaccttggtagttctcaaacaggggacggcgacttagatagttatggcgtattagataagacagcatttcactctccagtatatacaatggcaagggtaacttttaaagatcttaggttgattaaccctttctcaataagttacaaagaaaaagtagcgaaataccaagaaaaggtatcgcgaaaattaaatattcacaataaaataagatataccaaaacaaaaaaagagagcctacgtaaaatcgatgaggaggaaaaaagcctactaaaagctcaaaaacaaatcaatcggttagataatgatagcctagcgatgccactatctcaaagacaagctattcaaatgaaaattaaacaagaccgactatctcttttgaaacgaacaaaagagcttctaaaattgagacataacacccaaataatggaatcgcctcaaattattgtctacaaccgtactacctttcctggaggacaaggatataacacttttgactccagtacaaatagcacttctaaaatcagtaatcttttccccattattttatatttagtcgcagcattagtaaccttaacaacaatgactaggttcgtcgaggaagaaagaaccaacgcaggcatattaaaagcactaggctatagtgaccgccaagttatctttaaatttattatttatggttttatagcaggaacattagggactactttgggtatcattggagggcattatcttttacctcgtattatttctgatatcatttccaaagacctgactattccaaacacacagtatcatcttttcttaaattacagtttactagcctttgttttttcattattaagcattgttcttccagtttttgttatcactcgacgtgagttgaaagaaaaagcagcatttttattattaccaaaaccaccagctaaaggatctaaaatagctttagagtatatcaattggatttggaaaaaactgtccttcacacaaaaagtaactgctagaaatatttttcgttacaaacaaaggatgattatgaccatatttggagttgctggatcagtagcgctcttattttcaggtctaggaatacaatcctccttaaagcaaaccgtcaatgaacatttcggtcgtattatgccctatgatatattgctaacatataacacaaatgcttctcccccaaaaatacttgaactactttcaaaagattcaaaaatagacaaataccaaccaatacaccttgaaaatcttgacgaatccattcctggacaaattaataaacagtcaatttccctattcataacagacaaaaaacaattactaccttttatttatttacaagaagcaacaactaataagtcattgcacttgaataataaagggattattatttctaaaaaattagctcaattttatcatgttaataccggtgattttatccatttatctcattcacaaacacttccttctagaaaattaaaaataacaggagttgtcaatgcgaatgttggtcactatatttttatgacaaaacaatactatcgaactatttttaagaaagaagctaaagataacgcttttttggttaagttaaccaaacataaaatcgcaaataacttagcagaaaaacttttagaaattaatggagttgagtctcttacgcaaaatgctcttcagctggctagtgtagaagccgttgtgcgttctttagatggctctatgactattttagttgtcgtatctttattgttagccattgtaattctctataatctcactaatattaatttagcagaacgtaagcgggagctatcaactataaaggtattaggtttttataatgaagaagtaactttatacatttaccgcgaaaccattattttatcaaccatcggtgtgattctaggcaccattagcggtacttatttacaccgtcaaatgatgttgctaattggttcagatcaaatactttttggtgaaaaagtatcaccaactacatttataataccaataagcgtagtagtcatcattctaannnnnttaattaat

SEQ ID NO: 1910 - protein, 857 aa, Streptococcus agalactiae
  MISC_FEATURE (1)..(857): Xaa = Any Amino Acid
MGKTFWKDIYRSITTSKGRFSSILLLMMLGSFAFIGLKVSAPNMQRTAQNYLAHHHVMDITVFNSWGLDKHDQTVLESLKGSQVEFSYFVDTTPQQNSKSYRLYSNTKTISTFDLVKGRLPLNKSEIALSFQERKKYAIGDKINFKQDKNKLFSNTGPLTIVGFVNSTEIWSKTNLGSSQTGDGDLDSYGVLDKTAFHSPVYTMARVTFKDLRLINPFSISYKEKVAKYQEKVSRKLNIHNKIRYTKTKKESLRKIDEEEKSLLKAQKQINRLDNDSLAMPLSQRQAIQMKIKQDRLSLLKRTKELLKLRHNTQIMESPQIIVYNRTTFPGGQGYNTFDSSTNSTSKISNLFPIILYLVAALVTLTTMTRFVEEERTNAGILKALGYSDRQVIFKFIIYGFIAGTLGTTLGIIGGHYLLPRIISDIISKDLTIPNTQYHLFLNYSLLAFVFSLLSIVLPVFVITRRELKEKAAFLLLPKPPAKGSKIALEYINWIWKKLSFTQKVTARNIFRYKQRMIMTIFGVAGSVALLFSGLGIQSSLKQTVNEHFGRIMPYDILLTYNTNASPPKILELLSKDSKIDKYQPIHLENLDESIPGQINKQSISLFITDKKQLLPFIYLQEATTNKSLHLNNKGIIISKKLAQFYHVNTGDFIHLSHSQTLPSRKLKITGVVNANVGHYIFMTKQYYRTIFKKEAKDNAFLVKLTKHKIANNLAEKLLEINGVESLTQNALQLASVEAVVRSLDGSMTILVVVSLLLAIVILYNLTNINLAERKRELSTIKVLGFYNEEVTLYIYRETIILSTIGVILGTISGTYLHRQMMLLIGSDQILFGEKVSPTTFIIPISVVVIILXXLIN

SEQ ID NO: 1911 - DNA, 2634 bp, Streptococcus pyogenes
atgataaagaaaaccttatggaaggatattttgagagctatcaagaatagtaaagggcgattcatttccttatttttcctaatggccttaggctcctttgctttagttggacttaaagtcaccggtccagatatggaacgaacagccagccgttacctcgaaagacaccaggtgatggacctaacggtactggcttctcatcaattttcccaagccgataaacaagagttagatacgttaaaaggggctcatttagaatatggtcatttacttgatgtcagtctaactagcaaccagaaatctcttaggctctatagcgtgccaaagaaagtgtctaagccagtcttggttaaagggagttggccaaagcgagagacagatttggttttatcctcctcacttgctaaaaactatcagattggagatgaactagcagtcacctcacctatggaaggtttgctgacgacaacccattttcaagtggttggttttgcgaattcttcagaagtttggtccaagtccaatttaggaagttcctcaaccggagatggaagtctctacgcttatgcttttgttaatccaaacgtttttaaaagtgcctttaacctgctgcgcatccgttttagtcatcttcgtctgacaaacgctttttccaaagactatcaaaaaagggtaacccaaaaccaagctcatttggataatctacttaaagataatggccagaagcgttatgatgacctccaaaatcagtatgaccttgccttaaaaaatggcagagcagcacttgcaaaggaaacagtgaaactagctgcgagtgaggagaacttaacttttttagaaggctctgctttacaagaagctaagcatcagattgaacaaggcaaacaagcattagccaaggaggaaaagcagttagagcaggtgcaggctacaaaagataagctagaaaaacccagttacctgacttataatcgctcgaccctaccaggaggagaaggatatcatacttatgcaacttcaacgacctccatttcaaatgttggaaatatttttcctgttgttctttatctcgtagctgctctagtagcctttaccaccatgacacgttatgttgatgaagaaagaacaagctctggtctattaaaagccattggttattctaacaaggatatcagtttaaagtttcttatctatgggcttttagccagttttttagggacaactttaggtattattgggggaacttacctcttatctaccttgatttcagagatcttaacaggagctttgactattggaaagactcacctttatagttattggttttataatggcatagcttacttgctggctatgttatctgctgttttaccagcctacttaattgtcaaaaaggaattattcctcaatgcagctcagttattgctgcccaaacctcctagtaagggggcaaaaatctggttggaacaccttacttttgtctggaaagccctgtcctttactcacaaggtgaccatacgtaatatttttcgctataaacaaagaatgctgatgaccattgtaggcgttgcaggctcagtagcccttttatttgcaggcttagggattcagtcgtcattagccaaagtagttgagcatcaatttggtgatttaacgacttatgatattttggctgtcggttcggccaaagcgacagcgacagagcaaactgacttagctagctatcttaaacaagaacctattacagggtaccaaaaggtatcttatgccagcttaacccttcctgtaaagggattacctgataagcaaagtatttccattttatcaagttcagctacttctcttagtccctattttaatctgctggatagtcaggagcaaaagaaggttcccattccaacctctggtgttttgatttctgagaaattagcctcctattacaaggtaaaaccaggtgatcagttggtattgactgatcggaaaggacagtcttataaagtgacgattaaacaggttattgacatgacagttggccattacctgataatgtctgatacctattttaagaatcattttaaaggattggaggctgctcctgcctatctgattaaggtaaaagacaaagatagcaagcacataaaggagacagccagtgacttgttaaccttaaaagcgattagagcagtttcacaaaacgtcaatcatattaaatctgttcagctagtagtcacctctcttaatcaggtcatgaccctccttgtcttcttgtctattttattagcaatcgttatcctttataacttaacgactattaatattgctgagcgtattcgagaattatccactattaaagttctgggattttacgatcaggaggtcaccttatatatttatcgagaaactatttcgctatccctagtaggcattcttttaggtatctatttaggaaaaggcctgcatacttatatcatgacaatgatttcaactggggatattcaatttggtgtaaaggttgatgcttatgtttatctagtgccaattctagtaatccttagcttgttagcggtattaggtatctgggttaatcgccatttaaaaaaggttgatatgttagaagctttgaaatccatagat

SEQ ID NO: 1912 - protein, 878 aa, Streptococcus pyogenes
MIKKTLWKDILRAIKNSKGRFISLFFLMALGSFALVGLKVTGPDMERTASRYLERHQVMDLTVLASHQFSQADKQELDTLKGAHLEYGHLLDVSLTSNQKSLRLYSVPKKVSKPVLVKGSWPKRETDLVLSSSLAKNYQIGDELAVTSPMEGLLTTTHFQVVGFANSSEVWSKSNLGSSSTGDGSLYAYAFVNPNVFKSAFNLLRIRFSHLRLTNAFSKDYQKRVTQNQAHLDNLLKDNGQKRYDDLQNQYDLALKNGRAALAKETVKLAASEENLTFLEGSALQEAKHQIEQGKQALAKEEKQLEQVQATKDKLEKPSYLTYNRSTLPGGEGYHTYATSTTSISNVGNIFPVVLYLVAALVAFTTMTRYVDEERTSSGLLKAIGYSNKDISLKFLIYGLLASFLGTTLGIIGGTYLLSTLISEILTGALTIGKTHLYSYWFYNGIAYLLAMLSAVLPAYLIVKKELFLNAAQLLLPKPPSKGAKIWLEHLTFVWKALSFTHKVTIRNIFRYKQRMLMTIVGVAGSVALLFAGLGIQSSLAKVVEHQFGDLTTYDILAVGSAKATATEQTDLASYLKQEPITGYQKVSYASLTLPVKGLPDKQSISILSSSATSLSPYFNLLDSQEQKKVPIPTSGVLISEKLASYYKVKPGDQLVLTDRKGQSYKVTIKQVIDMTVGHYLIMSDTYFKNHFKGLEAAPAYLIKVKDKDSKHIKETASDLLTLKAIRAVSQNVNHIKSVQLVVTSLNQVMTLLVFLSILLAIVILYNLTTINIAERIRELSTIKVLGFYDQEVTLYIYRETISLSLVGILLGIYLGKGLHTYIMTMISTGDIQFGVKVDAYVYLVPILVILSLLAVLGIWVNRHLKKVDMLEALKSID

SEQ ID NO: 1913 - DNA, 699 bp, Streptococcus agalactiae
atgtcctatattgaaatgaagcattcctataagcgttatcaaacaggtgaaaccgaaattgttgctaacaatgatattagtttcagtattgaaagaggtgagttggtggttattcttggtgcatccggcgctggcaaatctactgttctcaatatactaggagggatggatagtaatagtgaaggtgaagttttaattgatggtaagaatattgctaattataccatcagggaattgactcgttaccgtagatatgatgtcgggtttgtttttcaattctataacttagtccctaatctaacagcactagagaatgtagaattggcttcagaaattgttccaaaggcattagatgcccaacaggcattagaaaacgtaggtttgggacaccgtatcaatcattttccagcacagctttccggtggcgaacagcaacgcgttgcaatagcacgagctattgccaaaaaacctaaactgttactttgtgatgaacctactggtgctttagattaccaaactggaaaacaagtactagccatcctgcaaaagatggcgcaatcaaaagaaacaactgtgatcattgttactcataatactgccttagcgccaattgcaaatcgcgtgatccatatgcatgattcaaaaatcagtgatattgtaataaacgagaatccaagtgatattcagaacatagaatat

SEQ ID NO: 1914 - protein, 233 aa, Streptococcus agalactiae
MSYIEMKHSYKRYQTGETEIVANNDISFSIERGELVVILGASGAGKSTVLNILGGMDSNSEGEVLIDGKNIANYTIRELTRYRRYDVGFVFQFYNLVPNLTALENVELASEIVPKALDAQQALENVGLGHRINHFPAQLSGGEQQRVAIARAIAKKPKLLLCDEPTGALDYQTGKQVLAILQKMAQSKETTVIIVTHNTALAPIANRVIHMHDSKISDIVINENPSDIQNIEY

SEQ ID NO: 1915 - DNA, 2127 bp, Streptococcus agalactiae
gtgatacctatggcaactacgacaaaaacgtcgaccaaaaaaacaagtaaaaaaaaatcagctactgctaaaaaaaatctagttattgtggagtctcctgcaaaagcaaagactatcgaaaaatacttaggacgtaactataaagttgtagcctcagtaggtcatatccgtgatttaaaaaagtcaagtatgtccattgattttgagaataattacgaaccacaatatattaatattcgtggtaaaggacctctcattaatgatttaaaaaaagaagctaaaaaggctaaaaaagtttacctcgcgagtgacccggaccgtgaaggagaagctatttcctggcatttagcgcatattttagatttagacaaagaagacagaaaccgtgttgttttcaatgaaatcacaaaagatgctgttaaaaatgcttttgtggaacctcgtcagattaacatggatctcgttgatgctcagcaagcacgacgtgttttagatcgcattgttggttattctatctcacctattttatggaaaaaagtaaaaaaaggcctatcagctggacgtgtacaatcagttgctcttaaactaatcattgatcgtgaaaatgagattaaggctttccaaccggaggagtattggactattgacggttcctttaaaaaaggaacacgtaaattcaatgccactttctacggtttagacggaaagaaattcaaattatcgaataatgaagacgtcaaaacagttctaaaacgtattaaaactgatgaattcttagttgaaaaagttgaaaaaaaagagcgtcgtcgtaatgcaccattaccgtatacaacttcttcattgcaacaagatgcagctaataaaatcaattttcgaactcgtaaaaccatgatgattgcgcaacagctgtacgaaggacttagcttaggcacagcaggtcatcaaggtctgattacctatatgcgtactgattctacacgtattagtccgttagcacaaaatgaagcaacagaatttattactaaccgttttggtgcaaattattctaaacatgggaataaagttaaaaatgcttctggagcacaagacgctcacgaagctattcgcccatctagtgttaatcatacacccgaaagtattgctaagtatttagacaaagatcaactaaaactttacactcttatctggaaccgttttattgcaagccaaatgacagcagcagtctttgacacaatgaaagttaatttaacgcaaaatggtgttacttttattgctaatggtagccaagtcaagtttgatggttacatggctgtttataacgatactgacaaaaataaaatgttaccagatatggaggaaggagaaagtgttaaaaaggttaatacgaatcctgaacaacacttcactcaacctcctgcaaggttttcagaagcaagtctcattaaaacacttgaagaaaacggtgtaggtcgtccttcaacttatgccccaacgcttgagactattcaaaaacgttattatgttaagcttgcagctaaacgcttcgaaccaactgaacttggtgaaattgttaatagccttattgtagaatttttcccagatattgttgatgttaccttcactgccgaaatggaagggaaactagacgaagttgagattggtaaagagcagtggcaaaagattatcgatgaattttataaaccatttgaaaaagaacttgcaaaagcagaaactgaaatggagaaaattcaaataaaggatgaacctgctggatttgattgcgagctatgtggatcaccaatggtaataaaactaggacgttatggaaagttttatgcgtgtagcaatttccctgaatgtcataacacaaaagctatcactaaggaaataggtgttatttgtcctatctgtcaaaaaggacaagttattgagcgaaaaacaaaacgcaatcgtatcttttatggctgtgaccgctacccagaatgtgagtttacatcttgggacaaacctattggacgaacttgccccaaatcaaatgatttcttagtggagaaaaaagtacgcggtggtggtaaacaagttgtttgctcaaatgaaaaatgcgactaccaagaagagaaaattaaa

SEQ ID NO: 1916 - protein, 709 aa, Streptococcus agalactiae
MIPMATTTKTSTKKTSKKKSATAKKNLVIVESPAKAKTIEKYLGRNYKVVASVGHIRDLKKSSMSIDFENNYEPQYINIRGKGPLINDLKKEAKKAKKVYLASDPDREGEAISWHLAHILDLDKEDRNRVVFNEITKDAVKNAFVEPRQINMDLVDAQQARRVLDRIVGYSISPILWKKVKKGLSAGRVQSVALKLIIDRENEIKAFQPEEYWTIDGSFKKGTRKFNATFYGLDGKKFKLSNNEDVKTVLKRIKTDEFLVEKVEKKERRRNAPLPYTTSSLQQDAANKINFRTRKTMMIAQQLYEGLSLGTAGHQGLITYMRTDSTRISPLAQNEATEFITNRFGANYSKHGNKVKNASGAQDAHEAIRPSSVNHTPESIAKYLDKDQLKLYTLIWNRFIASQMTAAVFDTMKVNLTQNGVTFIANGSQVKFDGYMAVYNDTDKNKMLPDMEEGESVKKVNTNPEQHFTQPPARFSEASLIKTLEENGVGRPSTYAPTLETIQKRYYVKLAAKRFEPTELGEIVNSLIVEFFPDIVDVTFTAEMEGKLDEVEIGKEQWQKIIDEFYKPFEKELAKAETEMEKIQIKDEPAGFDCELCGSPMVIKLGRYGKFYACSNFPECHNTKAITKEIGVICPICQKGQVIERKTKRNRIFYGCDRYPECEFTSWDKPIGRTCPKSNDFLVEKKVRGGGKQVVCSNEKCDYQEEKIK

SEQ ID NO: 1917 - DNA, 2127 bp, Streptococcus pyogenes
ttgggaacaaaaactacaactaagccaaaaacgggtactaaaaagtccaccactaaaaagaaatcaacagcgaaaaaaaatctcgttattgttgaatcacctgccaaagctaagactattgaaaaatatcttggacgcagttataaagttgttgcttcggtaggacatattcgtgacttaaaaaaatcgtctatgtctattgattttgataataattatgagccacaatacattaatatccgtggtaagggaccccttatcaattctttaaaaaaagaagccaaagctgctaaaaaagtttatttagctagtgacccggatcgtgagggagaggctatttcttggcatttgtcacatatcttaggacttgatcctcaagataataaccgagtggtttttaatgaaattacgaaagatgcagttaaacatgcctttgtggagcctcgtcagattgatatggacttggtagattctcaacaagcacgtcgtgttttggaccgtattgtgggatattccatttcaccaattctttggaaaaaggtcaaaaaaggactttcagcaggacgtgtccagtcggttgctttaaaactcatcattgaccgtgaaaatgacatcaaagcatttgttccaaaggaatactggtctattgatggtctttttaaaaaaggaactaaaaagtttcaagcgactttttacggtattaatggcaaaaaaacaaagcttgacaataacaacgatgtcaaagaggtattagcaaagctaacaaatgaagattttcttgtcagcaaggttgacaagaaagagcgacgtcgtaatgctcccttaccttacacaacatcatctcttcaacaagatgctgctaataaaatcaatttcagaacgcgtaaaaccatgatggtagcccaacaactgtatgaggggattcatttaggagaaaatggaactcaaggtttaattacctatatgcgtacggattctactcgtatcagtccagtagcacaaaacgatgctgctcaatttattatcaatcgctttggagctaattattcaaaacatggtaatcgtgtcaaaaataccagtggtgtccaagatgctcacgaggcgattcgtccatctagtgttaatcatacgccagactctattgccaaataccttaacaaggatcagttaaaactttatacgcttatttggaatcgttttgtggctagccaaatgacagcagctgtttttgataccgtaaaggtgaacttggagcaaaatggcgtgatttttgttgccaatggtagccaaatgaagtttgatggttacatggctgtttacaatgattccgataaaaacaaaatgttacctgagatggcagaaggagaaacggttaaaaaaatatcgacctctccagaacagcactttacgcagccaccagctcgttattctgaagcaactctaattaaaacgctagaagaaaatggtgttggacgtccatcaacttacgctccaaccttagaagtcattcaacgcagatactatgttaaattgtctgctaagcgctttgagccaactgagcttggggaaattgtcaacaagcttattgtcgaatttttcccagatattgtcgatgttgcctttactgccgagatggaaggtaagctagatcaagttgaaatcggagaagaacaatggcaacatgttatcgatcaattctatcaaccctttgtcaaagaattgaataaggctgagtctgaaattgaaaagattcaaatcaaagatgaaccagctggcttcgactgtgatgtttgtggtcacccaatggtcattaagttaggacgttttgggaaattttacgcgtgtagcaacttcccagagtgccgtaatacaaaagccatcactaaagaaattggtgttacttgtccggtttgtcataaaggacaagttatcgagcgtaaaaccaaaaaaaataggatattttatggttgtgatcagtatccagattgtgagtttatctcgtgggatttacctattggacgtgcttgccctaagtcaggtgactatcttattgagaaaaaagttcgtggtggcaaacaagtaatgtgtagcaatgagacctgtgattacaaggaagaaaaaattaaa

SEQ ID NO: 1918 - protein, 709 aa, Streptococcus pyogenes
LGTKTTTKPKTGTKKSTTKKKSTAKKNLVIVESPAKAKTIEKYLGRSYKVVASVGHIRDLKKSSMSIDFDNNYEPQYINIRGKGPLINSLKKEAKAAKKVYLASDPDREGEAISWHLSHILGLDPQDNNRVVFNEITKDAVKHAFVEPRQIDMDLVDSQQARRVLDRIVGYSISPILWKKVKKGLSAGRVQSVALKLIIDRENDIKAFVPKEYWSIDGLFKKGTKKFQATFYGINGKKTKLDNNNDVKEVLAKLTNEDFLVSKVDKKERRRNAPLPYTTSSLQQDAANKINFRTRKTMMVAQQLYEGIHLGENGTQGLITYMRTDSTRISPVAQNDAAQFIINRFGANYSKHGNRVKNTSGVQDAHEAIRPSSVNHTPDSIAKYLNKDQLKLYTLIWNRFVASQMTAAVFDTVKVNLEQNGVIFVANGSQMKFDGYMAVYNDSDKNKMLPEMAEGETVKKISTSPEQHFTQPPARYSEATLIKTLEENGVGRPSTYAPTLEVIQRRYYVKLSAKRFEPTELGEIVNKLIVEFFPDIVDVAFTAEMEGKLDQVEIGEEQWQHVIDQFYQPFVKELNKAESEIEKIQIKDEPAGFDCDVCGHPMVIKLGRFGKFYACSNFPECRNTKAITKEIGVTCPVCHKGQVIERKTKKNRIFYGCDQYPDCEFISWDLPIGRACPKSGDYLIEKKVRGGKQVMCSNETCDYKEEKIK

SEQ ID NO: 1919 - DNA, 840 bp, Streptococcus agalactiae
atgaatcattttgaactatttaagcttaaaaaagctggattaacaaatcttaatatccacaatattatcaactatctcaaaaagaatagtttaacttctctatctgttcgcaatatggccgtagtatcaaaatgtaaaaatcctactttctttatagaaaattataaacagctagaccttaaaaaacttcgacaagaattcaaaaaatttccagttctatcgattttggattctaactatcctttagagttaaaagaaatatataatccaccagttctacttttttatcagggtaatattgaacttctatctaaacctaaattagctgtagtgggggcaagacaggcatctcagataggttgtcagtctgttaaaaagattatcaaggagactaacaatcaatttgttatcgtaagtggtttagcgcgtggcattgatacagcagcacatgttagtgctttaaaaaatggcggcagtagtatagctgttatcgggagtggtttagatgtttattatccaacggagaataagaaacttcaagaatatatgtcatataatcatctcgtattatcagaatattttaccggagaacaacccttgaaatttcatttccccgaacgtaaccgtattattgcagggctgtgtcaaggtattgtggttgccgaagctaagatgagatctggaagtttaattacctgtgaaagagcattagaagagggacgagaagtttttgccattcccggaaatattatcgatggcaaatcagatggatgccaccatcttatccaagaaggagctaaatgcattatttcaggaaaagatatcctttctgaatatcag

SEQ ID NO: 1920 - protein, 280 aa, Streptococcus agalactiae
MNHFELFKLKKAGLTNLNIHNIINYLKKNSLTSLSVRNMAVVSKCKNPTFFIENYKQLDLKKLRQEFKKFPVLSILDSNYPLELKEIYNPPVLLFYQGNIELLSKPKLAVVGARQASQIGCQSVKKIIKETNNQFVIVSGLARGIDTAAHVSALKNGGSSIAVIGSGLDVYYPTENKKLQEYMSYNHLVLSEYFTGEQPLKFHFPERNRIIAGLCQGIVVAEAKMRSGSLITCERALEEGREVFAIPGNIIDGKSDGCHHLIQEGAKCIISGKDILSEYQ

SEQ ID NO: 1921 - DNA, 834 bp, Streptococcus pyogenes
gtgaatcattttgaactttataagctaaagaaagctggactgactaataaaaacattctcaatattcttgactaccaaaaacaccaggaaaaatcgttgtcacttcgagatatggccgttgtttctggttgtaagcatccgtctcactttatagaagcctataagcagttagatattcaaaatttaaaaatggaatttaaacaatttcctagtatttctatcttagataagcattacccaatggcattgaaagaaatatacaatccacctgtcctcttgttttttcagggaaatttagaccttcttgagaaacctaaattagccattgtcggctccagacgctcaagcgataccggagtaaagtctgtccgtaaaattcttaaagaactcgggaaccgttttgtgattgttagcggacttgctcgaggtatcgacactagtgctcatttagcctgccttaaaaatgggggacaaactatcgctattattggaacaggattggatcgcttttaccctaaagaaaatagggagttgcaaactttcttagggaaaaatcatcttgtgctaacagaatacggtccaggagaagaagctttatcttatcactttccagaacggaatcgtattatcgcaggccttagccgaggtattcttgtcgttgaagcaaaaaatcgttcaggttccttgattacttgtcaaattgggatagaagaaggccgagacatttttgctgtcccaggaaacattttggacgggaaatccgaaggttgccttcagttaattaaagagggagcaacatgcgtcacatcgggcatggatatcctttcagagtac

SEQ ID NO: 1922 - protein, 278 aa, Streptococcus pyogenes
VNHFELYKLKKAGLTNKNILNILDYQKHQEKSLSLRDMAVVSGCKHPSHFIEAYKQLDIQNLKMEFKQFPSISILDKHYPMALKEIYNPPVLLFFQGNLDLLEKPKLAIVGSRRSSDTGVKSVRKILKELGNRFVIVSGLARGIDTSAHLACLKNGGQTIAIIGTGLDRFYPKENRELQTFLGKNHLVLTEYGPGEEALSYHFPERNRIIAGLSRGILVVEAKNRSGSLITCQIGIEEGRDIFAVPGNILDGKSEGCLQLIKEGATCVTSGMDILSEY

SEQ ID NO: 1923 - DNA, 1026 bp, Streptococcus agalactiae
atgacaaaaaaacttattattgctatattagcactatgcactatcttaaccacttctcaagctgttttagctaaagaaaaatcacaaactgttaccataaaaaacaactattcggtctatattaaaaaagaaaaaagagacaagccggataataaaaagcaaatcagcgagacacttaaagttcctttaaaacccaaaaaagtagttgtttttgatatgggagctttggatactatcacagctttaggagctgaaaaatctgttattggtatcccgaaggctaaaaatgctctaagtttattgcccaataacgtcaaatctgtttataaagctaagagataccaagacgtaggaagtctcttcgaaccaaactttgaagctattgctcgtatgcaacctgatgtggttttcctaggagcacgtatggcttctgttgataatattgaaaaattaaaggaggctgcacctaaagcagcattagtatatgctggagtcgactcaaaaaaagtatttgacaaaggagttgctgagcgtgtcacaatgttagggaaaatcttcgaccaaaataaaaaggcaaaaacctttaataaagatatcgcacaagctgttcttaaattgcagaaaactattgagaaaaaaggtaaacctacagctctatttgtaatggcaaacagcggtgaacttttaactcaatcaccttctggtcgttttggttggattttctctgtaggtggatttaaagcagtcaatgaaaatgaaaaactaagttcacatggtactcccgtatcttatgaatacatcgctgaaaaaaatcctaactatctctttgttttagatcgtggagcgactattggacaaggagcttcatcaaaagaactttttaataacgatgttattaaagcaactgatgctgtcaaaaacaaacgtgttcatgaggtagatggaaaagattggtatatcaattcaggcggaagccgagtaacactccgtatgattaaagatgtacagaactttgttgataatcgt

SEQ ID NO: 1924 - protein, 342 aa, Streptococcus agalactiae
MTKKLIIAILALCTILTTSQAVLAKEKSQTVTIKNNYSVYIKKEKRDKPDNKKQISETLKVPLKPKKVVVFDMGALDTITALGAEKSVIGIPKAKNALSLLPNNVKSVYKAKRYQDVGSLFEPNFEAIARMQPDVVFLGARMASVDNIEKLKEAAPKAALVYAGVDSKKVFDKGVAERVTMLGKIFDQNKKAKTFNKDIAQAVLKLQKTIEKKGKPTALFVMANSGELLTQSPSGRFGWIFSVGGFKAVNENEKLSSHGTPVSYEYIAEKNPNYLFVLDRGATIGQGASSKELFNNDVIKATDAVKNKRVHEVDGKDWYINSGGSRVTLRMIKDVQNFVDNR

SEQ ID NO: 1925 - DNA, 915 bp, Streptococcus pyogenes
ttgctgtatgggtttggaaaaagaggaaaaaaaatgataaaacgatgtaaaggaattggtctagccttaatggccttctttttggtagcttgtgtgaatcagcaccctaaaacggctaaagagactgaacagcagagaattgtagccacttcggttgctgtggttgatatctgtgaccgtttaaatttagacctcgttggggtttgtgatagtaaattatatacccttcctaaacgctatgatgctgttaagcgtgtgggtttacccatgaatcctgatatagagttgattgcttctttgaaaccaacttggattttgagtcccaattctttacaagaagatttggaacccaagtatcaaaaattggatactgagtatggttttttgaacttacgaagtgttgagggcatgtaccagtccattgatgatttagggaaccttttccaacgtcaacaagaagcaaaagaattgcgccagcaataccaggactattatcgtgctttccaagctaaacgtaaggggaagaaaaagcctaaagtgcttattcttatgggcttgccaggtagttatttggtggcgacgaaccaatcttatgtagggaatcttttggacttggcaggtggtgagaatgtttatcagtcagatgagaaagaatttctatcagctaatcctgaagacatgctggctaaggagcctgacttgattttacgaacagctcatgccattccagacaaggtaaaagtgatgtttgacaaagaatttgctgaaaatgatatttggaaacattttacggcagtcaaggaagggaaagtctatgatttggacaataccctgtttggcatgagtgctaaattgaactacccagaagccttggacaccttaacacagctttttgaccacgtgggagatcatccg

SEQ ID NO: 1926 - protein, 305 aa, Streptococcus pyogenes
LLYGFGKRGKKMIKRCKGIGLALMAFFLVACVNQHPKTAKETEQQRIVATSVAVVDICDRLNLDLVGVCDSKLYTLPKRYDAVKRVGLPMNPDIELIASLKPTWILSPNSLQEDLEPKYQKLDTEYGFLNLRSVEGMYQSIDDLGNLFQRQQEAKELRQQYQDYYRAFQAKRKGKKKPKVLILMGLPGSYLVATNQSYVGNLLDLAGGENVYQSDEKEFLSANPEDMLAKEPDLILRTAHAIPDKVKVMFDKEFAENDIWKHFTAVKEGKVYDLDNTLFGMSAKLNYPEALDTLTQLFDHVGDHP

SEQ ID NO: 1927 - DNA, 759 bp, Streptococcus agalactiae
atgattcaaataaacaatttacataagttctatggccaaaaggaaatattaaaagacattaatatttcgattcctaaaggaaaagtaacagctattttaggtccaaatggatctggaaagagtacattgctgagttgtatcagtcgacttgaaccttatgataatggtgaaattttccttgataaagtaccattagcccactacagttcaaatgacttagccaaaacattagccatattaagacaatctaatcacttaacactcaagataaaggtgagagacttgataggattcggtagatttccttatagtaaaggacggttaagtcaaaaagataaagctgtcatagaatcagttatatcttatatggatttaaacgatatagctgacgagttcattaataacctcagcggaggtcaaattcaaagagcttttatcgcaatgacaatggcacaagatactcaatatatttgcttagatgagccactcaacaatttagatatgaaatatgctgttcaaatgatggatcttatcaaacgatatgcgtatgagtttaataaaactatagtgattattattcacgacatcaattttgcaactcactacgctgacaatgttgtcgctttaaaagaaggacaagtggtgacttgtgggactgtcgaagatgttatgcaagaaaaaatcctttctcatttatttgatatgcctatccgtatcgaaactgttgatggtaaaccaattatccttttttgtacaacg

SEQ ID NO: 1928 - protein, 253 aa, Streptococcus agalactiae
MIQINNLHKFYGQKEILKDINISIPKGKVTAILGPNGSGKSTLLSCISRLEPYDNGEIFLDKVPLAHYSSNDLAKTLAILRQSNHLTLKIKVRDLIGFGRFPYSKGRLSQKDKAVIESVISYMDLNDIADEFINNLSGGQIQRAFIAMTMAQDTQYICLDEPLNNLDMKYAVQMMDLIKRYAYEFNKTIVIIIHDINFATHYADNVVALKEGQVVTCGTVEDVMQEKILSHLFDMPIRIETVDGKPIILFCTT

SEQ ID NO: 1929 - DNA, 780 bp, Streptococcus pyogenes
atgacaacaattagtgctgaagacctcacaattgcctatgaacagcgtaccatcatcgataaattatcgttttatattcctgaaggtaaaattacgaccattattggcgccaatggctgtgggaagtctagtttattaaaagcactgacaagattattaccaccaaaacagggagttgtatatttaaatgggcaaaacattgccacattagaaactaaagaggttgctaaaaaactagctcttttacctcaagttcaagaagcaactaacggcataactgtttacgaattggtttcttacggacgttttccccatcaatcttactttggaaatcttagtccagctgacaaaaaagccattcattgggctatgcaagccaccaatgtcatggcctatgctgatcaacctgttgatgctctttctggggggcaacgtcaaagggtttggcttgcaatggcattagcccaaggcactgatactatttttttagatgagccaactacttatttagatttaaatcatcaactagaaatcctagagctcgttaaatccctaaataaggatgccggcaagactattgttatggttcttcacgacctcaatctttcagcccgctattcggatcatctgattgctatgaaacatggcaagatccattatactggtactatagcagatgttatgacttcacctatcattcaagacatcttccaaatcaaaccggtactggttgatgatcctatccacaactgtcctatagtgctgacttatcagcttcaa

SEQ ID NO: 1930 - protein, 260 aa, Streptococcus pyogenes
MTTISAEDLTIAYEQRTIIDKLSFYIPEGKITTIIGANGCGKSSLLKALTRLLPPKQGVVYLNGQNIATLETKEVAKKLALLPQVQEATNGITVYELVSYGRFPHQSYFGNLSPADKKAIHWAMQATNVMAYADQPVDALSGGQRQRVWLAMALAQGTDTIFLDEPTTYLDLNHQLEILELVKSLNKDAGKTIVMVLHDLNLSARYSDHLIAMKHGKIHYTGTIADVMTSPIIQDIFQIKPVLVDDPIHNCPIVLTYQLQ

SEQ ID NO: 1931 - DNA, 972 bp, Streptococcus agalactiae
atgattaaggatttagagataccaaaattacttattttactgatactactaattgctgctattattttgtttttaatttatggtattccaactgacgcaaatgaatttttgattatctatatcctaaaaacacgttatcaaaaactgattgcattaattttggttggtatctgcattggtagttctagtcttatttttcaaactctaaccaataaccgacttttaactccgtccattattggtttagatagcttatatatccttatccaaacaggattaatgtatttaatcggagctcagcgtgtcataaaattttcatcttttagtagcttcctcctttcattattattaatggttggatttgcttacttattatttacgatactttttcgaaataaaaaacagtctttgtattttgttctattagctggactcatatttaatacattattttcttctatctcatcctttattcaagccattatggaccccaacgattttatgattttacaaaatcagctctttgctagtttcaatgctattaacaccaagatcctttggatttctttcattatcattgtcgttagctttgtcattaattggccttttataaaggaattggatgtcttactattgggtaaagaaaatgcgatatcactcggcatctcatatcaaaagcttactactagattttttttatggttagcattgatggtagctatagcaacagcattagttgggccgattacttttttaggcttacttgtagcacatattacctatcacagttttcatacctttagacatcaaatattagttcctatagccattgttatctgtatctttacacttgtcttagggcagcatctcgttcaaaatctattacacctcactgttcaactaagtgttctcctcaaccttatcgggggaagttattttatattcaccttaatcaaaggaaggaaaaactta

SEQ ID NO: 1932 - protein, 324 aa, Streptococcus agalactiae
MIKDLEIPKLLILLILLIAAIILFLIYGIPTDANEFLIIYILKTRYQKLIALILVGICIGSSSLIFQTLTNNRLLTPSIIGLDSLYILIQTGLMYLIGAQRVIKFSSFSSFLLSLLLMVGFAYLLFTILFRNKKQSLYFVLLAGLIFNTLFSSISSFIQAIMDPNDFMILQNQLFASFNAINTKILWISFIIIVVSFVINWPFIKELDVLLLGKENAISLGISYQKLTTRFFLWLALMVAIATALVGPITFLGLLVAHITYHSFHTFRHQILVPIAIVICIFTLVLGQHLVQNLLHLTVQLSVLLNLIGGSYFIFTLIKGRKNL

SEQ ID NO: 1933 - DNA, 1047 bp, Streptococcus pyogenes
ttgaccacgtgggagatcatccgtaacatgacagcatcagatttacaaagggatcaatccctactggctaaaaaacgtttcagaagtggtctttatctagttcttttaattctcagcctcctatttttggcggttattgccttatcccttggtggtttggcggtttcttatggggcaattgtcaagggactgtttgtggcttatgacccccaagtggctttgatttatgatttgcgttttccaagaattgtcattgctttattagcaggagcagggatagctgtttcgggagttctttttcaagcagtgttgaaaaatcctatttcagaccctgctattatagggatttgtagtggtgctagttttatggttttagtctctagtttacttctgccgcagttgctgctgtatggtccaatcgtatcctttttaggaggcggagtgtctttcctgctgatttatggtttagcatggaagaaagggcttaatcctattcggcttattctaacagggattgctattaatgctttatttatggggttatcaactgctttaaccagctttttcacctcagctagtcccatggtcaatgctcttttagcaggtcatattagtcaaaaaacatgggctgatgtaggggttttattcccttatacattcattggcttgttactagctttgttattgtcaaaaacttgtaaccttcttcttttagatgatcaggtgattcgtcatttaggaatcgatgctacagcgttacggttgggaatttccttggttgctgttttattggcttcggtagccacttcgatcgttggagtggtttctttcctaggcttgattgtccctcatatgagccgcttgctggttggaagtaagcaccaaatcttaattcctttttcagctttgcttggagcctttgtctttttgctagccgatactttaggaagaagtcttgcttacccattggaaattagccctgcgattataatgagtattgtaggcgggccttactttatttacctgctaaggaggtctgatattata

SEQ ID NO: 1934 - protein, 349 aa, Streptococcus pyogenes
LTTWEIIRNMTASDLQRDQSLLAKKRFRSGLYLVLLILSLLFLAVIALSLGGLAVSYGAIVKGLFVAYDPQVALIYDLRFPRIVIALLAGAGIAVSGVLFQAVLKNPISDPAIIGICSGASFMVLVSSLLLPQLLLYGPIVSFLGGGVSFLLIYGLAWKKGLNPIRLILTGIAINALFMGLSTALTSFFTSASPMVNALLAGHISQKTWADVGVLFPYTFIGLLLALLLSKTCNLLLLDDQVIRHLGIDATALRLGISLVAVLLASVATSIVGVVSFLGLIVPHMSRLLVGSKHQILIPFSALLGAFVFLLADTLGRSLAYPLEISPAIIMSIVGGPYFIYLLRRSDII

SEQ ID NO: 1935 - DNA, 99 bp, Streptococcus agalactiae
atgctaattagattaggtacgattaaacctaagaaaggtaaagctcctacgataataatgactagggatgtcataattgaaaccaaaactaaaccaaag

SEQ ID NO: 1936 - protein, 33 aa, Streptococcus agalactiae
MLIRLGTIKPKKGKAPTIIMTRDVIIETKTKPK

SEQ ID NO: 1937 - DNA, 1005 bp, Streptococcus agalactiae
ttgtgctcatttttgaacactttatctttcattttaaggagttttatgaaaaagctattaaccactcctgtaatgggttgtactttggttatactttctctaacgtccctatttgttggtgtgaaatctatcccactggagcaaataacacaccttgatcaatcacaggtagatatttttttaacgagtcgcttaccaagaaccattagtatcctaatatctggtgcaagtttgtcagtctgtggcctgctgatgcaacaactaacccaaaacaagttcgtttcaccgacaacttcagggactatggattgggcgaaattaggagtagttgttacgctgattttctttaaaaatacctctatttttattcaactatgtatagcttcaggttttgccattttaggatcgcttctttttgtaaccattttaaaaatgattacttttaaggataatatttttatacctcttatcggactgatgcttggacaaattgtagcagcagcaacagtatttttaggaacacattttcaagtactacaatctgtcaacagttggcttcaaggtaatttttccatcatgactagccatcgctacgaaattctttacttagcattgccatgtttgtttttagtatatttttttgctcatcagtttaccattgttgggcttggagaaagcttcgctaagaatttaggggttgcttatgaaaagatgatttactttggtttagttttggtttcaattatgacatccctagtcattattatcgtaggagctttacctttcttaggtttaatcgtacctaatctaattagcataactaaaggagatcatatgtcctcaactatcttagagacatcgcttttaggggcttgtatcgtcatgatatgtgatctttttggtcgcttagttatttttccttatgaagtctcaataggagttacgctaggagtattaggtagtgcctttttcctgatttcaattataagaaatgagggaaaatca

SEQ ID NO: 1938 - protein, 335 aa, Streptococcus agalactiae
MCSFLNTLSFILRSFMKKLLTTPVMGCTLVILSLTSLFVGVKSIPLEQITHLDQSQVDIFLTSRLPRTISILISGASLSVCGLLMQQLTQNKFVSPTTSGTMDWAKLGVVVTLIFFKNTSIFIQLCIASGFAILGSLLFVTILKMITFKDNIFIPLIGLMLGQIVAAATVFLGTHFQVLQSVNSWLQGNFSIMTSHRYEILYLALPCLFLVYFFAHQFTIVGLGESFAKNLGVAYEKMIYFGLVLVSIMTSLVIIIVGALPFLGLIVPNLISITKGDHMSSTILETSLLGACIVMICDLFGRLVIFPYEVSIGVTLGVLGSAFFLISIIRNEGKS

SEQ ID NO: 1939 - DNA, 1035 bp, Streptococcus pyogenes
atgctttttatgggtaataagaagaggaggccgctattgaaatctcaaagacaccttttaaggttatatactagcctgatcctgctacttgtaagtcttatgggattagctttgtcccttggagaatctcatctatcttttttggaccttgtccatgtgtttttgggaaaatctagccatgccatatctttcatcgttattaacattcgtctgccaagaattctagctgcttgtctaggaggcggttctcttgctttatcagggctattattacaacgtttaacacgaaatcccttagctgactctggtgtattaggtattactataggagcaggtatctctttggctattgtggtctccttttctttctttgagcaagctcatatcagccattacttgcctttatttgccatgcttggtgctattgtaacaacctttagcgtttattggctatctttgacaaaacaaggacaaattgatcctacacggttaattcttactggtgtagctgttactaccatgctttcaagtctaatggttgctcttgttggtcatattaatcgctacaaagtcgatttggtcatcaattggcttagcggccaattaataggagacgactggcctactctgagtgtcatcgctcctttgttattgtgtttttggctattgacttatagtcaagcccatttccttaatattatgggattagctgataatactgctattgggctaggactccctttaaaccgtaagcgtcgtttgatacttgtcttagcagctggcttaggtgctttgagtgttcttttggttggtaatattagttttatcggcttaatagctggacactttagtacatacttggtagggagtaatcataaaataacaatacccattagtattttaatcggaatgatcctacttcttgttgcagatacagtaggacgagtctatctggttggcagtaatatccagacagggattttagtgtcgcttatcggagccccttattttctttacttaatggcaaaaacaaaa

SEQ ID NO: 1940 - protein, 345 aa, Streptococcus pyogenes
MLFMGNKKRRPLLKSQRHLLRLYTSLILLLVSLMGLALSLGESHLSFLDLVHVFLGKSSHAISFIVINIRLPRILAACLGGGSLALSGLLLQRLTRNPLADSGVLGITIGAGISLAIVVSFSFFEQAHISHYLPLFAMLGAIVTTFSVYWLSLTKQGQIDPTRLILTGVAVTTMLSSLMVALVGHINRYKVDLVINWLSGQLIGDDWPTLSVIAPLLLCFWLLTYSQAHFLNIMGLADNTAIGLGLPLNRKRRLILVLAAGLGALSVLLVGNISFIGLIAGHFSTYLVGSNHKITIPISILIGMILLLVADTVGRVYLVGSNIQTGILVSLIGAPYFLYLMAKTK

SEQ ID NO: 1941 - DNA, 546 bp, Streptococcus agalactiae
atgaccgaaaaagaaaaaatgttagcaggacaatattatcgtccatcagcacctgaactacgcaaggatagagaagttgcactaaaaaatatgcaagcctttaacaatgaagataatagtagcaaacgtaacgtcattttacaaaaatggtttggtgctactgggaagagtatccatatggaacaacgttttgtctgcgattatggttgtaatatttatgttggtgaaaacttctacgccaattttaaccaaactttcttagatgtttgtgaaattcgtattggcgataactgtatgtttggcccaaactgtcaactcctcaccccactccatcctctagatccaatagaaagaaattcaggattagaatacggtgccccaatccaaatcgggaataatgtctggctaggtggaggagtgactattttaccaggtgttgtattaggagataatgtcgtcgttggcgctggaagtgtcgttacgaaatcatttgaaaataacgttgttatagcaggaaaccctgctaagataatcaaaaaattagct

SEQ ID NO: 1942 - protein, 182 aa, Streptococcus agalactiae
MTEKEKMLAGQYYRPSAPELRKDREVALKNMQAFNNEDNSSKRNVILQKWFGATGKSIHMEQRFVCDYGCNIYVGENFYANFNQTFLDVCEIRIGDNCMFGPNCQLLTPLHPLDPIERNSGLEYGAPIQIGNNVWLGGGVTILPGVVLGDNVVVGAGSVVTKSFENNVVIAGNPAKIIKKLA

SEQ ID NO: 1943 - DNA, 564 bp, Streptococcus pyogenes
atgaccacagaatttgacaaaatgactagaggcgaatggtatgatgctaattttgattcggaactgattcaaaaacgcatgatggcacaagacctctgtttcgatttaaaccaattaaagcctagtcgagaagaagaacgctctgccgttttaaaccaactttttggacaatcttttgagggcttggtcctgctcagccctttcatctgtgactatggtaagaacattacttttgggaagaattgctttattaacagcaattgttatttcatggatggggcgaagattgccttgggcgataatgtctttgtaggtccttcgacaggtttttacacggcaaatcaccctctagattataaacgccgcaatgaggggcttgaaaaagctttaccaattaccataggagataatgtctggtttggtgccaatgtcaatgttatgcccggcgttactattggcagtggttgtgtgattgcgtcaggatcagttgttacccatgatattccagtcaattcccttgcggcaggtgttccttgccaagttgtacggaaaattgagcaggag

SEQ ID NO: 1944 - protein, 188 aa, Streptococcus pyogenes
MTTEFDKMTRGEWYDANFDSELIQKRMMAQDLCFDLNQLKPSREEERSAVLNQLFGQSFEGLVLLSPFICDYGKNITFGKNCFINSNCYFMDGAKIALGDNVFVGPSTGFYTANHPLDYKRRNEGLEKALPITIGDNVWFGANVNVMPGVTIGSGCVIASGSVVTHDIPVNSLAAGVPCQVVRKIEQE

SEQ ID NO: 1945 - DNA, 762 bp, Streptococcus agalactiae
atgatggcaacaattaaagaaatcaaagcaattttagagactattgttgatttaaaagacaaacgttggcaagaatatcaaacagattcacgcgcaggtgttcaaaaagcaatccttcaacgaaaaaaaaatattcagtcagatttagacgaagaagcgcgcttagaacaaatgttggtctacgaaaaaaaactttacattgaacatataaaccttattgcaggaatcgatgaagtaggtagaggtcctttagcgggaccagtagtagctgctgctgttattcttccaccaaactgtaaaataaaacatctcaatgactccaaaaaaattccaaagaaaaagcatcaagaaatctatcaaaatattttagatcaagcgttagcagttggtattggtattcaagacagccaatgtattgatgatatcaacatttatgaagctacaaaacatgctatgattgatgcagtttctcatttatctgtggctcctgaacatcttttaattgatgctatggttttagatctatcaattccacaaactaaaattatcaaaggtgatgctaattcactctctattgcagcagcttcaatcgtagctaaagtgaccagagataaaataatgtctgattatgatagcacatatcctggatatgcattttctaaaaatgctggctatggtactaaagagcatttagaaggtttgcaaaaatacggtattactccgatacatcgtaaaagttttgaacctataaaatcaatgttg

SEQ ID NO: 1946 - protein, 254 aa, Streptococcus agalactiae
MMATIKEIKAILETIVDLKDKRWQEYQTDSRAGVQKAILQRKKNIQSDLDEEARLEQMLVYEKKLYIEHINLIAGIDEVGRGPLAGPVVAAAVILPPNCKIKHLNDSKKIPKKKHQEIYQNILDQALAVGIGIQDSQCIDDINIYEATKHAMIDAVSHLSVAPEHLLIDAMVLDLSIPQTKIIKGDANSLSIAAASIVAKVTRDKIMSDYDSTYPGYAFSKNAGYGTKEHLEGLQKYGITPIHRKSFEPIKSML

SEQ ID NO: 1947 - DNA, 789 bp, Streptococcus pyogenes
atgccgactagtattaaagctattaaagaaagcttagaggccgttactagcctcttggaccccctctttcaagaattggcaaccgacactaggtcaggcgtccaaaaagctctaaaaagccgacaaaaggttattcaggccgagttagcagaagaagaacgattagaagccatgctttcttatgaaaaagctctttataaaaaaggttataaagccattgcaggtattgatgaggtgggacgtggtcccttagcaggtcccgttgtggcagcttgtgtgattttacctaagtattgtaaaattaaaggccttaatgattctaaaaaaatccctaaagctaagcatgagaccatttatcaggcagtgaaagaaaaggctttggctatcggtatcggtattattgacaatcagcttattgatgaggtcaatatttatgaagcaaccaaactggccatgctagaagccattaaacagttggagggccaactcacacaaccagattatctcttgattgatgccatgacattggatattgctatttcgcagcagtctattcttaaaggcgatgccaattccttgtctattgcagcagcatcaattgtagctaaggtcaccagagatcagatgatggctaactatgatcgcatttttcctggttatgactttgctaaaaatgcaggctatggcaccaaagaacatttacagggattaaaagcttacggcataacgcctatccatcgtaaaagttttgaacctgttaaatccatgtgctgcgattcaactaatcct

SEQ ID NO: 1948 - protein, 263 aa, Streptococcus pyogenes
MPTSIKAIKESLEAVTSLLDPLFQELATDTRSGVQKALKSRQKVIQAELAEEERLEAMLSYEKALYKKGYKAIAGIDEVGRGPLAGPVVAACVILPKYCKIKGLNDSKKIPKAKHETIYQAVKEKALAIGIGIIDNQLIDEVNIYEATKLAMLEAIKQLEGQLTQPDYLLIDAMTLDIAISQQSILKGDANSLSIAAASIVAKVTRDQMMANYDRIFPGYDFAKNAGYGTKEHLQGLKAYGITPIHRKSFEPVKSMCCDSTNP

SEQ ID NO: 1949 - DNA, 114 bp, Streptococcus agalactiae
ttgattgcccctgttaatgctagctttaatccaactaattcatcttcaaatttgggccacaagataccaggagtgtccaaaatttccagttccttattagatttgagccattgc

SEQ ID NO: 1950 - protein, 38 aa, Streptococcus agalactiae
MIAPVNASFNPTNSSSNLGHKIPGVSKISSSLLDLSHC

SEQ ID NO: 1951 - DNA, 849 bp, Streptococcus agalactiae
atggctactattcaatggttcccaggacacatgtccaaagctcgccgtcaagttcaagaaaatattaagcatgttgattttgttacaattttagtggatgcaaggttacctctttctagtcaaaatccaatgctaaccaaaatcgtcggagacaaacccaaactaatgatcctcaataaagctgatctagcagatcctattcgaactaaagaatggagagatttttatgaatctcaaggtttaaagacattagctattaattctaaagaacaatcaacagttaaaaaagtaaccgacatcgctaaaatattaatgtccgataaaattgctaatctacggggacgtggtattcaaaaagagacacttcgtacgatgattattggaattccgaatgcaggtaaatcgactctaatgaatcgcctagcaggtaaaaaaattgcagtggttggtaataaaccaggtgtcacaaaaggtcagcaatggctcaaatctaataaggaactggaaattttggacactcctggtatcttgtggcccaaatttgaagatgaattagttggattaaagctagcattaacaggggcaatcaaagatcaattattgcctatggatgaggtaacaatatttggattgaattactttaaaacctattatcctgatcgtctcaaagagcgttttaaaagcattaatttagaggatgaagctcctgaaatcatcatggccttaacacaaaaattaggttatcgtgacgattacgatcgcttttataatttatttgtcaaagaagttcgcgatggtaaattaggacgctatacgttagatatcgtcggagaacatgatggcaacaat

SEQ ID NO: 1952 - protein, 283 aa, Streptococcus agalactiae
MATIQWFPGHMSKARRQVQENIKHVDFVTILVDARLPLSSQNPMLTKIVGDKPKLMILNKADLADPIRTKEWRDFYESQGLKTLAINSKEQSTVKKVTDIAKILMSDKIANLRGRGIQKETLRTMIIGIPNAGKSTLMNRLAGKKIAVVGNKPGVTKGQQWLKSNKELEILDTPGILWPKFEDELVGLKLALTGAIKDQLLPMDEVTIFGLNYFKTYYPDRLKERFKSINLEDEAPEIIMALTQKLGYRDDYDRFYNLFVKEVRDGKLGRYTLDIVGEHDGNN

SEQ ID NO: 1953 - DNA, 846 bp, Streptococcus pyogenes
atggcaatgattcaatggtttcctgggcacatgtccaaagccagaagacaggttcaggaaaatgtaaagcatgttgactttgtaactattttagtggatgcacgcttaccactttctagtcaaaatcccatgcttacaaaaattgttggtgataaacctaaattaatgattttaaataaagctgacttggccgatgccactcgtacgaaagagtggaaggcttattatgaaagtcaaggtattaaaacattagccatcaattccaaagaacaatcaacggttaaaaaagtaacagaagcagccaaggaactcatggctgataaaattcaacgcttgcgagagcgcggcattcaaaaagaaaccttgcgaaccatgattattggcattccaaatgctggtaaatctaccttgatgaatcgcttggctggtaagaaaattgctgtagttggcaataaacctggtgtgactaaaggacaacaatggttgaagtccaataaggaattggaaattctagacactcctggtattttatggccaaaatttgaggacgaattggtgggcttaaaattagctttaacaggtgctatcaaggaccaattactaccaatggatgaagtgactatctttggcttgaattactttagggaatactaccctaatcgtttaaccaaacgttttaagaatattcctcttgaggaagaagctcctgaaatcattatgaccttgacacgccaacttggatttaaagacgattatgaccgtttttacactttattcgttaaggaagttcgtgatggtaaattaggtcaatacaccttagatcaggtgggagatatggatgccgac

SEQ ID NO: 1954 - protein, 282 aa, Streptococcus pyogenes
MAMIQWFPGHMSKARRQVQENVKHVDFVTILVDARLPLSSQNPMLTKIVGDKPKLMILNKADLADATRTKEWKAYYESQGIKTLAINSKEQSTVKKVTEAAKELMADKIQRLRERGIQKETLRTMIIGIPNAGKSTLMNRLAGKKIAVVGNKPGVTKGQQWLKSNKELEILDTPGILWPKFEDELVGLKLALTGAIKDQLLPMDEVTIFGLNYFREYYPNRLTKRFKNIPLEEEAPEIIMTLTRQLGFKDDYDRFYTLFVKEVRDGKLGQYTLDQVGDMDAD

SEQ ID NO: 1955 - DNA, 570 bp, Streptococcus agalactiae
atgagaaaacgttcaattttgccaatattagctgtcttatttgttttcatgagtatctttagcgtatattctatttttcgtggtgataaagccaaagaaaaagcaagtgtcataaaacaagcatctcaaacaagtcaaacttcaaaaaaagargtcttacaaaagaagacttatccaaatctaaataaatattcaaatctagaaattcatgtttcatctacgaggcaaacaatgacaataacctcgaatgacaaggtcatctttaaaacgattgtttcaacaggagcaaaagagagccctaccccaaaaggaacttttgtcatagaaccggaacgaggagattttttctataacgcctcatcaaaagaaggagcctattattgggtctcctttaaagaacatggtatttatctctttcatagcgttccgactgatcaacaaggaaatgagattccagaagaagcaaagcaattaggaaaagccgcctcacatggctgtgtgcgtatgtcaagggcggatgcaaaatggttctatgaaaatattcctcaaggaacgactgttaccatcaaa

SEQ ID NO: 1956 - protein, 190 aa, Streptococcus agalactiae
MRKRSILPILAVLFVFMSIFSVYSIFRGDKAKEKASVIKQASQTSQTSKKEVLQKKTYPNLNKYSNLEIHVSSTRQTMTITSNDKVIFKTIVSTGAKESPTPKGTFVIEPERGDFFYNASSKEGAYYWVSFKEHGIYLFHSVPTDQQGNEIPEEAKQLGKAASHGCVRMSRADAKWFYENIPQGTTVTIK

SEQ ID NO: 1957 - DNA, 1482 bp, Streptococcus agalactiae
atggtaacatttttaggaggggtagcccttttaattgttggttatttcacgtacggtagatacattgaaaagaattttcaaattgatgaaaatcgccaaacacctgcagaagcattaagggatggatatgattttgttcctatgccaaaatggaagaatgggatgattgagttattgaacatcgcaggaaccggacctatctttggccctattttaggagcactctatggtccagttgcttatatctggatagtcttaggatgtatttttgcaggggctgttcatgattatatgattggaatgatttctcttagaaataatggtgcatatcttcctgaattagctagtcgctatcttggaaagtcaatgaagcatgtgatcaacattttttcaatgctattacttattttagttgcaaccgtatttgtggtaactccagctaatcttatcctaagtattttaccagctgggacactatctttaccttggataatcggtcttattttcgtttattaccttatttctacagtcttacctattgataaagcacttggtaaagtttatcctgtattctgcgtcatcttaatggttagtacggcagcagttggcttccgtttattaactggtggctttgatatgccaaacttaacttttgaaacctttaaaaatatgcatccagctgggcttgggatattccctgctttattctttaccatttcatgtggagccatctctggtttccatgctacccaagcacctatggtctcaagaacaactgttaatgagagagaagggcgtttcactttctacggcatgatgattgcagaaggagtaattgcgatgatttgggcaggtgcttcaatgagcttgttcaaaggtcaaaatctctatgaaatgattgctgctgggacaccttctgcagttgtcaatcaagtaatgttaatgttactcggtagtgtaattggaactatcgctatcattggtgttattgttctccctgtttcatctggtttatcagctttccgtagcttacgtactatcgttgctgattatatccatgtcaaacaagatactcttccaaaaatctttgctgtaactatcccattatatgttatttcatttgtccttacacacgttgattttaatctcctatggcgttactttaactgggcaaatcaagtaactgctgttattggtttattagttgctacaagatatctcatcctaaaaagacgaaattattgggtaacatttgtaccagctatgttcatgttgtatgcagtagttgtttatattttatctcaaccaattggatttaatatgggcttaggcatcttaacttattcacttgctttagtgttaacaggtattcttgttggacttttctggaaatctggtcaaaaacaattaaaaactgttcatcctgaagcattcctgtttaacgatcatagaccaattaattattacagtagtttagattct

SEQ ID NO: 1958 - protein, 494 aa, Streptococcus agalactiae
MVTFLGGVALLIVGYFTYGRYIEKNFQIDENRQTPAEALRDGYDFVPMPKWKNGMIELLNIAGTGPIFGPILGALYGPVAYIWIVLGCIFAGAVHDYMIGMISLRNNGAYLPELASRYLGKSMKHVINIFSMLLLILVATVFVVTPANLILSILPAGTLSLPWIIGLIFVYYLISTVLPIDKALGKVYPVFCVILMVSTAAVGFRLLTGGFDMPNLTFETFKNMHPAGLGIFPALFFTISCGAISGFHATQAPMVSRTTVNEREGRFTFYGMMIAEGVIAMIWAGASMSLFKGQNLYEMIAAGTPSAVVNQVMLMLLGSVIGTIAIIGVIVLPVSSGLSAFRSLRTIVADYIHVKQDTLPKIFAVTIPLYVISFVLTHVDFNLLWRYFNWANQVTAVIGLLVATRYLILKRRNYWVTFVPAMFMLYAVVVYILSQPIGFNMGLGILTYSLALVLTGILVGLFWKSGQKQLKTVHPEAFLFNDHRPINYYSSLDS

SEQ ID NO: 1959 - DNA, 732 bp, Streptococcus agalactiae
atgaaagttttagtagttgatgatgaaccagttgcacgtaacgaattaatttaccttcttaataagtatgattctaacctcgttatagcagaggcgcatgatatggctactgcattagctattttacttagagaaacttttgatgtagcactgttagatatccatctcagagatgattctgggttgcaattagcagagtatatcaataaaatgcccaaaccaccattattgatatttgcgactgcttatgatcaatatgctattcaggcttttgagcatgatgcgcgtgattatttgttaaaaccctatgattttgataggctaaagcaagctatggatagagtaaaaggagcgctaagtacatctacaattatagagagcgtaacttccggtcctctcttcaagcaacagtatccattgacagtagaagatcgaatctatctggtgtcggcggatgatatccttttgattgaagctatgcaaggaaaactgattatacaaacacctgataaaaattatgaaattgatggctctctacaacaatggcaagataaactaccatcatctcaatttgtacgggtacatcgctcttacattgtgaacattaatgctattaaaacgattgaaccttggtttaaccaaacacttcagttacacctttgtaataaaataacagttcctgttagcagagcaaatgtaaaacccctaaaacaaatgttaggcatatctacc

SEQ ID NO: 1960 - protein, 244 aa, Streptococcus agalactiae
MKVLVVDDEPVARNELIYLLNKYDSNLVIAEAHDMATALAILLRETFDVALLDIHLRDDSGLQLAEYINKMPKPPLLIFATAYDQYAIQAFEHDARDYLLKPYDFDRLKQAMDRVKGALSTSTIIESVTSGPLFKQQYPLTVEDRIYLVSADDILLIEAMQGKLIIQTPDKNYEIDGSLQQWQDKLPSSQFVRVHRSYIVNINAIKTIEPWFNQTLQLHLCNKITVPVSRANVKPLKQMLGIST

SEQ ID NO: 1961 - DNA, 1737 bp, Streptococcus agalactiae
atgacactctttttaattatgatggagcgagcggggttaatcatattattagcctatgcctttgtgcatatcccctttataaaacaaactttgaagcaacccgaattaaaaaaacaccagtatattctgcttatcttatttagcttatttgctattatttctaattttacaggggtagaaattcagtcagatttatctatcattccacaaactcttaatcatatagcagatcaatcatcggttgccaatacacgtgttttaaccattggtgtatcaggtctaatcggtggccccatagtcggtattatagttggtctcttatctgtattcgttaggtatttgcaaggaggattagcccctcatatttatgtcatttcttccttactaattggtttatgctctggattatcaggcaattatcttcgtaaaaattataataaaattcgtgttttagatgcaatggttgttggtttcggtatggaaattctacaaatgatctgtatcctcatttttagtgttgactttaatcaggcgcttcgcttagtatcttttatcagcatgccaatgattttaagtaatactttaggtttaggtatatttatatccattatttcatctactcaaaaattagaagaacatgctaaagcatttcaaacccatcaagtacttgaattagcaaatttaacccttccttaccttagaaagggactgacaacagaatcttgtcaaccagtagctgaaattattcataaacatatggatgtgagtgctgttagcctgactagtcaatcagccattttagcctatgtaggagatggagctgaccatcatcttcctaatactcaaatattaacaaagcttgctaaaagagcaatagatactggtaaagttagtgtcgcaactgataaaagtgaaatcgaatgcgaccataagaattgcccacttagttcagcaattgttattccattacacatccacgatgttatagtgggtactttgaaattatatttttcagacgcacaacatatgacttacgttgaccgtcaattagctgaaggattaggcaatatcttttccactcagttagctttgggacaagctgaggaagcaacaaggttactacaggatgcggaaatgaagtctctccaagcgcaggttaatccgcattttctttttaatgcacttaatactatttatggtttaattcgcatggatagcgaaaaagcaagaaagctcgtccaagattttagcaaggttattcgtgctaatcttcaacgggcaaagcaaaatttaattcctcttcatgatgaattggaacaggttaacgcctatttagcccttgaagaagcaagatttcccaacatggtggcctttaatttagacaaccaaacaaattcagatgacaacttaatgattcctccctttacattgcaggtcttgattgaaaactcttataaacacgcttttaagcatgttaataaaaataaccagctaaaggttactattgcaagaaataatgataggcttcatatcattgtccaagacaatggtattgggattccaaaagaaaaattaataacgcttggaaaaaaaactcaaatttcaaaacaaggttctggtacagctattgagaatctcgttcgtcgcttgaatattatttatgatggacaagcaagtttaaaatttgaatcaaatgattcaggaacttgtgctattgttaatatccccattaaaaat

SEQ ID NO: 1962 - protein, 579 aa, Streptococcus agalactiae
MTLFLIMMERAGLIILLAYAFVHIPFIKQTLKQPELKKHQYILLILFSLFAIISNFTGVEIQSDLSIIPQTLNHIADQSSVANTRVLTIGVSGLIGGPIVGIIVGLLSVFVRYLQGGLAPHIYVISSLLIGLCSGLSGNYLRKNYNKIRVLDAMVVGFGMEILQMICILIFSVDFNQALRLVSFISMPMILSNTLGLGIFISIISSTQKLEEHAKAFQTHQVLELANLTLPYLRKGLTTESCQPVAEIIHKHMDVSAVSLTSQSAILAYVGDGADHHLPNTQILTKLAKRAIDTGKVSVATDKSEIECDHKNCPLSSAIVIPLHIHDVIVGTLKLYFSDAQHMTYVDRQLAEGLGNIFSTQLALGQAEEATRLLQDAEMKSLQAQVNPHFLFNALNTIYGLIRMDSEKARKLVQDFSKVIRANLQRAKQNLIPLHDELEQVNAYLALEEARFPNMVAFNLDNQTNSDDNLMIPPFTLQVLIENSYKHAFKHVNKNNQLKVTIARNNDRLHIIVQDNGIGIPKEKLITLGKKTQISKQGSGTAIENLVRRLNIIYDGQASLKFESNDSGTCAIVNIPIKN

SEQ ID NO: 1963 - DNA, 1725 bp, Streptococcus pyogenes
ttgatgagtgttaaaacattgggaaggtatgtgactaaccactttaagcagggttttttgattaatcgactgatgaaattatatagcctgctaattgtaagttttttcactttagcagctattggcttgagcagttattctattagtagtacttataaaagggtggatgctgaggcgcagatgcgattggaggagactctaggtagattgcagtcacaaaacgatattaccctacgggttttagaccagttggttggccgttcagaagattaccataatctctatcaatacatgacgttaaccccaaaccaatatttttcaaacgtttttgaagactgggaaaaaggaaaagacacggtcctattttctgaagaggtgaggcgtctttttgacttgtaccctgatgtgacttctatgaccctactgctagaggacagtagtgcttatctgtacgccgataaggtcattaagacgggtcgtttgctttatagcaagcctgaaaaagtaaccggaaatgttttagttcgctctattcgaaatccagaatcaggagatgtgacaggtcgtctttacctgacctttgacaaaccaccgactttggtagagacacagcaggatcactatttagctacttttgcttttgattactatggccgcaaactcttccatcaaggaggtcggagatttcctcatttagaggctgaggttaaaaaggctatcaaggcagatcgggcagctgatcttagtaatcttagcaaggcttatcggatgcagtacaatcgctcgggagacctcttggcttatgtggctgtcagaaaatcctatttattagcggaagctgtcaggacagtttttgtgtatggccttgtttctctacttttagcttggctgttattgcagttgctctttagggttttccgaaattatatccagcaggtttctgaaattacggatactgttgaaatggttgcagcaggcgatttgtctttaaccatcgacaacagccacatggaattggaactgtatcatatctcagaagccattaatcagatgttggccagcattaaagcttatattgacgaagtttatgtgttagaggtagagcaacgagatgcccaaatgagagctctgcagtctcaaatcaaccctcattttttatacaacacgttagagtatattcggatgtacgcccttagttgtcaacaagaagaattagcagatgtcatttatgcctttgcgagtctgcttcgcaacaatattagccaagataagatgaccaccttaaaagaagaactggctttttgtgaaaagtacatttacctttatcaaatgcggtatccagatagcttcgcttatcatgtaaaaattgatgagagtgttgctgacttagccattcctaaatttgtcattcaacctctcgttgaaaattattttgtgcatgggattgattatagtcgccatgacaatgcactaagcatcaaggctttagatgagacggatcatctcttgattcaggtgcttgataatggacgtggtattagtcaagagcgcttagcagatatggaaaaaaggcttcaagagcaccaaacaacaggcaatagctctattggtttgcaaaatgtttacctccgtctctttcatcattttcgagacagggtttcttggtccatggctaaggagccaaatggtggctttatcattcaaattaggattagaaaggatgct

SEQ ID NO: 1964 - protein, 575 aa, Streptococcus pyogenes
LMSVKTLGRYVTNHFKQGFLINRLMKLYSLLIVSFFTLAAIGLSSYSISSTYKRVDAEAQMRLEETLGRLQSQNDITLRVLDQLVGRSEDYHNLYQYMTLTPNQYFSNVFEDWEKGKDTVLFSEEVRRLFDLYPDVTSMTLLLEDSSAYLYADKVIKTGRLLYSKPEKVTGNVLVRSIRNPESGDVTGRLYLTFDKPPTLVETQQDHYLATFAFDYYGRKLFHQGGRRFPHLEAEVKKAIKADRAADLSNLSKAYRMQYNRSGDLLAYVAVRKSYLLAEAVRTVFVYGLVSLLLAWLLLQLLFRVFRNYIQQVSEITDTVEMVAAGDLSLTIDNSHMELELYHISEAINQMLASIKAYIDEVYVLEVEQRDAQMRALQSQINPHFLYNTLEYIRMYALSCQQEELADVIYAFASLLRNNISQDKMTTLKEELAFCEKYIYLYQMRYPDSFAYHVKIDESVADLAIPKFVIQPLVENYFVHGIDYSRHDNALSIKALDETDHLLIQVLDNGRGISQERLADMEKRLQEHQTTGNSSIGLQNVYLRLFHHFRDRVSWSMAKEPNGGFIIQIRIRKDA

SEQ ID NO: 1965 - DNA, 123 bp, Streptococcus agalactiae
gtgatgtttaaaggatttaaaaaattgattattattatgggagggataagcttaatgatgattttaacagcatgtgacttagtaaaaaaaatcaccaatgggttcaagaacattgaaaatact

SEQ ID NO: 1966 - protein, 41 aa, Streptococcus agalactiae
MMFKGFKKLIIIMGGISLMMILTACDLVKKITNGFKNIENT

SEQ ID NO: 1967 - DNA, 681 bp, Streptococcus agalactiae
ttgaaacagagcaaccatagatatcatggaccgttaattgagtttgaaatagaatattcatatattaaaatttttccatggattggactatttatatcttgcatagggttatatgcaagtaattttggtgatcctttaggttttataaaattcatattttctgtatgcatttttgttaatttggtctcaataattatttcgcttttttttaaaaaaatatctaattttttaaaaaaaatttcttatattttattatcattagtattcctaacacttattataggttttgattttataggcttggcaatgtttttaaataatagaaattttggacatgttcaatcaatttattatactgagatggcaaaaatgtatattatgataatgttaattatttttattgtattttctggaatatattatttctattatttaccaaaaaatcaggggaaaaaatggaaatttaatcagtggaaattacaaaaaggaaaaaaggaacaattaaaaattaattatggaattatttttggtttagtgatgctttctccagtctttcttgtaggtagtattgaaaatatttttggtttgattggaggtgtattatttacggcaacttttccagctctgattgtcgattccctttatgcagcatattatattcataagcatcccgaatatgag

SEQ ID NO: 1968 - protein, 227 aa, Streptococcus agalactiae
MKQSNHRYHGPLIEFEIEYSYIKIFPWIGLFISCIGLYASNFGDPLGFIKFIFSVCIFVNLVSIIISLFFKKISNFLKKISYILLSLVFLTLIIGFDFIGLAMFLNNRNFGHVQSIYYTEMAKMYIMIMLIIFIVFSGIYYFYYLPKNQGKKWKFNQWKLQKGKKEQLKINYGIIFGLVMLSPVFLVGSIENIFGLIGGVLFTATFPALIVDSLYAAYYIHKHPEYE

SEQ ID NO: 1969 - DNA, 321 bp, Streptococcus agalactiae
ttgaataatgcagcaataaaatcccttaaaaatgaagtccttgaattaaatcccaaaaatgcttttaaaggatggggaaaattaggaagaattgctaaagctggtaaagtattaggttggactgggaaaatagtcaatatagaaactaatgccaaaaaagacttttttgatgataagacttctacactagatcaaaaaatcaaaaactttgctatagattcaggtgtagatgcattgtccggtgcagcaataggaactttggtaggaggacctgtgggaaccgttgttggagcagtgcagggctggcatttgattttgctt

SEQ ID NO: 1970 - protein, 107 aa, Streptococcus agalactiae
MNNAAIKSLKNEVLELNPKNAFKGWGKLGRIAKAGKVLGWTGKIVNIETNAKKDFFDDKTSTLDQKIKNFAIDSGVDALSGAAIGTLVGGPVGTVVGAVQGWHLILL

SEQ ID NO: 1971 - DNA, 102 bp, Streptococcus agalactiae
atggaattcaatgcggaatcctcaacagtcttttgtggactaacagaagttcaggatgtcgtttcggcaggccttaactattctcagaaggttttggaaatt

SEQ ID NO: 1972 - protein, 34 aa, Streptococcus agalactiae
MEFNAESSTVFCGLTEVQDVVSAGLNYSQKVLEI

SEQ ID NO: 1973 - DNA, 531 bp, Streptococcus agalactiae
atgggaaatgataatgtaactataaaactagaacatcgggttaaaacatcagcagatttatcagattatgtatacaaatatgagagggcttatacagatgctttaaataatggtgatgacataaaagaagcaagtgaaagtactaaaaaagagttaaatcaactaattgatagaactgatttaacttatagtgacggtatgtatgacaaagagactggtattgcagctattgctgtaaaagataaaaatactggtgagacttatatagcttatgcgggtactaataaggatgctgatggggcaaccgactttatttcagatgcaaatatcggtgctaataactctgcttatttaaaacgattaggagacaaagctactagcttttatgatcgtgttcaaagtaatggcgataatattactgtcacaacaggtcattcttatggtgactttctcgcttctagagtggcaattgagctaattccattctttattaactttagaaaagttaatgattcatttcacttttgttat

SEQ ID NO: 1974 - protein, 177 aa, Streptococcus agalactiae
MGNDNVTIKLEHRVKTSADLSDYVYKYERAYTDALNNGDDIKEASESTKKELNQLIDRTDLTYSDGMYDKETGIAAIAVKDKNTGETYIAYAGTNKDADGATDFISDANIGANNSAYLKRLGDKATSFYDRVQSNGDNITVTTGHSYGDFLASRVAIELIPFFINFRKVNDSFHFCY

SEQ ID NO: 1975 - DNA, 144 bp, Streptococcus agalactiae
atgagagataaatttaaaatatctgatattaaggaagcagatattacttttacaaaaagtggaaaaaataattttgactatacactaaggataaaaactaaaaacaagagatactatttgggtgagacctatagttttagaaaa

SEQ ID NO: 1976 - protein, 48 aa, Streptococcus agalactiae
MRDKFKISDIKEADITFTKSGKNNFDYTLRIKTKNKRYYLGETYSFRK

SEQ ID NO: 1977 - DNA, 549 bp, Streptococcus agalactiae
atgaaaaaacaaaaactattactgcttattggaggcttattaataatgataatgatgacagcatgtaaggattcaaaaatcccagaaaaccgcacaaaggaagagtaccaagctgaacaaaattttaaaccgttttttgagtttttagcacaaaaagataaagatttgagcaaaatacaaaaatacttactattagtatcggattcaggtgatgcattagatttagaatatttctatagtattcaagatttaaaaaaaaataaggatttagggaagtttgaaacaagaaaaagtcaaatagaaaagccgggtggctataatgagttagaaaataaagaggtcccatttgaatattttaaaaataatatagtttatccaaaaggaaaaccgaatattacatttgatgactttattatcggagcaatggatactaaagaattaaaagaattaaaaaaattaaaagtaaaaagttatttattaaaacatccggaaactgagttgaaagatataacatatgaattgccgacacagtcgaagcttattaaaaaa

SEQ ID NO: 1978 - protein, 183 aa, Streptococcus agalactiae
MKKQKLLLLIGGLLIMIMMTACKDSKIPENRTKEEYQAEQNFKPFFEFLAQKDKDLSKIQKYLLLVSDSGDALDLEYFYSIQDLKKNKDLGKFETRKSQIEKPGGYNELENKEVPFEYFKNNIVYPKGKPNITFDDFIIGAMDTKELKELKKLKVKSYLLKHPETELKDITYELPTQSKLIKK

SEQ ID NO: 1979 - DNA, 447 bp, Streptococcus agalactiae
ttgacagaacaacaaattgaatatatcaataatcgaagtgaaatagcagggcatttagaagctattgtttcagaaatctatttaatagaagaatctggtaaaatagaatcatggtttgttactattcctgatatgaatagttttgtggcagaaacaaatatggatagagaacagattttattcttacttgactcggctcacaaatatcatatttatttcttatttggtggtttagcatcataccttatgactaatatctcagatgttccaaaagctattagaacacaggcacagtatgttctcttaggaatgagagttatggatcagtcagtattaccgaaatcatataattcaaaagaaccttatttgaaaccagatatgatttatattcatgatagaagacaagaaagaatgcttaaaatcactcaagaaatagaaatggagcat

SEQ ID NO: 1980 - protein, 149 aa, Streptococcus agalactiae
MTEQQIEYINNRSEIAGHLEAIVSEIYLIEESGKIESWFVTIPDMNSFVAETNMDREQILFLLDSAHKYHIYFLFGGLASYLMTNISDVPKAIRTQAQYVLLGMRVMDQSVLPKSYNSKEPYLKPDMIYIHDRRQERMLKITQEIEMEH

SEQ ID NO: 1981 - DNA, 258 bp, Streptococcus agalactiae
atgggtaatggtggcgattggaaaaataagccgggctatcaaaccacacacgaggcaaaaacaggctacgccatctcatttagccccggccaagctggtgctgatagaacttacggccacgtggccatcgtcgaagacgttaaggaagacggatctatcccgatctccgaatcaaatgtcctaggacttggcaccatctcctaccgcaccttcagtgcagcagaagcagcacaattgacttatgtagttggggagaag

SEQ ID NO: 1982 - protein, 86 aa, Streptococcus agalactiae
MGNGGDWKNKPGYQTTHEAKTGYAISFSPGQAGADRTYGHVAIVEDVKEDGSIPISESNVLGLGTISYRTFSAAEAAQLTYVVGEK

SEQ ID NO: 1983 - DNA, 1623 bp, Streptococcus pyogenes
atgaagaaaaggaaattgttagcagtaacactattaagtaccatactcttaaacagtgcagtgccattagttgttgctgatacctccttgcgtaatagcacatcatccactgatcagcctactacagcagatactgatacggatgacgagagtgaaacaccaaaaaaagacaaaaaaagcaaggaaacagcgtcgcagcacgacacccaaaaagaccataagccatcacacactcacccaacccccccttcaaatgatactaagcagaccgatcaggcatcatctgaagctactgacaaaccaaataaagacaaaaacgacaccaagcaaccagacagcagtgatcaatccaccccatctcccaaagaccagtcgtctcaaaaagagtcacaaaacaaagacggccgacctaccccatcacctgatcagcaaaaagatcagacacctgataaaacaccagaaaaatcagctgataaaacccctgaaaaaggaccagaaaaagcaactgataaaacaccagagccaaatcgtgacgctccaaaacccatccaacctcctttagcagctgctcctgtctttataccttggagagaaagtgacaaagacctgagcaagctaaaaccaagcagtcgctcatcagcggcttacgtgagacactggacaggtgactctgcctacactcacaacctgttgtcacgccgttatgggattactgctgaacagctagatggttttttgaacagtctaggtattcactatgataaagaacgcttaaacggaaagcgtttattagaatgggaaaaactaacaggactagacgttcgagctatcgtagctattgcaatggcagaaagctcactaggtactcagggagttgctaaagaaaaaggagccaatatgtttggttatggcgcctttgacttcaacccaaacaatgccaaaaaatacagcgatgaggttgctattcgtcacatggtagaagacaccatcattgccaacaaaaaccaaacctttgaaagacaagacctcaaagcaaaaaaatggtcactaggccagttggataccttgattgatggtggggtttactttacagatacaagtggcagtgggcaaagacgagcagatatcatgaccaaactagaccaatggatagatgatcatggaagcacacctgagattccagaacatctcaagataacttccgggacacaatttagcgaagtgcccgtaggttataaaagaagtcagccacaaaacgttttgacctacaagtcagagacctacagctttggccaatgcacttggtacgcctataatcgtgtcaaagagctaggttatcaagtcgacaggtacatgggtaacggtggcgactggcagcgcaagccaggttttgtgaccacccataaacctaaagtgggctatgtcgtctcatttgcaccaggccaagcaggagcagatgcaacctatggtcacgttgctgttgtagagcaaatcaaagaagatggttctatcttaatttcagagtcaaatgttatgggactaggcaccatttcctatcggacgttcacagctgagcaggctagtttgttgacctatgtcgtaggggacaaactcccaagacca

SEQ ID NO: 1984 - protein, 541 aa, Streptococcus pyogenes
MKKRKLLAVTLLSTILLNSAVPLVVADTSLRNSTSSTDQPTTADTDTDDESETPKKDKKSKETASQHDTQKDHKPSHTHPTPPSNDTKQTDQASSEATDKPNKDKNDTKQPDSSDQSTPSPKDQSSQKESQNKDGRPTPSPDQQKDQTPDKTPEKSADKTPEKGPEKATDKTPEPNRDAPKPIQPPLAAAPVFIPWRESDKDLSKLKPSSRSSAAYVRHWTGDSAYTHNLLSRRYGITAEQLDGFLNSLGIHYDKERLNGKRLLEWEKLTGLDVRAIVAIAMAESSLGTQGVAKEKGANMFGYGAFDFNPNNAKKYSDEVAIRHMVEDTIIANKNQTFERQDLKAKKWSLGQLDTLIDGGVYFTDTSGSGQRRADIMTKLDQWIDDHGSTPEIPEHLKITSGTQFSEVPVGYKRSQPQNVLTYKSETYSFGQCTWYAYNRVKELGYQVDRYMGNGGDWQRKPGFVTTHKPKVGYVVSFAPGQAGADATYGHVAVVEQIKEDGSILISESNVMGLGTISYRTFTAEQASLLTYVVGDKLPRP

SEQ ID NO: 1985 - DNA, 807 bp, Streptococcus agalactiae
gtggtgccaagccaacctcaagtgacagcaacacctcagaaatctgaagttgtgacaccagccattacgagtggcattgatttgccagatgttgccatacctacggcaatggctagcgcagcttatgtcaaacactggataggcaatgatgcttatacacacaatctattgtctcaccgttacggcattactgccgcacagcttgatggattcttacagtcgacaggtatcacatacgatagcagtcgcatcgacggtcaaaaaatcttagaccgagagaaatcatctggtctggatgcgcgtgcaatcattgccattgctatcgcagaaagttcgcttggtacacaaggcgttgccacagcaccaggtgctaatatgtttggttttggggcagttgacaacaatacaactaacgctcaaaactttagtgatgacaaggctgtcattaaaatgacgcaggaaaccatcatccaaaaccaaaacaccagctttgccattcaagaccaaaaagcacaattcttgtcaactggcaacttgaatgtagcggctcgaggtggggtttacttcacggatgctagcggttctggtaaacgtcgtgcggccattatggagagcattgacaagtggattgacgcgcatggcggaatttctgagatttcaaaggaactgctcaacacgtcgtccgtcgctatgatggcagtcccaacgagttactctgtttcaagagctaatcaagcgggcaactatgtggcaggcacttacccttggggccaaagaacttggctaccagtttggaccatttatggg

SEQ ID NO: 1986 - protein, 269 aa, Streptococcus agalactiae
MVPSQPQVTATPQKSEVVTPAITSGIDLPDVAIPTAMASAAYVKHWIGNDAYTHNLLSHRYGITAAQLDGFLQSTGITYDSSRIDGQKILDREKSSGLDARAIIAIAIAESSLGTQGVATAPGANMFGFGAVDNNTTNAQNFSDDKAVIKMTQETIIQNQNTSFAIQDQKAQFLSTGNLNVAARGGVYFTDASGSGKRRAAIMESIDKWIDAHGGISEISKELLNTSSVAMMAVPTSYSVSRANQAGNYVAGTYPWGQRTWLPVWTIYG

SEQ ID NO: 1987 - DNA, 1509 bp, Streptococcus pyogenes
atgaataaaaacaaactattaagagttgccatgctactaagtctcttagccccgacagcagaaagcatgacagtgctggctcaagatgtaatgcttgagacgcataaagcaactacaaatgaaaccagtgattcttcttcaaaagaggaaaataataaaaatgcagcacctacaacatcagataaaactgaccaaggtccccttgatgcttctgcagaaacaaactctaatagtcttgttaacgcggatgataaaaaaagaagcgattctagtcagtctgctataggctcttcggacaacaaggcagaagcagaaaaccaggtagatgataaatcaactgatcattcgaaatcaactgatcattcgaaaccaactgaccagcccaaaccatcaccatctaaagttgatacggcacctgcttcttcattgtcgaaacaactgccagaggcaagaactcctattcagtcgttgtccccttacgtatcagatttagatttgagtgagatagatatcccttctgtcaacacatacgcggcatatgtagagcattggagtggtaaaaatgcctatacccaccatcttttatctcgccgttatggtattaaagctgaccagattgatagttacttaaaatcaacaggcattgcctatgacagcacacgtattaatggtgagaagctattgcaatgggaaaagaaaagtgggctggatgttcgagctatcgtagctattgcgatgtctgagagttctttaggaactcaagggattgcaactttgcttggagctaatatgtttggctatgcagcttttgatctagatccgactcaagcaagtaagtttaatgatgatagtgctattgtcaaaatgacacaagacaccattattaaaaacaaaaatagcaattttgcacttcaagatttaaaagcggctaagttttcacgaggtcaattaaactttgcaagtgacgggggtgtttattttactgatactactggtagtggtaaacgtcgcgcacaaattatggaagacctggataagtggattgatgaccatggtggcacaccagccattccagccgaattgaaagtgcagtcatcagctagttttgcatctgtgccagcaggttataagctctctaagagttatgatgtcttgggttatcaagcttcgagttatgcttggggacaatgcacttggtatgtgtataatcgcgccaaagaattgggttaccaatttgatccttttatgggaaatggtggagattggaagtataaagtagggtatgccctttcaaagactccaaaagtaggttatgctatttcatttgcaccagggcaagcgggcgctgatggcacttatggccacgtatcaattgtagaagatgttagaaaagatgggtctattcttatttcagagtctaactgtatcggcttaggtaagatttcttatcgtacctttacagctcagcaggctgaacagctaacatatgttattggcaagagtaaaaac

SEQ ID NO: 1988 - protein, 503 aa, Streptococcus pyogenes
MNKNKLLRVAMLLSLLAPTAESMTVLAQDVMLETHKATTNETSDSSSKEENNKNAAPTTSDKTDQGPLDASAETNSNSLVNADDKKRSDSSQSAIGSSDNKAEAENQVDDKSTDHSKSTDHSKPTDQPKPSPSKVDTAPASSLSKQLPEARTPIQSLSPYVSDLDLSEIDIPSVNTYAAYVEHWSGKNAYTHHLLSRRYGIKADQIDSYLKSTGIAYDSTRINGEKLLQWEKKSGLDVRAIVAIAMSESSLGTQGIATLLGANMFGYAAFDLDPTQASKFNDDSAIVKMTQDTIIKNKNSNFALQDLKAAKFSRGQLNFASDGGVYFTDTTGSGKRRAQIMEDLDKWIDDHGGTPAIPAELKVQSSASFASVPAGYKLSKSYDVLGYQASSYAWGQCTWYVYNRAKELGYQFDPFMGNGGDWKYKVGYALSKTPKVGYAISFAPGQAGADGTYGHVSIVEDVRKDGSILISESNCIGLGKISYRTFTAQQAEQLTYVIGKSKN

SEQ ID NO: 1989 - DNA, 426 bp, Streptococcus agalactiae
ttgaaaaaagataaatatattgcattgtgtttgttgtgtgcaattgccacgtcaaacttatcggctgttacggtttttgctcaggatgcacaaactattttgacgcaagctacgactgtaactgatcaaacaattgaaaaagctggagaaaattcatcagctgaggcgacaagcgcttctgagtcagtttcatcagaagcgacgacagtggtacctgaggcaagtctgccttcaactgatctccatgcccaaccagcagatagcaaaacagctcctactgagactgtaattgagggacaaacagaaactaatccgacgactagtccagataaacagttccttcaacaagtgattccaaaggagaaacacaggctgggacgcaaacagatacaagcaaacccgaaactccagctcctagtcagtctg

SEQ ID NO: 1990 - protein, 142 aa, Streptococcus agalactiae
MKKDKYIALCLLCAIATSNLSAVTVFAQDAQTILTQATTVTDQTIEKAGENSSAEATSASESVSSEATTVVPEASLPSTDLHAQPADSKTAPTETVIEGQTETNPTTSPDKQFLQQVIPKEKHRLGRKQIQANPKLQLLVSL

SEQ ID NO: 1991 - DNA, 252 bp, Streptococcus agalactiae
atggataaaatacatactctaggaagtgtcattgaattaaaaaatgatagtcagaaagtcatgattacatcaagatttccgttatatgacaatgaaggtcaattgggatattttgattattctggatgtattttcccaattagtatagttggaaatgaaacttattttttcaatttggaagatatagataaagtcttgtttgaaggttactatgatgaaaatgaagaggagatgcaaaaaatatttttgaaa

SEQ ID NO: 1992 - protein, 84 aa, Streptococcus agalactiae
MDKIHTLGSVIELKNDSQKVMITSRFPLYDNEGQLGYFDYSGCIFPISIVGNETYFFNLEDIDKVLFEGYYDENEEEMQKIFLK

SEQ ID NO: 1993 - DNA, 588 bp, Streptococcus agalactiae
ttgatacatagagagaaatcatatgcagaaatatatcatgacggaaatcaaggttattattataattttgatacaaaaattttttacattaaaagttttgaaacgcctaattatcaaaaagaaaatttagaaaatattaaaaaatattctagtattattacgtttcttgttctcatactcattcctattaataattggtatagaacaatagctaatttaaagttgaatttaattcttgcaataatgtttatcgtaattgcactagtagtagttaacaaattaaacaatatagtttcgaaacaaaagagaaatatcgataatattagttacgagaaaatggaatttgacaaagaaaaaatagcaaatataattgtttctgctgaagaattgtcgaataaactgttatttttattagtaatttcattatttatatccctactcctaataatgttatattttaaatactcagtattgatattttttcctatagcacttatgttactaatattatcaagattgttattagaaaatattgatttttttgaaagaaaaaatgcaataaatgaaataaaaaagcaatataatttt

SEQ ID NO: 1994 - protein, 196 aa, Streptococcus agalactiae
MIHREKSYAEIYHDGNQGYYYNFDTKIFYIKSFETPNYQKENLENIKKYSSIITFLVLILIPINNWYRTIANLKLNLILAIMFIVIALVVVNKLNNIVSKQKRNIDNISYEKMEFDKEKIANIIVSAEELSNKLLFLLVISLFISLLLIMLYFKYSVLIFFPIALMLLILSRLLLENIDFFERKNAINEIKKQYNF

SEQ ID NO: 1995 - DNA, 303 bp, Streptococcus agalactiae
atgaagacaggagcacccgtaataattggtagtgctgcaaaagttgtaggaacggctgcgggtaccgcaacagctggactattaatttcaacaggtgtacttgcaccgcctgctcctgttgttggttctgctgtggactttggtgctacagcagtaataggtgtaggtggatcgatggtgttcgattatgtttatgataataaagatgaaataaatcatattataaaaagagcatcgaaggatacaattaacaatgttagtgatttttttgaattaatgtatgattcaacaggtagtataaat

SEQ ID NO: 1996 - protein, 101 aa, Streptococcus agalactiae
MKTGAPVIIGSAAKVVGTAAGTATAGLLISTGVLAPPAPVVGSAVDFGATAVIGVGGSMVFDYVYDNKDEINHIIKRASKDTINNVSDFFELMYDSTGSIN

SEQ ID NO: 1997 - DNA, 912 bp, Streptococcus agalactiae
atggtaaaagttagtgtaagttctgtaggaactcaagcatcaacagtagctatttctatgtttagtcgtgtatcggctttaaatgatgcaataacaaaactatcatcttttgcagaggctgcaactcttcaagggactgcttattcaaatgcaaaaagctatgctactggaacgttaactccgatgcttcaaggaatgattcttttctctgaaacattgagtgagaaatgtacagaattacaaaccttatatgtctcaatttgtggtgatgaggatttagactctgtcgttttagaatcaaaattagcaagtgatagggcatcattaaagattgctgaagcacttttagagcatcttaacgatgatccagaaccttccaaatctgccataagttctacaaaaagtaatattaaaaaattaaaaaaacgtataaaatctaatcaaaagaaattagacaaccttaatgaatttaacgcccattcagcaacagtatttgcggacatttctaatgcacagtcaactgttaaccaagcactagcggctgtttcaacaggattttctggatataatagtaaaaccggagcttttggaaaaccaacatccggacagatggaatggacaaagacagttaagaagaattggaaagagcgagaagacgccaaagctgaagaactgaaaagtaaaaaggctgaagaaagtaagaaagcttcaaaaattgaaaatactactaaaaaaagtaatgtttcagttgataaaaagaaattaataaaagcggctaatgaagcgtataaattaggagaaattaaaaaagatacctatgaatcaattatcagtggtttaagtaatgcatcggctgccttacttaaagaggtagctaaatcaaaattgactgacacagctcggctattgatg

SEQ ID NO: 1998 - protein, 304 aa, Streptococcus agalactiae
MVKVSVSSVGTQASTVAISMFSRVSALNDAITKLSSFAEAATLQGTAYSNAKSYATGTLTPMLQGMILFSETLSEKCTELQTLYVSICGDEDLDSVVLESKLASDRASLKIAEALLEHLNDDPEPSKSAISSTKSNIKKLKKRIKSNQKKLDNLNEFNAHSATVFADISNAQSTVNQALAAVSTGFSGYNSKTGAFGKPTSGQMEWTKTVKKNWKEREDAKAEELKSKKAEESKKASKIENTTKKSNVSVDKKKLIKAANEAYKLGEIKKDTYESIISGLSNASAALLKEVAKSKLTDTARLLM

SEQ ID NO: 1999 - DNA, 360 bp, Streptococcus agalactiae
atgactgaacgaacattcgaagatattgaacttgacttaaagttattccaaataaagcttgataatgctgagaatagtaaaaggctcttacaaaaattgaaaaacgacgtcatggagttacaaatagagttactagaatcattaaaactcggtgatgcctatttaacagaatcagaagaattagaagagaataatgactttattctaacggtaaatagtgaaacactaagtttagaagaatcctatgacaataggataaacttagtttctaaagagattatggattatgaaaatgcattagataagttgtattatgaaaaacagagtttgatgcaaaaaagtaatgaaagaaaaggaggt

SEQ ID NO: 2000 - protein, 120 aa, Streptococcus agalactiae
MTERTFEDIELDLKLFQIKLDNAENSKRLLQKLKNDVMELQIELLESLKLGDAYLTESEELEENNDFILTVNSETLSLEESYDNRINLVSKEIMDYENALDKLYYEKQSLMQKSNERKGG

SEQ ID NO: 2001 - DNA, 255 bp, Streptococcus agalactiae
atggcaaaaatacaaagtgatgcctccgtcgcatccacctgtgcaactgcaatacaatcaggagccagtggaatcacagcagtaggagctccaactaaggattcaaacagtgattatagtggtaatagcgatgcttcaacttacatcgatggagaggcaagtagtagtagccaaattgctgaaaaaataaatgagttcatagctctcattcattctacggtgaatgagtttgaagctattgaccaaaaaattagc

SEQ ID NO: 2002 - protein, 85 aa, Streptococcus agalactiae
MAKIQSDASVASTCATAIQSGASGITAVGAPTKDSNSDYSGNSDASTYIDGEASSSSQIAEKINEFIALIHSTVNEFEAIDQKIS

SEQ ID NO: 2003 - DNA, 3927 bp, Streptococcus agalactiae
atgaaattcaaatctgggggggctgattatgaaacatcattaactaagaaagttatgtcagcttatcaattttacgaaggctatcctgattttcaccgctcacctcgtattatttatcgttccagtgaagataaaattacagttaatgcgcctggtaatgaacctaataagtctaaagatgaactgttaaaattaattgttcctcctctagtgatgattggagtcagcattcttatttctatttttcgtcctcgtggtatctatatcattgcaacaatgtcaatggctctagtgacgatgattttctctatcactggttactttaaaaatcgtaaacagtataagcaggacttacaagaacgcattgattcctatcatgactatttatctgataagtcaattgaacttcagaagttagctaaagagcaaaagcgtgggcaacactatcattacccaacgattgaaggtttacaggaaatggctgatacttatcaccatcgtatttatgaaaagacaccacttcattttgacttcttgtattatcgcctaggtttgggagaagtaccaacgagctataatattcattattctcaaccagaacgttctgggaaaaaagatcctttagagaacgaaggctataacctctactttaacaatcgttatattaaaaatatgccgattgttgcgaatttatcacatggaccagttggctatataggaccacgaggtttagtattggagcaactccaattgatggttaatcaattagcttttttccattcttaccatgatgttcaatttattactattgttccagaggaagagatggataagtggtcttggatgcgttggttgccacatgaaaccttacaagatgtcaatgttcgtggctttgtttataatcaaagaagccgtgatcaagtgctcaacagtcttaaccaaattttaaaattacgtcgcacacaacgcgaagataaatctgccaaagaagggactttattttctccgcattatgtcgttattgtaactgatgaaaagttaattttagatcacgtcatcatggaattctttacggaagatcctacagaattgggatgttctctcatctttgttcaagatgttatgagttcactttcagaaaatatcaaaaccattattaatattaaagaccgtaatactggtcagttagttatagaagaaggagagcttaaagaaacagattttgaattagatcatttcttagaggattatgacaaggaaaatatttcacgtcgcctagctccgttaaatcacctacaaaatcttaaatcttcaataccagaagcagttacttttatggaaatgtatcaagcagaagaatttgaagatttgcatgttcaagagcgttggataagccatgctccgtataaaagctcagctgttccacttggcttacgtggtcaggatgatattgtttatctaaacctacatgaaaaagctcatggtcctcatggattagttgcaggaacaacgggatcagggaagtcagaaattatacagtcctatatcctttctttagctgttaatttccatccacacgatgtagctttccttctcatagactacaaaggtggggggatggcaaacctctttaaggacctgccacacttacttggcaccatcaccaacttagatggtgcccaatcgatgcgtgctttggtttctattaatgctgaattgaaacgtcgtcaacgtttatttgctaaagctgatgttaatcatattaaccagtatcagaagaaatacaaacttggagaagtttcagaaccaatgcctcatctcttcttaatctccgatgagtttgccgaattgaaatccaaccaacctgagtttatgaaagagcttgtctcaacagcgcgaattgggcgttccctagggattcacttaatcctagcgacccaaaaaccatctggtgtggtagatgaccaaatctggtcaaactcacgcttcaaactagctcttaaagtagcagaccgcggcgactccatggaaatgctccatactccagatgccgccgagattacacaagcaggacgtgcctacctccaagttggtaataatgaagtctatgaactcttccaatcagcatggtcaggagcagattaccaacctgaaaaagacgaccaagggattgaagaccataccatttattccatcaacgaccttggccaatacgaaatcctaaatgatgatctttcaggcttagaccaagccgaaaatattaaagaagtacctacggaattagatgctatcgttgaaaacattcaagctttaaccaaagaaatgggcatctcagacttacctcaaccgtggctaccgcctctaagcaatcagattgcagtaaccgatctccgtaaggagggatcagtagacctctggagcaaggccccatcttacaaagctgttcttggctttatggatataccaagccaacaagcacaagaagtggcttaccacgattttgaagacgatgggcatttgtcaatttttgcaggaccaagtatggggaaatccacagcccttcaaactgtaacaatggacttagcacgtcataatagtccagaatttttaaacctttacctctttgattttggtaccaatggcctcttacctctaagacgtttgccacatgtagcagatttctttaccattgatgatgacgaaaaaatagccaagtttattgcccgtatcaaagttgaaatgtctgatcgtaaaaaagccctcagtcgctacaatgtcgcgacagcaaaactttaccgtcaggtatctggggaaaccatgcctcaaatcctgattgttattgacagttatgaagggctacgggaagctcaaacaccgactaacttagaagcttgtttccaaaatatttcgcgtgatgggtcgtcacttggcatttccttagttatctcagctggtcgtacggcagctttgaggtcgtccttaatggcaaaccttaaagaacgtatcgctcttaaattaacagatgactctgaatcacggacacttgtcggtcgtcaccaacacatcatggaagatattccaggacgtggattaatcaaacgtgatgacattgaagtgttacaagtggctctctcaacagaaggcactgaaacctttgacatcatcaataacatccaaaacgaatctgacgccatgaacagcaaatggactggaccaagaccaaaagcaataccaattgttcccgaagaattaacctttgacgactttatggctacagatagtgttcaagctgacctatcagctaatcgtttaccacttgggcttgaaatggttgacgttgaaagttatagtttagcacttaatcgctttaagcatatgctttacatgtctgattctgacgagtcactcgaagcagttggttcccatatcatcaaggtcttgcttaacgtcccaaattaccataacatgatcatcgattcgcttggcgaatatgaaagctatcaaggtcaggtacgtacttatgtgggttctgatatgattgaagatatggcggatcagttgatctatgagttgcagcaacgtgaaagccaatctgagatagctgaatggtttatcatgattccagattttgaaagctttgtggctaagagcaatatgaagcttgaacaggttcaggcattgcttgacaatggaccacgctatggtttacatctgattcttggatcaagctataactatgttgggactaagatcgatgctgtgcctaaatacgttcgcacaacgacccagtatgtgctggctggcatgaggctcatggatcaaaccttccttgaaaaagtgtataatagtaaggaaatccgtccaaacaaagacgaagcctacattcacgatagaaaaacctatcaaaaattaaaactcaccatagac

SEQ ID NO: 2004 - protein, 1309 aa, Streptococcus agalactiae
MKFKSGGADYETSLTKKVMSAYQFYEGYPDFHRSPRIIYRSSEDKITVNAPGNEPNKSKDELLKLIVPPLVMIGVSILISIFRPRGIYIIATMSMALVTMIFSITGYFKNRKQYKQDLQERIDSYHDYLSDKSIELQKLAKEQKRGQHYHYPTIEGLQEMADTYHHRIYEKTPLHFDFLYYRLGLGEVPTSYNIHYSQPERSGKKDPLENEGYNLYFNNRYIKNMPIVANLSHGPVGYIGPRGLVLEQLQLMVNQLAFFHSYHDVQFITIVPEEEMDKWSWMRWLPHETLQDVNVRGFVYNQRSRDQVLNSLNQILKLRRTQREDKSAKEGTLFSPHYVVIVTDEKLILDHVIMEFFTEDPTELGCSLIFVQDVMSSLSENIKTIINIKDRNTGQLVIEEGELKETDFELDHFLEDYDKENISRRLAPLNHLQNLKSSIPEAVTFMEMYQAEEFEDLHVQERWISHAPYKSSAVPLGLRGQDDIVYLNLHEKAHGPHGLVAGTTGSGKSEIIQSYILSLAVNFHPHDVAFLLIDYKGGGMANLFKDLPHLLGTITNLDGAQSMRALVSINAELKRRQRLFAKADVNHINQYQKKYKLGEVSEPMPHLFLISDEFAELKSNQPEFMKELVSTARIGRSLGIHLILATQKPSGVVDDQIWSNSRFKLALKVADRGDSMEMLHTPDAAEITQAGRAYLQVGNNEVYELFQSAWSGADYQPEKDDQGIEDHTIYSINDLGQYEILNDDLSGLDQAENIKEVPTELDAIVENIQALTKEMGISDLPQPWLPPLSNQIAVTDLRKEGSVDLWSKAPSYKAVLGFMDIPSQQAQEVAYHDFEDDGHLSIFAGPSMGKSTALQTVTMDLARHNSPEFLNLYLFDFGTNGLLPLRRLPHVADFFTIDDDEKIAKFIARIKVEMSDRKKALSRYNVATAKLYRQVSGETMPQILIVIDSYEGLREAQTPTNLEACFQNISRDGSSLGISLVISAGRTAALRSSLMANLKERIALKLTDDSESRTLVGRHQHIMEDIPGRGLIKRDDIEVLQVALSTEGTETFDIINNIQNESDAMNSKWTGPRPKAIPIVPEELTFDDFMATDSVQADLSANRLPLGLEMVDVESYSLALNRFKHMLYMSDSDESLEAVGSHIIKVLLNVPNYHNMIIDSLGEYESYQGQVRTYVGSDMIEDMADQLIYELQQRESQSEIAEWFIMIPDFESFVAKSNMKLEQVQALLDNGPRYGLHLILGSSYNYVGTKIDAVPKYVRTTTQYVLAGMRLMDQTFLEKVYNSKEIRPNKDEAYIHDRKTYQKLKLTID

SEQ ID NO: 2005 - DNA, 93 bp, Streptococcus agalactiae
gtgcagcagttacctttaagtttaggtgatgagattagcttccaaggaacaattgttaagcttttcccagatgaaattcaaatctgggggggc

SEQ ID NO: 2006 - protein, 31 aa, Streptococcus agalactiae
MQQLPLSLGDEISFQGTIVKLFPDEIQIWGG

SEQ ID NO: 2007 - DNA, 126 bp, Streptococcus agalactiae
atgaaatttactgacaaagacaaagccttatctaaatccaagacattcaaggctaatcgtaatttttcagataaagtttcttttttaaagctttcaaaaaatagagcgtgcgcttctgtctggaat

SEQ ID NO: 2008 - protein, 42 aa, Streptococcus agalactiae
MKFTDKDKALSKSKTFKANRNFSDKVSFLKLSKNRACASVWN

SEQ ID NO: 2009 - DNA, 1272 bp, Streptococcus agalactiae
atggaaacagattcgtttgtatttgaagaacaagactttcaatttgaaaaaggaccagatttttggcagttatctcttaagcgttcaaaagtaggaactcaaaatctgcaacaactgcaattgttagaaattcaccattctttgttgatgcctatgacaactgcaattgatgcagataccattcaatttcaattccagacagaagcgcacgctctattttttgaaagctttaaaaaagaaactttatctgaaaaattacgattagccttgaatgtcttggatttagataaggctttgtctttgtcagtaaatttcattttgcatccctctaatctatttttaacaaaaaatgcaactgctaaaatagcttatcgtagccttcctgggattatgagacctgagaaatttggtccagaagagtttttatatcaattcaaatgttttgtctttgcattattgacgcaacatgactatatagagttgtataatggtgctatttctgttattgaagtatcagatttcctaaaaagcatttatcatgcagaaactattcaggctgttagagacatcattactattgattatgagcagcaagtagaagtagaaactcatacgttagcaaaagtatcaagggcaaaatataagctttataaatacataagtgtttggctaggagctttatctacaatactcttgattccgctagtatatctggtttttattcacaatccattcaaagaaaaaatgttggcagcggatacttcatttattaaagttgattataatcaagtgattaatcgactagaacatgtaaaagtaagtaagttaccttatacacagaagtacgagttggcctattcctatattaatggaatgtcattttctgaagaacagcgtgaagttattttaaacaatgttacgctcaagactgatgagctctatcttgattattggattaatattggccgtggtttagatgatgatgctattgatgctgccaaacgtttagacgattctgaccttgttatttatgctattgttcagaaaatggatcaggttagaaaagacaatagtttatctggtaaagatcgtgaacaaaaactttctgagctacaaacagactatgataaatattggaaagaccgtaagacagccttaacagatgaggaatccaaatcgaaaaatagcaataatcattcgacaaattccaacaaagagtcatctgaatcatcaagtactacagcaagtacatcttctaaaactaaaagtagg

SEQ ID NO: 2010 - protein, 424 aa, Streptococcus agalactiae
METDSFVFEEQDFQFEKGPDFWQLSLKRSKVGTQNLQQLQLLEIHHSLLMPMTTAIDADTIQFQFQTEAHALFFESFKKETLSEKLRLALNVLDLDKALSLSVNFILHPSNLFLTKNATAKIAYRSLPGIMRPEKFGPEEFLYQFKCFVFALLTQHDYIELYNGAISVIEVSDFLKSIYHAETIQAVRDIITIDYEQQVEVETHTLAKVSRAKYKLYKYISVWLGALSTILLIPLVYLVFIHNPFKEKMLAADTSFIKVDYNQVINRLEHVKVSKLPYTQKYELAYSYINGMSFSEEQREVILNNVTLKTDELYLDYWINIGRGLDDDAIDAAKRLDDSDLVIYAIVQKMDQVRKDNSLSGKDREQKLSELQTDYDKYWKDRKTALTDEESKSKNSNNHSTNSNKESSESSSTTASTSSKTKSR

SEQ ID NO: 2011 - DNA, 483 bp, Streptococcus agalactiae
gtgaggttgttgatgaagttgaaacgatttttagcctgtctactaatattatcctgtatgagtcaaacatcagtattttctgatgggttaaagaataatgatattcattttgatacaaaacgtttagaatcagattcacaaaaaaattctggttttcaaactgaattaactaaagatttatttaaaaaagaagaccttaaaaaattggataaaaaccgtcaatctaaagtctcactccagaaaaagcagtctaagcaactgtttcaatattcaaataaaggacaatctgataggaaaaaacgtatcaaacaattattttctgaagaaagtaatcaatttaaatttgttacaagaacagaagaaccgactgtttcggctgatattggtcatataattatatacctggttctcattagtttggtactaatattagcttctataatgacttttaaaataaaggacaaaaaggatgaatacacatat

SEQ ID NO: 2012 - protein, 161 aa, Streptococcus agalactiae
MRLLMKLKRFLACLLILSCMSQTSVFSDGLKNNDIHFDTKRLESDSQKNSGFQTELTKDLFKKEDLKKLDKNRQSKVSLQKKQSKQLFQYSNKGQSDRKKRIKQLFSEESNQFKFVTRTEEPTVSADIGHIIIYLVLISLVLILASIMTFKIKDKKDEYTY

SEQ ID NO: 2013 - DNA, 126 bp, Streptococcus agalactiae
atgttatcagaagcttctaaagattttttcagtgattcgttagcagtaatggaactactagactggttaacgagggctggaaagatattttggaaattagttgcagaatctaaaagatttttttgg

SEQ ID NO: 2014 - protein, 42 aa, Streptococcus agalactiae
MLSEASKDFFSDSLAVMELLDWLTRAGKIFWKLVAESKRFFW

SEQ ID NO: 2015 - DNA, 3042 bp, Streptococcus agalactiae
ttgttgaaaataaaatatattttaggaagaattatgaaaagaaataactttagaatactttggtatattatagctgttgctctctttttagtagctattgctggccttaatcttaagcttcaaggcgatcatgcaaaagagaataaaacaacacagtcagctactaacactaaactaaatatagcattagtcaacgaagatcaaaatgtatctaatggtaaagaaagttataatttaggagctagttatattaagtctatcgaacgtgataatagtcaaaattggtcagttgttagtcgaggtactgctcaaaatggattagacaaaggtgattatcaattaatggttatcatccctaataacttttctcaaaaacttcttgatgtcaataaagcaaatgcagagcaaacaactatctcttataaggttaatgccaaggggaatttagcattagagaaaaaggcaactgaaaaagagaaagatattgtttcagagttaaatagccacttagtaaatatgtacatggcaagtattttaagtaacttatatacagctcaagaaaatgtacaggccatggtaaatgttcagtcaggtaatatctcaaattaccaaaaaaatcttttagattctgcaactaatttccaaaatatctttccagccctcgttaaccagtctagtagttccattactgctaacgaatcactgaaaaaatctttagaagcttctgataacatgtttaatgatttggtgacaacccagacaaatactggaaaagatttatcaagcttaatagaacagcgccatcaagatagcatttcgtatgaagcgttttcgacctcattactagaaatgaataacgagttattagagaagcaattatctgatattatcacacaagcacaaaaagaccaagaaacattatcatcacaactcaatagtattatgggtgatgataacaatcataatcataaagaaaactcatcagcttatctaaatgttgcaaggcaaaaaatccaagaactatctgaagcactcaagtcacaagataacattgctaaagatcaaagtgaacaactagataaaattgttagagagggactagcaagttactttgctaagaataataaagataatattactttattagaattattgaagagtcattctactaatgagaagactttgaaagattttaaagctaaggtagcagatttcacaaattctctcatttcaagcattccttcactaaacctttcggagttgcacttaacccaagaagaagaaaaagccattcagtttacatcttctgattcggaaatcattaaaaaagtaagcaacgaaagaactctgtatttaaatactaatttattgaatcgtctttttgaagctaggaaaaatagagatgaagctaaaaataaagttaatcaattaaaattgtcatctagttctactcgaactggtgagcagatagtttctgttgaatcaaataatccagattacagggtagatacctggacggttaatggtaagcaaacaagaaccttggaccccagccaaaacaataatattattatcaatagcagttatcaaagggaatcatctaactctagtattacgaaaccaagctatacaatcactatcgggaatcagaaacaaattgtacaaaatgatgacggtaaaatccaacggtcttactttgaggcagaggcaacgtatcaacgaactctacaagaagtaaatgatgcatataacaccactcacggattagtagctaaatactacattatttctgatggcgaagaaccgcaaaatttatttgatcaatttttaaatcaaagtgttaacgatacgatggttgatctggtcaaaaatggtataactaagtatttgatggatgaaaacactgctgatgcgcaacagaaagttaaagatgtcatggaggaagttgaaaatagtcaagatgaattggcggatcaaatggcaaaagtaactgagacaaatgtacgactaacagatgcaatcaaaaaacagcttgaaacccttcaatcaattaacatgaaggtccaaaacatcacacaggatcaatctaaagtaaacgactcacagaaaacaactgatcaacaattatctgatttgaagaaccagctagatgggctaatgacctctgcagcgggcgtaaaagatatgtccaaatctaatagtcaagaggcggaccaagttaatcaaatattcacatcattcaataaagatgttcaagatgctaaaaattcgggcaacaaactttcgacggatgcaaccgatttaatggctaacttccaaaaagaattggccaataatggtgatttcgtagcttctttctctaaagtttttaatactgcttataaaaatggagtgccaaatgatattctccttaatttcttatcacgacctgtcgctgaatcagcgtctgcagttagggcaactgaaaatacttatcgcccattcacttggatactattattagaagttgttagcctatttacagcatatatctttgcgactcaaaaccttattaagaaattgacagataggtataatgtcaaccgctggcttcaaacagactttttaaatgtcattgtcatttcaggcctctctcttgttattggtttagcactgggagttatctcaagcagaagtcttcatgtcatgcctgaatatgtaccatcttggttcctagttatgactctgtttagttttttattaattcatagtcagtatttctttattaaaaattttaaagcagttggtatgggtttagctttgtttatgattattagttttgtgtatctatcaaatgccgtaggcacagtagcgactgttagtggacttccaaaattactaaaagctattaatccactatctatccttgaaaatcaattatcatcttattttgataatgtgacaactggatttattttccttatcttagtacttcttgtggatgttgcttttattatcatgaatatttttatcaccttaaattttgaagctaaagtaaaagag

SEQ ID NO: 2016 - protein, 1014 aa, Streptococcus agalactiae
MLKIKYILGRIMKRNNFRILWYIIAVALFLVAIAGLNLKLQGDHAKENKTTQSATNTKLNIALVNEDQNVSNGKESYNLGASYIKSIERDNSQNWSVVSRGTAQNGLDKGDYQLMVIIPNNFSQKLLDVNKANAEQTTISYKVNAKGNLALEKKATEKEKDIVSELNSHLVNMYMASILSNLYTAQENVQAMVNVQSGNISNYQKNLLDSATNFQNIFPALVNQSSSSITANESLKKSLEASDNMFNDLVTTQTNTGKDLSSLIEQRHQDSISYEAFSTSLLEMNNELLEKQLSDIITQAQKDQETLSSQLNSIMGDDNNHNHKENSSAYLNVARQKIQELSEALKSQDNIAKDQSEQLDKIVREGLASYFAKNNKDNITLLELLKSHSTNEKTLKDFKAKVADFTNSLISSIPSLNLSELHLTQEEEKAIQFTSSDSEIIKKVSNERTLYLNTNLLNRLFEARKNRDEAKNKVNQLKLSSSSTRTGEQIVSVESNNPDYRVDTWTVNGKQTRTLDPSQNNNIIINSSYQRESSNSSITKPSYTITIGNQKQIVQNDDGKIQRSYFEAEATYQRTLQEVNDAYNTTHGLVAKYYIISDGEEPQNLFDQFLNQSVNDTMVDLVKNGITKYLMDENTADAQQKVKDVMEEVENSQDELADQMAKVTETNVRLTDAIKKQLETLQSINMKVQNITQDQSKVNDSQKTTDQQLSDLKNQLDGLMTSAAGVKDMSKSNSQEADQVNQIFTSFNKDVQDAKNSGNKLSTDATDLMANFQKELANNGDFVASFSKVFNTAYKNGVPNDILLNFLSRPVAESASAVRATENTYRPFTWILLLEVVSLFTAYIFATQNLIKKLTDRYNVNRWLQTDFLNVIVISGLSLVIGLALGVISSRSLHVMPEYVPSWFLVMTLFSFLLIHSQYFFIKNFKAVGMGLALFMIISFVYLSNAVGTVATVSGLPKLLKAINPLSILENQLSSYFDNVTTGFIFLILVLLVDVAFIIMNIFITLNFEAKVKE

SEQ ID NO: 2017 - DNA, 2271 bp, Streptococcus pyogenes
atgttagaagaattgaaaacacttattaaaaatccaaaattaatgattacaatgattggtgtggccctagtgcctgccttatataatttatcctttctaggctcaatgtgggatccttatggtcgggtcaatgaccttcccattgctgttgttaatcatgataagcctgcaaagagagctgataagtcattgacaattgggaatgatatggtggacaagatgtctaaaagtaaagatttagagtatcattttgtctcagctaagcaagctcaagagggacttaaagaaggtgattattatatggttattactttacccgaagatctttctcaacgggcagcaaccttattaaatcccgaaccccaaaaattaactatccgttaccaaacgagtaaaggacatggaatggtcgctgctaagatgggggaaacagcgatggctaagctgaaagagtctgtttcgcaaaacattacgaagacttatacctcagcagtttttagcagtatgacagacctccaatcaggattaaaagaagcctcagctggaagtcaagcacttgcttcaggagcgaagactgctcaggcggggagtcaaacactttcgacgaacttagcagccttaacgggtgctagccaacagtttcaacaaggtactggtcgattgacatcaggtttgactacctatacagatggtgtcaaccaagtcaagaatgggttaggaacattatcaacggacatccccaattatctgaatggggtttctaggttatcccagggagcttctcagcttaatcagggtctttcacagttgacacaagcaacaacactttctgacgagaaagctaagggaattcaatccttaattgtaggactaccagtcctaaatcaaggcattcagcaactaaatacagagctatcaacattgcaaccccctaaccttaatgctgatgagttaggtaatagcttaggagctatcgctcaagctgccaaacaagtcattgctgaagagactgccgctcagaatgaagaattatcggctctccaagctactagcgtttaccaatcattaactgctgaacaacaaggagagttagctgcggccctcagtcaatctgataaaagtcagaccgtatctgcagcccaaactattttaagttctgttcaaactttgtcaacaagtttacagtctctctctcaagaagatcagtcaaaacagttggagcaacttaaggaagctgttgcacagattgctaatcaatccaatcaagctttgccgggagcaagttctgctttaactgaattatcaacgggattagcaaaggtaaatggtagcttaaatcaacaagttctaccaggaagtaatcaattgacaacaggattagcacaattaaacaggtataatactgccattggttctggggtaataaaactctcagaaggtgccaatgccttgtcatccaagtccggagaattactagatggtagccatcaattatcagaaggtgctactaaactagctgatggtagttctcaattgagtcagggtggtcatcaattaacgagcggattgactgaattatcaacaggattgtcaaccttaaatggttccttagccaaagcctctcagcagttatcgcttgtttctgtgactgataaaaatgctaaagctgtcgcaaaacctcttgtgttaaatgagaaagacaaagatggtgttaagacgaatgggatcgggatggcaccttatatgattgctgtttctctaatggttgtggccctttcaaccaacgtcatttttgctaattctttatctggtcgtccggtcaaagataaatgggattgggctaaacaaaaatttgttattaatggttttatttcgactatgggatccattgttctctacttagctattcaattattagggtttgaagcccgttatggtatggaaaccttaggatttattatgctaagtggttggacgtttatggctcttgtcacagctttggtcggttgggatgatcgatatggctcttttgcttctttggtcatgttattgcttcaggttggctcttcaggtggctcttaccccattgagttaagtggagcattcttccaaaagttacatcctttcttaccaatgacttatgtggtatctggtttacgacaaaccatttcattatcaggtcatattggagtagaagtgaaagtcttaactggtttcttactggcatttatggtattagcactactcatttatcgtcccaagaaaacagtc

SEQ ID NO: 2018 - protein, 757 aa, Streptococcus pyogenes
MLEELKTLIKNPKLMITMIGVALVPALYNLSFLGSMWDPYGRVNDLPIAVVNHDKPAKRADKSLTIGNDMVDKMSKSKDLEYHFVSAKQAQEGLKEGDYYMVITLPEDLSQRAATLLNPEPQKLTIRYQTSKGHGMVAAKMGETAMAKLKESVSQNITKTYTSAVFSSMTDLQSGLKEASAGSQALASGAKTAQAGSQTLSTNLAALTGASQQFQQGTGRLTSGLTTYTDGVNQVKNGLGTLSTDIPNYLNGVSRLSQGASQLNQGLSQLTQATTLSDEKAKGIQSLIVGLPVLNQGIQQLNTELSTLQPPNLNADELGNSLGAIAQAAKQVIAEETAAQNEELSALQATSVYQSLTAEQQGELAAALSQSDKSQTVSAAQTILSSVQTLSTSLQSLSQEDQSKQLEQLKEAVAQIANQSNQALPGASSALTELSTGLAKVNGSLNQQVLPGSNQLTTGLAQLNRYNTAIGSGVIKLSEGANALSSKSGELLDGSHQLSEGATKLADGSSQLSQGGHQLTSGLTELSTGLSTLNGSLAKASQQLSLVSVTDKNAKAVAKPLVLNEKDKDGVKTNGIGMAPYMIAVSLMVVALSTNVIFANSLSGRPVKDKWDWAKQKFVINGFISTMGSIVLYLAIQLLGFEARYGMETLGFIMLSGWTFMALVTALVGWDDRYGSFASLVMLLLQVGSSGGSYPIELSGAFFQKLHPFLPMTYVVSGLRQTISLSGHIGVEVKVLTGFLLAFMVLALLIYRPKKTV

SEQ ID NO: 2019 - DNA, 288 bp, Streptococcus agalactiae
atggcacaaattaaattaacaccagaagaacttcgctcatcagcacaaaagtacacagctggttctcaacaagtaacagaagttcttaatttgcttactcaagagcaagcagttattgacgaaaattgggatggatctacttttgattcttttgaagcacaattcaatgaattatctccaaaaattacagaatttgctcaattactcgaagatattaaccagcaattattaaaagttgcagatatcattgagcagacggatgcagatattgcttctcaaattagtgga

SEQ ID NO: 2020 - protein, 96 aa, Streptococcus agalactiae
MAQIKLTPEELRSSAQKYTAGSQQVTEVLNLLTQEQAVIDENWDGSTFDSFEAQFNELSPKITEFAQLLEDINQQLLKVADIIEQTDADIASQISG

SEQ ID NO: 2021 - DNA, 780 bp, Streptococcus agalactiae
atgattccagatagtagttttaaagtgctatcagatatggcatataatattgaaaaatccaaagcagaaagtaatggacaccttcaaattatagaaggtagtcaaattattgatttccatcaaaaacgctcttttatggtattagaggttaatgatgatatcaataatggtatgcaggctatggcatgtcagtctttggatgaaagtaatcatattgttatagcatattcaggaacgaacgcttttaataagaaagatatcttaacagatatcgattcagttgtattggggaagaacaataaattgctaacttgtccttcaagtattaccctgagagaggatggcatttctctgccttgtaaaaatccaagtcaaattacaacatctaaactatttgcacaaaaaattaagatgaactatcctgatgcaaccctctggttaacaggccattctctaggtggttatttggccatgattgtggcttcagaaatgagattatcagcgcgtgtttttaattcccctagtcccattaacaatatgtctgaagcagccacatcctatgtaatttcacatccagagaagtatcatagttaccgtattaataaagattacattggtaattttggtattaatagttcagatgataaattaggtatttctaaaagagtcaatgctaagaagcaacatggtttttataaaaagattttctttcacgaattgacacgatttcgattaaatcaacaaggacagattgttgatatagatgaaaataaacaggat

SEQ ID NO: 2022 - protein, 260 aa, Streptococcus agalactiae
MIPDSSFKVLSDMAYNIEKSKAESNGHLQIIEGSQIIDFHQKRSFMVLEVNDDINNGMQAMACQSLDESNHIVIAYSGTNAFNKKDILTDIDSVVLGKNNKLLTCPSSITLREDGISLPCKNPSQITTSKLFAQKIKMNYPDATLWLTGHSLGGYLAMIVASEMRLSARVFNSPSPINNMSEAATSYVISHPEKYHSYRINKDYIGNFGINSSDDKLGISKRVNAKKQHGFYKKIFFHELTRFRLNQQGQIVDIDENKQD

SEQ ID NO: 2023 - DNA, 3180 bp, Streptococcus agalactiae
atgccaaagcgcacagacatacgtaaaattatggttatcggttctggcccgattgtgattggacaagcagcagagtttgactattctggtacacaagcctgtctctctttaaaagaggagggataccaagttgttttggtcaattcgaatccagctactatcatgacagataaagatattgctgataaagtttatattgaacctattaccttggagtttgtcacaagaattctcaggaaggaaagacctgatgctctccttccaactcttggaggtcaaactggattgaatatggctatggctctatcaaaaaatggtatcctagaagaattgaatgttgaactattagggaccaaattatcagccattgataaagctgaagatcgtgatttatttaaacagttgatggaagaactcaatcaacctattccagaatctgagattgttaattcggtagaagaagctattcaatttgcagagcaaatcgggtatccattaattgttcgtcctgcctttactttaggaggtacaggtggaggcatgtgcgataatcaagaacaattggttgacatcacgacgaaggggttaaagttatcgcctgtgacacagtgccttattgaacgttcaattgctggctttaaagagattgaatacgaagttatgcgtgatgcagcagataacgctcttgttgtttgtaatatggagaattttgatcctgttggtatccatacaggggactctatagtttttgcacccgcacaaacgttatctgatgtggaaaatcagttattacgagatgcgagtttagatattataagagctttgaaaattgaaggaggatgcaatgttcaactagcccttgatccgaatagttttaaatactatgtcattgaagttaatccaagagtatcaagatcttctgctttagcttcaaaagctactggatatccaattgctaaattagcagctaagatagctgttggtttgacactagatgaggtaattaatcctattacaaaaacgacttacgctatgtttgaacctgctttagattacgtagtcgcaaaaatgccgagatttccttttgataaatttgaaagtggcgatagaaaattgggaacacagatgaaagctacaggcgaagtcatggcaataggacggaatatagaagaatctttgttgaaagcttgtcgttcactagaaataggtgtcgatcacattaaaatagcagatttagataatgtatcagatgatgttttattagaaaaaataagaaaggcagaagatgatcgcttattttatctagcagaagctttacgtagacattatagtattgaaaaattagcaagtttgactagcattgattctttcttccttgataagttaagagtgattgtagagttagaagatctattatctaaaaacagactggatatcaatattctcaaaaaggttaaaaataaaggtttttcagataaagctatagcgagtttatggcaaataaacgaagatcaagttcgtaacatgcgaaaagaagcaggaattcttccagtttataagatggttgatacatgtgcgtctgagtttgattcagcaacgccctacttttattcgacttatgccgtagaaaacgagtcattgatatcagataaagcctctattttggttttaggatcgggcccaatccgaattggacagggagttgaatttgattatgcaacggttcattctgttaaagccatcagagagtctggttttgaagcgattatcatgaactctaatccagagacggtctcaacggatttctctatttcagataagctttactttgaacctttgacttttgaagatgttatgaatgttattgacttagaaaaacctgaaggggtcatcttacaattcggtggtcagactgctattaatctagcaaaagatttaaacaaggcaggggttaaaatactaggcacacaattagaagatttggatcgtgctgaaaatagaaaacaatttgaagccactttacaagctctaaatatccctcaaccaccaggttttaccgccactacggaggaagaggcagttaatgcagcgcaaaagattggttatcccgtgttggttagaccatcatatgttcttggtggacgagctatgaagatagttgaaaacgaagaagatttacgtcattatatgacaaccgcggtaaaggcaagcccagatcatccagtgcttatagatgcataccttataggtaaagagtgtgaggttgatgctatatccgatggtcagaatatactgattcctggaataatggaacatatagagcgatctggtgttcattcaggagattccatggctgtatatcctcctcaaacattgtctgagaccattatcgaaactattgtagattatacaaaacgcttagcaattggattaaactgtatcggtatgatgaatattcagtttgtaatcaaggatcagaaagtatatgttattgaagttaatcctcgtgctagtagaacacttccattcttatcaaaagtaactcacattcctatggcccaagtagcaacaaaagttatcttaggagataaactctgcaattttacatatggttatgatctctatccagcttcagatatggtccacattaaagcccctgtctttagttttaccaaacttgctaaagtagatagtttattaggtcctgaaatgaaatcaacaggcgaagtgatgggatcagatattaatcttcagaaagccttgtataaagcctttgaagcagcatatctccatatgccagactatggtaacattgtttttacagtagatgatacagataaagaagaagctttagaacttgcaaaagtctatcaaagtattggttatcgtatttatgctacccaagggactgcaatttattttgatgctaatggtttagagacagttttagtaggtaagttaggagagaacgatcgaaatcatattcctgatttaattaaaaatggtaagattcaagcagttatcaacacagttggacaaaataacattgataaccatgatgctctcatcatcagacgttctgcaattgaacaaggagttcctctatttacatctttagatactgcacatgcaatgttcaaagttcttgaaagcagagcatttacattaaaagtactagat

SEQ ID NO: 2024 - protein, 1060 aa, Streptococcus agalactiae
MPKRTDIRKIMVIGSGPIVIGQAAEFDYSGTQACLSLKEEGYQVVLVNSNPATIMTDKDIADKVYIEPITLEFVTRILRKERPDALLPTLGGQTGLNMAMALSKNGILEELNVELLGTKLSAIDKAEDRDLFKQLMEELNQPIPESEIVNSVEEAIQFAEQIGYPLIVRPAFTLGGTGGGMCDNQEQLVDITTKGLKLSPVTQCLIERSIAGFKEIEYEVMRDAADNALVVCNMENFDPVGIHTGDSIVFAPAQTLSDVENQLLRDASLDIIRALKIEGGCNVQLALDPNSFKYYVIEVNPRVSRSSALASKATGYPIAKLAAKIAVGLTLDEVINPITKTTYAMFEPALDYVVAKMPRFPFDKFESGDRKLGTQMKATGEVMAIGRNIEESLLKACRSLEIGVDHIKIADLDNVSDDVLLEKIRKAEDDRLFYLAEALRRHYSIEKLASLTSIDSFFLDKLRVIVELEDLLSKNRLDINILKKVKNKGFSDKAIASLWQINEDQVRNMRKEAGILPVYKMVDTCASEFDSATPYFYSTYAVENESLISDKASILVLGSGPIRIGQGVEFDYATVHSVKAIRESGFEAIIMNSNPETVSTDFSISDKLYFEPLTFEDVMNVIDLEKPEGVILQFGGQTAINLAKDLNKAGVKILGTQLEDLDRAENRKQFEATLQALNIPQPPGFTATTEEEAVNAAQKIGYPVLVRPSYVLGGRAMKIVENEEDLRHYMTTAVKASPDHPVLIDAYLIGKECEVDAISDGQNILIPGIMEHIERSGVHSGDSMAVYPPQTLSETIIETIVDYTKRLAIGLNCIGMMNIQFVIKDQKVYVIEVNPRASRTLPFLSKVTHIPMAQVATKVILGDKLCNFTYGYDLYPASDMVHIKAPVFSFTKLAKVDSLLGPEMKSTGEVMGSDINLQKALYKAFEAAYLHMPDYGNIVFTVDDTDKEEALELAKVYQSIGYRIYATQGTAIYFDANGLETVLVGKLGENDRNHIPDLIKNGKIQAVINTVGQNNIDNHDALIIRRSAIEQGVPLFTSLDTAHAMFKVLESRAFTLKVLD

SEQ ID NO: 2025 - DNA, 3072 bp, Streptococcus pyogenes
ttggctctaaaagaagaaggctacaaagtcatacttgttaattcaaatcctgcaacgattatgacagataaagaaatcgctgataaggtatatattgagcctttgactcttgaatttgttaatcgtatcattcgaaaagaaaggccagatgccatactgccaaccttaggtggccaaacgggcctcaatatggcaatggcgttatctaaagctggtattcttgatgatttagagattgaattgttaggtactaagttatctgcgattgatcaggcagaagacagagaccttttcaaacaattaatgcaagaactagaccaacccattccagaatctacaattgttaaaacagttgatgaagctgttacatttgctagagatatcggttatccagtcattgtgcgcccagcttttactcttggtggaactggtggaggaatatgtagtagtgaagaagaactttgtgaaattactgaaaacggcctaaagttatcaccagtcacacagtgtttgattgaacgctcaattgctggcttcaaagaaattgaatacgaagtaatgcgagatagtgctgataacgcgctggttgtttgtaatatggaaaactttgatcccgtagggattcacacaggagattctattgtatttgcaccaacacagaccctttctgatattgaaaatcaaatgttacgtgatgctagtttaaaaataattcgagctctgaaaattgaaggtggctgtaacgtccagttagcactagatccttatagtttcaaatattatgttattgaagtaaatcctagagtgtctcgttcctctgcccttgcttcaaaagcaacaggttatcccattgccaaattggctgcaaagattgctgttggcctaacacttgatgaaatgattaaccctatcacaggcactacttacgctatgtttgaacctgcccttgattacgttgttgctaaaattccgcgttttccgtttgataaatttgaacatggtgaacgccaactgggaactcaaatgaaagcaacaggtgaagtcatggctattggccgtaatttggaagagtccttactaaaagcctgtcgttctttagaaattggtgtttgccataatgagatgacaagtttaagtaacattagtgatgaagagttagtgactaaagtgattaaagctcaagatgatcgacttttttacttgtcagaagcaatacgacgaggttatagtatcgaagaacttgagagcttgaccaagattgatttatttttcttggataaattacttcatattgttgaaatagagcaagaattacaaatgcatgttgaccatttggaaagcctcaaaaaagcaaagcgttatggattttcagatcaaaaaattgcagaaatttggcaaaaggatgaaagtgatatcagagcgatgagacattctcatagcctgtatcctgtctataaaatggtagatacttgtgcagctgaatttgatgctaaaaccccttatttttattcaacatatgagttggaaaatgaatctgttcagtcgaataaagaatcaattttagttttaggttcaggccctattcgtattggtcaaggggttgaatttgactacgcaacggttcattctgttaaagccatccaaaaagctggctatgaagccattatcatgaattcaaatccggagactgtatctacagatttttcggtatcagataaattatattttgaaccgttaacctttgaagacgtcatgaatgtgatagatttagagcagcctaagggagtaatagttcagtttggaggacaaactgctattaacttagcacaagcactttctgaggcgggtgttacaatattaggaacacaagtagaggatttggatagggctgaagacagagatttatttgaaaaggcgttgaaagagcttggaatcccacaaccacaaggtcaaacggcaactaatgaagaagaagctttagaggcagctaaaaaaattggttttccagtcttagttagaccttcttacgtacttggtggccgggctatggaaattgttgaaaacaaagaagatcttagagaatatataagaacagcggttaaagcaagtcctgaacatcctatcttagtggactcttatattttcggtaaggagtgtgaagtggatgccatttcagatggaaaatcagtcttaattcctggtattatggagcacatcgaaagagcaggtgttcattcaggagattcaatggcagtttatccgccacagcaattatctaagcaaattcaagaaacaatagctgagtatactaaacgtttagccattgggttaaattgtattggtatgatgaatgttcaatttgttattaaaaatgaacaagtttatgttattgaagtgaatccacgcgctagtcgtaccgtacctttcttatcaaaagtaacaggtattccgatggctcagattgctactaagttgattttaggtcaaacattaaaggatctaggatatgaagatggtctttatccccaaagtccactggtgcatatcaaagcgcctgtgttttcatttacaaagttggcacaggttgatagtcttttaggtcctgaaatgaaatcaactggagaagtaatgggttcggatactagtcttgaaaaagcactttataaagcgtttgaagccaataattctcatttatcagaatttggtcaaattgtctttactatagcagatgatagtaaggcagaagctctaagtctagcaagacgatttaaggcgattggctatcaaattatggctactcaaggtacagcagcttactttgctgagcaaggcttaagcgcgtgtttagttggaaaaattggtgatgctgccaatgacatcccgacactcgtgcgacatggtcacgttcaggcaattgttaatacagttggaattaaacgcacagctgataaagacggacagatgattagaagttcagctattgaacaaggagttcctttatttacagctttagataccgcaaaagctatgttaacggttttagaaagcagatgctttaacatcgaagcgata

SEQ ID NO: 2026 - protein, 1024 aa, Streptococcus pyogenes
LALKEEGYKVILVNSNPATIMTDKEIADKVYIEPLTLEFVNRIIRKERPDAILPTLGGQTGLNMAMALSKAGILDDLEIELLGTKLSAIDQAEDRDLFKQLMQELDQPIPESTIVKTVDEAVTFARDIGYPVIVRPAFTLGGTGGGICSSEEELCEITENGLKLSPVTQCLIERSIAGFKEIEYEVMRDSADNALVVCNMENFDPVGIHTGDSIVFAPTQTLSDIENQMLRDASLKIIRALKIEGGCNVQLALDPYSFKYYVIEVNPRVSRSSALASKATGYPIAKLAAKIAVGLTLDEMINPITGTTYAMFEPALDYVVAKIPRFPFDKFEHGERQLGTQMKATGEVMAIGRNLEESLLKACRSLEIGVCHNEMTSLSNISDEELVTKVIKAQDDRLFYLSEAIRRGYSIEELESLTKIDLFFLDKLLHIVEIEQELQMHVDHLESLKKAKRYGFSDQKIAEIWQKDESDIRAMRHSHSLYPVYKMVDTCAAEFDAKTPYFYSTYELENESVQSNKESILVLGSGPIRIGQGVEFDYATVHSVKAIQKAGYEAIIMNSNPETVSTDFSVSDKLYFEPLTFEDVMNVIDLEQPKGVIVQFGGQTAINLAQALSEAGVTILGTQVEDLDRAEDRDLFEKALKELGIPQPQGQTATNEEEALEAAKKIGFPVLVRPSYVLGGRAMEIVENKEDLREYIRTAVKASPEHPILVDSYIFGKECEVDAISDGKSVLIPGIMEHIERAGVHSGDSMAVYPPQQLSKQIQETIAEYTKRLAIGLNCIGMMNVQFVIKNEQVYVIEVNPRASRTVPFLSKVTGIPMAQIATKLILGQTLKDLGYEDGLYPQSPLVHIKAPVFSFTKLAQVDSLLGPEMKSTGEVMGSDTSLEKALYKAFEANNSHLSEFGQIVFTIADDSKAEALSLARRFKAIGYQIMATQGTAAYFAEQGLSACLVGKIGDAANDIPTLVRHGHVQAIVNTVGIKRTADKDGQMIRSSAIEQGVPLFTALDTAKAMLTVLESRCFNIEAI

SEQ ID NO: 2027 - DNA, 1074 bp, Streptococcus agalactiae
atgaagcgtctattattactggaagatggtagtgtgtttgagggtgaggctttcggagcggatgtagaaacaagtggtgaaatcgtttttagtacaggaatgacagggtatcaagaatctataacagatcaatcttacaacggtcaaattattacttttacttatcctcttattggaaattatgggataaatcgagacgattacgaatctattagaccaacatgtaagggagtagttatttatgaatgggcagagtatccaagtaactggcgtcaacagatgacacttgatgaatttttaaaattaaaaggaatacctggaatttcaggtatagatactcgagcattaacaaaaattattcgaaaacatggaacaatgaaagcttgtttaataaacgagggaaattctattcatgaagcactagaaaaccttcaaaaaagtgttcttttaaatgatcaaattgaacaagtatcaaccaaattagcttatgcttcgcctggagttggcaaaaatattgtattagttgactttggtttaaaacattctattctaagagaactgtcacaacgtcaatgtcatattacagtcgttcctcatactacgacagcgcaagaaatcttaaatctcaatccagatggagtactcttatctaacggccctgggaacccagaacaattaccgaatgctttacaaatgatccaagaaattcaaggtaaaattccaatttttggtatttgtatgggacatcaactatttgctaaagctaatggtgcaaagacttataaaatgacttttggtcatcgaggttttaatcatgctgttcgtcatttgcaaacaggacaggttgattttacaagtcaaaatcatggttatgctgtctcgagagaagatttccctgaggctctcttcattacacatgaagagattaatgataaaactgtcgaaggtgttcgacataaatactatcctgccttttcagtgcagtttcacccagatgcagcaccagggccgcatgatacatcttatctttttgatgaatttattaatatgattgatgatttccagcaaaaaagc

SEQ ID NO: 2028 - protein, 358 aa, Streptococcus agalactiae
MKRLLLLEDGSVFEGEAFGADVETSGEIVFSTGMTGYQESITDQSYNGQIITFTYPLIGNYGINRDDYESIRPTCKGVVIYEWAEYPSNWRQQMTLDEFLKLKGIPGISGIDTRALTKIIRKHGTMKACLINEGNSIHEALENLQKSVLLNDQIEQVSTKLAYASPGVGKNIVLVDFGLKHSILRELSQRQCHITVVPHTTTAQEILNLNPDGVLLSNGPGNPEQLPNALQMIQEIQGKIPIFGICMGHQLFAKANGAKTYKMTFGHRGFNHAVRHLQTGQVDFTSQNHGYAVSREDFPEALFITHEEINDKTVEGVRHKYYPAFSVQFHPDAAPGPHDTSYLFDEFINMIDDFQQKS

SEQ ID NO: 2029 - DNA, 1080 bp, Streptococcus pyogenes
atgacaaaacgattacttattttagaagacggcactatttttgaaggagaaccctttggtgctgatattgatgtgactggtgaaattgtctttaatacaggaatgacaggctaccaagaatccatcactgaccaatcctacaatgggcaaattttaacctttacctatcctttgattggaaattatgggattaatcgagatgactatgagtccatttcacccacctgtaaaggggttgttgtgtctgaagtcagtcggttggcaagtaattggcgcaagcaaatgacgctagatgcgttcttgaaaataaaagggattccagggatttcgggaattgatacgagagctttgaccaaaattattcggcaacacggtaccatgaaagctacgatggcagatgatggagatagtatccagcatttaaaagatcaactgcgtgcaacagtcttaccgactaacaccattgaacaagtgtcaactaaaacagcttatcctgcaccagggatcgggaaaaatattgtattggttgattttggtttaaaacattctattttaagagaattttctaaaagacaatgtaatatcaccgttgtccctttcaacatcactgcagaagaagtgctccaactaaatccggatggcttgatgctatctaatggcccaggaaacccagaagatttgccagaggctttagacatgattcgtggggtacaaggtaagattcctatttttggtatttgtatgggacatcaactctttagtctagcaaatggtgctaagacttgtaaaatgacctttggtcatcgtggctttaaccatgccgttagagaaattgcaacgggaagaattgattttaccagtcaaaaccatggttatgccgttgaacgtagtagtctacctgatactttaatggttacgcatgaagacattaacgataagacggtcgaaggagtgaaacatagagattttccagctttttcagtccaatttcaccctgatgcggctccaggacctcatgatgccagctacttatttgacgaatttttggaaatgattgattcttggagatgtacgagtaaa

SEQ ID NO: 2030 - protein, 360 aa, Streptococcus pyogenes
MTKRLLILEDGTIFEGEPFGADIDVTGEIVFNTGMTGYQESITDQSYNGQILTFTYPLIGNYGINRDDYESISPTCKGVVVSEVSRLASNWRKQMTLDAFLKIKGIPGISGIDTRALTKIIRQHGTMKATMADDGDSIQHLKDQLRATVLPTNTIEQVSTKTAYPAPGIGKNIVLVDFGLKHSILREFSKRQCNITVVPFNITAEEVLQLNPDGLMLSNGPGNPEDLPEALDMIRGVQGKIPIFGICMGHQLFSLANGAKTCKMTFGHRGFNHAVREIATGRIDFTSQNHGYAVERSSLPDTLMVTHEDINDKTVEGVKHRDFPAFSVQFHPDAAPGPHDASYLFDEFLEMIDSWRCTSK

SEQ ID NO: 2031 - DNA, 921 bp, Streptococcus agalactiae
atgaatcatcaaacacaaacactttcattagaacattttgtcagtttagaagaattatcaaatcaagaagttatgtctttgataaagagaagtatcgaagttaaagaaaatcctagcaacattggttttgataaagattactatgtgtcaaatctcttttttgagaattcaacaagaacacataagtcatttgaaatggcagaactcaaattaggattaaaaacaattgaatttaatgctgatacaagttctgttaataaaggagaaaccctttatgacactatcttaacaatgagtgctctaggattggacgtttgtgtcattaggcatcctgatattgactattataaagaattgattgctagtccgaacattcattcagctattgtcaatgggggtgatggctcaggccaacatccaagccaatcacttttggatttggtaactatttacgaagaatttggatacttcaaagggctaaaaattgcgattgtaggagatttaactcactcacgggtagctaaatctaacatgcaagtgctaaaacgattaggagctgaaattttcttttctggacccaaagaatggtatagtagtcaattcgatgaatatgggcaatatttaccaatagatcagttagttgatcaaattgatgtccttatgcttttacgtgttcaacacgaacgtcatgatggtaaaggggtgttttcaaaagaaagctatcatcaacaatttggtcttacaaaagaacgctataaacatttaagggatacagcaattattatgcacccagcacccgtcaatagggatgtagagattgctagcgatttggtagaagcagataaggctcgaatagtgaaacagatgagtaatggcgtctatgcaaggatagctatcttagaagcagtgctcaatagcaga

SEQ ID NO: 2032 - protein, 307 aa, Streptococcus agalactiae
MNHQTQTLSLEHFVSLEELSNQEVMSLIKRSIEVKENPSNIGFDKDYYVSNLFFENSTRTHKSFEMAELKLGLKTIEFNADTSSVNKGETLYDTILTMSALGLDVCVIRHPDIDYYKELIASPNIHSAIVNGGDGSGQHPSQSLLDLVTIYEEFGYFKGLKIAIVGDLTHSRVAKSNMQVLKRLGAEIFFSGPKEWYSSQFDEYGQYLPIDQLVDQIDVLMLLRVQHERHDGKGVFSKESYHQQFGLTKERYKHLRDTAIIMHPAPVNRDVEIASDLVEADKARIVKQMSNGVYARIAILEAVLNSR

SEQ ID NO: 2033 - DNA, 987 bp, Streptococcus pyogenes
ttgttgttagaccacttacatagtcatcagtcgttagtgataaaggggataatcatgtcagttgtaaataatcgcgttgcacttaccaatttagtttcaatggaagcattaaccaccgaagaagttttaggtcttatcaaccgtggttcagaatataaggctggtaaagttgttatttcggatcatcaaaaggatcttgttgccaatttattctttgaaaactccacccgaacccataagtcttttgaagtggctgagaagaaactcggcttgacagttcttgatttcaatgctgatgcaagtgcggttaacaagggagaaagtttgtatgatactgtgttaaccatgagtgcacttggaacagacatctgtgtgattcgtcacccagaagatgattattacaaggaattagtagaaagtccaactattacagcttccattgtcaatggaggagatggttctggacaacacccgagtcaatgtttacttgacttattaaccatctatgaagaatttggacgctttgaaggcttaaagattgcgatcgctggtgacttaactcactctagggtggcaaagtccaacatgcaaatcctcaaaagattaggagcagagctttatttctatggacctgaagaatggtattcagaagcctttaatgcttacggcacttatattgctattgaccagattattaaggaattggatgttcttatgttgctgcgtgtacagcacgaacgtcatgacggccatcagagtttttcaaaagaaggttaccatcaagcgtttggattgacacaggaacgttaccaacaattaaaagattctgctattattatgcatccagctccagttaatcgggatgtggaaattgcagatagtttggtggaagctcctaaagcgagaattgtatctcagatggctaatggtgtctttgttcgcatggctattattgaagccattttgaatggtagaaataaaaactca

SEQ ID NO: 2034 - protein, 329 aa, Streptococcus pyogenes
LLLDHLHSHQSLVIKGIIMSVVNNRVALTNLVSMEALTTEEVLGLINRGSEYKAGKVVISDHQKDLVANLFFENSTRTHKSFEVAEKKLGLTVLDFNADASAVNKGESLYDTVLTMSALGTDICVIRHPEDDYYKELVESPTITASIVNGGDGSGQHPSQCLLDLLTIYEEFGRFEGLKIAIAGDLTHSRVAKSNMQILKRLGAELYFYGPEEWYSEAFNAYGTYIAIDQIIKELDVLMLLRVQHERHDGHQSFSKEGYHQAFGLTQERYQQLKDSAIIMHPAPVNRDVEIADSLVEAPKARIVSQMANGVFVRMAIIEAILNGRNKNS

SEQ ID NO: 2035 - DNA, 1314 bp, Streptococcus agalactiae
ttggcaaagttagagaggacagatatgtatatcattaaaaacggattgattatcgaccctcaaagtggttttaatcaagtatcagacatgctgattgatcaaggaaaaattaaacaaatatcgaaagaaattgatattaaaggcattccaatcattgatgcaagcaataaaattgtagctccaggattagtcgatattcatgtacattttcgtgagcctggacagacacataaagaaaatatccatacaggggccctatcagctgcagtaggtggttttacgacagttcttatgatggccaatactaacccaacgatttctagcccagaaattgtaaaacaagttaaggagagtgcagcaaaagaagcaattaagattgaaacagttgctacaattactaaatctctgaatggtaaagatttagttaatttcgaagaactattagaggctggagttgctggattctcagacgatggtattcctttgacagatactaaggttttgcaagaagctatgaacttagctagaaaacatgatgttgtcctatcgttacatgaagaagatccatcgttaaatggtgtccttggtatcaacgaacatattgctcagaaaatttatcatgtctgtggagctagtggtcttgctgaatattcaatgattgcgcgagatgctatgattgcttaccaaacacaggcgaaagtccatatccagcatttgtcaagttcagaatcagtagaagtagttgattttgcgcagaagcttggtgctaacttaacagcagaagtaaccccccaacatttttcaaagacagagaacttacttttaactaagggtgctaatgcaaaattaaacccaccactgcgacttgaaaaggatagacaagccctcattgatggacttaaaagtggtgttatttcaattattgcaagtgaccacgctccccatcatattatggagaaagcagcagataatattagtcaagcgccctctggtatgactggcttagagacatcattagccttagggattacttatttagtatctactaaagaactctcaatgattgactttttggcaaaaatgacatgtaatcctgcacagttatatggatttgatgcaggttatctcagagaaggtggacctgcagatatcgttatttttgatcaagctgaagagagaataataaaggcagaatttgcctccaaatccagcaactctccttttatcggtgataaattgaagggagttattcactacacaatttgcaatggtgaaatagtctatcaaaaagatagccacgcagcgacattggta

SEQ ID NO: 2036 - protein, 438 aa, Streptococcus agalactiae
MAKLERTDMYIIKNGLIIDPQSGFNQVSDMLIDQGKIKQISKEIDIKGIPIIDASNKIVAPGLVDIHVHFREPGQTHKENIHTGALSAAVGGFTTVLMMANTNPTISSPEIVKQVKESAAKEAIKIETVATITKSLNGKDLVNFEELLEAGVAGFSDDGIPLTDTKVLQEAMNLARKHDVVLSLHEEDPSLNGVLGINEHIAQKIYHVCGASGLAEYSMIARDAMIAYQTQAKVHIQHLSSSESVEVVDFAQKLGANLTAEVTPQHFSKTENLLLTKGANAKLNPPLRLEKDRQALIDGLKSGVISIIASDHAPHHIMEKAADNISQAPSGMTGLETSLALGITYLVSTKELSMIDFLAKMTCNPAQLYGFDAGYLREGGPADIVIFDQAEERIIKAEFASKSSNSPFIGDKLKGVIHYTICNGEIVYQKDSHAATLV

SEQ ID NO: 2037 - DNA, 1266 bp, Streptococcus pyogenes
atgatactcatcaaaaatggacgcgttatggacccgaaatcgcagagagatcaagtggcagatgtcttgattgatggtaaacagattgtaaagatagcttcagctattgaatgccaagaagctcaagtgattgatgctagtggtcttattgttgccccgggtttggtcgatattcatgtgcattttagagaacccggtcaaacgcacaaagaagatattcacacgggagccttggcagcagcagcaggtggtgtgactacggttgtcatgatggctaataccaatcctgtcatttcagatgtcgaaactttacaggaagtgctagctagcgcagctaaagaaaagattcatatttacaccaatgccagtgtcacccaagcctttaatggaaaagacgtgactgattttaaagctttgttggaagcaggagcagtaagcttttcagatgatggtattcccttagaaagttctaaagttttaaaagaagcctttgatttggctaatgccaaccaaactttcatttctttgcatgaggaagatcctcagttaaatggggttcttggttttaatgaaggtattgctgaggagcattttcatttttgtggggcaactggtgtagcagaatatagtatgattgcaagagatgtcatgattgcttatgacaggcaagctcatgttcatatccaacatttatctaaagcagaatcggttcaagtagtggcttttgctcagcagttgggtgctaaggtaactgctgaagtgtccccacaacatttttcaacaactgaagatctcttattgatcgcaggtaccagcgccaagatgaatcctccccttcgtacacaaagagatcgcttagctgtcatagaaggcttgaaatcgggtgttatcacagtcattgccactgatcatgctcctcatcacaaggatgaaaaaactgtggatgatatgactaaagccccatctggtatgacaggacttgaaacttctttgtcattaggtttgacgcatttggttgaaccaggtcatcttacacttatgtcactattagaaaaaatgacgcttaatccagctttgctttatggttttgatgcgggttatttggcagaaaatggtccagcagatttggttatttttgcagacaagcaagaacgtctgatcactgagaattttgcttctaaagctagtaattccccatttattggtaacaaactcaaaggtgtcgtgaaatacactattgcagacggagaggttgtttaccctaat

SEQ ID NO: 2038 - protein, 422 aa, Streptococcus pyogenes
MILIKNGRVMDPKSQRDQVADVLIDGKQIVKIASAIECQEAQVIDASGLIVAPGLVDIHVHFREPGQTHKEDIHTGALAAAAGGVTTVVMMANTNPVISDVETLQEVLASAAKEKIHIYTNASVTQAFNGKDVTDFKALLEAGAVSFSDDGIPLESSKVLKEAFDLANANQTFISLHEEDPQLNGVLGFNEGIAEEHFHFCGATGVAEYSMIARDVMIAYDRQAHVHIQHLSKAESVQVVAFAQQLGAKVTAEVSPQHFSTTEDLLLIAGTSAKMNPPLRTQRDRLAVIEGLKSGVITVIATDHAPHHKDEKTVDDMTKAPSGMTGLETSLSLGLTHLVEPGHLTLMSLLEKMTLNPALLYGFDAGYLAENGPADLVIFADKQERLITENFASKASNSPFIGNKLKGVVKYTIADGEVVYPN

SEQ ID NO: 2039 - DNA, 627 bp, Streptococcus agalactiae
atggatttagcaagacagattgccatggaactattagatattcaagctgtttacttaagaccccaacaaccctttacttgggcttcgggggtcaaatcgccaatttacactgataatcgtgtaaccttatcgtatcctgagacaaggacactgattgaaaatggttttgttaaacaaatacagaaacatttcccaaacgttgatatcatagcagggacagcgactgcaggcataccacatggcgctattatagctgataagatgaacttgccctttgcctatatacgatcgaaggcaaaggatcatggtgtggggaatcaaatcgagggacgtgtttactcaggccaaaaaatggttatcattgaagatttgatttcaacaggaggatctgttttagaggctgttacggctgcgcagagtcaaggtattgaggttttaggggtagtagcgatatttacatatcaattagctaaggctgaacaagcatttcgtgaagctgatattcctttggtgactttgacggattacaatcaattaattaaagttgctaaagttaatggatatattacagctgaccaactggtattactgaaaaaatttaaagaagatcaaatgaattggcaaagt

SEQ ID NO: 2040 - protein, 209 aa, Streptococcus agalactiae
MDLARQIAMELLDIQAVYLRPQQPFTWASGVKSPIYTDNRVTLSYPETRTLIENGFVKQIQKHFPNVDIIAGTATAGIPHGAIIADKMNLPFAYIRSKAKDHGVGNQIEGRVYSGQKMVIIEDLISTGGSVLEAVTAAQSQGIEVLGVVAIFTYQLAKAEQAFREADIPLVTLTDYNQLIKVAKVNGYITADQLVLLKKFKEDQMNWQS

SEQ ID NO: 2041 - DNA, 627 bp, Streptococcus pyogenes
atgacactagcaagccaaattgcaactcaattacttgatattaaagctgtttatttaaagcctgaagacccttttacgtgggcatctggcattaaatcacctatttacactgataatcgtgtcaccctttcttatcctaagactcgtgatttaattgagaatgggtttgtggaaactatcaaggctcatttcccagaagttgaggtcatcgctggtacagctacagcaggtattcctcacggtgccattatagcagataaaatgactcttccttttgcttatattcgcagtaagccaaaagatcatggagcaggcaaccagattgaggggcgtgtgcttaaaggccaaaaaatggttatcattgaagatttgatttcaacaggtggttcggtactagatgcagccgcagcagccagtcgtgagggagctgacgttctgggagttgttgcgattttcacttatgagttaccaaaagctagtcagaattttaaagaagctggtatcaagttgattacgctttctaattatactgagctaattgcagttgcaaagttgcaaggctatattactaatgatggtttacatttacttaaaaaatttaaagaagaccaggtaaactggcaacaa

SEQ ID NO: 2042 - protein, 209 aa, Streptococcus pyogenes
MTLASQIATQLLDIKAVYLKPEDPFTWASGIKSPIYTDNRVTLSYPKTRDLIENGFVETIKAHFPEVEVIAGTATAGIPHGAIIADKMTLPFAYIRSKPKDHGAGNQIEGRVLKGQKMVIIEDLISTGGSVLDAAAAASREGADVLGVVAIFTYELPKASQNFKEAGIKLITLSNYTELIAVAKLQGYITNDGLHLLKKFKEDQVNWQQ

SEQ ID NO: 2043 - DNA, 753 bp, Streptococcus agalactiae
ttgtgtcatactggtacatttccaacaattattatttctatagagaggaattatatgttagaaaaatgccctatcattgccttagatttttctgatttggcttctgtaacaacttttttagaacattttccaaaagaagaattgctttttgtcaaaataggaatggagctttattattccgaaggtccctcaattattagatatattaaatccttaggacatcgcatttttttggatttaaaattacatgatatccctaatacagttcgatcatctatgtctgtcttagccaaattaggcattgatatgactaatgtgcatgctgcaggaggagtcgaaatgatgaaagcagctagagaaggtttggggaagggtccaatactattagcagtgacacaattaacctcgacttcacaagaacaaatgcaggtggatcaacatattaacttaagtgtagttgattcggtttgccattatgctcaaaaagctcaagaagcaggcttagatggagtagtcgcatcggctcaagagggaatgcaaatcaagaaacagactaacgaacatttcatttgcttaacgcctggtatcagacctccacaaaccaatcagttagatgatcaaaaaagaacgatgactcctgagcaagcacgtatagttggggctgattatatcgttgtgggaagacctataacgaaagcagaaaatccatatcaagcatatctagagataaaagaagaatggaatcgtattaaa

SEQ ID NO: 2044 - protein, 251 aa, Streptococcus agalactiae
MCHTGTFPTIIISIERNYMLEKCPIIALDFSDLASVTTFLEHFPKEELLFVKIGMELYYSEGPSIIRYIKSLGHRIFLDLKLHDIPNTVRSSMSVLAKLGIDMTNVHAAGGVEMMKAAREGLGKGPILLAVTQLTSTSQEQMQVDQHINLSVVDSVCHYAQKAQEAGLDGVVASAQEGMQIKKQTNEHFICLTPGIRPPQTNQLDDQKRTMTPEQARIVGADYIVVGRPITKAENPYQAYLEIKEEWNRIK

SEQ ID NO: 2045 - DNA, 690 bp, Streptococcus pyogenes
atgaaagaagaacgcccaattattgctttagacttttcatcatttgaggagactaaagcatttttagacttatttccagcagaagaaaaactatacgtgaaaattggtatggaattatattatgcgcaaggaccagatattgttcggtatatcaaatcgttagggcataatgtatttttggatttaaaattacatgatattccaaatactgttcgtgctgctatggcagttcttaaagaattagatattgatatggcaactgttcatgcagctggtggtgtagagatgctaaaagcagctcgagaaggactaggtcaaggccctaccttaattgcggtaacgcagctaacttcaaccagtgaagaccaaatgcgtggtgatcaaaatattcaaacgagtcttttagagtctgttttgcattacagcaagggggcagctaaagctcagctagatggggcggtttgttcggcacaagaagtagaagctatcaaggcggtgacgcctacgggatttacttgcttaactcctggcattcgtcctaaaggcagtaatattggcgatcaaaaacgagtgatgactccaaaccaagcaagacgcattggaagtgattatattgtggtagggcgaccaattacccaggcaaaagacccagtggctgcttaccaagccataaaagctgagtgggcaggc

SEQ ID NO: 2046 - protein, 230 aa, Streptococcus pyogenes
MKEERPIIALDFSSFEETKAFLDLFPAEEKLYVKIGMELYYAQGPDIVRYIKSLGHNVFLDLKLHDIPNTVRAAMAVLKELDIDMATVHAAGGVEMLKAAREGLGQGPTLIAVTQLTSTSEDQMRGDQNIQTSLLESVLHYSKGAAKAQLDGAVCSAQEVEAIKAVTPTGFTCLTPGIRPKGSNIGDQKRVMTPNQARRIGSDYIVVGRPITQAKDPVAAYQAIKAEWAG

SEQ ID NO: 2047 - DNA, 1230 bp, Streptococcus agalactiae
atgcaaaatgatatgagcgttgttcttagagcaggtaaattactgattgaaagcggagcagaagtctatcgtgtcgaagacacaatgaagcattttgctaaggctcttcagatagaaaattttgaagcttatgtggttagtagcagtattatcgcttccgggattaaccgctatggtaaacaagaagctaaagtatgcaatacagatggtgtaacagcaaatttaggtagacttgaagctgttaataacctttctaggcaaattgctaaacaagacttagtatctccagaagaaattgtaaagcagttagacttaattgaacatcaaaaagattatagtttacttgttactttaatttcttatttttgtggagcgggtagtttttctttagccttaggtagttccttattagattcattttccgctgctgtaacaggcttaattttaggatattttctgaatttgatggaaagtcgtatacatacaggatttcttttgaccattctaggtagttctgtagtggctttaagtgctaatttattatatttttcaggattaggtgagcatcgtagcattattatattaggggcactaatggttatggtgccaggggctgcctttgttaattcggtgagagaattttcacagaataatttttcaacaggtttagctttgattatgtctgctttactcatttgtatttctatatcagcaggtgtggctattacaattgaaattattccgtttgcagaacaaatgacaggttctttttctggtgttcctaataccatccttgagattatcatcagaacactaatggccggtttagggacgatagccttctctattctctaccatgttccaaaacgttatttccttgacttaggtatactaggagcaatatcttggatgctctacctgatcttatggcaacaatttcacatggatgctatagccgtattttttccagggcttttcatcacttatttttcacggctattagctgctaaacgtaagtgtcctgccactgtctttttagcgacaagtatgtttcctcttattccaggacttagcttctatagagctgtttactttttattgacgggagcagatgccgtagcaatggaatattttagatcctgttttgtaacagcttttacaattgctatagcaatcagtattgtacagcagattcctctatcgttctttattagacgtaaaatgataaaa

SEQ ID NO: 2048 - protein, 410 aa, Streptococcus agalactiae
MQNDMSVVLRAGKLLIESGAEVYRVEDTMKHFAKALQIENFEAYVVSSSIIASGINRYGKQEAKVCNTDGVTANLGRLEAVNNLSRQIAKQDLVSPEEIVKQLDLIEHQKDYSLLVTLISYFCGAGSFSLALGSSLLDSFSAAVTGLILGYFLNLMESRIHTGFLLTILGSSVVALSANLLYFSGLGEHRSIIILGALMVMVPGAAFVNSVREFSQNNFSTGLALIMSALLICISISAGVAITIEIIPFAEQMTGSFSGVPNTILEIIIRTLMAGLGTIAFSILYHVPKRYFLDLGILGAISWMLYLILWQQFHMDAIAVFFPGLFITYFSRLLAAKRKCPATVFLATSMFPLIPGLSFYRAVYFLLTGADAVAMEYFRSCFVTAFTIAIAISIVQQIPLSFFIRRKMIK

SEQ ID NO: 2049 - DNA, 879 bp, Streptococcus agalactiae
ttgaacgatgttatcaatattgtctatcatgttgaaaatcaagatttagtaagatattccggtgattatactaattttgaatcagtctatgcaatgaaaaaggctcaattagaagcagcctatgaacgtcaacaaaaggaaatagctgatttacaagattttgttaatcgtaataaagcacgcgtcgcaacacgtaatatggcaatgtctcgtcaaaagaaactagacaaaatggatattattgagttacaagcagagaaaccaaagccaagtttcgaatttaaagaatctcgcacaccaggacgttttattttccaagctaaagatcttcaaattggatatgatcgtgctttaacaaaacctctaaacctaacatttgaacgtaatcaaaaaatagctattgttggagcaaatgggataggaaaaacaacattacttaagagtttactaggtattatcccccctatttctggtaatgttgaacgaggtgattttattgatttaggttattttgaacaagaagtacccggaggaaatcgccaaactccactcgaagcagtatgggatgcttttcctgctttgaaccaagcagaggttagggcagctcttgctcgttgtggtttaacttcaaagcatattgaaagtcagattcaggtgttatctggtggggagcaatcaaaggtcagattttgcttattaatgaatcgcgaaaataatgtccttgtacttgacgaaccaaccaatcatttagatgtagatgctaaagatgagttaaaacgtgctttaaaagcttataagggatcaatcttgatggtatgtcatgaaccggacttttatgaaggatggatggatgatgtttgggactttaaccaacttagt

SEQ ID NO: 2050 - protein, 293 aa, Streptococcus agalactiae
MNDVINIVYHVENQDLVRYSGDYTNFESVYAMKKAQLEAAYERQQKEIADLQDFVNRNKARVATRNMAMSRQKKLDKMDIIELQAEKPKPSFEFKESRTPGRFIFQAKDLQIGYDRALTKPLNLTFERNQKIAIVGANGIGKTTLLKSLLGIIPPISGNVERGDFIDLGYFEQEVPGGNRQTPLEAVWDAFPALNQAEVRAALARCGLTSKHIESQIQVLSGGEQSKVRFCLLMNRENNVLVLDEPTNHLDVDAKDELKRALKAYKGSILMVCHEPDFYEGWMDDVWDFNQLS

SEQ ID NO: 2051 - DNA, 1578 bp, Streptococcus pyogenes
ttgacggcttttttgatgacagttaaggaagaaacgatgagtattttagaagttaagcagttgagtcacggttttggggatcgggctatttttgaaaatgtgtcatttcgcctcttaaaaggcgaacatattggactagttggggcaaatggtgaaggaaaatcaacctttatgagtatagtcacaggacatttacagcctgacgaaggaaaagtagagtggtcgaagtatgtcactgcaggttacctggatcaacatacagtgttggaatcaggacaaaccgttcgtgatgtcttgcgaactgcttttgatgagttatttaagaccgagaatcgtattaatgagatttacgcgtcaatggcagatgataaagctgatattgctgttttgatggaagaagtaggtgagcttcaagatcgtttagaaagtcgtgatttctatactttggatgctaagattgatgaagtagcgcgtgcgcttggtgttatggattttggaatggagtcagatgttacatccttatcaggtgggcaacgaacaaaggttttattagccaaattactattagaaaaacctgatattctgctattagatgaaccaactaaccatttggatgctgagcatattgaatggttaaaacgctatttacaacattatgaaaatgcttttgtgttgatttcgcatgatatttctttcttaaatgatgtgattaatattgtttatcatgttgaaaatcaaagtttagttcgctatactggggattattaccaatttcaagctgtttatgagatgaaacaatctcaacttgaagcagcctatgaacgtcaacaaaaagagattgctaacttgcaggattttgtcaaccgaaataaggctcgggtagcgacacgtaacatggcaatgtctcgccaaaaaaaacttgataagatggatataattgaacttcaagctgagaaaccaaaaccaaattttgaatttaagcaagctagaactcccagtcgattcatttttcaaacaaaaaatcttgtgattggttatgattacccattgaccaaagaacccttaaatataacgtttgaaagaaatcaaaaaattgctattgttggggccaacggtattggaaaatctactttgctaaaaagtttattaggtgttattgagcctttagaaggtcatattgtcacaggggattttttagaagttggctactttgaacaagaagtgacaggtgttaaccgacaaactccgctagaagtagtttgggatgcttttcctgccttaaatcaggcagaagttcgagcggcactagctcgttgcggactaacatcaaaacatatcgaaagtcaaattcaagtactttcgggtggtgaacaagcaaaagttcgtttttgtttgttgatgaatcgtgaaaataacgtgcttattttagacgaaccaacaaatcatcttgatattgatgctaaaaatgagctcaaacgtgctttaaaagcatataagggttctattttaatggtttgtcatgaacctgatttctacaatgggtgggtaaccgatacttgggattttagtaagttaacc

SEQ ID NO: 2052 - protein, 526 aa, Streptococcus pyogenes
LTAFLMTVKEETMSILEVKQLSHGFGDRAIFENVSFRLLKGEHIGLVGANGEGKSTFMSIVTGHLQPDEGKVEWSKYVTAGYLDQHTVLESGQTVRDVLRTAFDELFKTENRINEIYASMADDKADIAVLMEEVGELQDRLESRDFYTLDAKIDEVARALGVMDFGMESDVTSLSGGQRTKVLLAKLLLEKPDILLLDEPTNHLDAEHIEWLKRYLQHYENAFVLISHDISFLNDVINIVYHVENQSLVRYTGDYYQFQAVYEMKQSQLEAAYERQQKEIANLQDFVNRNKARVATRNMAMSRQKKLDKMDIIELQAEKPKPNFEFKQARTPSRFIFQTKNLVIGYDYPLTKEPLNITFERNQKIAIVGANGIGKSTLLKSLLGVIEPLEGHIVTGDFLEVGYFEQEVTGVNRQTPLEVVWDAFPALNQAEVRAALARCGLTSKHIESQIQVLSGGEQAKVRFCLLMNRENNVLILDEPTNHLDIDAKNELKRALKAYKGSILMVCHEPDFYNGWVTDTWDFSKLT

SEQ ID NO: 2053 - DNA, 246 bp, Streptococcus agalactiae
ttgacgctgtctggttgtgctaattggattgataaaggtcaatcaatcaccagcgttggttcaaccgccttacagccacttgtagaagctgcagcagatgagtttggtaagacaaacctcggtaagactatcaatgtccaaggaggaggctcaggaacaggcttatcacaagtacagtctggagctgttcaaattggtaatagcgacttatttgcagaagaaaaagaggtattgatgctaagaaat

SEQ ID NO: 2054 - protein, 82 aa, Streptococcus agalactiae
MTLSGCANWIDKGQSITSVGSTALQPLVEAAADEFGKTNLGKTINVQGGGSGTGLSQVQSGAVQIGNSDLFAEEKEVLMLRN

SEQ ID NO: 2055 - DNA, 567 bp, Streptococcus agalactiae
ttgaaagaccatcaagtcgcagtagctggattagctgttattgttaataaaaaagttaatgttaaaaatctaaccacccaccaacttcgtgatatttttgcaggaaaaatcaagaattggaaagaagtgggaggacaagatttagatatttccatcatcaatcgagcagcaagttctggatcccgtgcaaccttcgataatactattatgggaaatgttgctcctattcaaagccaagaacaagattcaaatggtatggtgaaatcaattgtttctcaaacacctggtgcgatttcatacctcgcttttgcatacgttgataaatctgtcggaacattaaaactaaatggttttgcgccaacagctaaaaatgttactaccgacaactggaaactttggtcatatgaacatatgtatacaaaaggtaatgaaacaggtctaacaaaagaattcttagactacatgaaaagtgataaagttcaaagtagtatcgtacaacatatgggatatatctctattaacgacatgaaagttgttaaagatgctgaaggtaaagtaaccccaaaa

SEQ ID NO: 2056 - protein, 189 aa, Streptococcus agalactiae
MKDHQVAVAGLAVIVNKKVNVKNLTTHQLRDIFAGKIKNWKEVGGQDLDISIINRAASSGSRATFDNTIMGNVAPIQSQEQDSNGMVKSIVSQTPGAISYLAFAYVDKSVGTLKLNGFAPTAKNVTTDNWKLWSYEHMYTKGNETGLTKEFLDYMKSDKVQSSIVQHMGYISINDMKVVKDAEGKVTPK

SEQ ID NO: 2057 - DNA, 933 bp, Streptococcus agalactiae
ttgatcctaggaggaattatgaaaaatcaagaattagctaaaaaattaacatctccttcaaaaaactctcgattagaaaaatttggtaaaggaataacttttctttcgcttgccctaatcgtcttcattgttgcgatgattttgatttttgttgctcaaaaaggactatctacattttttgttgatggcgttaaattaacagacttcttatttaatacaaaatgggaaccaagtgctaagtcatttggtgcttttccaatgatagctggatcatttattgttactattctatcagctatcattgctacaccatttgctatcggtgctgccgtatttatgactgaaatctcacctaaatatggttctaaaattttacaacctgcagttgaattactagttgggattccttctgttgtttacggttttattggtttacagattattgttcccttcgttcgctctatttttgggggaacaggttttggcattttatctggggtctgtgtcctcttcgtcatgattctaccaactgttactttcatgacagtagatagccttagagctgtgccacgtcactataaagaagcaagtttagccatgggggcaactcgttggcaaacaatttggcgtgttatattaaacgctgcacgtccaggaattttcactgcaattgtttttggtatggcacgtgcatttggtgaagctctagcaattcagatggttgtcggaaactctgcaattttaccaacgtcattgacaacaccagcagcaacattaacgtctgttctaacaatgggtattggtaatactgtaatgggaactgtacaaaacaatgtcctctggtcgctagccttagtacttttaattatgagtttagcatttaatacagttattaagttaattacaagggaaggaaagaaaaactatgaacgc

SEQ ID NO: 2058 - protein, 311 aa, Streptococcus agalactiae
MILGGIMKNQELAKKLTSPSKNSRLEKFGKGITFLSLALIVFIVAMILIFVAQKGLSTFFVDGVKLTDFLFNTKWEPSAKSFGAFPMIAGSFIVTILSAIIATPFAIGAAVFMTEISPKYGSKILQPAVELLVGIPSVVYGFIGLQIIVPFVRSIFGGTGFGILSGVCVLFVMILPTVTFMTVDSLRAVPRHYKEASLAMGATRWQTIWRVILNAARPGIFTAIVFGMARAFGEALAIQMVVGNSAILPTSLTTPAATLTSVLTMGIGNTVMGTVQNNVLWSLALVLLIMSLAFNTVIKLITREGKKNYER

SEQ ID NO: 2059 - DNA, 147 bp, Streptococcus agalactiae
ttgtataattgtattccaataccgcctcctgcttcatatgatgatgatttcccagttaaaaatgaccaagatacgtgtggcaatccgcgaacaagaataaaaattaaaagagaggcgaggattgtaacgatgatagctgcaatacta

SEQ ID NO: 2060 - protein, 49 aa, Streptococcus agalactiae
MYNCIPIPPPASYDDDFPVKNDQDTCGNPRTRIKIKREARIVTMIAAIL

SEQ ID NO: 2061 - DNA, 885 bp, Streptococcus agalactiae
atgaacgctaaaaaggctgacaaattagcaactacaatactctatagtattgcagctatcatcgttacaatcctcgcctctcttttaatttttattcttgttcgcggattgccacacgtatcttggtcatttttaactgggaaatcatcatcatatgaagcaggaggcggtattggaatacaattatacaattcctttttcctacttattgttactctgattatttctattcctctatctttaggagctggaatatacctctcagaatatgctaaaaaaggacgtttaacaaactttgttagaacatgtatcgaaattttgtcatctcttccttctgttgtagttggtctgtttggttacctaatcttcgttgttcaatttcaatatggcttctcaattatctcaggtgccttagcacttactgtttttaacttaccccaaatgacacgtagtgttgaagatagccttcaaaatgtacaccacacacagcgtgaagcaggattggccctaggtatttctcgttgggaaacggtcatttacgtcgttgtccctgaagctctgccaagtattgtaactggtgttgtgctagcttcaggacgtattttcggtgaggcagcagcacttatttatacagctggtcaatctgctccagcacttgattggtcaaattggaacgtccttagtgttacaagtccaatctcaattttccgtcaagcagaaactttagctgttcatatttggaaagttaatagcgaagggacaatccctgatgcaacacaagtatctgccggtagcgccgcagtcttattggttgttattcttattttcaacctttcagctcgctcgatcggtaagaaacttcattcgaaattaacctcgtctaat

SEQ ID NO: 2062 - protein, 295 aa, Streptococcus agalactiae
MNAKKADKLATTILYSIAAIIVTILASLLIFILVRGLPHVSWSFLTGKSSSYEAGGGIGIQLYNSFFLLIVTLIISIPLSLGAGIYLSEYAKKGRLTNFVRTCIEILSSLPSVVVGLFGYLIFVVQFQYGFSIISGALALTVFNLPQMTRSVEDSLQNVHHTQREAGLALGISRWETVIYVVVPEALPSIVTGVVLASGRIFGEAAALIYTAGQSAPALDWSNWNVLSVTSPISIFRQAETLAVHIWKVNSEGTIPDATQVSAGSAAVLLVVILIFNLSARSIGKKLHSKLTSSN

SEQ ID NO: 2063 - DNA, 801 bp, Streptococcus agalactiae
atggcagaatataattgggacgaacgccatatcattaccttccctgaagaaaattcagctctcaccacaaaagatttacacgtttactacggtgagaaagaagctatcaagggaattgatatgcaatttgaaaaaaataaaattacagccttaatcggcccatctggatgtggaaaatcaacatatcttcgtagcttaaatcgtatgaatgatacgattgatattgcacgcgtgactggacaaatcatgtatgaaggaattgatgttaacgctcaagatatcaatgtttacgagatgcgaaaacatatcggaatggttttccaacgtccaaacccgtttgcaaaatcaatttataaaaacattacctttgcatatgagcgtgctggtgtaaaagataaaaaattcttagatgaagttgtcgaaacctcactaaaacaagctgctctatgggatcaagtaaaagatgaccttcataaatcagcattcactttatctggcggtcaacagcagcgattatgtattgcacgtgctatcgcagttaaaccagaaattctcttaatggatgaacctgcttcagcactcgatccgattgcaactatgcaactagaagagacaatgtttgaactcaagaaaaattacactataattatcgtaacacataatatgcaacaagcagcacgtgctagtgattatactgcatttttctatcttggagacttaatcgaatacgataaaacgaataacattttccaaaatgctaaatgtcaatctactagcgattatgtttctggtcgatttgga

SEQ ID NO: 2064 - protein, 267 aa, Streptococcus agalactiae
MAEYNWDERHIITFPEENSALTTKDLHVYYGEKEAIKGIDMQFEKNKITALIGPSGCGKSTYLRSLNRMNDTIDIARVTGQIMYEGIDVNAQDINVYEMRKHIGMVFQRPNPFAKSIYKNITFAYERAGVKDKKFLDEVVETSLKQAALWDQVKDDLHKSAFTLSGGQQQRLCIARAIAVKPEILLMDEPASALDPIATMQLEETMFELKKNYTIIIVTHNMQQAARASDYTAFFYLGDLIEYDKTNNIFQNAKCQSTSDYVSGRFG

SEQ ID NO: 2065 - DNA, 756 bp, Streptococcus agalactiae
atgacacaacctattttacaagtcagtgatttgtctgtttactataataagaaaaaagctttaaaagaagtctcaatggacttctatcctaatgaaattacagccttaattggtccgtctggttctggaaagtcaacactcttacgagctattaaccgtatgggagacttaaatcctgaagtcactctaacaggagcagtgatgtataacggacataatgtttatagcccgcgcactgataccgtagaacttcgtaaagaaattgggatggtttttcagcagcctaatccatttcctatgtcagtatttgaaaatgttgtttatggtcttagactcaaaggaataaaagacaaagctacgttagatgaagccgtagagacttcattgaagggcgcgtctatctgggacgaggtcaaagatagattacacgactctgctcttggtttatctggtggtcaacaacaacgtgtttgtattgccagaacccttgctaccaagcctaaaattatccttctagatgagccaacctctgcacttgacccaatttctgctggtaaaattgaagagactttacatggtctaaaagatcaatataccatgttacttgttacacgttctatgcagcaagcctcacgtatttctgatcgtacaggtttcttcttagacggtaacttaattgaatatggcaatacaaaagaaatgtttatgaatcctaaacataaagaaactgaagattacattacaggtaaattcggt

SEQ ID NO: 2066 - protein, 252 aa, Streptococcus agalactiae
MTQPILQVSDLSVYYNKKKALKEVSMDFYPNEITALIGPSGSGKSTLLRAINRMGDLNPEVTLTGAVMYNGHNVYSPRTDTVELRKEIGMVFQQPNPFPMSVFENVVYGLRLKGIKDKATLDEAVETSLKGASIWDEVKDRLHDSALGLSGGQQQRVCIARTLATKPKIILLDEPTSALDPISAGKIEETLHGLKDQYTMLLVTRSMQQASRISDRTGFFLDGNLIEYGNTKEMFMNPKHKETEDYITGKFG

SEQ ID NO: 2067 - DNA, 759 bp, Streptococcus pyogenes
atgatgacagaacctattttacagatcagagacctttctgtttactacaatcaaaagaaaacgttaaaagatgtctctttggacctttatccaaatgaaataacagctttaattggtccttctggatctgggaaatcaacgctcttgcgttctatcaaccgtatgaatgatttgaatcctgaagtaaccattacaggctctatcgtctataacggacacaatatttatagtccaaggacagatacggttgatttacgcaaagaaattggtatggtattccaacaacccaacccatttccgatgtctatttatgagaacgtggtttacggccttcgcttaaaaggtatcagagataaatcaatcttagaccatgctgttgaaagctctcttaaaggggcttccatttggaatgaagtcaaagatcgtttacatgattctgcggttggcttatcaggcggacagcaacagagagtttgcatagctagagttcttgctaccagccccagaataatccttttagatgaacctacctcagctcttgatcctatctcagctgggaaaattgaagaaacattattgttattaaaaaaagattatacactggctattgtgacccgctcaatgcagcaagcctcacgtttatcagatcgaacaggttttttcttggagggtgacttacttgagtgtggtcctacaaaagccatgtttatgaatcctaagcgcaaagaaaccgaagactatatttctggtaaatttggt

SEQ ID NO: 2068 - protein, 253 aa, Streptococcus pyogenes
MMTEPILQIRDLSVYYNQKKTLKDVSLDLYPNEITALIGPSGSGKSTLLRSINRMNDLNPEVTITGSIVYNGHNIYSPRTDTVDLRKEIGMVFQQPNPFPMSIYENVVYGLRLKGIRDKSILDHAVESSLKGASIWNEVKDRLHDSAVGLSGGQQQRVCIARVLATSPRIILLDEPTSALDPISAGKIEETLLLLKKDYTLAIVTRSMQQASRLSDRTGFFLEGDLLECGPTKAMFMNPKRKETEDYISGKFG

SEQ ID NO: 2069 - DNA, 651 bp, Streptococcus agalactiae
atgttaagatcaaaatttgatgaagaattagataaactgcataaccaattctatgcaatgggaattgaagctatcggacaaatcaaaaaaacagttcgtgcttttgtcagtcatgatcgagagttagctaaagaagtgatagaagatgatgtaacgcttaacaactttgaaacgaagttagagaaaaaatcattggaaattattgcactccagcagcctgtatcacaagacttacgcaccgttattaccgttttaaaagctactagtgatgttgagcgtatgggagaccatgcagcagcagttgcaaaagcaaccatccgtatgaagggcgaggaaagaatcccagcagtagaattagaaatcaataatatgggaaaagcagttaaaaacatgcttgaagaagccttaacagcttatatcaatggtgatgatgaaaaagcttacgaagtagcagcaatggatgaaatagttgatgattacttccgtgatatccaaaaaatggtagttgaaacaattcaaaagcatcctgacgtagcatttgccgccaaagaatacttccaagtattgatgcacttggagcgaattggagattatggcaaaaatatctgtgaatggattgtttatttaaaaactggaaaaattatcgagtta

SEQ ID NO: 2070 - protein, 217 aa, Streptococcus agalactiae
MLRSKFDEELDKLHNQFYAMGIEAIGQIKKTVRAFVSHDRELAKEVIEDDVTLNNFETKLEKKSLEIIALQQPVSQDLRTVITVLKATSDVERMGDHAAAVAKATIRMKGEERIPAVELEINNMGKAVKNMLEEALTAYINGDDEKAYEVAAMDEIVDDYFRDIQKMVVETIQKHPDVAFAAKEYFQVLMHLERIGDYGKNICEWIVYLKTGKIIEL

SEQ ID NO: 2071 - DNA, 2547 bp, Streptococcus agalactiae
atgaaaactgtagaacattttgttaccaaatttgtccctgaaaactataaccttttcttggatattaatcgtcaaactaaaaccttttcaggtaacgttgctgtgtctggcgaagccttagataacaatatctcttttcaccaaaaagggttaaccattaaatctgtcttattagataatcaaccattagatttccaactagatgaagacaatgaagctatgcatattcaattgcatgaaactggtagcatggtattagtctttgaattcagcggtcacattaccgataatatgacaggtatgtatccatcttactatacagttaatggcatcaaaaaagaggttatctccacacaatttgaaagtcattttgctcgtgaagtattcccaagtattgacgaaccagaagcaaaagcaacctttgatttgagcctaaaattcgatcaaaaagaaggagagattgctctttcaaatatgccggaaatcaatgctgaacaacgtcaagaaacaggtttatggacatttgacaccacacctaaaatgtcctcatatttattagcttttgccttgggggaattgcatggtaaaacaacacataccaaaaacggcactcttgttggctcatatgccacaaaagcccatcagttaaatgaattagatttttctttagatatcgttgtgcgtgttattgagttttatgaggactactttggtgtacgttatcctattcctcagtcactccacgttgctctacctgatttttctgctggagctatggaaaattggggattagtaacatatcgtgaagtctatcttttagtagatgagaactctagtgtttccagccgtcagcaagtagcattagttgtagcacatgaaatagctcaccagtggtttggtaacctcgttactatgaaatggtgggatgatttatggttaaatgaatcatttgctaatatgatggaatatgtatcaattgattatattgaaccaaaacttaatatatttgaagactttcaaacaggtggtctaccattagctcttaagcgtgatgccacagatggcgtccaatctgttcacgttgaggtcaatcatcctgatgaaattaacacactttttgatccagctatcgtttatgcaaaaggtagccgcctcatgcacatgttacgtcgctggttaggcgatacagattttgccgcaggactaaaaatttattttgaaaaacatcaatatcaaaatactattggtcgtgacctttggaatgcactttctcaaacctcaggaaaagatgttgcagctttcatggattcttggttagagcaaccaggataccctgtgatggcagccaaaatagaagaagatgagctcattttaactcaaaaacaattctttattggtgaacacgaagataagtctcgcttgtggcaaattcctcttaatagtaattgggaaggaatcccagagatattaaccgaggaaacggtagtaatccccaattttagtcagttagctgaaaagaacaaagaaaatggtgcactgcgtttcaatactgaaaatactgcacattacattactaactatcaaggtcaactcttagagcatatcatttctgatcttcctcttatggataacatttctaaactacaaattgtacaagaacgtcatttacttgctgaaagtggtatgatttcatatagtagtttaatacctttagtctctcttttgagccaagagacatcatatcttgttaactctgctattaagagtgttattgatggtttatccttattcgtccaggaagatagccaagatgaattcgactttaaagaatttgttaataaattatcagcatttaattttaatagacttggctttgaaaaaagagaaggagaaggagatgatagcgaaatggtccgtcatctatccctaagccttgctctctactcagataatgaacatgctattgaagaagctcaccatatttttaaagcccacgaaaataatatcgctgctataccagctgcaattcgcctgttagttcttaccaatgaaatgaagcatttcgaatccaaagaacttagccacttgttattagagacttatagtactactaccgatgggaatttcaaacgacaactagcgagtgctttatctcatactacagatagcaagacactcaagaaattattgtcagattggaaaaataaagatattgtgaaaccacaagacttagctatgagttggtatgctactttccttaaaaattcttttacacaagaaagtgtctgggagtgggcccaagaaaactgggaatggatcaaagcaactctaggtggtgatatgagttttgataaatttgtgatttatccctcaagtagtttcaaaacagaagaacgccttgaacaatataaaaactttttcgagcctcaattaagcgatatggcgattagccgtaatatttcaatgggaattaaagaaatttctgctcgtgtccttttaatcacgaagcaaaaagaagaagttatcaatactatcaaaaaatatatc

SEQ ID NO: 2072 - protein, 849 aa, Streptococcus agalactiae
MKTVEHFVTKFVPENYNLFLDINRQTKTFSGNVAVSGEALDNNISFHQKGLTIKSVLLDNQPLDFQLDEDNEAMHIQLHETGSMVLVFEFSGHITDNMTGMYPSYYTVNGIKKEVISTQFESHFAREVFPSIDEPEAKATFDLSLKFDQKEGEIALSNMPEINAEQRQETGLWTFDTTPKMSSYLLAFALGELHGKTTHTKNGTLVGSYATKAHQLNELDFSLDIVVRVIEFYEDYFGVRYPIPQSLHVALPDFSAGAMENWGLVTYREVYLLVDENSSVSSRQQVALVVAHEIAHQWFGNLVTMKWWDDLWLNESFANMMEYVSIDYIEPKLNIFEDFQTGGLPLALKRDATDGVQSVHVEVNHPDEINTLFDPAIVYAKGSRLMHMLRRWLGDTDFAAGLKIYFEKHQYQNTIGRDLWNALSQTSGKDVAAFMDSWLEQPGYPVMAAKIEEDELILTQKQFFIGEHEDKSRLWQIPLNSNWEGIPEILTEETVVIPNFSQLAEKNKENGALRFNTENTAHYITNYQGQLLEHIISDLPLMDNISKLQIVQERHLLAESGMISYSSLIPLVSLLSQETSYLVNSAIKSVIDGLSLFVQEDSQDEFDFKEFVNKLSAFNFNRLGFEKREGEGDDSEMVRHLSLSLALYSDNEHAIEEAHHIFKAHENNIAAIPAAIRLLVLTNEMKHFESKELSHLLLETYSTTTDGNFKRQLASALSHTTDSKTLKKLLSDWKNKDIVKPQDLAMSWYATFLKNSFTQESVWEWAQENWEWIKATLGGDMSFDKFVIYPSSSFKTEERLEQYKNFFEPQLSDMAISRNISMGIKEISARVLLITKQKEEVINTIKKYI

SEQ ID NO: 2073 - DNA, 2595 bp, Streptococcus pyogenes
atgatacttaggtatcatctgttgatctattatgatttgttattagaattaaggagttatatgaagacagtagaacatctcatcgaaacatttgtgcctgaaaattataacatctttttagatattaatcgtcagactaaaacatttacggggaatgttgcgattaatggtgaagctttagataatcatgtggctttccaccaaaaagatttggacattaagtctattttgctcgataatgaagctgttatttatcaagtggataacgacaatgaagttgtgcgtgttgaattacctgaaacaggaatgatgacgcttgtcattgaattttcaggtagcattacagataatatgacaggtatttacccttcatattacactaaaaatggtgagaaaaaagaagtcatttcaactcagtttgaaagccattttgcacgtgaagctttcccatgtatcgatgaaccacaagcaaaagctacttttgatttaagcttgacctttgatcaagaaattggtgagatagcgttatcgaatatgccagaagtcaatattgaccgtcgcgaggagactggtctttggacatttgatacgacactaagaatgtcatcttacttgctagcgtttgcgctaggagaacttcatggaaagactgtagaaagcaaaaaaggaacaactgttggtgtgtatgcgacaacagcgcatcctcttagctcgcttgatttttcattggatattgcagttcgtgttatcaacttttatgaagactattttggagtacattacccaatcccgcaatctcttaatattgcgcttccagatttttcatctggtgctatggaaaattggggtttaatcacttatcgtgaaatttatttattagtagatgaaaattcgactgttcaaagccgacaacaagttgcacttgtaatcgcccacgagatagcacaccaatggtttggaaacttggttacaatgaaatggtgggacgatctgtggttaaatgagagttttgccaacatgatggaatatgtctctatcgaggctattgagccgtcttggaaaataatagaagatttccaaacaggcggtattcctcttgctttaaaacgtgatgctactgatggtgttcaatcagtgcatgttgaagtcaatcatccagatgagataaatacattgtttgatcctgctattgtctatgcaaaaggtagtcgtttgatgcatatgttacgccgttttattggtgatcgtgattttgccattggcttacatcactactttgaaaaatatcaatatcgaaatactgtcgggcgtgatttatggaatattttatcagatacttcaggcaaagacgtagctgcttttatggatgcttggcttgaacaaccaggttatccagttttaacagctcgccttgaaaacgatcaattgattttgagtcaaaaacaattttttattggaaaaggtgaagaaaaaggtcgcctttggccgattcctttaaacactaattggcatggccttcctgaaactttgacagaggcagaaatggtcattccaaactttagtcaattggcagcagaaaatgaaggagctctacgtttcaatattgataatacagctcattacattacagactaccaaggatcattattagatgccttagtcactgaacttgcccaacttgataatacttctgctttacaagttattcaagaacgtcgtttattggcagatagtggcttgatttcctatgctgaattggttgacttaattgctcaattggacgattctaagtcttatatggtagcagaagcggttcaacaagtggtctctggtttgaaacgcttcattgatgaaggaagcttagcagaaaaatcctttaatcgcttggtaaccaccatctatcaagaagactttaatcagcatggttttgagaaaaaagctgacgaatcagatgaagatgagatggtacgtcaggttgccttgggccgcttgtggctagcagaaaatcagacgattattgacggattgagaactatttttgaagcatatcaaaacaatattgcaagtattccagcagctgttcgtcgcttggttttagccaaccaaatgaaatattttgaaacagatagcttggttgatatttattttgagacttatgtagcaactactgataataatttacgcagtgatttaacggttgcttttagtcaaacaaaacaaccaactactattagacgtattcttgttagtttaaaagataaagatattattaaacctcaggatttatcttattggtacaatgctttgcttggacaaagctttactcaagatatcatttgggaatgggctagagaaaattgggattggattaaatctgcacttggtggagatatgagctttgataaatttgttatttatccagcaagtaactttaaaacaccaaaacatctagcagaatataaatctttctttgaacctaagctagatgatatggctattagccgtaatattaccatgggaattaatgaaattgaagcacgtgttgctttgattactaaagaaaaagaagcagttattgcagctctcagtcattac

SEQ ID NO: 2074 - protein, 865 aa, Streptococcus pyogenes
MILRYHLLIYYDLLLELRSYMKTVEHLIETFVPENYNIFLDINRQTKTFTGNVAINGEALDNHVAFHQKDLDIKSILLDNEAVIYQVDNDNEVVRVELPETGMMTLVIEFSGSITDNMTGIYPSYYTKNGEKKEVISTQFESHFAREAFPCIDEPQAKATFDLSLTFDQEIGEIALSNMPEVNIDRREETGLWTFDTTLRMSSYLLAFALGELHGKTVESKKGTTVGVYATTAHPLSSLDFSLDIAVRVINFYEDYFGVHYPIPQSLNIALPDFSSGAMENWGLITYREIYLLVDENSTVQSRQQVALVIAHEIAHQWFGNLVTMKWWDDLWLNESFANMMEYVSIEAIEPSWKIIEDFQTGGIPLALKRDATDGVQSVHVEVNHPDEINTLFDPAIVYAKGSRLMHMLRRFIGDRDFAIGLHHYFEKYQYRNTVGRDLWNILSDTSGKDVAAFMDAWLEQPGYPVLTARLENDQLILSQKQFFIGKGEEKGRLWPIPLNTNWHGLPETLTEAEMVIPNFSQLAAENEGALRFNIDNTAHYITDYQGSLLDALVTELAQLDNTSALQVIQERRLLADSGLISYAELVDLIAQLDDSKSYMVAEAVQQVVSGLKRFIDEGSLAEKSFNRLVTTIYQEDFNQHGFEKKADESDEDEMVRQVALGRLWLAENQTIIDGLRTIFEAYQNNIASIPAAVRRLVLANQMKYFETDSLVDIYFETYVATTDNNLRSDLTVAFSQTKQPTTIRRILVSLKDKDIIKPQDLSYWYNALLGQSFTQDIIWEWARENWDWIKSALGGDMSFDKFVIYPASNFKTPKHLAEYKSFFEPKLDDMAISRNITMGINEIEARVALITKEKEAVIAALSHY

SEQ ID NO: 2075 - DNA, 678 bp, Streptococcus agalactiae
atgataaaaattttattaattgaagatgacttgagtctttccaattccgtttttgatttccttgatgactttgccgatgtcatgcaaatttttgatggagaagagggtctttacgaagccgaaagtggagtctatgatctgattcttctagatctcatgttacctgaaaaaaacggcttccaagtgttgaaagagctacgtgaaaaaggtattacaacccctgtattaataatgaccgctaaagaaagcattgatgataagggacaaggtttcgacttaggtgctgatgattatctaacaaaacctttttacctagaagaactaaaaatgcgaattcaggctcttttaaagcgttctggaaaatttaatgataacagcctaatttatggtgatattcgcgtagacatgtctactaactcaacctttgttaatcaaacagaagttgagctcttaggtaaagagtttgatcttttagtctatttccttcaaaatcaaaatgttatcttaccgaaatctcaaatctttgatcgtatttggggatttgatagtgatacaacgatttcagttgtagaagtctatgtctctaaggttcggaaaaaattaaaaggaacacttttttcagaaaaccttcaaactttgcgtagtgtaggatatattttaaagcatgtcgaaaccgat

SEQ ID NO: 2076 - protein, 226 aa, Streptococcus agalactiae
MIKILLIEDDLSLSNSVFDFLDDFADVMQIFDGEEGLYEAESGVYDLILLDLMLPEKNGFQVLKELREKGITTPVLIMTAKESIDDKGQGFDLGADDYLTKPFYLEELKMRIQALLKRSGKFNDNSLIYGDIRVDMSTNSTFVNQTEVELLGKEFDLLVYFLQNQNVILPKSQIFDRIWGFDSDTTISVVEVYVSKVRKKLKGTLFSENLQTLRSVGYILKHVETD

SEQ ID NO: 2077 - DNA, 672 bp, Streptococcus pyogenes
atgataaaaatattattagtagaagatgacttgagcttatcaaattccatttttgattttttagatgattttgcagacgtcatgcaagtttttgatggcgatgaaggtttatacgaagcagaaagtggtatttatgatttgattttgttagaccttatgttgccggagaaaaatggctttcaagtcttaaaagaattgcgagaaaaagatattaaaattcctgtattgatcatgacagctaaagagggtttagatgataaaggccacggatttgaattaggtgctgatgattatctgacaaagccgttctatttagaagagttaaaaatgcgaattcaagcactgttaaaaagaacagggaaatttgcagataaaaatattagttttggcaatttagtggttgacttagctcgaaaagaggtgaaggttgaagggaaagtagttgaattacttggcaaagaatttgatttgttggtgtatcttttgcaaaatcaaaacgttattttaccaaagacacaaatttttgatcgtttatggggattcgatagtgatactacgatttcggttgttgaagtttacatttctaaaataaggaaaaaattaaaaggtacctgttttgttaacaggcttcaaactttaagaagcgtaggatatattctaaaaaacaatgaa

SEQ ID NO: 2078 - protein, 224 aa, Streptococcus pyogenes
MIKILLVEDDLSLSNSIFDFLDDFADVMQVFDGDEGLYEAESGIYDLILLDLMLPEKNGFQVLKELREKDIKIPVLIMTAKEGLDDKGHGFELGADDYLTKPFYLEELKMRIQALLKRTGKFADKNISFGNLVVDLARKEVKVEGKVVELLGKEFDLLVYLLQNQNVILPKTQIFDRLWGFDSDTTISVVEVYISKIRKKLKGTCFVNRLQTLRSVGYILKNNE

SEQ ID NO: 2079 - DNA, 1311 bp, Streptococcus agalactiae
atgtcgaaaccgattaagataagtaaattcaaaaaaaatgtctcagatagtcattttatccattttttcacagtttttagtggtatttttctggttatgactgttatcatcctccaagtcatgcgctatggtgtttattcttctgttgatagtagtttaaagtatatcagtacccatcctaaaaattacatcaatatggttatgtcacgtactgctgcctacctagataactccaatatcgcaagtgtcaagttaaaacccggcggtcagacagtagctaatactgatattattctttttacatcagaagaagaagtcattaactattttgacgcattttcaaactatcagtttttaaaacctaataaaaaaaatctaggtggcattagtgaattaactttaaccaacatctttggtcaagatgagacatatcatgctgtcaccgtaaaagttaataaccctgcttatcctaatgtgacttacatgacagctattgttaatattgatcaattagtaaatgctaaagaacgctatgaaaaaattattatatttgtcatgactactttttggattatttcaattggagcaagtatctacttagctaaatgggcacaaaaaccgattatagaaaactacgaaagacagaaggcttttgtcgaaaatgctagccacgagctgcgtactcccctagctgtcttacaaaatcgcctagaaacgctattcagaaaaccgaatgccaccattttagaaaatagtgaaaatatcgcttcaagtctagatgaagtacgaaatatgcgtattttaaccactaatcttttaaacttagcaagacgtgatgatggaatcaaaccagaattagctgttattaagcctacactttttgatagtatctttgagaattatgatctaatcacccaagagaatggtaaaaattttactggacataatatgatccaagatagtttcaaaacagataagacactgctaaaacaactcatgactattttatttgataatgctataaaatatactgacaatgatggtagcattgactttaccatatctgaaactgataagtatctctttttagaaatcgctgataatggaccaggaatttcagaggaggataaagtcagaatttttgatcgtttttaccgtgttgacaaagcaagaacacgacaacaaggagggtttggcctcggcctttctttagctcaacaaatcgttaactcactgcgaggtaatattacagtaattgataataaacctagaggcagtatttttaagataaaactaccaaaagtaaaaggt

SEQ ID NO: 2080 - protein, 437 aa, Streptococcus agalactiae
MSKPIKISKFKKNVSDSHFIHFFTVFSGIFLVMTVIILQVMRYGVYSSVDSSLKYISTHPKNYINMVMSRTAAYLDNSNIASVKLKPGGQTVANTDIILFTSEEEVINYFDAFSNYQFLKPNKKNLGGISELTLTNIFGQDETYHAVTVKVNNPAYPNVTYMTAIVNIDQLVNAKERYEKIIIFVMTTFWIISIGASIYLAKWAQKPIIENYERQKAFVENASHELRTPLAVLQNRLETLFRKPNATILENSENIASSLDEVRNMRILTTNLLNLARRDDGIKPELAVIKPTLFDSIFENYDLITQENGKNFTGHNMIQDSFKTDKTLLKQLMTILFDNAIKYTDNDGSIDFTISETDKYLFLEIADNGPGISEEDKVRIFDRFYRVDKARTRQQGGFGLGLSLAQQIVNSLRGNITVIDNKPRGSIFKIKLPKVKG

SEQ ID NO: 2081 - DNA, 1308 bp, Streptococcus pyogenes
atgaataaattaaaaaaagagattttatcagataactataaccacttttttcatttttttgcggtttttacaggtatttttgtcattatgactattattatcttacagattatgcggtttggcgtttattcgtcagttgacagtagtttagtttctgttagtaataatgcaagtagctatgctaatcgtacgatggctagaatatcttctttttactttgatactgaaaataacattattaaggcgctgcctgattcagatagttctaagttattaggaacgcctgcagctaatacagatatcattttgtttagtgctaatggaacaattttaaatgcttttgatgcgttttctaactatcaaaattttcatttagataaacgccggttggggagtattgaaaccaccagtttaatgaatttttatggacaagaagaaaaataccatacgataactgtaggggttcatatcaaaaattatcctgcagttgcctatatgatggcagtagtaaatgtggaacaattagaccgcgctaatgaacgttatgagcgcattattattatagttatgagtgttttttggctaatttctattttagcaagtatttatttagccaagtggagcagaaaacctattttagaaagctatgaaaaacaaaaaatgtttgttgaaaatgctagtcatgaattaaggacccctttggcggtcttacagaatcgtctggaatcgctttttcgtaagcccaacgaaacgatattagaaaatagtgagcatctcgcttctagtttagacgaggttcgcaacatgcgcatcttaacaactaatttattaaatttagcaagacgagatgatggcattaatccacagtggactcatttagatacagatttttttaatgctatttttgagaattatgaactagttgctaaagaatatggaaaaatattttattttcagaaccaagtcaatagatcgttaagaatggataaggctttactaaaacaattaataacgattttatttgacaatgctattaaatatacagataaaaatggtattattgaaattatagtgaaaacaacggacaaaaatttattaatttctgttattgataatggtccagggataacagatgaagaaaagaaaaagatttttgatcgtttttatcgagttgacaaagctagaacacggcaaacaggtggatttggcttggggttggctttagctcagcaaatcgtgatgtctttaaaaggaaatattacagtaaaggataatgatcctaaaggtagtatttttgaagtcaaacta

SEQ ID NO: 2082 - protein, 436 aa, Streptococcus pyogenes
MNKLKKEILSDNYNHFFHFFAVFTGIFVIMTIIILQIMRFGVYSSVDSSLVSVSNNASSYANRTMARISSFYFDTENNIIKALPDSDSSKLLGTPAANTDIILFSANGTILNAFDAFSNYQNFHLDKRRLGSIETTSLMNFYGQEEKYHTITVGVHIKNYPAVAYMMAVVNVEQLDRANERYERIIIIVMSVFWLISILASIYLAKWSRKPILESYEKQKMFVENASHELRTPLAVLQNRLESLFRKPNETILENSEHLASSLDEVRNMRILTTNLLNLARRDDGINPQWTHLDTDFFNAIFENYELVAKEYGKIFYFQNQVNRSLRMDKALLKQLITILFDNAIKYTDKNGIIEIIVKTTDKNLLISVIDNGPGITDEEKKKIFDRFYRVDKARTRQTGGFGLGLALAQQIVMSLKGNITVKDNDPKGSIFEVKL

SEQ ID NO: 2083 - DNA, 330 bp, Streptococcus agalactiae
atggaaattgaaaaaacaaatcgtatgaatgccctttttgagttttatgcggcattattaacagataaacaaatgaattatatcgagttatactacgccgatgactacagccttgctgaaatagctgaagaatccggtgttagccgacaagctgtctatgataatatcaaacgaactgaaaaaattcttgaggcgtacgaaatgaaactacatatgtattcagattatattgtccgtagtcagatttttgatgacattctagaaaaatataccgatgatgcctttttacaagaaaaaatttccattctaagtagcattgataatagagat

SEQ ID NO: 2084 - protein, 110 aa, Streptococcus agalactiae
MEIEKTNRMNALFEFYAALLTDKQMNYIELYYADDYSLAEIAEESGVSRQAVYDNIKRTEKILEAYEMKLHMYSDYIVRSQIFDDILEKYTDDAFLQEKISILSSIDNRD

SEQ ID NO: 2085 - DNA, 339 bp, Streptococcus pyogenes
atgaacattatggaaattgaaaaaacaaacaggatgaatgccctttttgaattttatgcagctttgctaacagataaacaaatgaattatattgaactgtattatgccgatgattatagcttagctgagattgctgatgaatttggtgtcagtcgtcaggctgtctatgataatattaagcgtacggaaaaaattttagagacttatgagatgaaacttcatatgtattcggattatgttgttcgaagtgaaatctttgacgacatgattgctcactaccctcatgatgagtatttgcaagaaaaaatttccattctaaccagtattgacaatagagag

SEQ ID NO: 2086 - protein, 113 aa, Streptococcus pyogenes
MNIMEIEKTNRMNALFEFYAALLTDKQMNYIELYYADDYSLAEIADEFGVSRQAVYDNIKRTEKILETYEMKLHMYSDYVVRSEIFDDMIAHYPHDEYLQEKISILTSIDNRE

SEQ ID NO: 2087 - DNA, 1563 bp, Streptococcus agalactiae
atggctttcgaaagtttaacagagcgcctgcaaggagtttttaaaaatattcgtggtaagaaaaagttatctgaaaaagatgtgcaagaagtcaccaaggagattcgtctagctcttttagaagctgacgttgctcttccagttgttaaaacctttattaaacatgttcgtgaacgtgctgttggacatgaaatcattgatacactagatcctacgcaacaaattgttaagattgtcaatgaagagctaacagatttattaggggctgagacctctgaaattgaaaaatcccctaaaattccaaccatcattatgatggttggtctacaaggtgctggtaaaacaacttttgccggtaagttagcaaacaaactaatcaaagaagacaatgctcgtcctatgatgatagcagctgatatttatcgaccagctgctattgatcagttaaaaacccttggtagccagattaatgttcctgtctttgatatgggaactaaccattcagcagttgagattgtcactaaaggtttagaacaggctcgtgaaaatcgtaatgactatgttcttattgatacagccggacgcctacaaattgatgcaacccttatgcaggaattgcatgatgtcaaagccatagctcaacctaatgaaatactccttgtcgttgacagcatgattggacaggaagctgcaaatgtcgctgaagaatttaaccgtcagctcagcattagtggtgttgttctgacaaagattgacggtgatacacgcggtggtgctgccctttcagtacgcgaaattactggaaaaccaattaaatttacagggacaggggaaaaaatcactgatattgaaactttccatcccgatcgtatggcaagccgtatattggggatgggagacctgctaacacttattgagcgcgctagtcaagaatacgacgaaaaacgttcaatggaattagcggagaaaatgcgtgaaaacacctttgacttcaacgattttattgatcaattagatcaagttcaaaatatggggccaatggaagatctccttaaaatgcttccaggaatggctaacaatccagcaatgaaaaacttcaaagtggatgaaaacgaaattgctcgcaaaagagccattgtgtcatcaatgactccagaagagagagaaaatccagatctcctcaatccaagtcgtagacgtcgtattgctgctggatcaggtaatactttcgttgatgttaataaattcattaaagattttaaccaggcaaaacaaatgatgcaaggcgtgatgtccggtgatatgaataaaatgatgaaaaaaatgggaattgatcctaataacctccctaaagatatgcctggaatggacggaatggatatgtctaatttagaaggtatgatggggcaaaatggcatgcctgacttatctagtttaggtggcgatatggacttcagccaaatgtttggtggtggcttaaaaggaaaagtaggagcctttgcagctaaacaatcaatgaaacgtatggctaataaaatgaagaaagctaagaagaaacgcaaa

SEQ ID NO: 2088 - protein, 521 aa, Streptococcus agalactiae
MAFESLTERLQGVFKNIRGKKKLSEKDVQEVTKEIRLALLEADVALPVVKTFIKHVRERAVGHEIIDTLDPTQQIVKIVNEELTDLLGAETSEIEKSPKIPTIIMMVGLQGAGKTTFAGKLANKLIKEDNARPMMIAADIYRPAAIDQLKTLGSQINVPVFDMGTNHSAVEIVTKGLEQARENRNDYVLIDTAGRLQIDATLMQELHDVKAIAQPNEILLVVDSMIGQEAANVAEEFNRQLSISGVVLTKIDGDTRGGAALSVREITGKPIKFTGTGEKITDIETFHPDRMASRILGMGDLLTLIERASQEYDEKRSMELAEKMRENTFDFNDFIDQLDQVQNMGPMEDLLKMLPGMANNPAMKNFKVDENEIARKRAIVSSMTPEERENPDLLNPSRRRRIAAGSGNTFVDVNKFIKDFNQAKQMMQGVMSGDMNKMMKKMGIDPNNLPKDMPGMDGMDMSNLEGMMGQNGMPDLSSLGGDMDFSQMFGGGLKGKVGAFAAKQSMKRMANKMKKAKKKRK

SEQ ID NO: 2089 - DNA, 1563 bp, Streptococcus pyogenes
ttgactatggcttttgaaagcttaacccaacgtttgcaagatgtgtttaaacacattcgcggtaaaaagaaattatcagaatcagatgttcaagaagtgacaaaagagattcgtctagctcttttagaagccgatgtcgctttaccagttgttaaaacctttattaagcgcgtacgtgagcgcgctattggccatgagattattgatactcttgatccaacacaacaaattcttaagattgttaatgaagaattaacgagtattttaggctcagaaactgcagagattgataaatctccaaaaattccaactattatcatgatggtcggtttgcaaggggctggtaaaacaacttttgcaggaaaactcgctaataaattaattaaagaagaaaacgcgcgaccactgatgattgctgccgatatttaccgtccagcggccattgatcagttaaaaacactggggcaacaaatcaatgtacctgtttttgatatggggacagaccactcagcagtcgatattgtcagaaaaggtttggaacaagctcgtgaaaaccacaatgactatgtcttgattgatactgcgggtcgcttgcaaattgatgaaaaactgatgggagagctgcgcgatgtcaaggctttagcacaaccaaatgaaattcttttggttgtagatagcatgattggtcaagaagctgccaatgtagcctacgagtttaatcatcagttgagcatcacaggggttgtgttaacaaagattgatggtgatacacgtggaggtgcggcgctatctgtccgtgaaatcactgggaaaccaattaaatttacaggtattggtgaaaaaatcacagatattgaaacatttcacccagaccgcatgtccagtcggattttgggaatgggggatttgcttaccctcattgaaaaagctagccaggaatatgatgagaaaaaatccttagagttagctgaaaaaatgcgtgaaaacacctttgatttcaatgattttattgaacagttagatcaagtgcaaaatatggggcctatggaagacctcttgaaaatgattccaggaatggctggtaacccagctttggccaatatcaaagttgacgaaaaccaaattgctcgcaaacgtgctattgtctcttcaatgacacccgctgaacgtgaaaatcctgacttactaaacccgagtcgtcgccgtcgtattgcagctggttccgggaacagctttgtagataataaatttatcaaagactttaaccaagccaaaagcatgatgcaaggggttatgtcgggcgatatgtctaaaatgatgaaagatatgggtattaatcccaataatcttcctaaaaacatgcctgctggtatgccagatatgtcttccttagaaggaatgatgggacaaggtggtatgcctgatttatctggccttggtggtgatatggatatgagtcaactatttggtaaagggtttaaaggaaaaattggccaatttgccatgaaacaggccatgaaacggcaggctaacaaactaaaaaaagcaaagaaaaaacgaaaa

SEQ ID NO: 2090 - protein, 521 aa, Streptococcus pyogenes
LTMAFESLTQRLQDVFKHIRGKKKLSESDVQEVTKEIRLALLEADVALPVVKTFIKRVRERAIGHEIIDTLDPTQQILKIVNEELTSILGSETAEIDKSPKIPTIIMMVGLQGAGKTTFAGKLANKLIKEENARPLMIAADIYRPAAIDQLKTLGQQINVPVFDMGTDHSAVDIVRKGLEQARENHNDYVLIDTAGRLQIDEKLMGELRDVKALAQPNEILLVVDSMIGQEAANVAYEFNHQLSITGVVLTKIDGDTRGGAALSVREITGKPIKFTGIGEKITDIETFHPDRMSSRILGMGDLLTLIEKASQEYDEKKSLELAEKMRENTFDFNDFIEQLDQVQNMGPMEDLLKMIPGMAGNPALANIKVDENQIARKRAIVSSMTPAERENPDLLNPSRRRRIAAGSGNSFVDNKFIKDFNQAKSMMQGVMSGDMSKMMKDMGINPNNLPKNMPAGMPDMSSLEGMMGQGGMPDLSGLGGDMDMSQLFGKGFKGKIGQFAMKQAMKRQANKLKKAKKKRK

SEQ ID NO: 2091 - DNA, 720 bp, Streptococcus agalactiae
ttgtctgctataatagacaaaaaggtggtgatatttatgtatttagcattaatcggtgatatcattaattcaaaacagatacttgaacgtgaaactttccaacagtcttttcagcaactaatgaccgaactatctgatgtatatggtgaagagctgatttctccattcactattacagctggtgatgaatttcaagctttattgaaaccatcaaaaaaggtatttcaaattattgaccatattcaactagctctaaaacctgttaatgtaaggttcggcctcggtacaggaaacattataacatccatcaattcaaatgaaagtatcggtgctgatggtcctgcctactggcatgctcgctcagctattaatcatatacatgataaaaatgattatggaacagttcaagtagctatttgccttgatgatgaagaccaaaaccttgaattaacactaaatagtctcatttcagctggtgattttatcaagtcaaaatggactacaaaccattttcaaatgcttgagcacttaatacttcaagataattatcaagaacaatttcaacatcaaaagttagcccaactggaaaatattgaacctagtgcgctgactaaacgccttaaagcaagcggtctgaagatttacttaagaacgagaacacaggcagccgatctattagttaaaagttgcactcaaactaaagggggaagctatgatttc

SEQ ID NO: 2092 - protein, 240 aa, Streptococcus agalactiae
MSAIIDKKVVIFMYLALIGDIINSKQILERETFQQSFQQLMTELSDVYGEELISPFTITAGDEFQALLKPSKKVFQIIDHIQLALKPVNVRFGLGTGNIITSINSNESIGADGPAYWHARSAINHIHDKNDYGTVQVAICLDDEDQNLELTLNSLISAGDFIKSKWTTNHFQMLEHLILQDNYQEQFQHQKLAQLENIEPSALTKRLKASGLKIYLRTRTQAADLLVKSCTQTKGGSYDF

SEQ ID NO: 2093 - DNA, 663 bp, Streptococcus pyogenes
atgacatatatagcgcttattggagatattatccagtccaaacaattgacggatcgttccaaagttcaaaaaactttagcagcttatttagacgacctcaacaaaacctttgctccttatattatttctaaattatccctaacgttgggagatgaatttcaaggactttttcaggtggatactcctattttccatctgattgatttgattaatcatcacatggatatccctattcgatttggagtaggagtaggttctattctaacagacatcaatcctgatattagtattggggctgatggacctgcttattggcatgctcgtgaggctattcgttatattcatcaaaaaaatgattatggtaatactacattagctcttcggactggtcatcacaaccaggatgatgtattaaacagtttactagcagctggagatgctattaaagccaactggcgagctagtcaatgggaaatttttgacacgcttttagatttgggcatttatgaggaatactttgatcaacaacgactaggaaagcaattatctcttagctctagcgctttgtcaaaacgtctaaaaagtagtcatgttaaaatttatctgagaacacggcagagtgcgctaaactgtctcaaacaaatcaaggaggaaactgatgat

SEQ ID NO: 2094 - protein, 221 aa, Streptococcus pyogenes
MTYIALIGDIIQSKQLTDRSKVQKTLAAYLDDLNKTFAPYIISKLSLTLGDEFQGLFQVDTPIFHLIDLINHHMDIPIRFGVGVGSILTDINPDISIGADGPAYWHAREAIRYIHQKNDYGNTTLALRTGHHNQDDVLNSLLAAGDAIKANWRASQWEIFDTLLDLGIYEEYFDQQRLGKQLSLSSSALSKRLKSSHVKIYLRTRQSALNCLKQIKEETDD

SEQ ID NO: 2095 - DNA, 114 bp, Streptococcus agalactiae
ttgaaatttattaaagaaaattttaaacacaatattaatgggtttggtgataatgataaaaaccagagctatgacaataaagtgcttgataggcaaaagccaatgattaggcgg

SEQ ID NO: 2096 - protein, 38 aa, Streptococcus agalactiae
MKFIKENFKHNINGFGDNDKNQSYDNKVLDRQKPMIRR

SEQ ID NO: 2097 - DNA, 771 bp, Streptococcus agalactiae
atgatttctgattttttaagggataatccaatcctaactttattattttgtgcacattttttagctgactttcagtggcaaagtcaatccttagcagatagtaaatcacatagttggaggggactctggagacatctcttgattgttttcctccccctagcagctttaatgatattgataccagaaactactttgttaaatttaagcatatggggaagtcatattgttattgatagtataaagaaattgagttacccttgggtagaggaagggcatttccaaaaagcagcttttattatagaccaactagcccactatacttgcattatcgttttttaccatgcgcttcctacatatttaccgcctaatcattggcttttgcctatcaagcactttattgtcatagctctggtttttatcattatcaccaaacccattaatattgtgtttaaaattttctttaataaatttcaagctaaagaattatcatcattattaacacaagaaaaaacaaaaataatgaaagaaaaatctgaagatcatgaagaaacaattgaaggagcaggagctatgattggtaatttagagcgtctaattatggctatattactaatctcaggacagtatgctgctataggtcttgtttttactgcaaaatccattgcacgttacgataaaatttctaaaagtcaggtttttgccgaatattatttaattggatcattgttctcaattataagtgttttgataactcattggttacttttggta

SEQ ID NO: 2098 - protein, 257 aa, Streptococcus agalactiae
MISDFLRDNPILTLLFCAHFLADFQWQSQSLADSKSHSWRGLWRHLLIVFLPLAALMILIPETTLLNLSIWGSHIVIDSIKKLSYPWVEEGHFQKAAFIIDQLAHYTCIIVFYHALPTYLPPNHWLLPIKHFIVIALVFIIITKPINIVFKIFFNKFQAKELSSLLTQEKTKIMKEKSEDHEETIEGAGAMIGNLERLIMAILLISGQYAAIGLVFTAKSIARYDKISKSQVFAEYYLIGSLFSIISVLITHWLLLV

SEQ ID NO: 2099 - DNA, 714 bp, Streptococcus pyogenes
atgattaatggtgtctctcactacctagctcaaacccctacacttaccctgtttctcatttgtcatgtgttatcagactaccagttacaaagtcagcaagtagctgatttaaaagaaaaacatttgacttatttaggttaccacttgattggagttagcattcccctaatttgtttaaccctcattatcccacaagcatggttgatgagcctattggttatgataagtcacgcgcttattgactggctaaagccaaagatggctaactctctaaaatggaaaagagagtggatttttctgctggatcaatgcttacatatcgctattagttcatttgctgggctaaggttagcaggggtgaccttgcctaattggcttccgatatctattttgatgaccgttttatttatcctactcattaccaaaccaactaatattgtctttaaactctttttcatcaaataccagcctgaccaaggagaaaaaatggacacgatcataggagcgggggctaccataggaattctagagagaattgttattggggtgtgtatgatcatggggcaatttgcttcaataggtctggtctttaccgctaaatctattgctcgctataataaaatttcggaaagtccagcttttgcagaatactacctaattggttctttatttagtattctcagtgtttttatcgcagcatggatttgtttcttc

SEQ ID NO: 2100 - protein, 238 aa, Streptococcus pyogenes
MINGVSHYLAQTPTLTLFLICHVLSDYQLQSQQVADLKEKHLTYLGYHLIGVSIPLICLTLIIPQAWLMSLLVMISHALIDWLKPKMANSLKWKREWIFLLDQCLHIAISSFAGLRLAGVTLPNWLPISILMTVLFILLITKPTNIVFKLFFIKYQPDQGEKMDTIIGAGATIGILERIVIGVCMIMGQFASIGLVFTAKSIARYNKISESPAFAEYYLIGSLFSILSVFIAAWICFF

SEQ ID NO: 2101 - DNA, 1659 bp, Streptococcus agalactiae
atgtctagttttaatagaaaaaaacttaagtttttgggtatatctttggcgactctaacagccaccacagttaccctggttgcctgtggtaatgagtcaaagaactctggagataataaagttattaattggtatattcctactgaaatcagtacattggacatttcaaagaatacagatgcttattcaaacttagctataggtaattcaggcagcaatttacttagaattgataaagagggcaaaccaaaacccgatttagctaaaaaagtatccgtttcttctgatggtcttacttatactgctacacttcgtgataatttaaaatggtcagatggaagcaaactaagcgctgaagattttgtttacacatggcggagaatagttgatcctaaaactgcatctgaatatgcttacttggcgacagaatcgcaccttttaaatgctgataagattaattctggagatattaaagatttaaataaacttggtgtaacagctaaaggcaatcaagtgacctttaaattgacaagtccatgccctcaatttaaatattatttagccttctctaattttatgcctcaaaaacaatcgtatgttgaaaaagttggtaaagattatggtacaacatcaaaaaatcaaatttactcaggtccttaccttgttaaggattggaatggttcaaatggtaaatttaaattagtcaaaaataaatattattgggattctaaacatgttaaaacaaatagtgtcatagttcaaactatcaaaaaaccagatactgcagttcaaatgtacaagcaaggtcagattgattttgctgaaatatcaggaacttctgctatttatcaagctaataaaaataataaagatgtagtagatgcgtctgatgcacgtactacatatattatttataaccaaactggttcggttaaagcattgacaaatcagaaaattaggcaagctttgaatttagcgactgatcgtaaaggtgttgttaaagcggcagttgatacaggttcaactcctgctgaatctctggtccctaaaaaattagccaaattacctaatggtgaggatctttccaagtatactgccccaggttatacgtataatacaagtaaagctcaaaaactttttaaagaaggtcttgctgaggttggtcagtcatctctcaagttaacaatcacagctgattcggactctccagcagctaaaaatgctgttgactatgtgaaatctacatgggagagtgctttgcctggtctaactgttgaagaaaaatttgttactttcaagcaacgccttgaagatgcaaaaaatgaaaattttgatgtcgtgctcttctcatggggaggagattatccagaaggatcaactttctatgggttattcacgactaattctgcgtataattatggtaaattttcttctaaagagtatgacaatgcctatcaaaaggcaattactactgacgccttgaaaccaggagatgccgctaatgattacaaaactgctgaaaaagctttatttgatcaatcatattataacccagtttattacctagggaaaaaaggactccaaaattctaaattaaaggggttggtaagaaattcaactggtttgaatgttgattttacttatgcttataagacagaa

SEQ ID NO: 2102 - protein, 553 aa, Streptococcus agalactiae
MSSFNRKKLKFLGISLATLTATTVTLVACGNESKNSGDNKVINWYIPTEISTLDISKNTDAYSNLAIGNSGSNLLRIDKEGKPKPDLAKKVSVSSDGLTYTATLRDNLKWSDGSKLSAEDFVYTWRRIVDPKTASEYAYLATESHLLNADKINSGDIKDLNKLGVTAKGNQVTFKLTSPCPQFKYYLAFSNFMPQKQSYVEKVGKDYGTTSKNQIYSGPYLVKDWNGSNGKFKLVKNKYYWDSKHVKTNSVIVQTIKKPDTAVQMYKQGQIDFAEISGTSAIYQANKNNKDVVDASDARTTYIIYNQTGSVKALTNQKIRQALNLATDRKGVVKAAVDTGSTPAESLVPKKLAKLPNGEDLSKYTAPGYTYNTSKAQKLFKEGLAEVGQSSLKLTITADSDSPAAKNAVDYVKSTWESALPGLTVEEKFVTFKQRLEDAKNENFDVVLFSWGGDYPEGSTFYGLFTTNSAYNYGKFSSKEYDNAYQKAITTDALKPGDAANDYKTAEKALFDQSYYNPVYYLGKKGLQNSKLKGLVRNSTGLNVDFTYAYKTE

SEQ ID NO: 2103 - DNA, 1068 bp, Streptococcus agalactiae
atgaaacgtgaattactactcgaaaaaatcgatgaactaaaagaaattatgccttggtatgttctagaatattatcaatcaaagctttctgttccttatagtttcacaacactctacgaatatttaaaagaatatagacgttttcttgaatggttattggattctggtgttgctaattgtcatcacattgcagaaattgagctttcagttttagaaaaccttactaaaaaagatatggaagcttttatactatatttacgagaacgccctttattaaatgctaacacaaggcaaaatggggtgtctcaaaccaccattaacagaactctatctgccttatctagtcttttcaaataccttactgaagaggttgagaatgctgacggggagccttacttttatcgcaatgtcatgaaaaaagtctcaaccaaaaagaaaaaggaaactttagcttctcgggcagaaaatattaaacaaaagttatttttgggcaatgaaacgatagaattcttagagtatatagattgtgaatatcaaaacaaactttccaaacgtgctttagcttttttcaacaaaaataaagagagagatttagctattattgctttgctactagcttcaggagtgcgtctatctgaggcagtaaacttagatttaaaggatattaaccttaatgtaatggttattgatgtcacacgaaaaggggggaaaagggactctgtcaatgtcgctagctttgcgaagccctaccttgctaattatttagacatccgtaaaaatagatacaaagcagaaaatcaggacattgctctatttttatcagaataccgtggggtgccaaatcgtattgatgcttcaagtgtagagaaaatggttgctaagtattcccaggattttaaggttcgtgtaacacctcataaactaaggcatactcttgctactaggctatatgatgctacaaaatctcaagtattagttagccaccaactaggtcatgcttccactcaagttactgacctatatacccatattgttaacgatgaacaaaagaacgctttagataaacta

SEQ ID NO: 2104 - protein, 356 aa, Streptococcus agalactiae
MKRELLLEKIDELKEIMPWYVLEYYQSKLSVPYSFTTLYEYLKEYRRFLEWLLDSGVANCHHIAEIELSVLENLTKKDMEAFILYLRERPLLNANTRQNGVSQTTINRTLSALSSLFKYLTEEVENADGEPYFYRNVMKKVSTKKKKETLASRAENIKQKLFLGNETIEFLEYIDCEYQNKLSKRALAFFNKNKERDLAIIALLLASGVRLSEAVNLDLKDINLNVMVIDVTRKGGKRDSVNVASFAKPYLANYLDIRKNRYKAENQDIALFLSEYRGVPNRIDASSVEKMVAKYSQDFKVRVTPHKLRHTLATRLYDATKSQVLVSHQLGHASTQVTDLYTHIVNDEQKNALDKL

SEQ ID NO: 2105 - DNA, 1104 bp, Streptococcus pyogenes
ttgaaaaaattgttattgttaaggaattatgatgatatgagacgcgaattattactagaaaaaattgaaacctacaaggctatcatgccctggtatgttttagattattaccaatccaaattagctgttccatacagctttaccaccttatatgagtatttaaaagaatacaaacgcttttttgattggctgatggatgctgatttaacgcaggcgccaaagattgctgatattgacttgagcacgcttgagcaccttaccaagaaggatttagaggcctttgtgctttatttgcgggaacgaccttctctcaacacctattccaccaaagaggggctttctcaaaccactattaatcggaccttgtctgccttatcaagcctttacaagtacttgactgaagaggttgaaaatgaccaaggggagccttatttttatcggaatgttatgaaaaaagtgtcaacaaaaaagaaaaaagaaaccctggcttccagagcggaaaatattaagcagaaactgtttttaggtgatgaaactctagctttcttggattatgtggataaggaatatgagcaaaaattgtctaatcgtgccaaatcttctttccgtaaaaataaggagagggatttggctattattgctctactacttgcttctggtgttcgtttgtctgaagcagtgaatcttgatttaaaagatgtcaatctaaatatgatgattatcgaagttattcgcaaaggcggaaaacgtgattcagtcaatgtagcaggttttgcgaaaggttatttggagtcttatttagctgttcgtcagagacgttacaaggctgaaaaacaggatcttgctttctttttaacagaataccgtggcgttccaaatcgaatggatgcttctagtatagaaaagatggttggcaagtactctgaggattttaaaattcgtgtgactcctcacaaattgcgtcatacgctagcgacaagactatatgatgctactaaatctcaggtgttagttagtcatcaattaggccattcctctactcaagtcacggatctttatacccatattgtcaatgatgagcaaaaaaatgctttagataacctt

SEQ ID NO: 2106 - protein, 368 aa, Streptococcus pyogenes
LKKLLLLRNYDDMRRELLLEKIETYKAIMPWYVLDYYQSKLAVPYSFTTLYEYLKEYKRFFDWLMDADLTQAPKIADIDLSTLEHLTKKDLEAFVLYLRERPSLNTYSTKEGLSQTTINRTLSALSSLYKYLTEEVENDQGEPYFYRNVMKKVSTKKKKETLASRAENIKQKLFLGDETLAFLDYVDKEYEQKLSNRAKSSFRKNKERDLAIIALLLASGVRLSEAVNLDLKDVNLNMMIIEVIRKGGKRDSVNVAGFAKGYLESYLAVRQRRYKAEKQDLAFFLTEYRGVPNRMDASSIEKMVGKYSEDFKIRVTPHKLRHTLATRLYDATKSQVLVSHQLGHSSTQVTDLYTHIVNDEQKNALDNL

SEQ ID NO: 2107 - DNA, 936 bp, Streptococcus agalactiae
atgatacgccagtttttaagagaacacttgatttggtatattttatatatcatgatgtttgtcctattttttattagtttctatctatatcatttaccaatgccctatttgtttaattccttaggtttaaatgttattgttttactaggaattagtatttggcaatacagtcgttacaggaaaaaaatgttacatctcaaatattttaatagtagtcaggacccctctttcgaacttcaaccgagtgattacgcttattttaatattattacacaattagaagctagagaagcgcaaaaagtttctgaaacaattgaacaaaccaatcatgttgcacttatgataaagatgtggtcgcaccaaatgaaagttccattggcagctatttcattaatggcccagacaaatcatctcgatcctaaggaagttgaacaacaattattgaaattgcaacattatcttgaaacgttgttagcatttttgaaatttagacaatatcgtgacgattttcgttttgaagctgttagccttagagaagtagtagtagaaattataaaatcgtataaggttatttgtctatccaaaagcttatctatcataattgaaggcgataatatctggaaaacagacaaaaagtggttaacttttgctctttcacaggtgctagataatgccataaaatattctaatcctgagtcaaagataataataagcataggagaagagagtattagaatacaagactacggtatcggcatactcgaagaagatatccctagactttttgaagatggctttacgggttacaacggtcatgagcaccaaaaggcaacaggcatggggttatatatgacaaaagaagtcttatctagtctgaatttgtccatttcggtggatagcaaaattaattatgggactgctgtttctatacataaa

SEQ ID NO: 2108 - protein, 312 aa, Streptococcus agalactiae
MIRQFLREHLIWYILYIMMFVLFFISFYLYHLPMPYLFNSLGLNVIVLLGISIWQYSRYRKKMLHLKYFNSSQDPSFELQPSDYAYFNIITQLEAREAQKVSETIEQTNHVALMIKMWSHQMKVPLAAISLMAQTNHLDPKEVEQQLLKLQHYLETLLAFLKFRQYRDDFRFEAVSLREVVVEIIKSYKVICLSKSLSIIIEGDNIWKTDKKWLTFALSQVLDNAIKYSNPESKIIISIGEESIRIQDYGIGILEEDIPRLFEDGFTGYNGHEHQKATGMGLYMTKEVLSSLNLSISVDSKINYGTAVSIHK

SEQ ID NO: 2109 - DNA, 1500 bp, Streptococcus pyogenes
atggaaaatcagaaacaaaaacagaagaaatataaaaattcgttaccaaaacgactatctaatatcttttttgttctttttttctgcattttctctgcctttacactgattgcctatagttcaacaaactatttcttattgaagaaagaaaagcagtcagtctttcaagctgtaaatattgttagagttcgtctttctgaggtggactctaattttacattagagaacttagcagaagttttgtacaaaaacgataaaacacatctgagaattgatgacagaaagggcagtcgagtcattaggagtgagcgcgatatcacaaatactctagatgcgaatcaagatatttatgtctataacattgataaacagatgatttttaccacagataacgaagaatcatctcctggcttgcatggtcctatcggtcgtgtgtatcacgaccatatcgaagatcagtatcgtgggttttccatgacacaaaaggtatattctaatcggactggaaaatttgtgggctatgttcaagtctttcatgatttaggcaattattatgtcattagagcaagactgctgttttggctactagttgttgagttatttggcacaagcttagcctatttaatcatcttaattactacgcggcgctttttgaagcctttacacaatttacatgaagtgatgcgtaatatctctgaaaatcctaataatttaaacctgcgctcagatatttcgtcaggagatgaaatcgaagaattgtctgttatctttgacaatatgttagacaaattggagacacatactaagttgcaatcacgttttattagtgatgtcagccatgaattacgaacaccggttgcgattattaaagggcatattggtctcttacaacgttggggtaaagatgacagtgatattcttgaagaaagcttgacagcaacagcgcatgaggctgaccgtatggcaatcatgattaatgatatgttagacatgattcgcgtacaaggctcatttgagggacatcaaaatgatatgacagttttggaagattctattgaaactgttgttggtaattttagagttttaagagaagattttatctttacatggcagtcagaaaatccaaaaacgatagcccgtatttataaaaatcattttgagcaggctttgatgattctgattgacaatgctgtgaagtattcccgtaaagaaaagaaaatcgcgattaacctttcagtgactggcaaacaagaagctattgttagagttcaagataaaggcgaaggaatttctaaagaagatattgaacatatctttgaacgcttttatagaacggataaatcacgtaatcgaacaagtacccaggctggattagggattggcttgtctattctcaagcaaattgtagatgggtatcatttacagatgaaggttgaaagtgaattaaatgaaggttcagtgtttatcttacatattcctttggcccagtctaaagagagt

SEQ ID NO: 2110 - protein, 500 aa, Streptococcus pyogenes
MENQKQKQKKYKNSLPKRLSNIFFVLFFCIFSAFTLIAYSSTNYFLLKKEKQSVFQAVNIVRVRLSEVDSNFTLENLAEVLYKNDKTHLRIDDRKGSRVIRSERDITNTLDANQDIYVYNIDKQMIFTTDNEESSPGLHGPIGRVYHDHIEDQYRGFSMTQKVYSNRTGKFVGYVQVFHDLGNYYVIRARLLFWLLVVELFGTSLAYLIILITTRRFLKPLHNLHEVMRNISENPNNLNLRSDISSGDEIEELSVIFDNMLDKLETHTKLQSRFISDVSHELRTPVAIIKGHIGLLQRWGKDDSDILEESLTATAHEADRMAIMINDMLDMIRVQGSFEGHQNDMTVLEDSIETVVGNFRVLREDFIFTWQSENPKTIARIYKNHFEQALMILIDNAVKYSRKEKKIAINLSVTGKQEAIVRVQDKGEGISKEDIEHIFERFYRTDKSRNRTSTQAGLGIGLSILKQIVDGYHLQMKVESELNEGSVFILHIPLAQSKES

SEQ ID NO: 2111 - DNA, 666 bp, Streptococcus agalactiae
atgtcacaagagcaaggaaaaatttatattgtagaagatgatatgacgattgtgtcacttttaaaagatcatttatcagctagctatcatgtctctagtgtcagcaattttcgtgatgtgaaacaagaaattatcgcatttcaacccgatttgatactaatggatattacgttaccctattttaatggtttttactggactgcagaattgcgtaagtttttaacaattcctattattttcatttcatctagtaatgatgaaatggatatggttatggcattaaatatggggggtgatgactttatttcaaaaccattctctctagctgtattagatgctaagctaactgctattttaaggagaagtcaacaatttatccaacaggaattaacttttgggggatttacgttgacaagagaagggttattgtctagccaagataaagaggttattttatcgccaacagaaaataaaatcctatctatcttgctcatgcatcctaaacaagtagtctcaaaagagtctctattagagaaactttgggaaaatgatagttttattgatcaaaatacacttaatgttaatatgacacgcttacgtaaaaaaattgtcccaataggttttgattacattcatacagtgagaggagttgggtatttactacaa

SEQ ID NO: 2112 - protein, 222 aa, Streptococcus agalactiae
MSQEQGKIYIVEDDMTIVSLLKDHLSASYHVSSVSNFRDVKQEIIAFQPDLILMDITLPYFNGFYWTAELRKFLTIPIIFISSSNDEMDMVMALNMGGDDFISKPFSLAVLDAKLTAILRRSQQFIQQELTFGGFTLTREGLLSSQDKEVILSPTENKILSILLMHPKQVVSKESLLEKLWENDSFIDQNTLNVNMTRLRKKIVPIGFDYIHTVRGVGYLLQ

SEQ ID NO: 2113 - DNA, 1962 bp, Streptococcus agalactiae
gtgaataatatgttttatctcaaaatagcctggcataatttaaaacattctatagaccagtacataccattcctcttagccagtttattactttattcattgacttgttctacgctactaatcttaatgagtgctgttggaagagatatggggacagcggcaacggttctttttcttggagtgattgttttgtcaatctttgcggtagtcatggaacattatagctacaatatcttgatgaaacagcgtagtagtgaatttggactgtataacattttggggatgaataaacgtcaagttgcgcgtgtagctagtctagagctgtttattatttatatatttcttatttctataggaagtctgtttagtgctttttttgctaaatttatttatttaatttttgtcaacattattaactatcatgcactaaatcttagtttaagtttatggccatttattatttgtatcgttatatttacaggtatttttctgactttagaagttccagttattcgacatgttcatttatcatccccattaagtctttttagaaagaaacaacagggagaaaaagaaccaaaaggtaatcttatacttgcaattttagcgttagtagctatcgccatcgcttatacaatggctcttacttcaggtaaagcacctgcattagctgttatctatcgtttcttctttgcagtacttttagttattgctggtacttatcttttttatattagttttatgacatggtacttaaaaaggttgcgtcaaaacaagcattattattataaatctgagcattttgtatcaacttcgcaaatgatttttcgaatgaagcaaaatgcagtagggttagcaagtatcactttattagctgttatggctctagttactattgctacaacagtctcactttattcaaatacacaaaatgttgttaccggactatttccaaaatcagtaagtttatcaatagataattcaaaaggtgacgcgaaaaatatatttgaagaaaagattttgaagaaactaggtaagtcatctaaggaagctatcacttataatcagacaatgatttcgatgccagttagtcaatcaagtgaacttaatatcacatctaaaaacgtcaaacatgttgatatcacaaaaacgggttttatgtacctaattactcagaatgatttccgtcgtttaggtcaccaattaccaaaattaaaagataaccaagtggcttactttgttcaaaaaggtgatagccgtttgaaaaaaataaatctattgggaaataaatttgacgttgtaaaaaatttaaaagaggcttatgtcccagagactacaaatacttacaacccgggtttgattatatttgcaaacaacaaacaaattgacaatattagaaaagcatatttaccttatactaagaacatcaatacttttccaaaaacctttaaggcatatttggatttgaatagtcaagagataaattcaatttctaaaaacgacataatagaggtagatggtaagtatgttggaaatattagcactaaacagagttttctaaaagaaggttatcaaatgtttggtgggttattatttactggatttctgttaggtataagctttttgctaggtatagctctaattgtttactataagcaatactcagaaggtcatgaagataagagatcttatcgtatcttacaagaagtaggtatgagcaaaaaattagttaaacggactattaattctcaaattatgattttcttcttccaacctttagtggtagcagttattcactttggagttgctattccaatgctaaaacagatgcttttggtatttggggtgcttaactcaacaatcgtatatgtagtaagtggtttgacagtacttgcgatttctataatttactttatcatttaccgtataactagtcgaacttattatcatattattgaacgc

SEQ ID NO: 2114 - protein, 654 aa, Streptococcus agalactiae
MNNMFYLKIAWHNLKHSIDQYIPFLLASLLLYSLTCSTLLILMSAVGRDMGTAATVLFLGVIVLSIFAVVMEHYSYNILMKQRSSEFGLYNILGMNKRQVARVASLELFIIYIFLISIGSLFSAFFAKFIYLIFVNIINYHALNLSLSLWPFIICIVIFTGIFLTLEVPVIRHVHLSSPLSLFRKKQQGEKEPKGNLILAILALVAIAIAYTMALTSGKAPALAVIYRFFFAVLLVIAGTYLFYISFMTWYLKRLRQNKHYYYKSEHFVSTSQMIFRMKQNAVGLASITLLAVMALVTIATTVSLYSNTQNVVTGLFPKSVSLSIDNSKGDAKNIFEEKILKKLGKSSKEAITYNQTMISMPVSQSSELNITSKNVKHVDITKTGFMYLITQNDFRRLGHQLPKLKDNQVAYFVQKGDSRLKKINLLGNKFDVVKNLKEAYVPETTNTYNPGLIIFANNKQIDNIRKAYLPYTKNINTFPKTFKAYLDLNSQEINSISKNDIIEVDGKYVGNISTKQSFLKEGYQMFGGLLFTGFLLGISFLLGIALIVYYKQYSEGHEDKRSYRILQEVGMSKKLVKRTINSQIMIFFFQPLVVAVIHFGVAIPMLKQMLLVFGVLNSTIVYVVSGLTVLAISIIYFIIYRITSRTYYHIIER

SEQ ID NO: 2115 - DNA, 1905 bp, Streptococcus pyogenes
atgatttggtcaattacaaaatctaacattaaaaaaaatttttcgttatatcgtatctattttctagctacgattggtttattaagtatttttatagcttttctaaattttatctcagataaaatcattacagaaaaaattggggatagtggtcaagctctagttatcgctaatgggtcattgatttttttgattgtatttttggtggtattcttaatttacttcaataatttctttgtaaaaaaacgtagtcaagagcttggagtcttagcaatactagggttttcaaaaagagaattaacaaaattactaactttagaaaatcttgttattctagttctgagttacttggtaagtttattgctgggaccgactttatattttttagctgtactggcaattactcatctattgaatttaacaatggaagttcagtggtttattacagttaatgagattatagagtctttaggaatattagtcgtagtttttctgattaatgtcatcacaaatggacttatcattagtaaacagtctttgattgaatttgttaatttctcaagaaaggctgagaaaaaaattaagataagaaaagtcagagctattattgctatcactgcattgctattgtcatatattttatgtttggcgacagtgttttcatccacacgaaatatgctattaagcatagggatggtaccggtttctctattgataattgtcttagttgttttaggaacagtgttcaccatcagatatggattggcttttgtagtttcgttgttaaaagaaaataaaaaaaggttataccgtcctctgtctaatatcatctatcccaaatttaactatcgtattgcaacaaaaaataaattattaacagtcttgggaggtcttttaacagtaaccgtttcagttgccggaatgatggtaatgctctatgcttattctcttaatgggatagagaggttgactccatctgccatagaatataatgttgaatcagaaaacggtcaagtcaatgttacaactattttagagaacgaccaagtgagcttggttgatgtcggcctgttgcgattgaatactatcccagaggtgactatcacagactctgggcaaacaataccttattttgatataattaactacagtgactacaaagagttaatgaaagctcaaggcagaacaaattctattgaaggtagtaagtcactcccattgttaataaattattatccaacagaaattagccttggaaaaacctttaacttaggaaatgcatatgatgttactgtaaaacaagtatcaacgaataatgtttttagtttttctacaagtgtcacgaccctggttgtttctgataaattatatgctaaacttagttctcgttttccagagaaagaaatgacaattaggacttttaatggaacttcgattaggtcaagtgaagcattttacaatcagtttagtatggttcctgatgttatcagtagttatagtaaggaacacacagtaaagactgctaatattgcgacttatatctttataactttcctatccatactctttattatttgtacaggtagtattctgtactttacaagcctcatcgaaatcatggaaaataaagaagaatatggctatctaagtaagctaggttatagtaaaaaaatgattcatcggattcttcgatatgaaacaggtatacttttccttattcctgtattcattgggattgtaaatggtggtatgttgcttatttactataaatatttattcatggatacattggtagcaggcaatatcataatgttatctttattgctttgtctgcttttcttcttgataatatatggcacattttatgtattgacattgcggttagtgacatccataatcaaaaat

SEQ ID NO: 2116 - protein, 635 aa, Streptococcus pyogenes
MIWSITKSNIKKNFSLYRIYFLATIGLLSIFIAFLNFISDKIITEKIGDSGQALVIANGSLIFLIVFLVVFLIYFNNFFVKKRSQELGVLAILGFSKRELTKLLTLENLVILVLSYLVSLLLGPTLYFLAVLAITHLLNLTMEVQWFITVNEIIESLGILVVVFLINVITNGLIISKQSLIEFVNFSRKAEKKIKIRKVRAIIAITALLLSYILCLATVFSSTRNMLLSIGMVPVSLLIIVLVVLGTVFTIRYGLAFVVSLLKENKKRLYRPLSNIIYPKFNYRIATKNKLLTVLGGLLTVTVSVAGMMVMLYAYSLNGIERLTPSAIEYNVESENGQVNVTTILENDQVSLVDVGLLRLNTIPEVTITDSGQTIPYFDIINYSDYKELMKAQGRTNSIEGSKSLPLLINYYPTEISLGKTFNLGNAYDVTVKQVSTNNVFSFSTSVTTLVVSDKLYAKLSSRFPEKEMTIRTFNGTSIRSSEAFYNQFSMVPDVISSYSKEHTVKTANIATYIFITFLSILFIICTGSILYFTSLIEIMENKEEYGYLSKLGYSKKMIHRILRYETGILFLIPVFIGIVNGGMLLIYYKYLFMDTLVAGNIIMLSLLLCLLFFLIIYGTFYVLTLRLVTSIIKN

SEQ ID NO: 2117 - DNA, 750 bp, Streptococcus agalactiae
atgttattagaaatcaatcacttagaaaaagtttttcgtacacgtttttcaaaagaagagacaagggctctacaagacgtcgattttaaagttgaacaaggggaattcattgctattatgggagagtctggttcgggaaaaacaactctgctaaatattttagctactttagaaaaaccgacaaatggacaagtgattttaaatggggaagatattacgaaaattaaagaggcaaaattagcgagttttcgtttgaaaaatcttggtttcgtctttcaggacttcaaccttttggatactctctctgtaagagataatatctatcttcctttagttcttgatcgtaaacgttacaaagaaatggatcatcgtttgtcagaattatcttctcatctgagaattgatgacttattagataagagacctttcgagctctctggtgggcaaaagcaacgtgtagcgattgctcgtagtttgataaccaaccctcaaattttattagcagatgaaccaacagcagcgttagattaccgtaattcagaagacttgctgaatttatttgaaactattaacttggatggacaaactattttgatggtaacccattcagcaaatgctgctagtcatgccaaacgcgttttatttatcaaagatggacgtatttttcaccaactttatcgtggtaataagaataatagcgaattcaataaagatatttctttaacaatgtctgccatattagggggtgaa

SEQ ID NO: 2118 - protein, 250 aa, Streptococcus agalactiae
MLLEINHLEKVFRTRFSKEETRALQDVDFKVEQGEFIAIMGESGSGKTTLLNILATLEKPTNGQVILNGEDITKIKEAKLASFRLKNLGFVFQDFNLLDTLSVRDNIYLPLVLDRKRYKEMDHRLSELSSHLRIDDLLDKRPFELSGGQKQRVAIARSLITNPQILLADEPTAALDYRNSEDLLNLFETINLDGQTILMVTHSANAASHAKRVLFIKDGRIFHQLYRGNKNNSEFNKDISLTMSAILGGE

SEQ ID NO: 2119 - DNA, 672 bp, Streptococcus pyogenes
ttgttaaaccttaaagatattcgaaaaagctatcatcttggaactgaagaatttgcgattttaaaaggaatcgatttagaagttaacgagggtgactttttagccatcatgggaccatcaggttcgggaaagtcaacattgatgaatatcattgggtgtttagataagcctggctctggctcatatgccattgaaggcagagacgtgtcatccttatctgataatgaacttgctgatttgcgtaatcaaaaaatcggctttgtttttcaaaattttaacctgatgcccaagctaacagcttgtcaaaatgtcgaattacccttgacttatatgaatgttcctaaaaaagagcgtcgcaaacgagccctagagatgttaaagctagtaggactagaagaacgtagtgaatttaaaccgatggagctatctggtgggcaaaaacagcgtgtagcgattgcaagagctttagtcactaacccgagttttatccttggtgatgagccaacaggtgcactagacacaaaaaccagcgtccaaatcatggacctatttaaacaattcaatgataacggcaaaacgattattatcatcacacacgagcctgaagtagctgccctatgcaaaaagacggtgatcctaagagatggtaatatagaacattccgatatagag

SEQ ID NO: 2120 - protein, 224 aa, Streptococcus pyogenes
LLNLKDIRKSYHLGTEEFAILKGIDLEVNEGDFLAIMGPSGSGKSTLMNIIGCLDKPGSGSYAIEGRDVSSLSDNELADLRNQKIGFVFQNFNLMPKLTACQNVELPLTYMNVPKKERRKRALEMLKLVGLEERSEFKPMELSGGQKQRVAIARALVTNPSFILGDEPTGALDTKTSVQIMDLFKQFNDNGKTIIIITHEPEVAALCKKTVILRDGNIEHSDIE

SEQ ID NO: 2121 - DNA, 960 bp, Streptococcus agalactiae
atgcggcgaaaaatagttttactttttgtagttccaatgcttatagttttaggaattttaggagtggtagttcattattatggttcagcattaaatatttatctattacctcctagtagcgaacgttatggacgtgttattttagatcgtgttgaacagcgtggtttgtattcgcaaggtcgtcaatggcaaattataagacaacgatcagaaaaaaagttgaaaacgtcaaaatcttaccaagagagtcgcaacattgtacaggaagcagtacggtatggaggcggtaaacatagtcaaatattatccaaagagactgtacgaagagataccctagatagtcgatatccagaatatcgaagattaaacgaagacattctcttaattactattccttctataagtaagttagataaacgatctattagccattatagtggtaaattacaaaatatattgatggaaaaaagttataagggactcattttagacttatcgaataatactggcggcaatatgatccctatgattgggggggtagcctctattttaccaaatgataccctatttcattatactgataagtatggaaataagaaaacaatcacgatgaaaaatataccgctagaagcattaaaaatatctaggaaaacaatcaatactaagcatgttccaatcgctattataactaatcataaaactgctagttcggcagaaatgacttttttatcatttaaaggattacctaatgttaaaagctttggtcaagctacagcaggatatacgactgttaatgaaactttcatgctttacgacggtgctagattagctttaactacaggaatagttagtgatcgacaaggatataaatacgagaacacccctatcttaccagatcaagtaaccagccttcctttacaagagtcacagtcttggttaaagagtagaatcaatcaaaat

SEQ ID NO: 2122 - protein, 320 aa, Streptococcus agalactiae
MRRKIVLLFVVPMLIVLGILGVVVHYYGSALNIYLLPPSSERYGRVILDRVEQRGLYSQGRQWQIIRQRSEKKLKTSKSYQESRNIVQEAVRYGGGKHSQILSKETVRRDTLDSRYPEYRRLNEDILLITIPSISKLDKRSISHYSGKLQNILMEKSYKGLILDLSNNTGGNMIPMIGGVASILPNDTLFHYTDKYGNKKTITMKNIPLEALKISRKTINTKHVPIAIITNHKTASSAEMTFLSFKGLPNVKSFGQATAGYTTVNETFMLYDGARLALTTGIVSDRQGYKYENTPILPDQVTSLPLQESQSWLKSRINQN

SEQ ID NO: 2123 - DNA, 171 bp, Streptococcus agalactiae
atggccaagacaagtaaaaaattgacaaaatctttagggcctattggtaaattaatttcaataatccctgacacaactgaacttattggaaaagcaattgataattctcgtccaattattgaaaaagaacttgaccgtcgtcatgaaaaaaaaacagacttatactcagct

SEQ ID NO: 2124 - protein, 57 aa, Streptococcus agalactiae
MAKTSKKLTKSLGPIGKLISIIPDTTELIGKAIDNSRPIIEKELDRRHEKKTDLYSA

SEQ ID NO: 2125 - DNA, 480 bp, Streptococcus pyogenes
atgccaaagagaataagaaaagctctaggagtagttgggaaactgatgtcaattgttcctgacactactgaaattattggaaaaacgattgataacagtcgaccaattatcgaaaaacgtatggaacaaaaacatgaaaaagagatgcaattacgcacgataaatgatgtgattaatcttcctgttgatcaggcacaagctcatttggaacaacttggctttgtagtagccactatacctgctaagcctcataaaaaatggcttcatagtaatctcaatgaagtggttgctatgtctccaaaatctggtaaatataagataggaagcctgatcaaactctactacattactgttgatgttttggaaaaaagtcaagacttattagaccaagaaaacttgcggactgtggaacgcaatcaaaaaatcgctgatacttttgagtctgtcaaacacattcgatttccttttaaaaaatggcgt

SEQ ID NO: 2126 - protein, 160 aa, Streptococcus pyogenes
MPKRIRKALGVVGKLMSIVPDTTEIIGKTIDNSRPIIEKRMEQKHEKEMQLRTINDVINLPVDQAQAHLEQLGFVVATIPAKPHKKWLHSNLNEVVAMSPKSGKYKIGSLIKLYYITVDVLEKSQDLLDQENLRTVERNQKIADTFESVKHIRFPFKKWR

SEQ ID NO: 2127 - DNA, 345 bp, Streptococcus agalactiae
atgaaaaaaaaacagacttatactcagcttgataatgtagtacaccttgatatcaatgatgcgcaagtttacttagagcaacgccattttaatgtatcaaggattgttgctgaaccaaattcaaagtgggcaaccctacatcctaatcaagttgtgaatatgtcgcctaaagctggtagggtcagaatcggttcattagtgaagttgtactatattacagaggatatccttgaagaaagtaagacactacttttatctaaatccgaaaaaagtaaagcacgacaacaacggttaacagaagtattgagtacccctagtcaattactcaaaaaaaatcgaaataaa

SEQ ID NO: 2128 - protein, 115 aa, Streptococcus agalactiae
MKKKQTYTQLDNVVHLDINDAQVYLEQRHFNVSRIVAEPNSKWATLHPNQVVNMSPKAGRVRIGSLVKLYYITEDILEESKTLLLSKSEKSKARQQRLTEVLSTPSQLLKKNRNK

SEQ ID NO: 2129 - DNA, 846 bp, Streptococcus agalactiae
atgaaaatcaaaaagctattagggttaacgacaacagtagtaatttcagcacttattttaggagcctgtggtcagtctaaaaatgaagacgccaaagtcgttagagttggaacaatggtaaagagtaaaactgaaaaagctcgttgggataaaatcgaagaattagttaagaaaaaaggcgttaagctaaaatttacggaattcacagattatacacaacctaataaagctttagaaagtgatgagattgatattaatgctttccagcattataattacttaaacaattggaataaagcaaataagaccaatcttgtttccgttgctgagacatactttacttcctttagattatactctggtactaagaacggtaaaggtaaataccaaacagtttctgaaattccaaataaagcaactattactatcccaaacgatgcagttaacgaaagtcgctctctctacttgttacaatcagcaggcttgctaaaattgaaagtatcaggtgatgcattagcaacaatgtcagatgttgtttccaatcctaaatctttagatttaaaagaagtagatgcagcacagaccgcacgttctttggattccacagatgcagcagttattaataatgattttgtgacagaagcaggaataaatcctaaatcagctatttttattgaaccaaaaagtaaaaatgcaaaacaatggtacaaccttttagttgctcaaaaaggttggcaagacaaatcaaaagctaaagccattaaagaagttgtgaaagcttaccatacagatgcggttaaaaaagttatcgaaaaaacatctcaaggtttagatcaacctgtttgg

SEQ ID NO: 2130 - protein, 282 aa, Streptococcus agalactiae
MKIKKLLGLTTTVVISALILGACGQSKNEDAKVVRVGTMVKSKTEKARWDKIEELVKKKGVKLKFTEFTDYTQPNKALESDEIDINAFQHYNYLNNWNKANKTNLVSVAETYFTSFRLYSGTKNGKGKYQTVSEIPNKATITIPNDAVNESRSLYLLQSAGLLKLKVSGDALATMSDVVSNPKSLDLKEVDAAQTARSLDSTDAAVINNDFVTEAGINPKSAIFIEPKSKNAKQWYNLLVAQKGWQDKSKAKAIKEVVKAYHTDAVKKVIEKTSQGLDQPVW

SEQ ID NO: 2131 - DNA, 789 bp, Streptococcus pyogenes
ttggttgcttgttctgaaaaacaagatgataaaaacactttaactattggggtgatgacaaaaacagaatctgatcaagcgagatgggataaagttgaagaattattgaaaaaagacaatatcactttgaagtacaaagaatttacagattactcgcaacctaataaggcagttgctaatggtgaagtcgatattaatgccttccaacactataatttcttaaataactggaataaggaaaataaggaacatttggtggccattgctgatacctatatcagcccaattaaccttttctctggaaccagtcaagatggaaaggctaaatacaaatcagtagctgatctgccaaatggtactcaaattgcagtaccaaatgatgcgaccaatgaaagccgtgccctctatgtgctgcaatcagctggcctcattaaattgaatgtgtctggtgatcaattagcaaccattgccaatatctcagagaacaaaaagaaattagatatcaaggaattagatgctagccaaacggcacgtgctttagtatctgctgatgcagctgttgtcaataatagttacgctgttcctgcaaaaattgactacaaaacctctcttttcaaagaaaaagcagatgacaattcaaaacagtggattaacattattgcaggtcaaaaagattgggaaaaatcagagaaggctgatgctattaaaaaactcatcaaggcctaccaaactgatgaggtgaagaaagtcgtggaaaaaacttcaaatggtatagatgtatccgtatgg

SEQ ID NO: 2132 - protein, 263 aa, Streptococcus pyogenes
LVACSEKQDDKNTLTIGVMTKTESDQARWDKVEELLKKDNITLKYKEFTDYSQPNKAVANGEVDINAFQHYNFLNNWNKENKEHLVAIADTYISPINLFSGTSQDGKAKYKSVADLPNGTQIAVPNDATNESRALYVLQSAGLIKLNVSGDQLATIANISENKKKLDIKELDASQTARALVSADAAVVNNSYAVPAKIDYKTSLFKEKADDNSKQWINIIAGQKDWEKSEKADAIKKLIKAYQTDEVKKVVEKTSNGIDVSVW

SEQ ID NO: 2133 - DNA, 756 bp, Streptococcus agalactiae
atgaatggagtaaatatgcactataaagaattacttgagtcatccgaaaaagcttatttggaaactaatcggtataaacattttaagaatataatcatttcagagcgttatttttcaaactatattagctacaaaataatgcctacagtaagtgagtttttacaggatatgatctatttagcagatgaacaaaaagattatcagtctgattttgcttttgtattttttgaggaaaatgctgaattgagcagtgaattacagagaactttatcacaacaaggctttgaatcagagaaacatatcatatttacaaattcattaaatcatcttaaactttttgaaaaagaatttgatgacatcacatttactaaacttaatgaaaattacctagaaaaatacctaaagttcaaatataaacaaagtatagtttacggagaaatttacgctaagcaaatgtataatgataatcgtgttaatcttttaaataataatgctaaagtttacctagctattaaagataatcaaattattggagatgtaacagcttgggactatggtgaatacgtggaaatagatgatttttatgtccaagagtcctacagaggacaaggaattggtacgcgcctacaatttgatgcaagtagggggtttaagaaagttatcttaatttcagaagaagaaaacagaaaaatgtatgagcaccaaggttatgaggaagtcgcctattattggaccgctttacggagccctcgaaag

SEQ ID NO: 2134 - protein, 252 aa, Streptococcus agalactiae
MNGVNMHYKELLESSEKAYLETNRYKHFKNIIISERYFSNYISYKIMPTVSEFLQDMIYLADEQKDYQSDFAFVFFEENAELSSELQRTLSQQGFESEKHIIFTNSLNHLKLFEKEFDDITFTKLNENYLEKYLKFKYKQSIVYGEIYAKQMYNDNRVNLLNNNAKVYLAIKDNQIIGDVTAWDYGEYVEIDDFYVQESYRGQGIGTRLQFDASRGFKKVILISEEENRKMYEHQGYEEVAYYWTALRSPRK

SEQ ID NO: 2135 - DNA, 1332 bp, Streptococcus agalactiae
atgtctcaatcttacattaatgttatcggcgctggtttggctggttctgaagcagcttatcaaattgctaaacgtggaataccagttaagctttatgaaatgcgtggggttaaatcaacccctcaacataaaacagataattttgcagaattagtatgttccaattcattccgcggtgattctctaacaaatgcagttggtcttttaaaagaagaaatgcgtcgtttggattctatcattatgagaaatggggaggcacatcgagttccagcaggtggagccatggccgttgatagagaaggttattctgaagctgttactgaggaaatccataaacatccattaatcgaagtaattcgtgatgaaatcacagatatccctggagatgctattacagttatcgctacaggaccattaacaagtgatagtctggcagctaaaatccatgaacttaatggtggtgatggtttttatttttacgatgccgccgctccaattgtcgataaaaatacgattgacataaataaagtttaccttaagtctaggtatgacaaaggtgaagcagcttatctaaattgtccaatgaccaaagaagaatttatggcttttcatgaagctttaactacagctgaggaagcaccactaaattcttttgagaaagaaaaatacttcgaaggttgtatgcctatcgaagtgatggctaagcgtggtattaaaacgatgctttatggtccaatgaaaccagttggtttggagtatcctgaggactacaaaggaccgcgagatggtgaatttaaaacaccatatgctgttgttcaattacgtcaagataatgctgcaggctctctttataacatagttggtttccaaactcatcttaagtggggagaacaaaaacgtgtatttcaaatgattcctggtcttgaaaatgctgaatttgtccggtatggtgttatgcatcgcaattcttatatggattcaccaaatcttttaaaccaaacctttgctacacgtaagaacccaaatcttttctttgctggacaaatgaccggtgttgaaggttatgtagaatcggcagcaagtggtcttgtagcgggaatcaatgctgtccgtcgcttcaatggggagagtgaagtagttttcccacaaactactgctattggtgcactgccacattatattacacatacagacagcaaacatttccaaccaatgaatgttaactttggtatcatcaaagaattagaaggtccacgaattcgtgataagaaagagcgttatgaagctattgctacacgagctttgaaagatttagaaaaatttctcaactat

SEQ ID NO: 2136 - protein, 444 aa, Streptococcus agalactiae
MSQSYINVIGAGLAGSEAAYQIAKRGIPVKLYEMRGVKSTPQHKTDNFAELVCSNSFRGDSLTNAVGLLKEEMRRLDSIIMRNGEAHRVPAGGAMAVDREGYSEAVTEEIHKHPLIEVIRDEITDIPGDAITVIATGPLTSDSLAAKIHELNGGDGFYFYDAAAPIVDKNTIDINKVYLKSRYDKGEAAYLNCPMTKEEFMAFHEALTTAEEAPLNSFEKEKYFEGCMPIEVMAKRGIKTMLYGPMKPVGLEYPEDYKGPRDGEFKTPYAVVQLRQDNAAGSLYNIVGFQTHLKWGEQKRVFQMIPGLENAEFVRYGVMHRNSYMDSPNLLNQTFATRKNPNLFFAGQMTGVEGYVESAASGLVAGINAVRRFNGESEVVFPQTTAIGALPHYITHTDSKHFQPMNVNFGIIKELEGPRIRDKKERYEAIATRALKDLEKFLNY

SEQ ID NO: 2137 - DNA, 1494 bp, Streptococcus pyogenes
ttgaaaagggttcccgtagaaagagacaaacgcttagtctctttctttttctttcttctcatttctgttataataagtcaggtaactacattagaaagatttgtgggtctgtcatctaagagatgtcattcccgaagaggtattagtgacttgtctcaatcaactgcaacttatattaatgttattggagctgggctagctggttctgaagctgcctatcagattgctaagcgcggtatccccgttaaattgtatgaaatgcgtggtgtcaaagcaacaccgcaacataaaaccactaattttgccgaattggtctgttccaactcatttcgtggtgatagcttaaccaatgcagtcggtcttctcaaagaagaaatgcggcgattagactccattattatgcgtaatggtgaagctaaccgcgtacctgctgggggagcaatggctgttgaccgtgaggggtatgcagagagtgtcactgcagagttggaaaatcatcctctcattgaggtcattcgtggtgaaattacagaaatccctgacgatgctatcacggttatcgcgacgggaccgctgacttcggatgccctggcagaaaaaattcacgcgctaaatggtggcgacggattctatttttacgatgcagcagcgcctatcattgataaatctaccattgatatgagcaaggtttaccttaaatctcgctacgataaaggcgaagctgcttacctcaactgccctatgaccaaagaagaattcatggctttccatgaagctctgacaaccgcagaagaagccccgctgaatgcctttgaaaaagaaaagtattttgaaggctgtatgccgattgaagttatggctaaacgtggcattaaaaccatgctttatggacctatgaaacccgttggattggaatatccagatgactatacaggtcctcgcgatggagaatttaaaacgccatatgccgtcgtgcaattgcgtcaagataatgcagctggaagcctttataatatcgttggtttccaaacccatctcaaatggggtgagcaaaaacgcgttttccaaatgattccagggcttgaaaatgctgagtttgtccgctacggcgtcatgcatcgcaattcctatatggattcaccaaatcttttaaccgaaaccttccaatctcggagcaatccaaaccttttctttgcaggtcagatgactggagttgaaggttatgtcgaatcagctgcttcaggtttagtagcaggaatcaatgctgctcgtttgttcaaaagagaagaagcacttatttttcctcagacaacagctattgggagtttgcctcattatgtgactcatgccgacagtaagcatttccaaccaatgaacgtcaactttggcatcatcaaagagttagaaggcccacgcattcgtgacaaaaaagaacgttatgaagctattgctagtcgtgctttggcagatttagacacctgcttagcgtcgctt

SEQ ID NO: 2138 - protein, 498 aa, Streptococcus pyogenes
LKRVPVERDKRLVSFFFFLLISVIISQVTTLERFVGLSSKRCHSRRGISDLSQSTATYINVIGAGLAGSEAAYQIAKRGIPVKLYEMRGVKATPQHKTTNFAELVCSNSFRGDSLTNAVGLLKEEMRRLDSIIMRNGEANRVPAGGAMAVDREGYAESVTAELENHPLIEVIRGEITEIPDDAITVIATGPLTSDALAEKIHALNGGDGFYFYDAAAPIIDKSTIDMSKVYLKSRYDKGEAAYLNCPMTKEEFMAFHEALTTAEEAPLNAFEKEKYFEGCMPIEVMAKRGIKTMLYGPMKPVGLEYPDDYTGPRDGEFKTPYAVVQLRQDNAAGSLYNIVGFQTHLKWGEQKRVFQMIPGLENAEFVRYGVMHRNSYMDSPNLLTETFQSRSNPNLFFAGQMTGVEGYVESAASGLVAGINAARLFKREEALIFPQTTAIGSLPHYVTHADSKHFQPMNVNFGIIKELEGPRIRDKKERYEAIASRALADLDTCLASL

SEQ ID NO: 2139 - DNA, 696 bp, Streptococcus agalactiae
ttgttaccagcatatattaaaattcacgacgctattaaaaaggaaatcgataaagggacttggaagattgggcagcggttacctagcgaaagagatttagcggatgattatagtgtaagtcgtatgacacttcgccaatcaattacattgttagttgaagaaggtattttggagagacgagttggtagtggcacctatgttgctagtcatcgtgttcaagaaaaaatgcggggaacaactagttttacagaaattgtcaattctcaagggcgtaagccatccagtaaactaatctcatttcaaagaaaactagcaaatgaaaccgaaattcaaaaattaaatttatcacagtcagattatgtggttcgtatggaaagggtacgttatgctgataaggtaccgttggtttatgaggtagcctctataccagagaatttaattaaaggttttgaacaatcagaggttacagaacatttctttaaaaccttaacagagaatggctacgaaattgggaaaagccaacaaactatatatgctagaaatgctagtgaacgtgttgcttcgcatttagaagttaacgcaggccatgctattttggcattgacacaagtttcatactttactgatggtaagccttttgaatatgttcatgggcaatatgttggagatcgttttgagttttatttagagaataac

SEQ ID NO: 2140 - protein, 232 aa, Streptococcus agalactiae
MLPAYIKIHDAIKKEIDKGTWKIGQRLPSERDLADDYSVSRMTLRQSITLLVEEGILERRVGSGTYVASHRVQEKMRGTTSFTEIVNSQGRKPSSKLISFQRKLANETEIQKLNLSQSDYVVRMERVRYADKVPLVYEVASIPENLIKGFEQSEVTEHFFKTLTENGYEIGKSQQTIYARNASERVASHLEVNAGHAILALTQVSYFTDGKPFEYVHGQYVGDRFEFYLENN

SEQ ID NO: 2141 - DNA, 1560 bp, Streptococcus agalactiae
atgactgatatttctatattgaatgatatccaaaaaattatcgttctagattacggtagtcaatataaccagcttatcgcacgtcgtatccgtgaatttggtgtattttctgagttaaaatcacataaaattacggctgatgaaattcgcgatattaatcctattggtatcgtactttcaggtggtccaaattccgtatacgctgatggcgcttttggaatcgatgaagaaatttttgaattaggaattccaatcttaggaatttgttatggcatgcaactgattacccataaactcggtggtaaggttcttcctgcgggagaagctggtcatcgtgagtatggtcaatcagcacttcgcctacgctcagaatcagcactctttgctggcactcctcaagaacaacttgttttgatgagccatggtgatgctgtcactgaaattcctgagggtttccatctcgttggtgactctgttgactgtccatttgctgcaatggaaaatactgaaaaacaattttatggtatccaattccaccccgaagttcgtcactcagtatatggcaatgatatccttaaaaattttgctgttaatatctgtggcgcacgtggtgattggtcaatggataacttcattgatatggaaattgcaaaaatacgtgaaactgtaggcgatcgtaaagtacttcttggactatctggcggtgttgattcatctgttgtcggagtactcctacaacgtgctatcggtgatcaattaacatgtatttttgtagatcatggtttattacgtaaaaatgaaggtgaccaagttatggatatgcttggtggtaaatttggacttaatattatccgtgttgatgcttcaaaacgcttcctagatcttctttctggtgttgaagatcccgagagaaaacgaaaaatcatcggaaatgagttcgtgtacgtttttgatgatgaggcaagtaaacttaaaggcgttgatttccttgctcaaggtaccctctacacagatattattgaatctgggacagaaacagcccaaacaatcaagtcacaccataatgttggtggattgccagaagatatgcaatttgaattgattgagccacttaacacattattcaaagatgaggttcgcgctcttggtactgcacttggaatgcctgatgaagttgtatggcgtcaaccattccctgggcctggtcttgctattcgcgttatgggtgaaattaccgaagaaaaacttgaaacagtccgcgaatcagatgctattcttcgtgaagaaatcgctaaagctggtctagatcgtgacgtatggcagtatttcacagttaatactggcgtacgttctgtcggtgttatgggagatggtcgtacttatgactatacaattgctatccgtgcaattacttcaattgatggcatgacagctgactttgcgcaacttccttgggatgtacttaagaaaatttcgacacgtattgttaacgaagttgatcacgttaaccgtattgtttatgatattacaagtaaaccacctgcaactgttgagtgggaa

SEQ ID NO: 2142 - protein, 520 aa, Streptococcus agalactiae
MTDISILNDIQKIIVLDYGSQYNQLIARRIREFGVFSELKSHKITADEIRDINPIGIVLSGGPNSVYADGAFGIDEEIFELGIPILGICYGMQLITHKLGGKVLPAGEAGHREYGQSALRLRSESALFAGTPQEQLVLMSHGDAVTEIPEGFHLVGDSVDCPFAAMENTEKQFYGIQFHPEVRHSVYGNDILKNFAVNICGARGDWSMDNFIDMEIAKIRETVGDRKVLLGLSGGVDSSVVGVLLQRAIGDQLTCIFVDHGLLRKNEGDQVMDMLGGKFGLNIIRVDASKRFLDLLSGVEDPERKRKIIGNEFVYVFDDEASKLKGVDFLAQGTLYTDIIESGTETAQTIKSHHNVGGLPEDMQFELIEPLNTLFKDEVRALGTALGMPDEVVWRQPFPGPGLAIRVMGEITEEKLETVRESDAILREEIAKAGLDRDVWQYFTVNTGVRSVGVMGDGRTYDYTIAIRAITSIDGMTADFAQLPWDVLKKISTRIVNEVDHVNRIVYDITSKPPATVEWE

SEQ ID NO: 2143 - DNA, 1560 bp, Streptococcus pyogenes
atgactgaaatttcaattttgaatgatgttcaaaaaattatcgttcttgattatggtagccagtacaatcagcttattgctagacgtattcgagagtttggtgttttctccgaactaaaaagccataaaatcaccgctcaagaacttcgtgagatcaatcccataggtatcgttttatcaggagggcctaactctgtttacgctgataacgcctttggcattgaccctgaaatctttgaactagggattccgattcttggtatctgttacggtatgcaattaatcacccataaattaggtggtaaagttgttcctgctggacaagctggtaatcgtgaatacggtcagtcaacccttcatcttcgtgaaacgtcaaaattattttcaggcacacctcaagaacaactcgttttgatgagccatggtgatgctgttactgaaattccagaaggtttccaccttgttggagactcaaatgactgtccctatgcagctattgaaaatactgagaaaaacctttacggtattcagttccacccagaagtgagacactctgtttatggaaatgacattcttaaaaactttgctatatcaatttgtggcgcgcgtggtgattggtcaatggataattttattgacatggaaattgctaaaattcgtgaaactgtaggcgatcgtaaagttcttctaggtctttctggtggagttgattcttcagttgttggtgttctacttcaaaaagctatcggtgaccaattaacttgtattttcgttgatcacggtcttcttcgtaaagacgagggcgatcaagttatgggaatgcttgggggcaaatttggcctaaatattatccgtgtggatgcttcaaaacgtttcttagaccttcttgcagacgttgaagatcctgagaaaaaacgtaaaattattggtaatgaatttgtctatgtttttgatgatgaagccagcaaattaaaaggtgttgacttccttgcccaaggaacactttatactgatatcattgagtcaggaacagaaactgctcaaaccatcaaatcacatcacaatgtgggtggtctccccgaagacatgcagtttgaattgattgagcccttaaacactcttttcaaagatgaagttcgagcgcttggaatcgctcttggaatgcctgaagaaattgtttggcgccaaccatttccaggtcctggacttgctatccgtgtcatgggagcaattactgaagaaaaacttgaaaccgttcgcgaatcagacgctatccttcgtgaagaaattgctaaggctggacttgatcgtgacgtgtggcaatactttacagttaacacaggtgtccgttctgtaggcgtcatgggagatggtcgtacttatgattataccatcgccattcgtgctattacgtctattgatggtatgacagctgactttgctcaacttccttgggatgtcttgaaaaaaatctcaacacgtatcgtaaatgaagttgaccacgttaaccgtatcgtctacgacatcacaagtaaaccacccgcaacagttgaatgggaa

SEQ ID NO: 2144 - protein, 520 aa, Streptococcus pyogenes
MTEISILNDVQKIIVLDYGSQYNQLIARRIREFGVFSELKSHKITAQELREINPIGIVLSGGPNSVYADNAFGIDPEIFELGIPILGICYGMQLITHKLGGKVVPAGQAGNREYGQSTLHLRETSKLFSGTPQEQLVLMSHGDAVTEIPEGFHLVGDSNDCPYAAIENTEKNLYGIQFHPEVRHSVYGNDILKNFAISICGARGDWSMDNFIDMEIAKIRETVGDRKVLLGLSGGVDSSVVGVLLQKAIGDQLTCIFVDHGLLRKDEGDQVMGMLGGKFGLNIIRVDASKRFLDLLADVEDPEKKRKIIGNEFVYVFDDEASKLKGVDFLAQGTLYTDIIESGTETAQTIKSHHNVGGLPEDMQFELIEPLNTLFKDEVRALGIALGMPEEIVWRQPFPGPGLAIRVMGAITEEKLETVRESDAILREEIAKAGLDRDVWQYFTVNTGVRSVGVMGDGRTYDYTIAIRAITSIDGMTADFAQLPWDVLKKISTRIVNEVDHVNRIVYDITSKPPATVEWE

SEQ ID NO: 2145 - DNA, 348 bp, Streptococcus agalactiae
gtgcaatcggcaacacctgtaggagcttcaaacgtttattatttgacaggtttcactacacaaggatcaaccaaagctaaagctttccatgatcattacgttaaggcatatggtgaagaaccatccatgttctcggctttatcatacgacgctgtgtatatggcagctaaatctgctaaaggagctaaaacttcaattgatattaaaaaagctttagctaagctgaaagattttaaaggtgtgacagggaaaatgtctattgataaaaatcacaatgttgttaaatcagcttacgttgtcaaattagaggatggaaaaacaagtagcgttaacattatttcagcaaaa

SEQ ID NO: 2146 - protein, 116 aa, Streptococcus agalactiae
MQSATPVGASNVYYLTGFTTQGSTKAKAFHDHYVKAYGEEPSMFSALSYDAVYMAAKSAKGAKTSIDIKKALAKLKDFKGVTGKMSIDKNHNVVKSAYVVKLEDGKTSSVNIISAK

SEQ ID NO: 2147 - DNA, 867 bp, Streptococcus agalactiae
atgcttcaacagctcgttaatggacttatcttaggatccatatatgctttacttgccttaggatatactatggtatatggcattattaagctgattaattttgctcatggggacatctatatgatgggcgctttcatgggctattatttgattaatcatcttcatcttaattttttcctagctttattaattgcaatgctggggtctgctttcctaggtgttgtaattgaatatttagcttatcgtccactgagaaaatcaactagaattgccgcgttaattacagctattggtgtttcttttcttttggagtacgggatggtataccttgttggagcggatactagggcatttccgcaagccattcatactgttaaatataatttaggaccgataactataaccaatgttcagctcatcattttaggtattgcgctattactaatgcttactttacagttcatcgttcaaaaaactaaaatggggaaagctatgagagctttatcagtggatagcgatgccgcacaattgatgggaattaatgttaaccgtaccattagttttacatttgcgctggggtctgctttagctggagcaggtggagtactgattgggctttattataattctgttcaacctcttatgggggtaactccagggttgaaagcatttgttgcagctgtcttaggtggtattggtatcattccgggagcggctatcggtggttttgttattggcattttagaaactttagcgactgcacttggtgtgtcagattttcgagatggtatcgtttatgctattttaattctcattttcttgatccgtccagcaggaattcttggaaaaaatattaaggagaaggtc

SEQ ID NO: 2148 - protein, 289 aa, Streptococcus agalactiae
MLQQLVNGLILGSIYALLALGYTMVYGIIKLINFAHGDIYMMGAFMGYYLINHLHLNFFLALLIAMLGSAFLGVVIEYLAYRPLRKSTRIAALITAIGVSFLLEYGMVYLVGADTRAFPQAIHTVKYNLGPITITNVQLIILGIALLLMLTLQFIVQKTKMGKAMRALSVDSDAAQLMGINVNRTISFTFALGSALAGAGGVLIGLYYNSVQPLMGVTPGLKAFVAAVLGGIGIIPGAAIGGFVIGILETLATALGVSDFRDGIVYAILILIFLIRPAGILGKNIKEKV

SEQ ID NO: 2149 - DNA, 1089 bp, Streptococcus pyogenes
gtggttcaattcataaggaggaaggtcatgtctaaaaatgcgcaaaaaattgctgtaccattgatttctgtcttgctaggatttttacttggcgctattattatggttatctttggttatgatcctatctgggggtatgaaggtttattccaaattgcctttggtagtgttaaaaatattggagaaatattccgttcaatggggccattgattttaatagcgcttggctttactgttgctagccgtgcaggcttctttaacgttggtttgtctggacaggctttagctggatggatttcagcaggttggtttgcactcttaaatccagatatgcctcgtccattattgattcttatgacagctcttatcggaatgattgctggtggtattgctggagctattccagggatacttcgtgcttatcttggtacaagtgaagttatcgttacgattatgatgaactacatcattttatatgtcggaaatgctattgttcaacgtggttatcctgagagtgtcaaacaaagtattgattcaactattcaagttagtgataatgctagttatcaaacgcattggttatcagccctaactaataactctcgtattaatattggtattttctttgccattattgccattgccctaatctggttcttgcttaacaaaactactttaggttttgagattcgttcagttggtctcaacccacatgcttcagaatacgcagggatgtcatcaaaacgtactatcattttatcaatgattatctctggagctcttgcaggtcttggaggagtagttgaaggtctaggaacctttgaaaatgtttttgtacaaggatcttctttagcagttggttttgacggtatggcagttagcttattagcagcaaattcaccgcttggaatatttttctcatcattcctatttggtgtcttaaatattggtgctccaggaatgaatattgcaggcattccaccagaacttgttaaagtagtaactgcatcaatcattttctttgttggttcacattacctcattgaacgttacattattcgccctaaaaaattagtgaaaggtggtaaa

SEQ ID NO: 2150 - protein, 363 aa, Streptococcus pyogenes
VVQFIRRKVMSKNAQKIAVPLISVLLGFLLGAIIMVIFGYDPIWGYEGLFQIAFGSVKNIGEIFRSMGPLILIALGFTVASRAGFFNVGLSGQALAGWISAGWFALLNPDMPRPLLILMTALIGMIAGGIAGAIPGILRAYLGTSEVIVTIMMNYIILYVGNAIVQRGYPESVKQSIDSTIQVSDNASYQTHWLSALTNNSRINIGIFFAIIAIALIWFLLNKTTLGFEIRSVGLNPHASEYAGMSSKRTIILSMIISGALAGLGGVVEGLGTFENVFVQGSSLAVGFDGMAVSLLAANSPLGIFFSSFLFGVLNIGAPGMNIAGIPPELVKVVTASIIFFVGSHYLIERYIIRPKKLVKGGK

SEQ ID NO: 2151 - DNA, 951 bp, Streptococcus agalactiae
atgaaagaaaatatgaaatcaattttatcttggttagctatagtagtgttagattatctcttgattagcgtgctaatatctatgggtatatttaacctctatcatattcaaattattgaaacaattgggattaatgttattttagcagttggtttgaacctaattgtaggttgttcgggacagttttcactaggacatgcaggtttcatggctattggcgcttatgcagttgctattatcggcgttaaaatgccaacttatgtaggttttttgatagctatacttgttggaactcttgttgcaggaggtattgccttaggtgtaggaattcctactttgagactaaaaggtgattatttagctatagctactttaggtgttgctgagattatccgtattttgttggttaatggaggtgatattacgaatggtgctgcgggtatcatggggattccgccttttacaacctggtctttagtttatggggtggcagttgtgagccttatccttgcaatgaattttttgcgtagtcccttagggcgtaatacaattgctatacgagaagatgaaattgcagcagagtctatgggtgtggatacaacaaaagtgaaagtaattgtttttgtttttggagctattttagcttctatcgctggtagtttacaggctggctacgttggaactgttatgccaaaagacttttcatttatgatgtctgtcaatgttttaattattgttgttttaggtggtttaggttcaatgacagggacagttttagcagcaattttattaggattattgaatatgttactacaagactacgcttctgttcgaatgattatctatgctttagccctgattttaattatgatttttagacctagcggtttattaggaacgaaagagttaactctatctcatctatttcgtaagacgagtaagggaggcaat

SEQ ID NO: 2152 - protein, 317 aa, Streptococcus agalactiae
MKENMKSILSWLAIVVLDYLLISVLISMGIFNLYHIQIIETIGINVILAVGLNLIVGCSGQFSLGHAGFMAIGAYAVAIIGVKMPTYVGFLIAILVGTLVAGGIALGVGIPTLRLKGDYLAIATLGVAEIIRILLVNGGDITNGAAGIMGIPPFTTWSLVYGVAVVSLILAMNFLRSPLGRNTIAIREDEIAAESMGVDTTKVKVIVFVFGAILASIAGSLQAGYVGTVMPKDFSFMMSVNVLIIVVLGGLGSMTGTVLAAILLGLLNMLLQDYASVRMIIYALALILIMIFRPSGLLGTKELTLSHLFRKTSKGGN

SEQ ID NO: 2153 - DNA, 762 bp, Streptococcus agalactiae
atggcacttcttgaagtaaaaaatttaagtaaacatttcggtggcctaactgctgtaggtgatgtttcgatgaaattacataaaggtgaattaattggcttaatcggccccaacggtgcgggtaagacaacgctttttaatctcttaacaggagtataccttcctagtaaagggacaatatcaattgatggtaagatattaaatgggaggaaaccagctaaaatagcttctttaggtttaggtagaacttttcaaaatatccgactttttaaaaatatgactgttttagacaatgtactagtaggactcagtaatcatcacttatcacatcctattgctagttttttacgattacccaaatactatcatagtgaaaaagccttaaggaaaaaggcactggagctattagagatttttggtttgaaagcatatcaagatgctcttgctaagaacctcccttatggaaaacaacggcgtttagaaattgttcgtgctttagcaacagaaccaaaaatattgtttttggatgagcccgcggcaggaatgaatcctcaagaaactgcagaattgacgcagttaattagtcaaataaagagtgattttgatattactattatgctgattgaacatgatatgaacttggttatgcaagtaacagagagaatttatgtattggaatatggtcgtctgattgctcacgggacacctgaagaaattaaaaataataaacgtgttatagaagcatacttggggggtgagcta

SEQ ID NO: 2154 - protein, 254 aa, Streptococcus agalactiae
MALLEVKNLSKHFGGLTAVGDVSMKLHKGELIGLIGPNGAGKTTLFNLLTGVYLPSKGTISIDGKILNGRKPAKIASLGLGRTFQNIRLFKNMTVLDNVLVGLSNHHLSHPIASFLRLPKYYHSEKALRKKALELLEIFGLKAYQDALAKNLPYGKQRRLEIVRALATEPKILFLDEPAAGMNPQETAELTQLISQIKSDFDITIMLIEHDMNLVMQVTERIYVLEYGRLIAHGTPEEIKNNKRVIEAYLGGEL

SEQ ID NO: 2155 - DNA, 708 bp, Streptococcus agalactiae
atgaccatgttgaaagtagaaaatctatctattcactatggtgttattcaagcggtgaatgatgtctcgtttgaagttaaccaaggtgaggttgtaaccttaattggagccaatggtgcaggaaagacatcaattttgaggacaatttctggtttagtaagaccaagtcagggttctatttcttttatggggaaacctatacataagttagcagctagaaaaattgttggcaatggtttagctcaggttccagaagggcgccacgttttctcaagtttgtctgttatggaaaatttagaaatgggagcctttcttcaaaaggatcgtgaacaaaatcaaaaaatgttaaaaaaagtgtttgatcgttttcctcgcttagaagaacgtaaaaaccaagatgcagcaaccttatcaggtggtgagcagcaaatgctcgctatggggcgtgcattgatgagtcgtcctaaattattacttttagatgaaccgtcaatgggcctagctccaatttttattcaagaaatttttaatatcattgaagacatcaaaaaacaagggactacagttcttttagttgaacaaaatgcaaataaagctctgacgattgctgataaagcatatgttctagagactgggaaggttgttttatcagggacaggtaaggaattactagtttcagatcaagttcgtaaagcttacttaggtgga

SEQ ID NO: 2156 - protein, 236 aa, Streptococcus agalactiae
MTMLKVENLSIHYGVIQAVNDVSFEVNQGEVVTLIGANGAGKTSILRTISGLVRPSQGSISFMGKPIHKLAARKIVGNGLAQVPEGRHVFSSLSVMENLEMGAFLQKDREQNQKMLKKVFDRFPRLEERKNQDAATLSGGEQQMLAMGRALMSRPKLLLLDEPSMGLAPIFIQEIFNIIEDIKKQGTTVLLVEQNANKALTIADKAYVLETGKVVLSGTGKELLVSDQVRKAYLGG

SEQ ID NO: 2157 - DNA, 807 bp, Streptococcus pyogenes
ttgaacgccgtttcgatgccgatacttacaccactggagcaaaccaaatgcagattgcggaggtctcaaatgtctaactcaattattgaaatcaaaaatctcaaaaaatcttacggcagcaatgaagtactcaaagatatctccctttctgttaacaagggagaagtgatttccattatcggttcttctggttctggaaaatcaaccctcctgcgctcgatcaatcttttggaagagccaagtgccggtcaaatcctctttcatggtgaagatgtccttgctgaacactacaacttgactcactaccgtgaaaaactaggcatggttttccaatcctttaacttgtttgaaaacctaaatgtattggaaaatgctatcgtcgctcaaaccaccgtcctcaaaagagaccgtgcacaagccgaacaaatcgctaaagaaaacctcaatgcggttggtatgacagaacaatactggcaagccaaaccaaaacaattatcaggggggcaaaaacaacgggttgccattgccagagccttatctgtcaatccagaagccatgctctttgatgaaccaacatcagctcttgatcctgaaatggttggtgaggtccttaaaaccatgcaagacttggcaaaatcagggttgaccatgattattgttacccatgaaatggaatttgctcgtgatgtttctgaccgtatcatcttcatggataagggattgattactgaagaaggaagtcctcaacaaattttcgagaatcctacacaagatcgtaccaaagaatttttacaacgcttcttaaaa

SEQ ID NO: 2158 - protein, 269 aa, Streptococcus pyogenes
LNAVSMPILTPLEQTKCRLRRSQMSNSIIEIKNLKKSYGSNEVLKDISLSVNKGEVISIIGSSGSGKSTLLRSINLLEEPSAGQILFHGEDVLAEHYNLTHYREKLGMVFQSFNLFENLNVLENAIVAQTTVLKRDRAQAEQIAKENLNAVGMTEQYWQAKPKQLSGGQKQRVAIARALSVNPEAMLFDEPTSALDPEMVGEVLKTMQDLAKSGLTMIIVTHEMEFARDVSDRIIFMDKGLITEEGSPQQIFENPTQDRTKEFLQRFLK

SEQ ID NO: 2159 - DNA, 657 bp, Streptococcus agalactiae
atgccagtgaaagattttatgacaaaaaaattagtttatgtctctccagatactacagttgcagaagctgctgatttattgagagaacaccacttaaggcgtttgccagttgttgaaaatgatcagctagtggggttagtgacagaagggacaatggcagaagcacaaccttctaaagcaaccagtctttctatatatgagatgaactatcttcttaataagacaaaaattcgagatattatgattaaagatattgtgactgtttcacagtatgctagccttgaggacgctatttatttgatgatgtctcgaaagatcggtgttttaccagtagttgataatggacaactttatgggattgtcacggatagggatgtttttaaagccttccttgaaattgcggggtatggtcaagaaagttatcgcttggttatattagctgatgaggggataggggtactatcaaaagtcctaaatcgtctttctagtgcaaatttaagtgttaaacgtttagtcattattgaacgaaaagcaggtaagaaagcggtcgagatacaactagaaggatacgctgacaaggatgttttaaaacaagaactagtatttgatgatgttattgtggaaactttagaaaagaccatgaaaaaaccactttct

SEQ ID NO: 2160 - protein, 219 aa, Streptococcus agalactiae
MPVKDFMTKKLVYVSPDTTVAEAADLLREHHLRRLPVVENDQLVGLVTEGTMAEAQPSKATSLSIYEMNYLLNKTKIRDIMIKDIVTVSQYASLEDAIYLMMSRKIGVLPVVDNGQLYGIVTDRDVFKAFLEIAGYGQESYRLVILADEGIGVLSKVLNRLSSANLSVKRLVIIERKAGKKAVEIQLEGYADKDVLKQELVFDDVIVETLEKTMKKPLS

SEQ ID NO: 2161 - DNA, 1479 bp, Streptococcus pyogenes
atgtcaaattgggacactaaatttttgaaaaaaggctacacttttgacgatgtcttgcttattccggcagagagtcatgttcttccaaatgaagttgatttaaagacaaaactcgcagacaatttgacattaaatattcctattattacagcagctatggatacggttactggtagtaaaatggctattgcaattgcgcgtgcgggtggtttaggtgttattcataaaaacatgtctattactgagcaagcagaagaagttcgcaaggtaaaacgttctgaaaatggtgtcatcattgatccattcttcttaacacctgaacacaaggtttcagaagctgaagaattaatgcagcgctaccgtatcagtggtgtgccaattgttgaaactttagcaaaccgtaagttggtcggtatcattactaatcgtgatatgcgttttatttctgattacaatgcaccaatctctgaacatatgactagtgagcacctcgttacggctgctgttggtacagatcttgaaactgcagaacgtattcttcatgaacaccgtattgaaaaacttcctttggttgataatagcggtcgtctgtctggtttaatcactatcaaagatattgaaaaagtaatcgaattcccacatgctgctaaagatgaatttggtcgtcttctggtcgctgctgcggtaggtgttacctcagatacttttgagcgtgccgaggccttgtttgaagctggtgcagatgcgattgttattgacacagctcatggtcattcggctggtgttcttcgtaaaattgctgaaattcgtgctcatttcccaaatcgtactttgattgctggaaatattgccactgctgaaggtgcgcgtgctctttatgatgcaggtgttgatgttgttaaagtgggtattggtcccggatctatctgtaccactcgtgtggttgcaggtgtcggtgttcctcaagtgactgctatttacgatgctgctgctgttgctcgtgaatatggcaaaacgattattgctgatggtggtatcaagtattctggcgatattgttaaggctcttgcagccggcggtaatgctgttatgcttggatcaatgtttgcaggtactgatgaagctccaggtgaaactgaaatctaccaaggccgtaagttcaaaacttatcgtggaatgggttccattgcagctatgaagaaaggatcaagcgatcgttacttccaaggttccgtcaatgaagctaataagctagttccagaaggtattgaaggccgtgttgcttataaaggagctgcttcagatattgtcttccaaatgttaggtggtatccgctcaggtatgggctatgttggcgcaggtgacattcaagaattacatgaaaatgctcaatttgttgaaatgtcaggtgcaggcttgattgaaagtcatccacatgatgtccaaatcacaaatgaagcaccaaactattctgtgcac

SEQ ID NO: 2162 - protein, 493 aa, Streptococcus pyogenes
MSNWDTKFLKKGYTFDDVLLIPAESHVLPNEVDLKTKLADNLTLNIPIITAAMDTVTGSKMAIAIARAGGLGVIHKNMSITEQAEEVRKVKRSENGVIIDPFFLTPEHKVSEAEELMQRYRISGVPIVETLANRKLVGIITNRDMRFISDYNAPISEHMTSEHLVTAAVGTDLETAERILHEHRIEKLPLVDNSGRLSGLITIKDIEKVIEFPHAAKDEFGRLLVAAAVGVTSDTFERAEALFEAGADAIVIDTAHGHSAGVLRKIAEIRAHFPNRTLIAGNIATAEGARALYDAGVDVVKVGIGPGSICTTRVVAGVGVPQVTAIYDAAAVAREYGKTIIADGGIKYSGDIVKALAAGGNAVMLGSMFAGTDEAPGETEIYQGRKFKTYRGMGSIAAMKKGSSDRYFQGSVNEANKLVPEGIEGRVAYKGAASDIVFQMLGGIRSGMGYVGAGDIQELHENAQFVEMSGAGLIESHPHDVQITNEAPNYSVH

SEQ ID NO: 2163 - DNA, 141 bp, Streptococcus agalactiae
gtgtttagcagtttcgatagctgtcttagaatccatcagtttggcaaagatgaagttacagaaggcgacattgaaggtgagaaggacctttccaccaatccgtccaataaccgtgtccatttcaagccaggagttcagctc

SEQ ID NO: 2164 - protein, 47 aa, Streptococcus agalactiae
MFSSFDSCLRIHQFGKDEVTEGDIEGEKDLSTNPSNNRVHFKPGVQL

SEQ ID NO: 2165 - DNA, 669 bp, Streptococcus agalactiae
gtgaagttcaaaaaaaggcgaaagagcacactccctcctattccaaaagcgattaaagaagggcgacggtacgaggattttatagaacacatgaaccaatcagagctgaactcctggcttgaaatggacacggttattggacggattggtggaaaggtccttctcaccttcaatgtcgccttctgtaacttcatctttgccaaactgatggattctaagacagctatcgaaactgctaaacacatacaggtcattaagaggacactctatgataacaagagagacttcttcgaactctttcctgttatcctaacggataatggtggggaattcgctagagtggatgatattgagatagatgtttgtggacagtctcaactcttcttttgtgaccctaatcggtctgaccagaaagcaagaatcgagaagaatcataccctcgtgagagacatactgcctaaggggacttccttcgacaacttgactcaagaggacattaatctggcactatctcatatcaacagcgttaagagacaggctctaaatggtaaaacggcttatgagctattctcttttacttacggaaaagacatcgcaagtatactcggtattgaggaaattactgcggaagacgtctgccaatctcccaaactattaaaagacaaaatc

SEQ ID NO: 2166 - protein, 223 aa, Streptococcus agalactiae
MKFKKRRKSTLPPIPKAIKEGRRYEDFIEHMNQSELNSWLEMDTVIGRIGGKVLLTFNVAFCNFIFAKLMDSKTAIETAKHIQVIKRTLYDNKRDFFELFPVILTDNGGEFARVDDIEIDVCGQSQLFFCDPNRSDQKARIEKNHTLVRDILPKGTSFDNLTQEDINLALSHINSVKRQALNGKTAYELFSFTYGKDIASILGIEEITAEDVCQSPKLLKDKI

SEQ ID NO: 2167 - DNA, 564 bp, Streptococcus agalactiae
atgagtttatccatcatgacaaaacacaaacacctaactctcttagaccgtaatgacatccaatctggtttggatagaggagaaacctttaaagccatcgggcttaatctactgaaacaccctactactatcgcaaaagaagtcaaacgaaataagcaactaagagaatcaaccaaagactgcctagactgtccgctactaagaaaagctccctatgtttgtaatgggtgtccaaagaggaggatcaactgtggttacaagaagaccttctatcttgctaagcaagctcaaagaaactatgaaaaacttttagttgaatctagagaaggaatccctttgaacaaagagaccttctggaaaatagatagagtgctttctaatgggggtcaagaagggccaacgtatctatcatatcctcaaaaccaacgatctagaagtgagttcttcaaccgtttatcgacacatcaagaaaggctacctatccatcacaccaatcgacctacccagagctgtgaagttcaaaaaaaggcgaaagagcacactccctcctattccaaaagcgat

SEQ ID NO: 2168 - protein, 188 aa, Streptococcus agalactiae
MSLSIMTKHKHLTLLDRNDIQSGLDRGETFKAIGLNLLKHPTTIAKEVKRNKQLRESTKDCLDCPLLRKAPYVCNGCPKRRINCGYKKTFYLAKQAQRNYEKLLVESREGIPLNKETFWKIDRVLSNGGQEGPTYLSYPQNQRSRSEFFNRLSTHQERLPIHHTNRPTQSCEVQKKAKEHTPSYSKSD

SEQ ID NO: 2169 - DNA, 681 bp, Streptococcus agalactiae
ttgataaattttgatagaatagtagtaattataaataaaggatgtaccatgaaaaaaggactaatgatttcttttgagggcccagatggtgcgggtaaaacaaccgttttagaagctgttttacccttgctcagagaaaaattatcacaagatattctcaccaccagagagcctggtggcgtaactatttcagaagaaattcgtcatattattttagatgttaaacacacgcaaatggataaaaaaacagagctattgctttacatggctgctcgacgccaacatctagtggaaaaggtactcccagctctagaagaagggaaaatagtcctaatggatcgttttattgatagttctgttgcctatcagggatcaggaagaggattagataagtcacatataaaatggcttaatgactatgcgactgatagtcataaacctgatttaactttatattttgatgttccttctgaagtaggtttagagcgtattcaaaaaagtgttcaaagggaggtaaatcgtctagatctcgagcaattagatatgcatcaacgcgtccgtcaaggttaccttgaattggcggattcggagccaaaccgcattgtgacgattgatgcctcccaacagctagatgaagtaatagctgagacattctctattattttagatcgtatcaaccaa

SEQ ID NO: 2170 - protein, 227 aa, Streptococcus agalactiae
MINFDRIVVIINKGCTMKKGLMISFEGPDGAGKTTVLEAVLPLLREKLSQDILTTREPGGVTISEEIRHIILDVKHTQMDKKTELLLYMAARRQHLVEKVLPALEEGKIVLMDRFIDSSVAYQGSGRGLDKSHIKWLNDYATDSHKPDLTLYFDVPSEVGLERIQKSVQREVNRLDLEQLDMHQRVRQGYLELADSEPNRIVTIDASQQLDEVIAETFSIILDRINQ

SEQ ID NO: 2171 - DNA, 696 bp, Streptococcus pyogenes
atgccagtgctttttagctcattttttgataaaatagaactactaaaaagtgaaggaaataagatgatcacaggaaaactcataaccgttgaaggtccagatggcgcagggaaaacgactgttttagagcaactcattccactgttaaaacaaaaagtggctcaggatatcttgacaacaagagagcctggaggtgttgccatttcagaacacattagagaacttattttagacatcaaccatactgctatggaccctaaaacagaactcttactttatattgcggctcgaaggcagcatttggtggaaaaggtactaccagctcttgaagcaggccagttggtttttattgatcgtttcatcgatagttcagtagcttatcaaggtgcgggacgcggtttgatcaaagcagacattcagtggctcaacgagttcgcaacagatggtttagagcctgacttgaccctttattttgatgttccttctgaaattggtttagcacggattaacgcgaaccaacaaagagaagtcaatcgtttagatttggaaacaatagagatacatcaacgagtacgaaaaggatacctagccttagctaaggagcatccaaaacgtattgtcacaattgatgcgactaaaccattgaaagaagttgtctctgtcgctttggaacatgtcttagccttgcttttagcc

SEQ ID NO: 2172 - protein, 232 aa, Streptococcus pyogenes
MPVLFSSFFDKIELLKSEGNKMITGKLITVEGPDGAGKTTVLEQLIPLLKQKVAQDILTTREPGGVAISEHIRELILDINHTAMDPKTELLLYIAARRQHLVEKVLPALEAGQLVFIDRFIDSSVAYQGAGRGLIKADIQWLNEFATDGLEPDLTLYFDVPSEIGLARINANQQREVNRLDLETIEIHQRVRKGYLALAKEHPKRIVTIDATKPLKEVVSVALEHVLALLLA

SEQ ID NO: 2173 - DNA, 861 bp, Streptococcus agalactiae
atggatttaaagcgaacacaacccaaattgctggaaaagtttaatactattttacagtcagataggatgagtcatgcctatcttttttcgggaaattttgcaagtctagatatggcactttatttagcacaaagtcagttctgtgaaaagcgccagagtggtttaccatgtcaagagtgtagagcctgtcgtttaatcgctaatggggaattttcagatgttaaaatcatagaaccacaggggcaacttattaagacagagactataaaagagctgactaaagatttttcaagatcaggtttcgaagggaaatcacaggtctttatcatcaaagattgcgaaaaaatgcatgtcaatgcagccaacagtcttttgaaatttattgaagaacctcaaagttcatcttatgtcatcttattgactaatgatgaaaacaatgttttgccaacaattaagagtagaacgcaaatttttcgttttccaaaacaattggacatgttggttcatcaagctgaacaagcaggattgctaaaatcacaagctagcttattagctcaagtagcagacgatcctaaacatttagaaatattgttgactaacaaaaagttattagattacttgaatttaagtcaacagtttgtgacgactttggcaaaagataggcaaactgcttatttagaagtatctcgcttgacatcgcaagttgtagataaaaatgatcaggcatttgtttttcaatggctgacaataatgctggctaaagaaggccaactttatgatttagaaaatacttatagagctcagcaaatgtggaagagcaatgttagttttcaaaatagtttagagtatatggtgctttct

SEQ ID NO: 2174 - protein, 287 aa, Streptococcus agalactiae
MDLKRTQPKLLEKFNTILQSDRMSHAYLFSGNFASLDMALYLAQSQFCEKRQSGLPCQECRACRLIANGEFSDVKIIEPQGQLIKTETIKELTKDFSRSGFEGKSQVFIIKDCEKMHVNAANSLLKFIEEPQSSSYVILLTNDENNVLPTIKSRTQIFRFPKQLDMLVHQAEQAGLLKSQASLLAQVADDPKHLEILLTNKKLLDYLNLSQQFVTTLAKDRQTAYLEVSRLTSQVVDKNDQAFVFQWLTIMLAKEGQLYDLENTYRAQQMWKSNVSFQNSLEYMVLS

SEQ ID NO: 2175 - DNA, 873 bp, Streptococcus pyogenes
atggatttagcgcaaaaagctcctaacgtttatcaagcttttcagacaattttaaagaaagaccgtctgaatcatgcttatcttttttcgggtgattttgctaatgaagaaatggctctttttttagctaaggtcatcttttgtgaacagaaaaaggatcagacgccctgcgggcattgtcgctcttgtcaattgattgaacaaggagattttgccgatgtgacggtattggaaccaacagggcaagtgattaaaacggatgtggtcaaagaaatgatggctaacttttctcagacaggatatgaaaacaaacgacaagtttttattatcaaagattgtgacaaaatgcatatcaatgccgctaatagcttgctaaaatacattgaggagcctcagggagaagcttacatatttttattgaccaatgatgataacaaagtgcttccgaccattaaaagtcggacacaggtttttcagtttcctaaaaacgaagcctatctttaccaattggcacaagaaaagggattattaaaccatcaggctaagctagtagccaaacttgccacaaacaccagtcatctagaacgtctgttgcaaacgagcaagcttttagaactgataactcaagcagagcgttttgtatctatttggctgaaagatcagttgcaggcatatttagcgttgaaccgtctggtacagttagcaactgaaaaagaagaacaagatttagttttgacccttttgaccttgctcttggcaagagagcgtgcgcaaacgcctttgacacaattggaggctgtctatcaggctaggctcatgtggcagagcaatgttaattttcaaaacacattagaatatatggtgatgtcagaa

SEQ ID NO: 2176 - protein, 291 aa, Streptococcus pyogenes
MDLAQKAPNVYQAFQTILKKDRLNHAYLFSGDFANEEMALFLAKVIFCEQKKDQTPCGHCRSCQLIEQGDFADVTVLEPTGQVIKTDVVKEMMANFSQTGYENKRQVFIIKDCDKMHINAANSLLKYIEEPQGEAYIFLLTNDDNKVLPTIKSRTQVFQFPKNEAYLYQLAQEKGLLNHQAKLVAKLATNTSHLERLLQTSKLLELITQAERFVSIWLKDQLQAYLALNRLVQLATEKEEQDLVLTLLTLLLARERAQTPLTQLEAVYQARLMWQSNVNFQNTLEYMVMSE

SEQ ID NO: 2177 - DNA, 324 bp, Streptococcus agalactiae
atggataaaaaagacttgtttgatgcctttgatgatttttcacaaaatttattagttgggttgtctgaaattgagactatgaaaaaacaaatccaaaaattattggaggagaatactgttctacgcattgaaaatggtaaacttcgtgagcgtctgagcgttattgaagcagaaacagaaactgcagttaaaaattctaaacaaggaagagaattactcgaaggcatttacaatgatggctttcacatttgtaatactttctatggtcaacgtcgtgaaaatgacgaagaatgtgctttttgtattgaattattatatagagat

SEQ ID NO: 2178 - protein, 108 aa, Streptococcus agalactiae
MDKKDLFDAFDDFSQNLLVGLSEIETMKKQIQKLLEENTVLRIENGKLRERLSVIEAETETAVKNSKQGRELLEGIYNDGFHICNTFYGQRRENDEECAFCIELLYRD

SEQ ID NO: 2179 - DNA, 321 bp, Streptococcus pyogenes
gtgaataaaaaagaattattcgatgcttttgatggattttcccaaaatttaatggttactttagctgaaattgaagccatgaaaaaacaagtccaatcactagtagaagaaaacacgattcttcgcctagaaaatacaaaactacgggaacgtttgagtcacctagaacatgaaacggtagctaaaaatccttccaaacaaaggaaggatcacttagagggaatttatgatgaagggtttcatatctgcaattttttctatggacaacgtcgtgaaaatgatgaagaatgtatgttttgcagagaattattagatagaaag

SEQ ID NO: 2180 - protein, 107 aa, Streptococcus pyogenes
VNKKELFDAFDGFSQNLMVTLAEIEAMKKQVQSLVEENTILRLENTKLRERLSHLEHETVAKNPSKQRKDHLEGIYDEGFHICNFFYGQRRENDEECMFCRELLDRK

SEQ ID NO: 2181 - DNA, 870 bp, Streptococcus agalactiae
ttgatggaaatgcaagttcaaaaaagttttaaatcaaatatacattacggaacactctatctagtcccaactccaattggtaatctagatgatatgacttttcgtgccattaggattttaagagaagttgattttatttgtgcagaggatacacgaaatacgggacttttactcaagcactttgatattactactaaacaaattagttttcacgaacacaatgcttacgataaaatctctgggttaattgatttgttaaaagaagggaaatctttagcccaagtatctgatgcaggaatgccctctatttctgacccaggacatgaccttgtcaaggctgctattgaaggggatatcccagttgtatctataccaggagctagcgctggtattactgctctcatcgcttcaggtttagctccacaacctcatattttttatggcttcttacctcgtaagaaaggtcaacaaataactttctttgaaacaaagcaagattaccctgaaacacaaatcttttatgagtcaccgtttcgagtctctgatacgctaaaacacatgaaagagatttacggagatcgccaagttgttttagtacgcgaattgacgaaactctatgaagagtatcaaagaggaaccattagtcaacttttagagcatattgaaaaggtccctctcaaaggtgaatgcttaattattgttgatggtaagagagataccgagcgagtgaaagacagtagccaacaagatccactagtattagtaaaagaatatatcgctaatggtgataaaactaatcaagcgataaaaaaagtagcaaaagaatttaatctcaatagacaagaactctatgctagtttccatgattta

SEQ ID NO: 2182 - protein, 290 aa, Streptococcus agalactiae
MMEMQVQKSFKSNIHYGTLYLVPTPIGNLDDMTFRAIRILREVDFICAEDTRNTGLLLKHFDITTKQISFHEHNAYDKISGLIDLLKEGKSLAQVSDAGMPSISDPGHDLVKAAIEGDIPVVSIPGASAGITALIASGLAPQPHIFYGFLPRKKGQQITFFETKQDYPETQIFYESPFRVSDTLKHMKEIYGDRQVVLVRELTKLYEEYQRGTISQLLEHIEKVPLKGECLIIVDGKRDTERVKDSSQQDPLVLVKEYIANGDKTNQAIKKVAKEFNLNRQELYASFHDL

SEQ ID NO: 2183 - DNA, 861 bp, Streptococcus pyogenes
atgcaggttcaaaaaagttttaaagacaaaaaaacaagcggaaccttgtatttggttccaaccccaattggcaatctgcaggacatgacctttagagcagtggcaacgttaaaagaggttgattttatttgtgcagaagacacaagaaacacaggtcttttgctaaaacactttgatattgctaccaagcaaatcagctttcatgagcacaacgcctatgagaagattcctgatttaattgatttattaatatcaggacggtcactagctcaggtgtctgatgcaggaatgccatcgatttctgatcctgggcatgatttggtcaaggctgctattgatagtgatatcgcagtcgttgctttaccaggtgcctcagcagggattacagctttgattgctagtggactggctcctcaaccccatgttttttatgggtttttacccagaaaagcagggcaacaaaaggctttctttgaggacaaacaccattacccagagacacaaatgttttatgaatcaccctatcgcatcaaagataccctgaccaatatgttggcttgttatggtgatcgtcaagtggtgcttgtcagagaattaaccaagctttttgaggagtaccaacgggggtcgatttcagaaatcttgtcctaccttgaggaaacacccctcaaaggggagtgtctgctgattgtggctggagcccaagcagacagtgaggttgagctgacagctgatgttgacttagtgtctctagtgcaaaaagaaattcaagcaggagccaagccaaatcaggctattaaaacaattgctaaagcttaccaggtaaatcgccaagagctttaccaacaatttcatgactta

SEQ ID NO: 2184 - protein, 287 aa, Streptococcus pyogenes
MQVQKSFKDKKTSGTLYLVPTPIGNLQDMTFRAVATLKEVDFICAEDTRNTGLLLKHFDIATKQISFHEHNAYEKIPDLIDLLISGRSLAQVSDAGMPSISDPGHDLVKAAIDSDIAVVALPGASAGITALIASGLAPQPHVFYGFLPRKAGQQKAFFEDKHHYPETQMFYESPYRIKDTLTNMLACYGDRQVVLVRELTKLFEEYQRGSISEILSYLEETPLKGECLLIVAGAQADSEVELTADVDLVSLVQKEIQAGAKPNQAIKTIAKAYQVNRQELYQQFHDL

SEQ ID NO: 2185 - DNA, 633 bp, Streptococcus agalactiae
atgattttgagggaattttgtgcagagaatttaacagacttaaccagattagataaagctattatttcacgtgtcgagctttgtgataaccttgctgtcggaggcactactcctagctacggtgttatcaaagaagctaatcaatatttacatgaaaaaggtattagtgtcgctgttatgattcgtccccgtggaggaaattttgtatacaatgatttagaattacgtattatggaagaggatatcctacgtgctgttgagttagaatcagatgctcttgttttgggaatattaacttcaaataatcatattgatactgaagccattgaacaacttctacctgctacccaaggtttgccacttgtttttcatatggcatttgatgttatcccgaaatctgaccaaaaaaaatcaatagatcaattagttgctttaggctttacaaggattctcctacatggttcatctaatggcgaaccaattatagaaaatatcaaacatatcaaagcattagttgaatatgctaataatcgtattgaaattatggttggcggcggtgtgactgctgaaaactatcaatatatttgccaagaaactggggttaaacaagcccatggtactagaataactcaa

SEQ ID NO: 2186 - protein, 211 aa, Streptococcus agalactiae
MILREFCAENLTDLTRLDKAIISRVELCDNLAVGGTTPSYGVIKEANQYLHEKGISVAVMIRPRGGNFVYNDLELRIMEEDILRAVELESDALVLGILTSNNHIDTEAIEQLLPATQGLPLVFHMAFDVIPKSDQKKSIDQLVALGFTRILLHGSSNGEPIIENIKHIKALVEYANNRIEIMVGGGVTAENYQYICQETGVKQAHGTRITQ

SEQ ID NO: 2187 - DNA, 627 bp, Streptococcus pyogenes
atgattaaagaattttgtgctgagaacctcacactactgccaacccttgatgctggtcaaatcagtcgtgtggaactctgtgataacctagctgtcggagggaccacgccatcttatggcgtcatcaaagaagcctgtcagctcttacacgataaaaagattagcgtagcgaccatgattcgacctcgcggtggcgattttgtctataacgacctcgaactaaaagctatggaagaagatatcttaaaagctgttgaagctggctcagatgcgctagtcttaggcttgctgaccacagaaaatcaactggataccgacgctatcgagcaattactgcctgctacacaaggcttgccactggttttccacatggcttttgaccggattccgactgatcaccagcaccaagcgcttgaccaactgattgattatggctttgtgcgtgtgctaactcatggctcacctgaagctactcctattacagacaatgtggaacagcttaaaagtcttgtgacctatgccaataaacgcattgaaatcatgattgggggaggcatcactgctgagaattgccaaagcttgagtcaactcactggaacggccattgttcacgggactaaaatcatt

SEQ ID NO: 2188 - protein, 209 aa, Streptococcus pyogenes
MIKEFCAENLTLLPTLDAGQISRVELCDNLAVGGTTPSYGVIKEACQLLHDKKISVATMIRPRGGDFVYNDLELKAMEEDILKAVEAGSDALVLGLLTTENQLDTDAIEQLLPATQGLPLVFHMAFDRIPTDHQHQALDQLIDYGFVRVLTHGSPEATPITDNVEQLKSLVTYANKRIEIMIGGGITAENCQSLSQLTGTAIVHGTKII

SEQ ID NO: 2189 - DNA, 351 bp, Streptococcus agalactiae
atgacaatttataatttttctgcaggtcctgcagtcttaccaaaaccagtgcttgtaaaagcccaatctgaactccttaattatcaagggtctagtatgagtgttttggaggtatcgcaccgctccaaagagtttgatgatattatcaaaggtgctgagcgttacttaagagatttgatgggaattccggataattataaagtaatctttttacaaggtggtgcatccttacagtttagtatgattcccttgaatattgccagagggcgtaaagcttactatcatgttgctggttcgtggggggaaaaaagcttatacagaggctgtaaaactatcaaaaacaattccttt

SEQ ID NO: 2190 - protein, 117 aa, Streptococcus agalactiae
MTIYNFSAGPAVLPKPVLVKAQSELLNYQGSSMSVLEVSHRSKEFDDIIKGAERYLRDLMGIPDNYKVIFLQGGASLQFSMIPLNIARGRKAYYHVAGSWGEKSLYRGCKTIKNNSF

SEQ ID NO: 2191 - DNA, 90 bp, Streptococcus agalactiae
atgaagctaatagaattggttcaaaaggaattgtttttgatagttttacagcctctgtataagcttttttccccccacgaaccagcaaca

SEQ ID NO: 2192 - protein, 30 aa, Streptococcus agalactiae
MKLIELVQKELFLIVLQPLYKLFSPHEPAT

SEQ ID NO: 2193 - DNA, 642 bp, Streptococcus agalactiae
gtgacaacaaataataccattgaaggaacatcgctttatgatattcctaaaactaatgaagtgcctgttattgcggatatgtcttctaatatattagctgtaaaatataaagtagaagattttgcaatgatttatgcaggagctcaaaaaaatattggacctgctggtgtaacggtagttattatccgtgaagatatgattaatgaggaaccaactttatcatcaatgttggattataagattcagtcagatgctggttctctttataatacgccgcctgcttacagtatttacattgctaaattagtctttgaatgggtgaaaagtctaggtggtgttgatgctatggaaaaagctaatcgtgaaaaatcaggacttctctatgattatattgattcctcagaattttatagtaatcctgtcagagataaaaagagtcgttctctatgtaacattcctttcataactattaataaagatttagatgaaaaatttgtaaaggaagcgacagaacgtggatttaaaaatattaaaggacatcgttcggtaggtggtatgagagctagcctttataatgcctttcctaaacaaggtgtcatcgaattaattgattttatgaaaacatttgaagcagaaaataca

SEQ ID NO: 2194 - protein, 214 aa, Streptococcus agalactiae
MTTNNTIEGTSLYDIPKTNEVPVIADMSSNILAVKYKVEDFAMIYAGAQKNIGPAGVTVVIIREDMINEEPTLSSMLDYKIQSDAGSLYNTPPAYSIYIAKLVFEWVKSLGGVDAMEKANREKSGLLYDYIDSSEFYSNPVRDKKSRSLCNIPFITINKDLDEKFVKEATERGFKNIKGHRSVGGMRASLYNAFPKQGVIELIDFMKTFEAENT

SEQ ID NO: 2195 - DNA, 558 bp, Streptococcus agalactiae
gtgggtaatataatgcaaatcagattagcttttccaaatgaaattgaccaaattatgcttcttattgaggaagcgcgtgccgaaattgctaaaacaggaagtgatcaatggcaaaaagaagatggataccctaatcgtaacgatattattgatgatatcttgaacggttatgcttgggttggtattgaagatgggatgctagcgacttatgcggctgtcattgatggtcatgaagaggtttatgatgctatttatgagggaaaatggctccatgataaccatcgctatcttacatttcatcgtattgcgatctcaaatcaatttcgtggtagaggactagcacagacattccttcaagggttaattgaaggtcataaaggacctgattttcgttgcgatactcatgaaaaaaatgtcactatgcagcatattctaaataaattaggctatcaatattgtggtaaagtacctctagatggggtacgattggcttatcagaagataaaagaaaagggagaaacgagcatctatcgtgagattgatgaaagaaatcccatg

SEQ ID NO: 2196 - protein, 186 aa, Streptococcus agalactiae
MGNIMQIRLAFPNEIDQIMLLIEEARAEIAKTGSDQWQKEDGYPNRNDIIDDILNGYAWVGIEDGMLATYAAVIDGHEEVYDAIYEGKWLHDNHRYLTFHRIAISNQFRGRGLAQTFLQGLIEGHKGPDFRCDTHEKNVTMQHILNKLGYQYCGKVPLDGVRLAYQKIKEKGETSIYREIDERNPM

SEQ ID NO: 2197 - DNA, 99 bp, Streptococcus agalactiae
gtgagattgatgaaagaaatcccatgtaagaaaaaaagaaaggggttattttggtcaatgatgactaaagagataaccttagtgaaaaagaatggtttt

SEQ ID NO: 2198 - protein, 33 aa, Streptococcus agalactiae
MRLMKEIPCKKKRKGLFWSMMTKEITLVKKNGF

SEQ ID NO: 2199 - DNA, 1179 bp, Streptococcus agalactiae
atggtttttagtgtcaaaacatttaataatattaatcaaattggtttacaagagttagggaatcgtttccagattgatggggatatgtcagaaaatcctgatgcctatattattcgtagtcaaaatttgcataatcaggatttcccaagtaacctcaaagctattgctagggcgggtgcaggaacaaataatattcctattgaagaggcaagtgcacagggaatagtcgtgtttaataccccaggtgcaaatgctaatgctgtaaaagaagcggtcattgctgccttattactttcagctcgtgattatttaggagctaaccgatgggttaatactctaactggaacagatattcccaaacaaattgaagcaggaaagaaagcttttgctggtaatgaaattgcaggaaaaaaattgggagttatcggccttggtgccattggagctagaattgcgaatgatgctagacgcttaggaatgacagttcttggttatgatccctatgtttcaattgaaacagcttggaatatttcaagccatgttcaaagggttaaagagattaaggatatttttgaaacttgtgactatatcacaattcatgttcccttaacaaatgaaactaagcatacttttgatgcgaaagctttttcaatcatgaaaaaaggaactacgattatcaactttgctcgtgcagaattagtcaataaccaagagctatttgaagcgatagaaactggtgttgtcaagcgctatattactgattttggagacaaagaattattaaaccaaaaaggaattacagtctttcctcatgtaggcggatcaacagatgaggcagagctaaattgtgctattatggcaagtcaaaccattcgttgttttatggagacaggagaaatcactaattcagttaatttccccaatgtacatcaaattcaaaccgcaccatttcgtattactttaattaacaagaatgttcctaacattgtggctaaaatttcaactgctgtatcagagttaggtataaatattgataacattattaaccgttcaaagggtgactacgcctacacactaatagatttagatgaaacggataataacaagatttctactttaattgaagaatttgaaggtgatgagaatatcgtccgtgtacgtttaattgcaaaacaacaa

SEQ ID NO: 2200 - protein, 393 aa, Streptococcus agalactiae
MVFSVKTFNNINQIGLQELGNRFQIDGDMSENPDAYIIRSQNLHNQDFPSNLKAIARAGAGTNNIPIEEASAQGIVVFNTPGANANAVKEAVIAALLLSARDYLGANRWVNTLTGTDIPKQIEAGKKAFAGNEIAGKKLGVIGLGAIGARIANDARRLGMTVLGYDPYVSIETAWNISSHVQRVKEIKDIFETCDYITIHVPLTNETKHTFDAKAFSIMKKGTTIINFARAELVNNQELFEAIETGVVKRYITDFGDKELLNQKGITVFPHVGGSTDEAELNCAIMASQTIRCFMETGEITNSVNFPNVHQIQTAPFRITLINKNVPNIVAKISTAVSELGINIDNIINRSKGDYAYTLIDLDETDNNKISTLIEEFEGDENIVRVRLIAKQQ

SEQ ID NO: 2201 - DNA, 474 bp, Streptococcus agalactiae
atgttatatcaagaattctatcagtcccctcttggagaaattcgccttctagcagacaatctaggtttatcagggctttattttgttgggcaaaaatatgatatgctagcagtcaaccaagaggaaattgttaatatgtcaaattcctatactttacttggtaagaagtggttagatgcttatttttcacagcaaaatttacctagtattccattatcattgagagggacagcatttcagacgagagtatggcaggaattacagaaaatcccttttggagataccaaaacttatggagaattagcgaaagagctaaattgtcaatctgcacaggctgttggaggagcaataggtaaaaattctatttctctaattataccttgtcaccgtgttttaggaagatatggtcaattaactggttatgctggtggcttagaaagaaaatcttggttattagaatacgaaaaggagaaa

SEQ ID NO: 2202 - protein, 158 aa, Streptococcus agalactiae
MLYQEFYQSPLGEIRLLADNLGLSGLYFVGQKYDMLAVNQEEIVNMSNSYTLLGKKWLDAYFSQQNLPSIPLSLRGTAFQTRVWQELQKIPFGDTKTYGELAKELNCQSAQAVGGAIGKNSISLIIPCHRVLGRYGQLTGYAGGLERKSWLLEYEKEK

SEQ ID NO: 2203 - DNA, 354 bp, Streptococcus agalactiae
atgtatacgttttatgaataccccaaatgtaccacttgtcgttcagcaaaaaaagagttaactgaactcggcttgacttttgaagcgattgatataaaaagcaatcctcccaaagtttcgttattaaaagaattgttagagaattcgccttatgaccttaaaaagtttttcaatacttcaggaaattcttacagagaattaggcttaaaagataaatttgatgatttaactcttgaccaagctttggacttattggcatcggatggaatgcttattaagcgtccattgctagttaaagataataaaattcttcagattggctaccgtactaagtataaagacctcaacttagta

SEQ ID NO: 2204 - protein, 118 aa, Streptococcus agalactiae
MYTFYEYPKCTTCRSAKKELTELGLTFEAIDIKSNPPKVSLLKELLENSPYDLKKFFNTSGNSYRELGLKDKFDDLTLDQALDLLASDGMLIKRPLLVKDNKILQIGYRTKYKDLNLV

SEQ ID NO: 2205 - DNA, 306 bp, Streptococcus pyogenes
atggctgaattaaagcaactggttagtgactttgaagccattgacatcaaagctaatccacccaaagctcaggacctcaaacattggatggaaacatctggttataccatcaaaaatttctttaataccagtggtaacagctaccgcgaattgggacttaaagataaaatagaccagcttagccttgataaagctgctgaacttttagccacagatggtatgttgattaaacggcctattttgattaaggacggtaacgtcttacaagttggctatcgcaagccatatcaagagttggatttagga

SEQ ID NO: 2206 - protein, 102 aa, Streptococcus pyogenes
MAELKQLVSDFEAIDIKANPPKAQDLKHWMETSGYTIKNFFNTSGNSYRELGLKDKIDQLSLDKAAELLATDGMLIKRPILIKDGNVLQVGYRKPYQELDLG

SEQ ID NO: 2207 - DNA, 825 bp, Streptococcus agalactiae
atgaaactcatttcatggaatattgattccctcaatgcggcattaacaagtgaatcaacacgtgctttaatgtcacgccaagttattgatactttagttgctgaagatgccgacatcattgcgattcaagaaactaaactgtctgccaaaggacctactaaaaaacatttggaagtacttgaaacttacttcccagaatatgatttggtttggcgatcatcagtcgaacctgctcgtaagggctatgctggtacaatgttcttatatcgtaaagggttaaatcctattgttagcttccctgaaatcgatgctcctactacaatggataatgaaggtcgcattattactctcgaattggaaaactgctatatcacacaggtctatactccaaatgcaggtgatggcctaaagcgcttagctgaccgtcaaatatgggatattaaatatgctgagtatttagcaacattggatagtcaaaaacctgttctagcaacaggtgactataacgtagcccacaaggaaatagacctagctaatcctagcagtaatcgtcgttctgctggattcacagctgaagagcgccaaggctttacaaatctactagccaaaggttttacagatacttttcgttaccttcatggcgatgttccaaatgtttatagctggtgggcacaacgaagtcgtacatccaaaatcaacaatacagggtggagaattgattattggctaacaagtaaccgtgtcgcagataaaattaccaagtcagaaatgattcattctggtgatcgtcaagatcatacaccaattattttggagattgaacta

SEQ ID NO: 2208 - protein, 275 aa, Streptococcus agalactiae
MKLISWNIDSLNAALTSESTRALMSRQVIDTLVAEDADIIAIQETKLSAKGPTKKHLEVLETYFPEYDLVWRSSVEPARKGYAGTMFLYRKGLNPIVSFPEIDAPTTMDNEGRIITLELENCYITQVYTPNAGDGLKRLADRQIWDIKYAEYLATLDSQKPVLATGDYNVAHKEIDLANPSSNRRSAGFTAEERQGFTNLLAKGFTDTFRYLHGDVPNVYSWWAQRSRTSKINNTGWRIDYWLTSNRVADKITKSEMIHSGDRQDHTPIILEIEL

SEQ ID NO: 2209 - DNA, 825 bp, Streptococcus pyogenes
atgaaactgatttcatggaacattgattccttaaatgctgctctcacaggagagtcccctcgtgcgcttttatcacgcgctgttttagacactttagtcgctcaagatgcggatattattgccatccaagaaactaaattatctgctaaggggcctaccaaaaaacatatcgagaccctacttagttactttccaaactatttgcatgtgtggcgttcttcagttgagcctgctaggaaaggctatgctggcaccatgttcctgtacaaaaacacgttaaaccctgtcattacttttccagaaattggtgccccaacaacaatggatgctgagggccgtatcattaccctagaatttgaagactttttcgtcacacaggtttacacgcctaatgctggtgatggccttagacgtttagatgaccgtcaaatttgggaccacaaatacgctgattatttgactgaactggatgctcaaaagcctgttttggctacgggagattacaacgttgcccataaagagattgatttggcaaatccaaacagcaatcgacgttctcctggttttaccgacgaagaacgtcaaggctttactaacctattagcaagaggctttacagatacttttcgtcacgtgcacggcgatattcctcatgtttatacctggtgggcacaacgtagcaaaaccagcaaaatcaataataccggttggagaattgactattggctagcttcaaaccgacttgtggataaggttaagcgttctgaaatgatttcttctggggaacgccaagaccatacgccaattttactagatattgatctc

SEQ ID NO: 2210 - protein, 275 aa, Streptococcus pyogenes
MKLISWNIDSLNAALTGESPRALLSRAVLDTLVAQDADIIAIQETKLSAKGPTKKHIETLLSYFPNYLHVWRSSVEPARKGYAGTMFLYKNTLNPVITFPEIGAPTTMDAEGRIITLEFEDFFVTQVYTPNAGDGLRRLDDRQIWDHKYADYLTELDAQKPVLATGDYNVAHKEIDLANPNSNRRSPGFTDEERQGFTNLLARGFTDTFRHVHGDIPHVYTWWAQRSKTSKINNTGWRIDYWLASNRLVDKVKRSEMISSGERQDHTPILLDIDL

SEQ ID NO: 2211 - DNA, 900 bp, Streptococcus agalactiae
ttgttggcttctttatttatcgtccgtttgtcaaaatcgctttcgctaaggaggagcaatatgaaaaaattacttagatggcttcctcctgtacttttcattattatccttataggaatgactatcttaggtaagtcctatatcaataaagtaacagctcacaaaataaaactctataactctcgaatgactcctactattttaattccaggatccagtgctactcaagaacgatttaacagcatgttagcacagctcaaccaaatgggagaaaaacatagcgttttaaagttaactgtcaaaaaagacaatagcattatctacaatggacaaattagcggcaatgaccacaaaccctacattgtcattggatttgaaaataatgaagatggttatagtaacatcaaaaaacaaacaaaatggctacagattgctatgaatgatcttcagaagaaatataaatttaaacgttttaacgctatcggtcattcaaatggtggcttatcatggactattttcctagaagattattacgactctgatgaatttgatatgaaatcattgttaacaatgggaacaccttttaactttgaagaaagtaacacctcaaatcatactcaaatgcttaaagatttaatcagtaataaaggaaatattccatcaagtctcatggtatacaatttggcaggaactaattcatatgatggtgataaaattgttccatttgctagtgtggagactggtaaatatattttccaagaaaccgctaaacactatacccaactaacagtaactggtaataatgctacacattctgacttgcctgataatcctgaagttatccaatatgtcgcagaaaaaattcttaaaaatgagaaaggtaaattaccaaaacctcac

SEQ ID NO: 2212 - protein, 300 aa, Streptococcus agalactiae
MLASLFIVRLSKSLSLRRSNMKKLLRWLPPVLFIIILIGMTILGKSYINKVTAHKIKLYNSRMTPTILIPGSSATQERFNSMLAQLNQMGEKHSVLKLTVKKDNSIIYNGQISGNDHKPYIVIGFENNEDGYSNIKKQTKWLQIAMNDLQKKYKFKRFNAIGHSNGGLSWTIFLEDYYDSDEFDMKSLLTMGTPFNFEESNTSNHTQMLKDLISNKGNIPSSLMVYNLAGTNSYDGDKIVPFASVETGKYIFQETAKHYTQLTVTGNNATHSDLPDNPEVIQYVAEKILKNEKGKLPKPH

SEQ ID NO: 2213 - DNA, 1215 bp, Streptococcus agalactiae
atgcacagcactatttataaatgtcatcattgccgttatctaatttataaaagttttaaagatatctttccttttgctctcattttttcttggattgaaatccttcaaaaactcgttatatcagatgattcttttttagctcaaacaacaaagtccagtatttataaaaacgagtggttatatacggtttccaatactctttatgatttatctcatttactaatctactttatggctagttattttgtggctagtttagtatggagagacttatctaaccaaactaaagaaagtttttctgcaagtttacttggctttgccactgtttggttgcttctaacttcagttgttccaggtacagattatcactatcctagccaacccatttggcttatgctggctttgatttcgtatctttttatctttttaactcgactgcttcaaaatcgacatcatattttccagtatagtatgttagctatactactattaatctcttctattttgtcacatatcttatatcgttatcctaatattgatttagaataccttatacaaaatcacttttctcaatggctgggtgatgggccacatcaattaattcctattatgctttggtctatcttagctatttttctaaccttatcaggtctttttgtaccagatattttatttcgtccttactcctatttttcagtagttagcgaaaatttaaatgctgccttgagccaacatacagataaaatcccttatctgtataccttttatactgttaaaaatagctttgctatgtttggcggtattggaatcctattatccttatttttagcagttttatatgaaagtagaaaactacaatcgaagaattactataaattgacattactgaccttaactcctcttatttttgatcaaaatttaccatttttagtaggtctacctgtcattttacaaccaatattattcattccgatggtattaacaactatctttgcagaggcttttggagctcttatgctctacctaaaatttgtcgaccctgcagtttatactgtcccaagtggtacacctagtctactatttggctttcttgcttcaaatggggattggcgttaccttccagtcactgcaattattctagttgttggcttctttatttatcgtccgtttgtcaaaatcgctttcgctaaggaggagcaatatgaaaaaattact

SEQ ID NO: 2214 - protein, 405 aa, Streptococcus agalactiae
MHSTIYKCHHCRYLIYKSFKDIFPFALIFSWIEILQKLVISDDSFLAQTTKSSIYKNEWLYTVSNTLYDLSHLLIYFMASYFVASLVWRDLSNQTKESFSASLLGFATVWLLLTSVVPGTDYHYPSQPIWLMLALISYLFIFLTRLLQNRHHIFQYSMLAILLLISSILSHILYRYPNIDLEYLIQNHFSQWLGDGPHQLIPIMLWSILAIFLTLSGLFVPDILFRPYSYFSVVSENLNAALSQHTDKIPYLYTFYTVKNSFAMFGGIGILLSLFLAVLYESRKLQSKNYYKLTLLTLTPLIFDQNLPFLVGLPVILQPILFIPMVLTTIFAEAFGALMLYLKFVDPAVYTVPSGTPSLLFGFLASNGDWRYLPVTAIILVVGFFIYRPFVKIAFAKEEQYEKIT

SEQ ID NO: 2215 - DNA, 1302 bp, Streptococcus pyogenes
atggcaaaaatgaatatgcaaaacatcatcaagccaatcatgacatttgtgaatatgcgcggcatcattgccttaaaagacggtatgttagccattttacctttgaccgttgtggggagtcttttcctgattgctgggcagattcctttccaaggggttaatgatgccattgctagtgtgtttggtgctgactggacagaaccctttatgcaggtttaccatggaacatttgctattatggggttgatttcctgttttgcaattggctattcttatgctaaaaactcaggtgttgaacctctcccttcaggggttctatccttgtcagccttctttattttattgagatcatcttatgttccagcagaaggtgaagctattggagatgctatcagtaaggtttggtttggtggtcaagggattattggtgctattgtgattggtttaacggtcggagctgtttacacaacatttatccgtcgtcatatcgtcattaaaatgccagatcaagtgccacaagccatcgccaaacagtttgaagccatgattccagcctttgtgatctttaccttgtcaatgcttgtgtatattattgccaagtcagtaacaggtggtggcacctttattgaaatgatttatgatgtcattcaggtaccgctgcaagggttaacgggttctctttatggcgcactaggtattgccttctttatttcctttctttggtggtttggcgtgcatgggcaatctgtggtcaatggaattgtcactgctcttctcttatcaaatctagatgccaataaggccttgatggcagcaggtgagttatccctagacaagggtgcccatattgtaacccaacaatttttagactctttcttgattctatcaggttctggcattacctttggtttagtggtagctatgatctttgcggctaaatccaaacaatacaaggctttaggcaaggttgcagccttcccagccctctttaatgttaatgaaccagtcgtctttggttttccaattgtgatgaatccagtcatgttcttgccatttatcttggttccggtcttggcagctctcacagtttatggcgccattgctattggtttcatgcagccctttgcaggagtgacccttccgtggtcaacaccagccattatctcagggttcatggttggtggctggcaaggagctattgtgcaaattcttatactcatcatgtcaacgttggtgtacttcccattctttaaaatccaagataatatggcttatcaaaatgaacaagctagtgaagagtca

SEQ ID NO: 2216 - protein, 434 aa, Streptococcus pyogenes
MAKMNMQNIIKPIMTFVNMRGIIALKDGMLAILPLTVVGSLFLIAGQIPFQGVNDAIASVFGADWTEPFMQVYHGTFAIMGLISCFAIGYSYAKNSGVEPLPSGVLSLSAFFILLRSSYVPAEGEAIGDAISKVWFGGQGIIGAIVIGLTVGAVYTTFIRRHIVIKMPDQVPQAIAKQFEAMIPAFVIFTLSMLVYIIAKSVTGGGTFIEMIYDVIQVPLQGLTGSLYGALGIAFFISFLWWFGVHGQSVVNGIVTALLLSNLDANKALMAAGELSLDKGAHIVTQQFLDSFLILSGSGITFGLVVAMIFAAKSKQYKALGKVAAFPALFNVNEPVVFGFPIVMNPVMFLPFILVPVLAALTVYGAIAIGFMQPFAGVTLPWSTPAIISGFMVGGWQGAIVQILILIMSTLVYFPFFKIQDNMAYQNEQASEES

SEQ ID NO: 2217 - DNA, 120 bp, Streptococcus agalactiae
ttgcttaataatttatttagaactgttaggctagctagtgctaatattaatactattttaaaccaatctattagaaaaaaagtgctgagcaagattgcccagtcttatttttgtttgcca

SEQ ID NO: 2218 - protein, 40 aa, Streptococcus agalactiae
MLNNLFRTVRLASANINTILNQSIRKKVLSKIAQSYFCLP

SEQ ID NO: 2219 - DNA, 720 bp, Streptococcus agalactiae
ttgtttgccataaagttagaggaaaatatgtctaaaaagtctcaccgtcaatatcaaatatatgaagggctcaggtgtgcggttgcactctgttttatttcaggttatatcaatgcttttacttatgtaacacaaggaaaacgttttgcaggtgtacaaacagggaatttgttatcttttgctattcatcttagtaataagcattatagtcaagcgcttgcttttttgctacctataatggttttcatgttaggtcaatcgtttacttatttcatgaatcgttgggcgaataaacatcaactgcactggtacctattatctagttttgcgttgacacaggttgctatagtaacaattatattgactcctttcttaccatcgtcgtttactgtggcaggactagccttctttgcttcaatacaagtagatacctttaaatcgctcagaggagcaccttatgctaatatgatgatgactggtaatatcaagaatgctgcttatttattaacaaagggactttacgaaaaaaattctgatattttcttaattgctagaaatacgattattattattggaggatttatctttggtgttgtttgctcgacttatttttcaagtaaactgggcgaatggagcttatcattaatattaattcctcttttatatgtcaacttgctgttaggccatgaattttataacctacaagtagaaaggcactcc

SEQ ID NO: 2220 - protein, 240 aa, Streptococcus agalactiae
MFAIKLEENMSKKSHRQYQIYEGLRCAVALCFISGYINAFTYVTQGKRFAGVQTGNLLSFAIHLSNKHYSQALAFLLPIMVFMLGQSFTYFMNRWANKHQLHWYLLSSFALTQVAIVTIILTPFLPSSFTVAGLAFFASIQVDTFKSLRGAPYANMMMTGNIKNAAYLLTKGLYEKNSDIFLIARNTIIIIGGFIFGVVCSTYFSSKLGEWSLSLILIPLLYVNLLLGHEFYNLQVERHS

SEQ ID NO: 2221 - DNA, 705 bp, Streptococcus pyogenes
atgtcaaaaaagaaacgaaaacactatcaggtttatgagggattacgctgtgctatgacgctttgttttatcagtggctatgtcaatgcctttacctatatgacccaaggaaaacgttttgcaggtgttcagacaggcaaccttttgtcatttgccattcgcttgtcagaacagcaactgaaggaggcactgcaatttttacttcccatgatcgtttttatgcttgggcagtcctttacttatttcatgcaccgctgggccactaaaaaagggctccactggtacttattatcaagtgttatcttaacagggattgcttttggaacggccctattcacgccttttcttccttccaatgttacggtagcagctttagccttttttgcctctattcaggttgatacgtttaaaaccttacgaggagctagctatgctaatgtgatgatgacaggaaatatcaaaaatgccgcctatttactaaccaaaggcttgtacgaaaaaaatcacgaactaacacatatcggacgcaacaccttaatagtcatcttggcttttgctgttggggtggtttgttcgacgttgctttgcatagcttatggcgagtatgctttgatgcctattttaatgcctttactctatgtcaattacctgttggctcaggaattttatcacattcaaaccaaaatcaaaccgattaaaagaact

SEQ ID NO: 2222 - protein, 235 aa, Streptococcus pyogenes
MSKKKRKHYQVYEGLRCAMTLCFISGYVNAFTYMTQGKRFAGVQTGNLLSFAIRLSEQQLKEALQFLLPMIVFMLGQSFTYFMHRWATKKGLHWYLLSSVILTGIAFGTALFTPFLPSNVTVAALAFFASIQVDTFKTLRGASYANVMMTGNIKNAAYLLTKGLYEKNHELTHIGRNTLIVILAFAVGVVCSTLLCIAYGEYALMPILMPLLYVNYLLAQEFYHIQTKIKPIKRT

SEQ ID NO: 2223 - DNA, 873 bp, Streptococcus agalactiae
atggttaatacaaaaacacttctcccctacaaaactatgccggtttggactgcacagtctattccaaaggcatttttagaaaagcataatactaaggaaggcacctgggcaaaactaaccattctaagtggttctttagtattttaccagttatctcctgatggagaggaaatctcgcggcatatttttgatgctagtagtgatattccttttgttgatccacaagtctggcataaagtttcgccgaatagtccagacttaagttgctatctaactttttactgccaaaaagaagattacttccataaaaaatatggtctcacgcgcacacattctgaggttatcgccagtgcacctctcttatctgagaagagtaatatattagaccttgggtgtggtcaagggcgaaactcactttatttatcgctgctgggacatcaagtgacttctgtcgattcaaacggacagagccttgtagctttagaaaatatggcattagaagaagagcttccttacaatataaaaaggtatgatattaatactgctgctattgaagggcactatgattttattttatcaactgtggtatttatgtttttaaatcccgactgcatttctgatattattttacaaatgcaatcacatactcagattggaggatacaatcttatcgtttctgctatggataccgctgaaaatccttgcccgcttccattcccttttaccttcaaagaaggacaattgaaatcttattacaatgactgggaaatcatcaaatataatgaaaatttaggtgaattgcacagggtggatgaaaacggtaatcgcttaaaattacagtttgcgactttattagctcgaaaattaagatca

SEQ ID NO: 2224 - protein, 291 aa, Streptococcus agalactiae
MVNTKTLLPYKTMPVWTAQSIPKAFLEKHNTKEGTWAKLTILSGSLVFYQLSPDGEEISRHIFDASSDIPFVDPQVWHKVSPNSPDLSCYLTFYCQKEDYFHKKYGLTRTHSEVIASAPLLSEKSNILDLGCGQGRNSLYLSLLGHQVTSVDSNGQSLVALENMALEEELPYNIKRYDINTAAIEGHYDFILSTVVFMFLNPDCISDIILQMQSHTQIGGYNLIVSAMDTAENPCPLPFPFTFKEGQLKSYYNDWEIIKYNENLGELHRVDENGNRLKLQFATLLARKLRS

SEQ ID NO: 2225 - DNA, 2046 bp, Streptococcus agalactiae
atgtatcatgataaaaaacacctctcattagggtggcttataggagaaatcatgacagaaaaaaaatcattttacattactaccccaatttattacccatcaggtaaattgcacatcggttctgcctatacaacgatagcatgtgatgttttggcacgttacaaacgcatgatgggctttgatgttcagtatttgactggtcttgatgagcatggtcagaaaattcaacaaaaggctgaagaagcaggcattacaccacaggaatatgttgatggcatggctgaaagtgtcaaaacattatgggaacttttagatatttcctatgacaaattcatccgtacaacagatacttaccatgaagaagcggttgctaaaatttttgaacaattgttggcacaaggggacatctatcttggtgagtataccggatggtattctgtttcagatgaagaattttttactgaaagccaattagcagaagtttatcgtgacgaaaacggtaatatgattggtggtgttgcgccatctggtcatgaagttgaaaaagtttctgaagaatcttatttcttccgcatgagcaaatatgcagatcgtttaaaagcgtactacgctgagcatccagaatttattcagccagatggtcgtatgaatgaaatgcttaaaaactttatagaaccaggtttagaagatttagcagtgtctcgtacaacttacacatggggagttcaggtaccatcaaatccaaaacatgttatttatgtctggattgatgctttgatgaactatatttctgctcttggttatggttggtctgacgatctcagtcaatatcataaattttggccagcagacattcatatgattggtaaagatattcttcgtttccactctatttattggcctatcatgttgatggcgctggatttgccattaccaaaacgtctagttgctcatggttggtttgtgatgcaagatggtaaaatgtctaaatcaaaagggaatgtcgtttatccagaaatgttagtagagcgttttggtcttgatccactccgttattatctcatgcgttcattgcctgttggttcagacggaacttttacgccagaagattatgttggacgtattaactatgaacttgctaatgatttaggaaaccttctcaaccgcactattgctatggttaacaagtatttcgatggagaagtaccaaggtttgctgttgcaactgactttgatgccgatttagcttctgttgcgacagatagtattgaaaactatcataaacaaatggaagcggtggatttcccacgtgcccttgaagctgtatggaatcttatttcacgaactaacaaatatattgatgaaacagcaccgtgggtacttgcaaaagacgaaacagatcgtgataagttagcagctgtaatgagtcatttagttgctagtctacgtgttgttgctcacctcattcaaccgttcatgatggaaacttccgatgccattatggaacaacttggtttaggggcaacattcgatcttgaaaaattgacttttgctgatctaccagaaggtgttcgagttgttgcaaaaggttcaccaattttcccaaggttggatatggaagacgaaattacttatatcaaagaacaaatgaatgctggaaaagcaccagtggaaaaggagtgggttcctgaagaagttgaattgacatcaagcaaaggtcaaatcaagtttgaggattttgacgctgttgaaatccgcgttgcagaagtaattgaagttgagaaagtggaaggttctgataaacttcttcgtttccgtctagatgctggtgatgagggccatcgtcaaatcttatcagggattgcaaaattttacccaaatgaacaagagttagtagggaaaaaactccaaattgttgctaacctcaaaccacgtaaaatgatgaaaaaatatgtcagtcaaggcatgattctctcagcagaacatgatggtaaattgacagtgttgacggtcgattcagcagtggcaaatggatcaattattggt

SEQ ID NO: 2226 - protein, 682 aa, Streptococcus agalactiae
MYHDKKHLSLGWLIGEIMTEKKSFYITTPIYYPSGKLHIGSAYTTIACDVLARYKRMMGFDVQYLTGLDEHGQKIQQKAEEAGITPQEYVDGMAESVKTLWELLDISYDKFIRTTDTYHEEAVAKIFEQLLAQGDIYLGEYTGWYSVSDEEFFTESQLAEVYRDENGNMIGGVAPSGHEVEKVSEESYFFRMSKYADRLKAYYAEHPEFIQPDGRMNEMLKNFIEPGLEDLAVSRTTYTWGVQVPSNPKHVIYVWIDALMNYISALGYGWSDDLSQYHKFWPADIHMIGKDILRFHSIYWPIMLMALDLPLPKRLVAHGWFVMQDGKMSKSKGNVVYPEMLVERFGLDPLRYYLMRSLPVGSDGTFTPEDYVGRINYELANDLGNLLNRTIAMVNKYFDGEVPRFAVATDFDADLASVATDSIENYHKQMEAVDFPRALEAVWNLISRTNKYIDETAPWVLAKDETDRDKLAAVMSHLVASLRVVAHLIQPFMMETSDAIMEQLGLGATFDLEKLTFADLPEGVRVVAKGSPIFPRLDMEDEITYIKEQMNAGKAPVEKEWVPEEVELTSSKGQIKFEDFDAVEIRVAEVIEVEKVEGSDKLLRFRLDAGDEGHRQILSGIAKFYPNEQELVGKKLQIVANLKPRKMMKKYVSQGMILSAEHDGKLTVLTVDSAVANGSIIG

SEQ ID NO: 2227 - DNA, 1998 bp, Streptococcus pyogenes
atgatgaaaaaaccattttacattacgacacccatttattacccatctgggaaattacacattggttctgcctatacaactattgcttgtgatgtcttggcacgctacaagcgcctgatgggccatgaggtcttttacctcacaggactagatgaacacggacaaaagattcaaaccaaggcaaaagaagctggtattacacctcaaacctacgttgataacatggcaaaggatgtcaaagccctttggcaattgctagatatttcctatgacacatttatccggacaacggacgattaccacgaagaggtcgttgctgctgtctttgaaaaattgctggcgcaagatgacatttaccttggcgaatactctggttggtattctgtctctgatgaggaatttttcactgaaagccaattaaaagaagtctttagagatgaagacggtcaggttattggagggattgccccatcaggtcatgaggtcgagtgggtctctgaagaatcctacttcctacgccttagcaaatacgatgatcgtcttgtggccttctttaaagagcgacctgactttatccaaccagatggtcgtatgaatgaaatggtgaaaaactttatcgagccaggcctagaagatttggctgttagccgtactacctttacatggggtgtacctgttccatcagacccaaaacacgtggtttatgtctggatcgatgccctcttaaactacgcgacagctcttggttatcgtcaagctaatcacgctaactttgataagttttggaatggaacggttttccacatggttggaaaagatatcttgcgttttcatagcatctactggccaattttactcatgatgcttgatttaccaatgccagaccgcttaattgcccatggttggtttgtcatgaaagacggtaaaatgtctaaatcaaaaggcaatgtggtctatccagaaatgttagttgagcgctttggacttgatcctcttcgttattacctcatgcgttctttgccagttggttcagacgggacctttacccctgaagattatgtgggtcgtatcaactatgagttagccaacgaccttggcaatttattgaaccgtaccgttgccatgatcaacaagtattttgacggcacggtgccagcttatgttgacaatggaactgcctttgatgctgacttaagtcaactgattgatgctcagctagcagactaccataagcacatggaagcggtggactacccacgcgccttggaggctgtttggaccatcatcgctcgtaccaacaaatacatcgatgaaaccgctccttgggtgctcgctaaagaagatggtgacaaagctcaactagccagtgtcatggcacacttagcagccagcttgcgtctggtcgctcatgtgatccaaccctttatgatggaaacatcagctgctatcatggcccagcttggtttggaacctgtttctgatttgtcaacacttgctctagcagattttcctgccaatacaaaggttgttgccaaagggacaccgattttcccacgtcttgacatggaagctgagattgactacatcaaagcccaaatgggtgacagctcagctatttcccaagaaaaagaatgggtccctgaagaggttgcgctcaaatctgaaaaagacgtcatcacatttgaaacctttgatgctgtggaaatccgtgtggcagaagtcaaggaagtgtcaaaagtggaaggttcagaaaaattgctgcgctttagagtagatgcaggagacgggcaagaccgtcaaatcttgtcaggtattgccaaattttaccccaacgaacaagaattagtgggtaaaaaactacaaattgttgctaacctgaaaccgcgtaaaatgatgaaaaaatacatcagtcaagggatgattctatcagcagagcatggagatcagctaacggtcttaaccgttgattcctctgttccaaatggaagtatcattggc

SEQ ID NO: 2228 - protein, 666 aa, Streptococcus pyogenes
MMKKPFYITTPIYYPSGKLHIGSAYTTIACDVLARYKRLMGHEVFYLTGLDEHGQKIQTKAKEAGITPQTYVDNMAKDVKALWQLLDISYDTFIRTTDDYHEEVVAAVFEKLLAQDDIYLGEYSGWYSVSDEEFFTESQLKEVFRDEDGQVIGGIAPSGHEVEWVSEESYFLRLSKYDDRLVAFFKERPDFIQPDGRMNEMVKNFIEPGLEDLAVSRTTFTWGVPVPSDPKHVVYVWIDALLNYATALGYRQANHANFDKFWNGTVFHMVGKDILRFHSIYWPILLMMLDLPMPDRLIAHGWFVMKDGKMSKSKGNVVYPEMLVERFGLDPLRYYLMRSLPVGSDGTFTPEDYVGRINYELANDLGNLLNRTVAMINKYFDGTVPAYVDNGTAFDADLSQLIDAQLADYHKHMEAVDYPRALEAVWTIIARTNKYIDETAPWVLAKEDGDKAQLASVMAHLAASLRLVAHVIQPFMMETSAAIMAQLGLEPVSDLSTLALADFPANTKVVAKGTPIFPRLDMEAEIDYIKAQMGDSSAISQEKEWVPEEVALKSEKDVITFETFDAVEIRVAEVKEVSKVEGSEKLLRFRVDAGDGQDRQILSGIAKFYPNEQELVGKKLQIVANLKPRKMMKKYISQGMILSAEHGDQLTVLTVDSSVPNGSIIG

SEQ ID NO: 2229 - DNA, 186 bp, Streptococcus agalactiae
gtgcctagtaggagggtaataatagctaatccaactcctgacaaacaaaatcctaaaatcgctggccagaaatcttgtccagatgctacacctaatgctggtggaaaaatgaggttccctgcaccaaagaagataccaaataagagtaatcccgttaaaaagcctttttttaccataagcaaccat

SEQ ID NO: 2230 - protein, 62 aa, Streptococcus agalactiae
MPSRRVIIANPTPDKQNPKIAGQKSCPDATPNAGGKMRFPAPKKIPNKSNPVKKPFFTISNH

SEQ ID NO: 2231 - DNA, 1131 bp, Streptococcus agalactiae
atgtcggaaaaatttagtccgtggttttctttaacatttttagttatactctacctaactattggtccactttttgctattcctagaacagcaacggtttcttttgaaattggggttgctccaattgtagggcatagtccgattgctcttttgtgttttacagcctgtttttttgctgcagcttattatctcgctattagaccaaatggtatattagatagtgttggaaaaatcttaacgcctgtttttgcctttttaattctctctttggttgttgttggagctattgcttatggaaacttggagagtgctaaggcgagtgctgactatgcaggaaaagcgtttggaagtggtgtcttagcaggctataatacacttgatgcacttgcagcagttgctttttgtctagtagcaacagaaacgcttaaaaagtttggttttaaaactaaaaaagaatatttatcaaccatttggattgttggaattgttactagtttagcatttagtattttatatattggcttaggttttttagggaataagtttcctgtcccagctgatattttagctgacccaaatgttaataaaggagcttatgtattatcacaagcatcttataaattatttggaaattttggtcgttatttcttgagtattatggtaacattgacatgctttacaacaacagttgggcttattgtgtcagtatctgaattttttgataagaactttcgttttgggaattataaattatttgctactgtttttactttgattggctttttaattgctaatcttggtttaaatgctgtaattactttttcagttcctgtgctaactttattgtatccgattgttattgttattgtcttaattattttgattaataagtggttgccgctttcaaaaaagggaatgtctttgacaattggtcttgtcactttagtgtcgtttgttgaggttctagcgggacaatggcaagaaaaaacattaactcagttagttggattcctcccctttcatactatttcaatggggtggctagttccaatgttgattggtatagtattttctttggtgctgtcagataaacaaaaaggccaagcatttgatttagagaaatttgaagga

SEQ ID NO: 2232 - protein, 377 aa, Streptococcus agalactiae
MSEKFSPWFSLTFLVILYLTIGPLFAIPRTATVSFEIGVAPIVGHSPIALLCFTACFFAAAYYLAIRPNGILDSVGKILTPVFAFLILSLVVVGAIAYGNLESAKASADYAGKAFGSGVLAGYNTLDALAAVAFCLVATETLKKFGFKTKKEYLSTIWIVGIVTSLAFSILYIGLGFLGNKFPVPADILADPNVNKGAYVLSQASYKLFGNFGRYFLSIMVTLTCFTTTVGLIVSVSEFFDKNFRFGNYKLFATVFTLIGFLIANLGLNAVITFSVPVLTLLYPIVIVIVLIILINKWLPLSKKGMSLTIGLVTLVSFVEVLAGQWQEKTLTQLVGFLPFHTISMGWLVPMLIGIVFSLVLSDKQKGQAFDLEKFEG

SEQ ID NO: 2233 - DNA, 1368 bp, Streptococcus pyogenes
atgaaacaaaaaaatgtatatatcgtcattggattcatgctatttgcgctattttttggagcagcaaacctcatttacccagcttttttaggcatctactcaggtcatcagattctatggtctatcattggtttttgtttaactggtgtctccttgcctttactcggtgtcattgctgttgctaaatctggatcaggcgatgttgaaagtttggcacgccccatctctaaatggtatgcaatcttctattcttccattttgtatttatctattggcccattttttgctattccaagaacaggagccacttctttttcagtcggtatcgctcctatcttaggagataatacaaccaataaagctatttatgctatactattttttggtctgtcctacttccttgctatcaaacctagtaaactagctgaaaatatcggaaaatttttaacgccaacgttgttagttgttatttctattttggttatcgcgtcctttgtccatcctgctggaaattacggtgatgcttttaacgctggggtcggtgttaataatgcctttaaagattttccttttatagcaggattaattcaaggttatggcactatggatgcactagcttctcttgtttttgctattttagtcattgaggctaccaaacaatttggcgctaagacggacaaagaaatgaccaaaataacacttatttctggggctattgccattttgctattagcacttgtctatatctttgtcggtcgtattggagcaacatcacaatcattatttccttttattgatggcagctttacccttcatggtaatccagttaatggcggtcaaatcttaagtcatgcttctcgtttttacctaggtggcatcggacaagcatttctagctgttgtgattttcctggcctgtctaaccacttcaacaggcttaatcacgtcaagtgctgaatacttccataaattagtgcctgctttatctcatattgcttgggcaactatctttactttactatcagctttcttttattttggtggcttatcagtcattatcaactggtcagctcctgttttattccttttatacccattaacagtcgatttaattttccttgttttggcacaaaaatgcttcaataatgatcctattgtctatcgaactacaattggtctaacctttattcctgccatatttgatgcactcctaacactatcacaaatgactggattatttcatttaccagaagccgttgtaacttttttccaaaaaactgttccactagggcaattctcaatgggatggattatctttgctgctattggttttttaatagggcttatactaagtaaaacgaagaaaagc

SEQ ID NO: 2234 - protein, 456 aa, Streptococcus pyogenes
MKQKNVYIVIGFMLFALFFGAANLIYPAFLGIYSGHQILWSIIGFCLTGVSLPLLGVIAVAKSGSGDVESLARPISKWYAIFYSSILYLSIGPFFAIPRTGATSFSVGIAPILGDNTTNKAIYAILFFGLSYFLAIKPSKLAENIGKFLTPTLLVVISILVIASFVHPAGNYGDAFNAGVGVNNAFKDFPFIAGLIQGYGTMDALASLVFAILVIEATKQFGAKTDKEMTKITLISGAIAILLLALVYIFVGRIGATSQSLFPFIDGSFTLHGNPVNGGQILSHASRFYLGGIGQAFLAVVIFLACLTTSTGLITSSAEYFHKLVPALSHIAWATIFTLLSAFFYFGGLSVIINWSAPVLFLLYPLTVDLIFLVLAQKCFNNDPIVYRTTIGLTFIPAIFDALLTLSQMTGLFHLPEAVVTFFQKTVPLGQFSMGWIIFAAIGFLIGLILSKTKKS

SEQ ID NO: 2235 - DNA, 696 bp, Streptococcus agalactiae
gtgatgaacgaagttcttagacaggaaaaaaaatatttaatatcacttgaagattactatcttttatctaagaaattttcccaagtaatgacgctcgattcgcatagttcagacgacggctatactatccgttcgctatactttgattctttagaagatgttgattggcaagaaaaggaagatggtgttgagatacgaagaaagattcgtttgcgcaattatggtagtcaaagcaattttgcgaaattagaaatgaaacaaaaacaaggtgctaatcaaaaaaagcgctctctaaaattaagcaagacagatgctcaagcgctgattaatggtaacaatagtgttttattaaattatccggatacatttgctgcggagtgttattcaaggataacaacgcaactttatcaacctaaaacggttattgagtaccaaagaaaagcttttgttgctaaggaaaacaatatccgaatcacctttgaccaccatataataggtacagaggctagttatgatattttctcagaggatttaaatcaaaattatttattagatccttatcttgttattttagaagttaaatataatggatttttattgtcttatattaaagaactcttagattcggtagatagaagtgaactttcagcgagtaagtattgtttaggaagagctgttagtaaacattatcgtttt

SEQ ID NO: 2236 - protein, 232 aa, Streptococcus agalactiae
MMNEVLRQEKKYLISLEDYYLLSKKFSQVMTLDSHSSDDGYTIRSLYFDSLEDVDWQEKEDGVEIRRKIRLRNYGSQSNFAKLEMKQKQGANQKKRSLKLSKTDAQALINGNNSVLLNYPDTFAAECYSRITTQLYQPKTVIEYQRKAFVAKENNIRITFDHHIIGTEASYDIFSEDLNQNYLLDPYLVILEVKYNGFLLSYIKELLDSVDRSELSASKYCLGRAVSKHYRF

SEQ ID NO: 2237 - DNA, 675 bp, Streptococcus agalactiae
atgaaagacctattacgaaatagtctagagcaaagtggaaatttaagttttcaagatatgattttacatattcttgtagcagctttattgagtgtagttatttatgtttcctatgcttatacgcatagtggaactgcctatagtaaaaagtttaatgtttcattaatgacattgacggtcttgactgcaacagtaatgaccgttattggtaataatgtagccttgtcattgggtatggtcggtgccttgtcagttgttcgttttaggacagccataaaagattcaagagatacagtttatattttttggaccatagttgttggtatctgttgtggtgtcggtgactatgtggtagctgcattaggaagtagcgttatctttatcttattatgggttatgggacgtgttaaaaacgagaatcgtatgttattgattgtgaagtgcgatagaacactagaagttgatttagaaggaattttcttccaatattttgacggaaaagctgttcagcgtgttaaaaattcaacaactaatactattgaaatgattttcgaaatctctagaaaagattacgataagcaactccatgtagataatcagttaactgaaaaagtgtaccaattgggaaatattgattatttcaacattgttagccaaagcgacgaaatcaatggg

SEQ ID NO: 2238 - protein, 225 aa, Streptococcus agalactiae
MKDLLRNSLEQSGNLSFQDMILHILVAALLSVVIYVSYAYTHSGTAYSKKFNVSLMTLTVLTATVMTVIGNNVALSLGMVGALSVVRFRTAIKDSRDTVYIFWTIVVGICCGVGDYVVAALGSSVIFILLWVMGRVKNENRMLLIVKCDRTLEVDLEGIFFQYFDGKAVQRVKNSTTNTIEMIFEISRKDYDKQLHVDNQLTEKVYQLGNIDYFNIVSQSDEING

SEQ ID NO: 2239 - DNA, 1482 bp, Streptococcus agalactiae
ttgattatttcaacattgttagccaaagcgacgaaatcaatgggtagacttatgagagggaaggttatttacggcacaacccttataggtctttttctattcttatttttctatttttggattcctaagcatcacatcgagagaatacatcatcatcgtataaagcaggtagatgcgaagagtgatttaacaggatttaaaacccatttgcccattatcagcattgatacaaagcaacaagttattcctcttgttacaaaagaaggcggaaaatatgtcaaagctagggataatattaatgttgatatcgaattacgggattctccaagtagatcacatcatttatcagaaaagccgagaattaggacaaaagggttaatatcatatagaggaaatacctctcgttactttgataagaagtcattgaaagttaagtttgttactaataagttaaaggaaaagaagcatcgattagcaggaatgcctaaagaatcggagtgggtattgcatggtccctttctagacagaacattattaagaaattatctgagttataatattgctggtgagattatgtcctatgccccaaacgttcgctactgtgagttatttgtcaatggtgagtatcagggagtatatctagcagttgagaatatcgaacaaggtgagcaacgagttcccattgaaaaaagtgataaaaagttgcataaaacaccttatatcgttgcttgggatcgtgaacataaggcaaagcaaaagttagataactatgtacattatacacaccagtctggtatctcagctcttgatgtgaaatatccaggtaaacaaagattgacatcaaaacaattagagtttattaataaggacatcaatcatattgaaaaagtcctttattcttatgatttttcacaatatcctaaatatattgatagagaatcatttgcaaattattttgtcatcaatgaattttttagaaatgtggatgcgggtaaattttcaacctatctatataaagatcttcgtgatagagcaaaactagtagtttgggattttaataatgcttttgataatcaaattgaaggacgtgttgatgaggcagattttaccttgacggatgcaccgtggttcaatatgctcattaaggacaaagcatttatagacctggttgttcatcgctataaagaattacgaaagggagttctagcgacagaatatttatctaattacatagacgagacaaggcattttttaggtccagctattgatcgaaattataaaaaatggggctatgtctttgatttaaagaatactgatccaaggaattatttgattcctactgaacgcaatgtgacaagttatcacaaatcagtagaacaattaaaagattttatcaaaaagcgtggcagatggatggatagaaatattgagaccttgtatcaatatagtgcaccatcgaaaaatactaatactttactggag

SEQ ID NO: 2240 - protein, 494 aa, Streptococcus agalactiae
MIISTLLAKATKSMGRLMRGKVIYGTTLIGLFLFLFFYFWIPKHHIERIHHHRIKQVDAKSDLTGFKTHLPIISIDTKQQVIPLVTKEGGKYVKARDNINVDIELRDSPSRSHHLSEKPRIRTKGLISYRGNTSRYFDKKSLKVKFVTNKLKEKKHRLAGMPKESEWVLHGPFLDRTLLRNYLSYNIAGEIMSYAPNVRYCELFVNGEYQGVYLAVENIEQGEQRVPIEKSDKKLHKTPYIVAWDREHKAKQKLDNYVHYTHQSGISALDVKYPGKQRLTSKQLEFINKDINHIEKVLYSYDFSQYPKYIDRESFANYFVINEFFRNVDAGKFSTYLYKDLRDRAKLVVWDFNNAFDNQIEGRVDEADFTLTDAPWFNMLIKDKAFIDLVVHRYKELRKGVLATEYLSNYIDETRHFLGPAIDRNYKKWGYVFDLKNTDPRNYLIPTERNVTSYHKSVEQLKDFIKKRGRWMDRNIETLYQYSAPSKNTNTLLE

SEQ ID NO: 2241 - DNA, 93 bp, Streptococcus agalactiae
gtggcgaaagatgtattccacgcccttgcattccaatcgtcttgccatgcattgatagtcgctccaaaactaccggatgatataaaagattca

SEQ ID NO: 2242 - protein, 31 aa, Streptococcus agalactiae
MAKDVFHALAFQSSCHALIVAPKLPDDIKDS

SEQ ID NO: 2243 - DNA, 2157 bp, Streptococcus agalactiae
atgaaaaaatatctaagtattgtagcccttttaactattttgtttagctctatttattatttgtattactttgatggtagtttgtatttaccaaagggcttattaaaagaaaatacaagaactaactttgttgttaaaggtgatactgtacttcacaagcccaccaataaaccttttgttgttaaaggagtagacgttgagtcttccttagcgggttatcatcacaacgattttcctattactcaaaaaacgtatcgtgaatggttccatttaatttccaacatgggggcaaatactgtaagagtcaaggtaccgatgaatgttgcattttacgatgccttatatcaccacaacaaagcatcaaagaggccactgtatttgttgcaaggaatacgtatagattcttatcgcaataatgcttctataacagcttttaatgataattatagggggtatttaaaacgagaagcaaaaggcgttgtggatattctccatgggcgtaagcaagtatggaatactgatttgggtagccgtcattatcattatgatcttagtccttgggtacttggttatgtcgtaggggatgattggaatagtggtactgtcgcttatactaatcatcaagagaaaaaaacgcaatataaaggacgttattttaaaacttctgtggcagctaatccatttgaggtcatgctagctcaagtaatggatgaattgacacattatgagacagctaaatatggttggcaacatttgattagtttttcaaactcaccaacaacagacccttttcattatcgaaaaccatttgaggcacaggctcctaaatacgtacaactaaatgtagaaaatattcaagctaattcaaatgttaaagcaggtatgtttgcagcatataaagctattgatttccatcctcgatacaaggattatctattatttgataaagagaatatcagtaaagaagatagacaaaagattaaagaactttctttgtcacagggatacgttaaactgctaaatgcttatcacaaaatccctgttctagtcacgggttatggctattcgacagcgagaggtattgcccaaaaagaaattgataaacgtcctctgccgattaatgaaaaagaacaaggtcagcgtttactagaagattatgaatcttttatatcatccggtagttttggagcgactatcaatgcatggcaagacgattggaatgcaagggcgtggaatacatctttcgccacaaataaacatagtcaattcctatggggggatgcacaagtatttaatcaaggttatggtttattaggctttaaaaacgcaaaacatcattatcaagttgatggtaaaagaggcaaaggagagtggaaacatcctctgatgactagtgcaacaggagatgacttatatgctagcagtgatgaaagctatctctaccttgcgattaaaacaaaacctgaaaaactaaaagaaaaacgattattaccaatagatattacaccaaaatctggtagtagaaaaatgaatggtagtaaggtcacattttctaaatctagtgactttgtattgtctattgatccaaatggcaagtctgaattatttgtccaagagcgctataatgccttaaaagcgaactatcttcgacagcttaacggtaaagatttttatgctttcccaccaaagaagaacagtagtaattttgagcagataaatatggtattgagaaatacaaagattgttgaagacatggaaaaagtaaaagcaacagagaggttcttaccaactcatcctactggtcttctcaaaacaggaacaactgataggcaccaaaaaacatttgattcacaaacagatatttcgtttggaaaggactttatagaggtcagaattccgtggcagttgttgaatttttctgatccatcatctcaaaaaattcacgatgattactttaaacattatggtgtgaaggagttagaaattgagagcattgctttaggattaggtgctaatagcaaagaaaacacactgataaagatggcagattatcgtttgaaaaattgggagagacccgataccaaaacctttttaaaagactcctattatagtattaagaaagaatggtctaaagaaagagagagaacatatggtaca

SEQ ID NO: 2244 - protein, 719 aa, Streptococcus agalactiae
MKKYLSIVALLTILFSSIYYLYYFDGSLYLPKGLLKENTRTNFVVKGDTVLHKPTNKPFVVKGVDVESSLAGYHHNDFPITQKTYREWFHLISNMGANTVRVKVPMNVAFYDALYHHNKASKRPLYLLQGIRIDSYRNNASITAFNDNYRGYLKREAKGVVDILHGRKQVWNTDLGSRHYHYDLSPWVLGYVVGDDWNSGTVAYTNHQEKKTQYKGRYFKTSVAANPFEVMLAQVMDELTHYETAKYGWQHLISFSNSPTTDPFHYRKPFEAQAPKYVQLNVENIQANSNVKAGMFAAYKAIDFHPRYKDYLLFDKENISKEDRQKIKELSLSQGYVKLLNAYHKIPVLVTGYGYSTARGIAQKEIDKRPLPINEKEQGQRLLEDYESFISSGSFGATINAWQDDWNARAWNTSFATNKHSQFLWGDAQVFNQGYGLLGFKNAKHHYQVDGKRGKGEWKHPLMTSATGDDLYASSDESYLYLAIKTKPEKLKEKRLLPIDITPKSGSRKMNGSKVTFSKSSDFVLSIDPNGKSELFVQERYNALKANYLRQLNGKDFYAFPPKKNSSNFEQINMVLRNTKIVEDMEKVKATERFLPTHPTGLLKTGTTDRHQKTFDSQTDISFGKDFIEVRIPWQLLNFSDPSSQKIHDDYFKHYGVKELEIESIALGLGANSKENTLIKMADYRLKNWERPDTKTFLKDSYYSIKKEWSKERERTYGT

SEQ ID NO: 2245 - DNA, 1266 bp, Streptococcus agalactiae
ttgtaccatattttgtttcgcaggaagtctattgtaccagcctataatgaatcaacaaccattgtgagttcgattgattcgttattgcaccttgattatgaagcgtatgaaattatcgttgtggatgacggttccagtgacaatacttcagatgttctcaaggaagagtttgcattaatgaaaatctcgaatacgattgattcaattattgctactcaaacttgtaaagatgtctttcagagacaggttggtaaggttaaactgacactcattgttaaagaaaatggtggcaaaggggatgccttaaatatggggatcaatgctgctaattacgattattttctatgtctagatgcagattctatgttgcaggtagattctttgagtcaaattagcaaatccatacaggtagatccgacggttatagcagtgggagggctcgtccaagttgcccaaggtgttaagattgagcaggggaaagtagcatcttatcgtttgccttggagaattattccttgtgcacaagcacttgagtatgattcatcatttttaggagctcgaatctttttagactatttaagagctaatttaattatttcgggggctttcggtctttttaagaaagaccttgttaaagcggtgggaggatatgacacccagactctaggagaagatatggagttggtgatgaaattacatttcttctgtcgtaataataatattccttatcgtatttgttatgaaacagatgctgtttgttggagtcaagcaccaacgaatttaggggatttacgtaaacagagacgccgatggtatcttggcttgtaccaatgtttaaaaaaatataaaagtatttttgccaattatcgctttggagctgtaggatcaatttcttatatttactatattttatttgaattactgaccccttttatagaatgttttggtattgtcattatatttttgtccttattatttaatcaattaaacatcccattctttatatcattggtgagcctttatatcttttactgtgttttaattacattaagctctttcttacaccgtatttattctcagcaactagtaataggaattttagatattgttaaagtattttatattgctgtttttaggtatcttatcctacatcctgtattaacttttgttaaggttgcaagtgttattggctataaaaataaaaaaatggtttgggggcatattacgagagagaaacaaatgaaggattttgaaacaagtgttact

SEQ ID NO: 2246 - protein, 422 aa, Streptococcus agalactiae
MYHILFRRKSIVPAYNESTTIVSSIDSLLHLDYEAYEIIVVDDGSSDNTSDVLKEEFALMKISNTIDSIIATQTCKDVFQRQVGKVKLTLIVKENGGKGDALNMGINAANYDYFLCLDADSMLQVDSLSQISKSIQVDPTVIAVGGLVQVAQGVKIEQGKVASYRLPWRIIPCAQALEYDSSFLGARIFLDYLRANLIISGAFGLFKKDLVKAVGGYDTQTLGEDMELVMKLHFFCRNNNIPYRICYETDAVCWSQAPTNLGDLRKQRRRWYLGLYQCLKKYKSIFANYRFGAVGSISYIYYILFELLTPFIECFGIVIIFLSLLFNQLNIPFFISLVSLYIFYCVLITLSSFLHRIYSQQLVIGILDIVKVFYIAVFRYLILHPVLTFVKVASVIGYKNKKMVWGHITREKQMKDFETSVT

SEQ ID NO: 2247 - DNA, 1335 bp, Streptococcus pyogenes
ttgacattaccccttatttatattagaatatcgaggtccctgtctttcaaggaaattaaaaaagaaagaggtgtaattgtgcctatttttaaaaaaactttaattgttttatcctttatttttttgatatctatcttgatttatctaaatatgtatctatttggaacatcaactgtaggaatttatggagtaatattaataacctatctagttattaaacttggattatctttcctttatgagccatttaaaggaaagccacatgactataaagttgctgctgtaattccttcttataatgaagatgccgagtcattattagaaactcttaaaagtgtgttagcacagacctatccgttatcagaaatttatattgttgatgatgggagttcaaacacagatgcaatacaattaattgaagagtatgtaaatagagaagtggatatttgtcgaaacgttatcgttcaccgttcccttgtcaataaaggaaaacgccatgctcaagcgtgggcatttgaaagatctgacgctgacgtttttttaaccgtagattcagatacttatatctatccaaatgccttagaagaactcctaaaaagcttcaatgatgagacagtttatgctgcaacaggacatttgaatgctagaaacagacaaactaatctattaacgcgacttacagatatccgttacgataatgcctttggggtggagcgtgctgctcaatcattaacaggtaatattttagtttgctcaggaccattgagtatttatcgacgtgaagtgattattcctaacttagagcgctataaaaatcaaacattcctaggtttacctgttagcattggggatgatcgatgtttaacaaattatgctattgatttaggacgcactgtctaccaatcaacagctagatgtgatactgatgtacctttccaattaaaaagttatttaaagcaacaaaatcgatggaataaatctttttttaaagaatctattatttctgttaaaaaaattctttctaatcccatcgttgccttatggactattttcgaagtcgttatgtttatgatgttgattgtcgcaattgggaatcttttgtttaatcaagctattcaattagaccttattaaactttttgcctttttatccatcatctttatcgttgctttatgtcgtaatgttcattatatgatcaaacatcctgctagttttttgttatctcctctgtatggaatattacacttgtttgtcttacagcccctaaaactttattctttatgcaccattaaaaatacggaatggggaacacgtaaaaaggtcactatttttaaa

SEQ ID NO: 2248 - protein, 445 aa, Streptococcus pyogenes
LTLPLIYIRISRSLSFKEIKKERGVIVPIFKKTLIVLSFIFLISILIYLNMYLFGTSTVGIYGVILITYLVIKLGLSFLYEPFKGKPHDYKVAAVIPSYNEDAESLLETLKSVLAQTYPLSEIYIVDDGSSNTDAIQLIEEYVNREVDICRNVIVHRSLVNKGKRHAQAWAFERSDADVFLTVDSDTYIYPNALEELLKSFNDETVYAATGHLNARNRQTNLLTRLTDIRYDNAFGVERAAQSLTGNILVCSGPLSIYRREVIIPNLERYKNQTFLGLPVSIGDDRCLTNYAIDLGRTVYQSTARCDTDVPFQLKSYLKQQNRWNKSFFKESIISVKKILSNPIVALWTIFEVVMFMMLIVAIGNLLFNQAIQLDLIKLFAFLSIIFIVALCRNVHYMIKHPASFLLSPLYGILHLFVLQPLKLYSLCTIKNTEWGTRKKVTIFK

SEQ ID NO: 2249 - DNA, 498 bp, Streptococcus agalactiae
atggcttgcataatcaggagagcaagattaggagatgaagtcaatttagcttatattcaaacggagagctggaaagctgcttttggtaagatactacctgaggatatcattcaaaaaactacggaaatagaacctgccataacaatgtatcaacagctactacacaaggaggttggtaaggggtatatattggaagtagatagcaatcctcattgtatggcttggtgggataaaagtagagaagatggtatgcttgattatgcagaactcatttgtatacatagtcttaaagaaggttggggaaaaggttatgggtctcaaatgatgaatcatgtactatcagagatacaacaagcaggttataataaagtgatactttgggtatttacagaaaatacacgcgcaaggaaattttacgataggtttggtttttcttttaagggtaaatcaaaaacttattttgaaaaggaagaaatgtgttatgagaagattttgcac

SEQ ID NO: 2250 - protein, 166 aa, Streptococcus agalactiae
MACIIRRARLGDEVNLAYIQTESWKAAFGKILPEDIIQKTTEIEPAITMYQQLLHKEVGKGYILEVDSNPHCMAWWDKSREDGMLDYAELICIHSLKEGWGKGYGSQMMNHVLSEIQQAGYNKVILWVFTENTRARKFYDRFGFSFKGKSKTYFEKEEMCYEKILH

SEQ ID NO: 2251 - DNA, 246 bp, Streptococcus agalactiae
atggagaaaattacgaatgattttgaaaaagttatagctgtgctaaatcaactaagtatttcttatgaattagtggaaaatggacctgttttgttgacggagcaagcagataactttattgtgggaattgaaggagtaagaacaaaaataatgttcttgaccaacaagaaaaagacgaaatattatttactaataatggatgaccagaaactattttatcctatgaaaacaatagtagcctttaga

SEQ ID NO: 2252 - protein, 82 aa, Streptococcus agalactiae
MEKITNDFEKVIAVLNQLSISYELVENGPVLLTEQADNFIVGIEGVRTKIMFLTNKKKTKYYLLIMDDQKLFYPMKTIVAFR

SEQ ID NO: 2253 - DNA, 273 bp, Streptococcus agalactiae
ttgatatatcaatggttaaagacaataaaggagaacaatatgacatttgaagaaattttaccaggtttaaaagcaaagaaaaaatatgtacgtacaggttgggggggcgctgaaaattatgttcagttatttgatacccttgaagttaatgggaaagtactacaggctacaccttattttcttattaatgttactggtgaaggtgaaggtttttccatgtgggcaccaacaccatgtgatgttttagcagaggattggatcgaggtcaatgac

SEQ ID NO: 2254 - protein, 91 aa, Streptococcus agalactiae
MIYQWLKTIKENNMTFEEILPGLKAKKKYVRTGWGGAENYVQLFDTLEVNGKVLQATPYFLINVTGEGEGFSMWAPTPCDVLAEDWIEVND

SEQ ID NO: 2255 - DNA, 264 bp, Streptococcus pyogenes
gtgtctatttcgtcaataaaggagaacaatatgacatttgaagagattttaccaggtttaaaagccaagaaaaaatatgtacgtacaggttggggtggcgctgaaaattatgtgcagttgtttgatacccttgaagtggatgggaaagtactacaggcgacgccttattttctgattcatgttactggtgcaggtgaaggtttttccatgtgggcaccgacaccatgtgatgtgttagcagaggattggattgaggtcaatgac

SEQ ID NO: 2256 - protein, 88 aa, Streptococcus pyogenes
VSISSIKENNMTFEEILPGLKAKKKYVRTGWGGAENYVQLFDTLEVDGKVLQATPYFLIHVTGAGEGFSMWAPTPCDVLAEDWIEVND

SEQ ID NO: 2257 - DNA, 696 bp, Streptococcus agalactiae
atgactaaagttgttttagtgacgggctgtgctagtggaattggttatgcacaggctcaatattttttgaaacaagggtatcaagtatatggtgtggataagtcggataaaccgaacttaaatggtaattttaactttataaagttggatttatcctctgatttatccccactattcacaatggtaccgactgttgatattttgtgtaatactgcaggtattctagatgcctacaagccacttctagaagtaagtgatgaagaactggaacacctatttgatattaattttttcgtgactgttaggctaacacgtcattatcttagacgtatggtggaaaagaagtcaggtattattatcaatatgtgctcaatagcaagttttatagcgggtggcggtggagctgcatatactagttctaaacatgcccttgcgggattcacacgtcaattggctttggattacgcaaaagattgtattcaaatttttggtatagcgccaggtgctgtacaaactgctatgactgctagtgattttgaacctggtggattagcagaatgggtagctagtgagacgccaattggtcgttggactaaaccaagtgaagttgctgaattaactggatttcttgcttcaggaaaagcgagatcaatgcaaggtgaaattgtcaaaattgatggtggctggagtttgaaa

SEQ ID NO: 2258 - protein, 232 aa, Streptococcus agalactiae
MTKVVLVTGCASGIGYAQAQYFLKQGYQVYGVDKSDKPNLNGNFNFIKLDLSSDLSPLFTMVPTVDILCNTAGILDAYKPLLEVSDEELEHLFDINFFVTVRLTRHYLRRMVEKKSGIIINMCSIASFIAGGGGAAYTSSKHALAGFTRQLALDYAKDCIQIFGIAPGAVQTAMTASDFEPGGLAEWVASETPIGRWTKPSEVAELTGFLASGKARSMQGEIVKIDGGWSLK

SEQ ID NO: 2259 - DNA, 705 bp, Streptococcus pyogenes
ttgaggtcaatgactaaagttgttttagtgacgggctgtgctagtgggattggttatgcacaggcccgctattttttgaaacaagggcatcacgtatatggtgtggataagtcggataaaccggacttaagcggtaactttcactttatcaaattggatttatcctctgagttagccccactatttaaagtggtccccagtgttgatattttgtgtaatactgcagggattttagatgcctacaagccacttttagacgtcagtgatgaagaagtggaacacctatttgatattaatttttttgcgacggtgaagttaacacgtcattatcttagacgtatggtggaaaagcagtcaggtgttatcatcaatatgtgctcaatagcaagttttatagcgggtggcggtggtgttgcctatacgagttctaagcatgcccttgcgggattcacgcgccagctggctttggattacgccaaagatcagattcacatttttggtatagcaccaggtgctgtcaaaaccgctatgacggctaacgattttgagcctggtggcttagcagactgggtagctcgtgagacgccaattgggcgttggactaaaccagatgaagttgctgaattaacgggatttcttgcttcaggaaaagcgagatcaatgcaaggcgagattgtcaaaattgacggtggctggactttgaaa

SEQ ID NO: 2260 - protein, 235 aa, Streptococcus pyogenes
LRSMTKVVLVTGCASGIGYAQARYFLKQGHHVYGVDKSDKPDLSGNFHFIKLDLSSELAPLFKVVPSVDILCNTAGILDAYKPLLDVSDEEVEHLFDINFFATVKLTRHYLRRMVEKQSGVIINMCSIASFIAGGGGVAYTSSKHALAGFTRQLALDYAKDQIHIFGIAPGAVKTAMTANDFEPGGLADWVARETPIGRWTKPDEVAELTGFLASGKARSMQGEIVKIDGGWTLK

SEQ ID NO: 2261 - DNA, 240 bp, Streptococcus agalactiae
atgaaggcacaagaattatggaataagtttaaatctttgaatccttcaatcggtgatgagatagacgcatggcaatttggagcagaaccagatcttctggcaaagttagttgtagatgggacaaaaactgcaacggcctctgcctatgatttatatgaattagatgaggaagggttacacaagttggttcatatgatattattttggatagcaatgatgaagctatctgtattattgaaa

SEQ ID NO: 2262 - protein, 80 aa, Streptococcus agalactiae
MKAQELWNKFKSLNPSIGDEIDAWQFGAEPDLLAKLVVDGTKTATASAYDLYELDEEGLHKLVHMILFWIAMMKLSVLLK

SEQ ID NO: 2263 - DNA, 246 bp, Streptococcus agalactiae
ttggatagcaatgatgaagctatctgtattattgaaataactaaagttgatattgtcccttttaaagatgtctctgcagaccatgcttttaaagaaggagaaggagataaaactttagaatggtggagaaaagctcacattgatttctttaaaccttattttgaggagtttggtttaatgtttagtgaggactctaggatagttttagaggaattccaagtggtttacccaaaggagattaacgaa

SEQ ID NO: 2264 - protein, 82 aa, Streptococcus agalactiae
MDSNDEAICIIEITKVDIVPFKDVSADHAFKEGEGDKTLEWWRKAHIDFFKPYFEEFGLMFSEDSRIVLEEFQVVYPKEINE

SEQ ID NO: 2265 - DNA, 954 bp, Streptococcus agalactiae
atgaaattagcggttttggggacaggtatgattgttaaggaagttttgcctgtcttgcagaaaattgaaggtattgatctagttgctatcttatcaacagttagaagtttggagacagctaaagatctagctaaggaatataacatgtctctagctacgagtgaatataaggctgtcttggacaatgaggagattgacacagtctatattggactgccgaatcacttgcattttgactatgctaaggaggcactcttggcaggaaaacatgtcatttgtgagaagccatttacattagaagcaagtcaattagaagaacttgtatctattgccaatactaggcaactaatattactcgaagcaattacaaatcaatatttacctaattttgaccttgtaaaagaacatttaagcaaccttggagatattaaaattgtagaatgtaattattcccaatattcatcgcgttatgatgcctttaaacgtggggaaatagcaccagctttcaatcctgaaatgggtggaggtgcgttgagagaccttaatatttataatttacatttagtaattggactttttggagaacctataacagcacagtatttaccaaatatagagcgtggtattgatacttcaggagttctagtcctagactatgggcactttaaaacagtctgtattggagcaaaagattgtagtgcagaagtaaaatctactattcaaggtgataaggggtctatagcgattttagggccaactaatactatgcctaaaatttcattaactatgaatggacaagaaagtcatgtttatcaattaaatggtgataggcaccgcatgcacgatgaatttgttatttttgaaggtattattagcaatttagattttaagcgtgctgctcaagctttagaacatagtagaacggtgatgaaagttctagatatggtaacgaaa

SEQ ID NO: 2266 - protein, 318 aa, Streptococcus agalactiae
MKLAVLGTGMIVKEVLPVLQKIEGIDLVAILSTVRSLETAKDLAKEYNMSLATSEYKAVLDNEEIDTVYIGLPNHLHFDYAKEALLAGKHVICEKPFTLEASQLEELVSIANTRQLILLEAITNQYLPNFDLVKEHLSNLGDIKIVECNYSQYSSRYDAFKRGEIAPAFNPEMGGGALRDLNIYNLHLVIGLFGEPITAQYLPNIERGIDTSGVLVLDYGHFKTVCIGAKDCSAEVKSTIQGDKGSIAILGPTNTMPKISLTMNGQESHVYQLNGDRHRMHDEFVIFEGIISNLDFKRAAQALEHSRTVMKVLDMVTK

SEQ ID NO: 2267 - DNA, 375 bp, Streptococcus agalactiae
atgatttcatcaattggacaggtaatgctctacgttagcaatgttgaagcatcagcagatttttggaaaaacaaggtgggttttgagcgtgttgaaaaacagacacaaggagattatgtaacctatatagttgcaccgaagttggatagtgaagttagcttcgtcttacatgacaaagcaattatagctcaaatgagtcctgagctagatttagcaactccctctattttatttgaaactactgatattgacagtacatatcaagaattaacagcaaatgaggttatgacaaatcctattgttgatatggggagtatgagagtttttaatttttccgataatgacaataattactttgcaatccgtgaagtaaaa

SEQ ID NO: 2268 - protein, 125 aa, Streptococcus agalactiae
MISSIGQVMLYVSNVEASADFWKNKVGFERVEKQTQGDYVTYIVAPKLDSEVSFVLHDKAIIAQMSPELDLATPSILFETTDIDSTYQELTANEVMTNPIVDMGSMRVFNFSDNDNNYFAIREVK

SEQ ID NO: 2269 - DNA, 411 bp, Streptococcus agalactiae
atggttaaagcactagaaacatacatcgtaacaaatggaaatgggcgacaagcggttgatttttataaagatgtctttcaagcggatttagtgaatatgatgacatgggaagagatggaccccaactgtcttgaagaccgcaaggatttaatcattaatgctcagcttatttttgatggcattcgtcttcaaatctcggatgaaaatccagatttcgtgtatcaagctggtaaaaatgttacagccgctattattgtgggtagcgtagaggaggcgcgtgaaatttatgaaaaattaaagaagagtgcacaagaagttcagttagagttacaagaaactttctggagtcctgcttacgcaaacttagtagaccaatttggtgtgatgtggcaaatttcaacagagttaaac

SEQ ID NO: 2270 - protein, 137 aa, Streptococcus agalactiae
MVKALETYIVTNGNGRQAVDFYKDVFQADLVNMMTWEEMDPNCLEDRKDLIINAQLIFDGIRLQISDENPDFVYQAGKNVTAAIIVGSVEEAREIYEKLKKSAQEVQLELQETFWSPAYANLVDQFGVMWQISTELN

SEQ ID NO: 2271 - DNA, 1377 bp, Streptococcus agalactiae
atgtcaaattatgccattattttagctgcgggtaagggaactcgcatgaaatctgatttaccaaaagttatgcataaagtatctggtattaccatgcttgagcatgttttccgtagtgtgcaagctattgagccaagtaaaattgttactgttattggacataaggcggagcttgtacgtgatgttttaggtgacaaatcagagtttgtaatgcaaacagaacagctaggaactggccatgctgtaatgatggcggaagaagaattagcgacatcaaaaggacatacactagttattgcaggtgatacacccctgattactggagaaagtttaaaaaacttaattgattttcatgtcaatcataaaaacgttgcaacaatcttaacagccgatgctgcaaatccatttggatatggtcgtattatccgtaattcagatgatgaagttactaaaattgtagaacaaaaggatgctaatgactttgagcagcaggttaaagagattaatactggaacttatgtttttgataatcaaagtctatttgaagcacttaaagacattaatacaaataacgctcaaggagagtattatctaactgatgttattggaattttcaaagaagcgggtaaaaaggtaggtgcctataaacttcgtgactttgacgaaagtctaggagttaatgatcgtgtagcacttgcaactgctgaaaaagtgatgcgtcaccgaattgcacgtcaacatatggttaatggggtcacagtggttaatcctgattccgcttatattgatattgatgttgagattggagaagaatctgtaattgagcctaatgtgactttaaaaggacagacgaagattggtaaaggtactttattaaccaatggtagttatttagtagatgctcaagtcggaaatgatgttaccatcactaattcgatggttgaagaatccattatttctgatggagtaaccgtaggcccttatgcgcatattagaccaggaacaagtcttgcaaaaggtgttcatattggtaatttcgttgaagtaaagggttctcaaataggtgagaatacgaaggcaggtcatttaacttatatcggcaatgcagaggtaggttgtgatgttaactttggcgcagggacgattactgtcaattatgatggacaaaataaatttaaaacagaaatcggaagtaatgtctttatcggaagtaattctactctgattgcaccacttgaaattggtgataatgctttaacagcagctggatctaccatcacagataatgttccaattgatagcatagctattggaagaggacgtcaagtcaataaagaaggatatgccaataaaaaaccacatcatccttcacaaaag

SEQ ID NO: 2272 - protein, 459 aa, Streptococcus agalactiae
MSNYAIILAAGKGTRMKSDLPKVMHKVSGITMLEHVFRSVQAIEPSKIVTVIGHKAELVRDVLGDKSEFVMQTEQLGTGHAVMMAEEELATSKGHTLVIAGDTPLITGESLKNLIDFHVNHKNVATILTADAANPFGYGRIIRNSDDEVTKIVEQKDANDFEQQVKEINTGTYVFDNQSLFEALKDINTNNAQGEYYLTDVIGIFKEAGKKVGAYKLRDFDESLGVNDRVALATAEKVMRHRIARQHMVNGVTVVNPDSAYIDIDVEIGEESVIEPNVTLKGQTKIGKGTLLTNGSYLVDAQVGNDVTITNSMVEESIISDGVTVGPYAHIRPGTSLAKGVHIGNFVEVKGSQIGENTKAGHLTYIGNAEVGCDVNFGAGTITVNYDGQNKFKTEIGSNVFIGSNSTLIAPLEIGDNALTAAGSTITDNVPIDSIAIGRGRQVNKEGYANKKPHHPSQK

SEQ ID NO: 2273 - DNA, 1380 bp, Streptococcus pyogenes
atgacaaattatgccattattttagcagcgggcaaagggactcgcatgacttctgatctcccaaaagttcttcataaagtatctggactaaccatgcttgagcatgtttttcgtagtgtaaaagcgattagtcctgaaaaatccgtgacggttattggtcacaaatcagaaatggtacgtgctgtcttagcagatcaatcagcctttgtccatcaaacagagcagttaggaactggccatgccgtgatgatggcagaaacacaactagaaggactagaagggcataccttggtgattgcaggagatactcccttgatcactggagaaagcctgaagagtctgattgattttcatgtgaatcataaaaatgtcgccactattttaacagctacggctcaagatccatttggttatggtcgtattgttcgcaacaaagatggcgaagtgatcaagattgttgagcaaaaagacgccaatgagtatgagcaacaattaaaagaaatcaatacaggaacctatgtgtttgataacaagcgtctctttgaagcgctcaaatgcatcactaccaacaatgctcaaggagagtattacctgactgacgttgtggctatttttagagcaaacaaagaaaaggtaggagcctatatcctgagagacttcaatgaaagtctgggagtaaatgatcgtgtggccttagcaatagctgaaacagtgatgcgtcagcgcattacccaaaaacatatggtcaatggggtgactttccaaaatcctgaaactgtttatattgaaagcgatgttgagattgctccagacgtccttatcgaaggaaatgtgaccttaaaagggcgtacacatatcggctcaggaactgtcttgacgaatggtacttatattgtggattctgaaattggtgataactgtgttgttaccaattcgatgatcgaatcatctgttttagctgcaggagttacggttggcccttacgcccaccttcgaccgggaacgaccttagatagggaagtccatatcggtaactttgtcgaggtcaagggttctcacattggtgaaaaaacaaaggctgggcatctgacttatattggaaacgctcaggttgggtcttcagtcaatgttggggctggaaccatcactgtcaactacgacggccaaaacaaatatgaaacagtcattggagatcacgcttttattgggagcaactcgactctcattgcacctttggaagttggggatcacgctttaacagcagcaggttcaacgatttcaaaaacagttcctatcgatagcattgctattggtcgtagccgccaagtcacaaaagaaggttatgccaagcgcctagcgcatcacccaagtcgaagcaaa

SEQ ID NO: 2274 - protein, 460 aa, Streptococcus pyogenes
MTNYAIILAAGKGTRMTSDLPKVLHKVSGLTMLEHVFRSVKAISPEKSVTVIGHKSEMVRAVLADQSAFVHQTEQLGTGHAVMMAETQLEGLEGHTLVIAGDTPLITGESLKSLIDFHVNHKNVATILTATAQDPFGYGRIVRNKDGEVIKIVEQKDANEYEQQLKEINTGTYVFDNKRLFEALKCITTNNAQGEYYLTDVVAIFRANKEKVGAYILRDFNESLGVNDRVALAIAETVMRQRITQKHMVNGVTFQNPETVYIESDVEIAPDVLIEGNVTLKGRTHIGSGTVLTNGTYIVDSEIGDNCVVTNSMIESSVLAAGVTVGPYAHLRPGTTLDREVHIGNFVEVKGSHIGEKTKAGHLTYIGNAQVGSSVNVGAGTITVNYDGQNKYETVIGDHAFIGSNSTLIAPLEVGDHALTAAGSTISKTVPIDSIAIGRSRQVTKEGYAKRLAHHPSRSK

SEQ ID NO: 2275 - DNA, 552 bp, Streptococcus agalactiae
atggattttgaagaaaaaacaattaatcgtcaaactgtttttgatggacaaattatcaaagtagctgttgatgatgtagagttgccaaatggattgggacaatccaaacgtgaacttgtttttcatggaggagctgttgctactttggcggtaactcctgagcataaaattgttttagtgaaacagtatcgtaaggctattgaaggtatttcttacgaaattccagcagggaaacttgagacgggtgagtcaggttctaaggaagaagctgcccttcgggaattagaagaagagactggctacacagggaatcttgaaattctttatagtttctacactgctattggtttttgtaatgagaaaatcgtcctctatctagctactgatttacaaaaagttgaaaatcctaggccacaagatgatgatgaggtccttgagcttctagagttaagttatgaggattgtatgcaaatggtagaaaaaggcatgattcaagatgcgaaaacgatcattgctttacaatattacggtttaaaaatgggaggtcattct

SEQ ID NO: 2276 - protein, 184 aa, Streptococcus agalactiae
MDFEEKTINRQTVFDGQIIKVAVDDVELPNGLGQSKRELVFHGGAVATLAVTPEHKIVLVKQYRKAIEGISYEIPAGKLETGESGSKEEAALRELEEETGYTGNLEILYSFYTAIGFCNEKIVLYLATDLQKVENPRPQDDDEVLELLELSYEDCMQMVEKGMIQDAKTIIALQYYGLKMGGHS

SEQ ID NO: 2277 - DNA, 552 bp, Streptococcus pyogenes
atgaaatttgaagaaaaaacgcttaagagacaaacagtttttgatggtcatatttttaaagttgttgtggatgatgttgaacttcccaacaatctggggcaatccaagcgagaattaatttttcatcgtggtgccgttgctgttttggctattactcctgaacgtaagattgtccttgtcaaacaataccgtaaggctattgaacgtgtctcatacgagatcccagcgggtaagctagagattggtgaggaaggctcaaagctaaaagctgctgcacgtgagctagaagaagaaacagcctatacggggacattgacgtttttgtatgaattttatacagcgattggtttttgcaacgaaaaaatcacacttttcttagcgacagacctaatacaagttgccaatcccaaacctcaagacgacgatgaagttatcgaggtcttagagttgacatatcaagagtgcatggacttagtcgctcaaggtaaacttgctgacgctaaaacgttgattgctttgcaatactatgccttacattttggaggtgagcag

SEQ ID NO: 2278 - protein, 184 aa, Streptococcus pyogenes
MKFEEKTLKRQTVFDGHIFKVVVDDVELPNNLGQSKRELIFHRGAVAVLAITPERKIVLVKQYRKAIERVSYEIPAGKLEIGEEGSKLKAAARELEEETAYTGTLTFLYEFYTAIGFCNEKITLFLATDLIQVANPKPQDDDEVIEVLELTYQECMDLVAQGKLADAKTLIALQYYALHFGGEQ

SEQ ID NO: 2279 - DNA, 267 bp, Streptococcus agalactiae
atgggaaaaccattgttaacagatgatatgattgaacgttcaaatcgaggtgaaaaagtttcaggtcaaacaatcttagatcaagaaactaaaattatttctacagaagatggcatggagcaactaactgacgagaacggtaaacatatctacaagagtcgccggattgagaatgcaaaacgaaatgaatttcaacgtaagttgaatttagttttattcattttgcttattttgttggctctcttgttttatgcaatttttaaatta

SEQ ID NO: 2280 - protein, 89 aa, Streptococcus agalactiae
MGKPLLTDDMIERSNRGEKVSGQTILDQETKIISTEDGMEQLTDENGKHIYKSRRIENAKRNEFQRKLNLVLFILLILLALLFYAIFKL

SEQ ID NO: 2281 - DNA, 252 bp, Streptococcus pyogenes
gtgatgggaaggccattgttgaccgatgatatcatcgaaaaagcgagacgaatggaaacatttgagccagatgatgctgtaaactttgacacaaaagtaatgacgctaccagaaaaagatgataaagcacgcatttataaaagtcgtcggattgaaaatgccaaacgcagccaattgcaatctaaattaaatgtgattttgatagctgttatgctgttaattgccatcttggtatatgctatcttttatctt

SEQ ID NO: 2282 - protein, 84 aa, Streptococcus pyogenes
VMGRPLLTDDIIEKARRMETFEPDDAVNFDTKVMTLPEKDDKARIYKSRRIENAKRSQLQSKLNVILIAVMLLIAILVYAIFYL

SEQ ID NO: 2283 - DNA, 687 bp, Streptococcus agalactiae
atgaaaattggaattattgcagccatggaggaagagttaaaactccttgtggaaaatcttgaggataaatctcaagagacagtattatcaaatgtatattacagtggacgttatggtgaacatgagcttgttttagtacagtctggtgttgggaaagtcatgtcagcgatgagtgttgctattttagtagaaagctttaaagttgatgctattattaatacaggatcagctggtgcagtagcaacaggattgaatgtaggagacgtcgttgtcgcagatacattagtttatcacgatgtagatttaaccgcctttggttatgactatggacaaatgtcaatgcagccactttattttcattcggataagacttttgtttccacttttgaagcagttttatctaaagaagaaatgattagtaaagttggtttaattgcaactggggatagttttattgctggccaggaaaagattgatgttattaaggggcattttccacaggttttagctgtcgagatggaaggtgcagcaattgcccaagctgctcaagctacaggaaagccctttgtggtggtacgtgctatgagtgatactgcagctcatgatgccaatatcacatttgatgaatttatcattgaagctggtaaacgctctgcccaagtattaatggcatttttgaaagcatta

SEQ ID NO: 2284 - protein, 229 aa, Streptococcus agalactiae
MKIGIIAAMEEELKLLVENLEDKSQETVLSNVYYSGRYGEHELVLVQSGVGKVMSAMSVAILVESFKVDAIINTGSAGAVATGLNVGDVVVADTLVYHDVDLTAFGYDYGQMSMQPLYFHSDKTFVSTFEAVLSKEEMISKVGLIATGDSFIAGQEKIDVIKGHFPQVLAVEMEGAAIAQAAQATGKPFVVVRAMSDTAAHDANITFDEFIIEAGKRSAQVLMAFLKAL

SEQ ID NO: 2285 - DNA, 693 bp, Streptococcus pyogenes
atgaaaataggaattattgctgctatggaggaggagttgtccctgctcttagcaaatcttttggatgctcaagaacatcaggtgctttcaaaaacttactatacgggtcgttttggcaagcatgagctcattttggtacagtcgggtgttggaaaagtgatgtctgctatgacagttgcgatcttggttgagcatttcaaagcccaagctattatcaatacaggatcagcaggggcagtcgcttcacatttagcgatcggagatgtggtggttgcagatcggttagtgtatcatgatgtggatgctactgcatttggttatgcttatggtcaaatggctggtcaaccattatactatgattgtgatccacagtttgtggctatcttcaaacaagtcctaaaacacgaaaagacaaatggccaagttggtttgattgcaacaggagacagttttgttgctggtcaggacaagattgaccagatcaaaacagcttttagcgacgtgttagcagtagaaatggaaggcgcagctattgctcaagcagcacatactgcagggaaacccttcatcgttgttcgtgcgatgagtgataccgcagcgcatgatgccaatattacttttgatcaatttattatagaagctggcaagcgttcggcccagacattaatgacatttttagaaaacttacctgtt

SEQ ID NO: 2286 - protein, 231 aa, Streptococcus pyogenes
MKIGIIAAMEEELSLLLANLLDAQEHQVLSKTYYTGRFGKHELILVQSGVGKVMSAMTVAILVEHFKAQAIINTGSAGAVASHLAIGDVVVADRLVYHDVDATAFGYAYGQMAGQPLYYDCDPQFVAIFKQVLKHEKTNGQVGLIATGDSFVAGQDKIDQIKTAFSDVLAVEMEGAAIAQAAHTAGKPFIVVRAMSDTAAHDANITFDQFIIEAGKRSAQTLMTFLENLPV

SEQ ID NO: 2287 - DNA, 534 bp, Streptococcus agalactiae
gtgtcagaaatgattaaaaaaatgataagtgaacaactgattgttaaagataaagatttaggatattatcttaccaaacaaggtttattagttgtttctgacctttaccgtaaacatcgtctagtagaggtatttttagttaaccatttgcactatactgctgatgatattcatgaagaagcggaagttttagaacatactgtatcaacaacttttgttgatcaattagaaaagttgttagactttccacaattttgtccacacggtgggactattcctaaaaagggagagtttttagtagaaattaaccaaatgacattggaccaaattagtcagcttggcacatatgttatcagtcgtgttcatgatgattttcagctactgaaatacctagaacaacaccgtttgcatatcaacgataccattgaattgacacaaattgacccttatgcaaaaacttatcacatcacctataacgatgaaaatctaacaatccctgagcgtatcgcaagtcaaatatatgtatctgctaca

SEQ ID NO: 2288 - protein, 178 aa, Streptococcus agalactiae
MSEMIKKMISEQLIVKDKDLGYYLTKQGLLVVSDLYRKHRLVEVFLVNHLHYTADDIHEEAEVLEHTVSTTFVDQLEKLLDFPQFCPHGGTIPKKGEFLVEINQMTLDQISQLGTYVISRVHDDFQLLKYLEQHRLHINDTIELTQIDPYAKTYHITYNDENLTIPERIASQIYVSAT

SEQ ID NO: 2289 - DNA, 336 bp, Streptococcus pyogenes
atgacgcctaataaagaagattacttgaaatgtatttatgaaattggagaacaagaacccaagattacaaataaaatggttgcagaaaagatgcacgtttcggcacctgccgtttcagagatgattaaaaaaatgatttcacaaggctggattgtcaaagataaagcaaaaggctatttgctaaaagacaaaggctatgctcttgttgctaacctctaccgcaaactccgcttgattgaggtatttttgattcatcagctgggctataatacccaagaagtgcaccaagaagctgaagtcttagagcacactgtctcagactcctttatcgaccgt

SEQ ID NO: 2290 - protein, 112 aa, Streptococcus pyogenes
MTPNKEDYLKCIYEIGEQEPKITNKMVAEKMHVSAPAVSEMIKKMISQGWIVKDKAKGYLLKDKGYALVANLYRKLRLIEVFLIHQLGYNTQEVHQEAEVLEHTVSDSFIDR

SEQ ID NO: 2291 - DNA, 495 bp, Streptococcus agalactiae
atgaaccttccggttaaattttttgataaatatgtaccagagttagataaaaataatgtacgtgtacaggtcatcggagatactcataaattacctaaggcaacatacgatgcaatgcaacgcgcttgtttgaggacaaaacataattcggggctcgtcttgaattttgcgctaaattatggcggacgttcagaaatcactaatgccattaaggaaattgctcaggatgttttggaagctaagttgaatcctgacgatattacagaggatttagtagcaaatcatttaatgacaaatagcttaccctatctttatagagaccctgatttgattatccgaactagtggagagttacgcttgagtaactttttaccttggcaatcagcttatagtgaattttactttactcccgttttatggccagattttaaaaaagacgaactacataaggccattgtggattataatcaacgccatcgtcgatttggtagtgta

SEQ ID NO: 2292 - protein, 165 aa, Streptococcus agalactiae
MNLPVKFFDKYVPELDKNNVRVQVIGDTHKLPKATYDAMQRACLRTKHNSGLVLNFALNYGGRSEITNAIKEIAQDVLEAKLNPDDITEDLVANHLMTNSLPYLYRDPDLIIRTSGELRLSNFLPWQSAYSEFYFTPVLWPDFKKDELHKAIVDYNQRHRRFGSV

SEQ ID NO: 2293 - DNA, 747 bp, Streptococcus pyogenes
atgtttggattaaaagcgaaatcaacaaaaaaagttttggggagtatcccaaagcatattggaattatcatggatggtaatggacgttgggccaaaaaaagactaaaacctagagtgtttgggcataaagctgggatggatgctttacaagaagtaacgattactgcatctgagttgggggttaaagttctgacagtctatgccttttcgacagaaaactggtccagaccccaagatgaggtgtcttttatcatgaatttaccagtaaccttctttgacaaatatgtgcctgtgcttcatgagaacaatgtaaagattcaaatgattggagagactagtcgtttacctgaagataccttggcagcgctaaatgcagccatcgacaaaacaaaacgtaatacgggtttaattttgaattttgctctcaattatggaggacgtgctgagattaccagtgctgttcgctttattgctcaagatgtcttagatgccaaattaaatccaggagatattacggaggatttgattgctaattacttgatgacagaccatctgccatatctctaccgagaccccgatttgattattcgcaccagtggtgagctgcgtttgagcaatttcttgccttggcaatcagcttacagtgaattttatttcacaccagtcttgtggcctgattttaaaaaggcagagctactaaaggccattgcggattataaccgccgccaacgtcgttttggcaaggtc

SEQ ID NO: 2294 - protein, 249 aa, Streptococcus pyogenes
MFGLKAKSTKKVLGSIPKHIGIIMDGNGRWAKKRLKPRVFGHKAGMDALQEVTITASELGVKVLTVYAFSTENWSRPQDEVSFIMNLPVTFFDKYVPVLHENNVKIQMIGETSRLPEDTLAALNAAIDKTKRNTGLILNFALNYGGRAEITSAVRFIAQDVLDAKLNPGDITEDLIANYLMTDHLPYLYRDPDLIIRTSGELRLSNFLPWQSAYSEFYFTPVLWPDFKKAELLKAIADYNRRQRRFGKV

SEQ ID NO: 2295 - DNA, 792 bp, Streptococcus agalactiae
atgaaagaacgtgttatttggggagctgtcgcgcttgccatatttatcccttttttagtaatgggtggtttgcctttccaatttttagttggacttttagctatgattggtgtttctgaattacttcgtatgcgtcgtttagaaatattttcctttgaaggtgcattagctatgataggagcctttgttttaacagttcctttagatagttatttgtcctttttaccagttgacgctagtttatcagcatacggtattgttatttttatgattttggcaggtactgttttgaacagtaattcttacagttttgaagatgctgcctttccaattgcgtctagtttttatgtgggtattggctttcaaaatctagtcagtgctcgtatggctggaatagataaggtgttgttagctttatttattgtctgggcgactgatatcggtgcttatatgattggtcgtcaatttggacaacgcaaactactaccctcagtgtctccaaataaaacaattgaagggagtctaggagggattgcttcagccattgtggtagctttcttttttatgctttttgataagaccgtctatgcgcctcatagcttcctagtcatgttagttttagtggctatctttagcatttttggtcaatttggagatttagttgaaagtagtattaaacgtcattttggtgttaaagattcgggtaaattgattccgggtcatggggggattttggatcgctttgatagtatgatttttgttttcccaatcatgcacttctttggcttattc

SEQ ID NO: 2296 - protein, 264 aa, Streptococcus agalactiae
MKERVIWGAVALAIFIPFLVMGGLPFQFLVGLLAMIGVSELLRMRRLEIFSFEGALAMIGAFVLTVPLDSYLSFLPVDASLSAYGIVIFMILAGTVLNSNSYSFEDAAFPIASSFYVGIGFQNLVSARMAGIDKVLLALFIVWATDIGAYMIGRQFGQRKLLPSVSPNKTIEGSLGGIASAIVVAFFFMLFDKTVYAPHSFLVMLVLVAIFSIFGQFGDLVESSIKRHFGVKDSGKLIPGHGGILDRFDSMIFVFPIMHFFGLF

SEQ ID NO: 2297 - DNA, 792 bp, Streptococcus pyogenes
atgaaagaacgtgttgtttgggggggagtagcagtagctattttcctaccttttctcataataggaaacctaccattccaattatttgtaggcgttttggccatgattggggtatcagaattactgaaaatgaaaagattagaagtcttttcttttgaaggtgtttttgccatgttagccgcctttgtattggcagttccgatggaccattacctcacttttttaccaattgatgcgaatgttgctttttacagcttaatggtttttttcattttggcaggtactgttttaaatagcagagcttattcatttgatgatgcggcctttccgattgcaactagtttttatgttgggattggttttcaacatttgatcaatgctcgcctgtcaggaattgacaaggtctttttggccttatttatcgtttgggccactgatattggagcatatctgattgggcgtcagtttggtagacgcaaactattgcctacagtttctccaaacaaaaccattgaaggtagtttaggagggatcgcttgtgcagtccttgtgtcttttatctttatggtgattgataggtctgtttatgcgccacatcactttttgaccatgttggttttggtcgctcttttttccatttttgcccaatttggtgatttggttgaaagtgctctcaaacgtcactttggtgtcaaagattcaggtaagcttatcccgggacatggtggtattttagaccgctttgattccatgatttttgtttttcccatcatgcatctctttggtttattt

SEQ ID NO: 2298 - protein, 264 aa, Streptococcus pyogenes
MKERVVWGGVAVAIFLPFLIIGNLPFQLFVGVLAMIGVSELLKMKRLEVFSFEGVFAMLAAFVLAVPMDHYLTFLPIDANVAFYSLMVFFILAGTVLNSRAYSFDDAAFPIATSFYVGIGFQHLINARLSGIDKVFLALFIVWATDIGAYLIGRQFGRRKLLPTVSPNKTIEGSLGGIACAVLVSFIFMVIDRSVYAPHHFLTMLVLVALFSIFAQFGDLVESALKRHFGVKDSGKLIPGHGGILDRFDSMIFVFPIMHLFGLF

SEQ ID NO: 2299 - DNA, 1257 bp, Streptococcus agalactiae
atgctaggaattttaacctttattattatttttggtgtcattgtagttgttcacgaatttgggcatttctattttgcaaagaaatcaggaattcttgttcgtgaatttgctattggtatgggtccaaaaatcttttctcacattgataaagaaggaacaacctatactattcgtatattaccgctaggtggttatgtccgtatggctggttggggtgatgataagactgaaattaagacagggacgccggctagccttactttaaataaagaaggcattgtaactcgtattaatttatcaggaaaacaattagacaatacttctttaccaatcaatgtaacagcttatgatttagaagataaactaactatcacaggattggtcttaagtgagacaaaaacctatagtgttgatcacgatgctactatcattgaggaggatggtactgaaattcgtattgctcccttagatatgcagtatcagaatgcttctgtatgggggcgcttaattaccaattttgcaggtccgatgaataattttattttaggtcttgtagtctttattgcacttgcttttattcaaggaggtgttcaagacttatcaaccaatcaggtccgtgtatcagaaaatggtcctgccgctagtgcaggtttaaaaaataatgatcgtattttacaaatagggtcgcacaaagtttctaactgggaacagttgacagcagcagtagaaaagtcaactaggcatttagaaaaaaaacaaaaacttgcccttaagattaagagcaaagaggtggtgaaaacgatcaacgttaagccacagaaagttgataaatcctacatcatcggcattatgccagctttaaagacaagctttaaagacaaacttttaggtggattaaaactagcatgggaaagtttctttagaattttaaatgaattaaagaaacttattgctcattttagtattaataaattgggaggtccagtagctctctatcaggctagtagccaagctgctaaaaatggtttcgtcacagttctcaacttaatgggattaatctctatcaacttaggtattatgaatctcatccctataccagcccttgacgggggtaagatagtgatgaatattttagaagccattcgtcgcaaaccacttaaacaagaaacagaaacttatattacgctcgctggggtagcagttatgttagtattaatgattgctgtgacctggaacgatatcatgcgagctttcttc

SEQ ID NO: 2300 - protein, 419 aa, Streptococcus agalactiae
MLGILTFIIIFGVIVVVHEFGHFYFAKKSGILVREFAIGMGPKIFSHIDKEGTTYTIRILPLGGYVRMAGWGDDKTEIKTGTPASLTLNKEGIVTRINLSGKQLDNTSLPINVTAYDLEDKLTITGLVLSETKTYSVDHDATIIEEDGTEIRIAPLDMQYQNASVWGRLITNFAGPMNNFILGLVVFIALAFIQGGVQDLSTNQVRVSENGPAASAGLKNNDRILQIGSHKVSNWEQLTAAVEKSTRHLEKKQKLALKIKSKEVVKTINVKPQKVDKSYIIGIMPALKTSFKDKLLGGLKLAWESFFRILNELKKLIAHFSINKLGGPVALYQASSQAAKNGFVTVLNLMGLISINLGIMNLIPIPALDGGKIVMNILEAIRRKPLKQETETYITLAGVAVMLVLMIAVTWNDIMRAFF

SEQ ID NO: 2301 - DNA, 1257 bp, Streptococcus pyogenes
atgttaggaataataacctttattattatttttggtattttagtgattgtccatgaatttggacatttctattttgctaaaaaatcaggcattctagtaagagaatttgccattggaatgggccctaaaattttttctcatgttgaccaaggaggaactctttataccttgaggatgttacccttgggcggttatgtgcgaatggctggttggggtgatgacaaaactgagatcaaaacaggtactccagcaagtttaacccttaatgagcaaggttttgttaagcgcatcaacttgtctcaaagtaagttagacccaacgagtctcccaatgcatgttacaggctatgacttagaagatcagctgagtattactggcttagttttagaagaaaccaagacatataaggtcgctcacgatgctactattgttgaagaagacggtactgagataagaattgctccgcttgatgttcaatatcaaaatgctagtattggcggacgtttaatcaccaattttgcaggtcccatgaataattttattttagggattgtggtttttatcctcttggtctttttacaaggtgggatgccagattttagtagcaatcatgtccgtgttcaagaaaatggagcagcagctaaggctggtcttcgagataatgaccaaattgtcgcaattaatggttacaaggtgactagctggaatgatctcactgaggctgtagaccttgcaacacgggatctaggcccgtcacagaccattaaggtcacctacaagtcacatcagcgcttaaaaacggtggctgtgaaaccacaaaagcatgcaaagacatacacgataggagttaaggcgagtctgaaaacaggatttaaggataagctcttaggcggtctagaattagcttggagtagggcgtttactattttgaatgctttgaaaggattgatcactggctttagtctcaataaattaggtggacctgttgccatgtatgacatgtccaatcaggctgctcaaaacggcttagagtcagtcttatctcttatggcaatgctttcgatcaatttagggatctttaacctgattccgattcctgcacttgatgggggaaaaatcttgatgaatatcattgaagccattcgtcgcaagcctatcaagcaagaaacagaggcctatatcaccctagctggggttgctatcatggtcgtattgatgattgctgtgacatggaatgatatcatgcgcgtctttttc

SEQ ID NO: 2302 - protein, 419 aa, Streptococcus pyogenes
MLGIITFIIIFGILVIVHEFGHFYFAKKSGILVREFAIGMGPKIFSHVDQGGTLYTLRMLPLGGYVRMAGWGDDKTEIKTGTPASLTLNEQGFVKRINLSQSKLDPTSLPMHVTGYDLEDQLSITGLVLEETKTYKVAHDATIVEEDGTEIRIAPLDVQYQNASIGGRLITNFAGPMNNFILGIVVFILLVFLQGGMPDFSSNHVRVQENGAAAKAGLRDNDQIVAINGYKVTSWNDLTEAVDLATRDLGPSQTIKVTYKSHQRLKTVAVKPQKHAKTYTIGVKASLKTGFKDKLLGGLELAWSRAFTILNALKGLITGFSLNKLGGPVAMYDMSNQAAQNGLESVLSLMAMLSINLGIFNLIPIPALDGGKILMNIIEAIRRKPIKQETEAYITLAGVAIMVVLMIAVTWNDIMRVFF

SEQ ID NO: 2303 - DNA, 1851 bp, Streptococcus agalactiae
atgaaacaaagtaaaatgcttattccaacacttcgcgaaatgccaagtgatgctcaggttatcagccatgctcttatggttcgtgcaggatatgtccgccaagtttcggctggaatctatgcttatttgcctctagctaaccgtactattgaaaaatttaaaacaattatgcgtcaagaatttgagaagattggtgcagttgaaatgttagctccagctcttcttacagcagatttatggcgtgaatctgggcgctacgaaacatatggtgaagacctttataaattaaagaatcgtgatcaatcggattttatcttaggaccaactcatgaagagactttcacaactcttgttcgtgatgcagtaaaatcttataagcaattaccactaaacctttatcaaattcagtctaaatatcgtgatgagaagcgtcctcgtaatggacttcttcgaacacgtgaatttatcatgaaagatggatacagcttccacaaagattatgaagaccttgatgtcacttacgaagattaccgtaaagcatatgaagccatcttcacacgtgctggacttgactttaaaggcattataggtgacggaggtgctatgggaggtaaagatagccaagaatttatggcagtaactcccaatcgtacagatttaaatcgttggttagtccttgataaaactattccttctattgatgatattccagaggatgttttagaagaaattaaggtagaactctcggcttggctagtttctggtgaggacactattgcatactctactgaatcaagctatgctgctaaccttgagatggcaacgaatgagtacaaaccatctactaaggctgctacctttgaagaagtaacaaaagtagaaactcctaactgcaaatcaattgatgaggtagctggatttttatcaattgatgaaaatcaaactatcaagacactattgtttattgctgatgaacagcccgtggttgctttactagttggtaacgatcaagtcaatgatgtgaagttaaaaaattatttagcggctgatttcttagagcctgcaagtgaagagcaagcaaaagagatttttggtgcaggttttggttctcttgggccagttaacctacctgactctgttaaaattattgctgatcgtaaagttcaagaccttgctaatgctgtgtctggtgctaaccaagatggttatcattttactggagttaatccagaacgtgatttcacagctgaatacgttgatattcgtgaagtaaaagaaggggagatttctccagacggtaaaggtactctgaaatttgctcgtggtattgaaattggacatatctttaaactaggtacccgttattcagatagtatgggagcgaacatccttgatgaaaatggccgctcaaatcctattgttatggggtgttatggtattggtgttagtcgtattctctcagctgtcattgaacaacatgcccgactttttgtgaataagacaccaaaaggagcttatcgctttgcttgggggattaatttcccagaagaattagccccatttgatgtacatttgattactgtcaatgtcaaagatcaagagtcacaagaccttactgagaaaattgaagctgatttgatgcttaaaggttatgaagtcctgacagacgatcgtaatgaacgtgttggttctaaattctcagacagtgacttaattggacttccaattcgagtaactgttgggaagaaagcttctgaaggtatcgttgaagtgaaaattaaagcaagtggtgatacgattgaggttcacgctgataacttaattgaaactttagagattctaacaaaaaaa

SEQ ID NO: 2304 - protein, 617 aa, Streptococcus agalactiae
MKQSKMLIPTLREMPSDAQVISHALMVRAGYVRQVSAGIYAYLPLANRTIEKFKTIMRQEFEKIGAVEMLAPALLTADLWRESGRYETYGEDLYKLKNRDQSDFILGPTHEETFTTLVRDAVKSYKQLPLNLYQIQSKYRDEKRPRNGLLRTREFIMKDGYSFHKDYEDLDVTYEDYRKAYEAIFTRAGLDFKGIIGDGGAMGGKDSQEFMAVTPNRTDLNRWLVLDKTIPSIDDIPEDVLEEIKVELSAWLVSGEDTIAYSTESSYAANLEMATNEYKPSTKAATFEEVTKVETPNCKSIDEVAGFLSIDENQTIKTLLFIADEQPVVALLVGNDQVNDVKLKNYLAADFLEPASEEQAKEIFGAGFGSLGPVNLPDSVKIIADRKVQDLANAVSGANQDGYHFTGVNPERDFTAEYVDIREVKEGEISPDGKGTLKFARGIEIGHIFKLGTRYSDSMGANILDENGRSNPIVMGCYGIGVSRILSAVIEQHARLFVNKTPKGAYRFAWGINFPEELAPFDVHLITVNVKDQESQDLTEKIEADLMLKGYEVLTDDRNERVGSKFSDSDLIGLPIRVTVGKKASEGIVEVKIKASGDTIEVHADNLIETLEILTKK

SEQ ID NO: 2305 - DNA, 1854 bp, Streptococcus pyogenes
atgaaacaaagtaaactgcttatcccaaccttgcgcgaaatgccaagtgatgcccaggttatcagccacgcgcttatggtgcgtgccggttatgtgcgccaagtttctgctggtatctatgcttatttaccactggcaaatcgtaccattgagaaattcaagaccatcatgcgtgaagagtttgaaaagatcggtgctgttgaaatgttggcgccagctcttttgacagctgatctctggcgtgaatcaggccgttatgagacctatggagaggacctctataagcttaaaaaccgtgataactcagactttatcttgggtccaactcacgaagaaacctttacgactttggtgcgtgatgcggtcaaatcttacaagcaattgcccttaaacctttatcaaattcagtctaagtatcgtgatgaaaaacgtccgcgtaatggcttgcttcgtacccgtgagtttattatgaaagacggctatagtttccatcacaactatgaagatttagatgtgacctacgaagattatcgtcaagcttacgaagctatttttaccagagctggtttagatttcaaagggattattggagatggcggtgccatgggggggaaagattcccaagaatttatggccattacaccagctcgtacggatcttgatcgctgggtggttcttgacaagtctattgcgtcaatggatgatattccaaaagaggtcttagaagatattaaggcagaattggctgcttggatgatttcaggtgaagatactattgcttattcaacagaatcaagctacgctgccaaccttgagatggcaactaacgaatacaaaccgtcctcaaaagtagctgctgaagatgccttggcagaagttgagacaccacattgcaaaacgattgatgaagtggctgcttttctttcagtagatgaaacacaaaccatcaaaaccttgctttttgtggcagataatgaacctgttgttgctttgctagttggaaatgaccatatcaataccgttaaattaaaaaactatctagctgctgattttttagagccagctagtgaagaagaagcccgtgctttctttggtgcaggttttggctcacttgggcctgtcaacttggcacaaggtagtcgtattgtggctgaccgcaaagtgcaaaaccttaccaatgccgttgcaggagctaacaaggatggtttccatatgacaggagtcaatccaggacgtgacttccaggctgaatatgtagatattcgtgaagtcaaagaaggggaaatgtctccggacggtcatggtgttctccagtttgcgcgtggtatcgaagtcggtcatatcttcaagttgggcactcgttattcagacagcatgggagcaacgattcttgatgaaaatggcagaacagttccaattgtgatgggttgttatggtatcggggttagccgcattttgtctgctgtcattgaacagcatgcccgtctctttgtgaacaagacaccaaaaggcgattaccgttatgcttggggtattaacttccctaaagaattagccccatttgacgtgcatttgattacagttaatgtcaaagatcaagtggcccaagacttgacggcgaagttagaagctgacttgatggctaaagggtatgatgtcttgacagatgaccgtaatgaacgcgtcggttcgaaattctctgatagcgatttgattggtttgccaattcgtgtcactgttggtaaaaaagccgctgaaggtatcgtggaaattaaaatcaaggcaacaggtgacagcattgaagttaatgcagaaaacctcatcgaaacccttgaaattttaacaaaagaacac

SEQ ID NO: 2306 - protein, 618 aa, Streptococcus pyogenes
MKQSKLLIPTLREMPSDAQVISHALMVRAGYVRQVSAGIYAYLPLANRTIEKFKTIMREEFEKIGAVEMLAPALLTADLWRESGRYETYGEDLYKLKNRDNSDFILGPTHEETFTTLVRDAVKSYKQLPLNLYQIQSKYRDEKRPRNGLLRTREFIMKDGYSFHHNYEDLDVTYEDYRQAYEAIFTRAGLDFKGIIGDGGAMGGKDSQEFMAITPARTDLDRWVVLDKSIASMDDIPKEVLEDIKAELAAWMISGEDTIAYSTESSYAANLEMATNEYKPSSKVAAEDALAEVETPHCKTIDEVAAFLSVDETQTIKTLLFVADNEPVVALLVGNDHINTVKLKNYLAADFLEPASEEEARAFFGAGFGSLGPVNLAQGSRIVADRKVQNLTNAVAGANKDGFHMTGVNPGRDFQAEYVDIREVKEGEMSPDGHGVLQFARGIEVGHIFKLGTRYSDSMGATILDENGRTVPIVMGCYGIGVSRILSAVIEQHARLFVNKTPKGDYRYAWGINFPKELAPFDVHLITVNVKDQVAQDLTAKLEADLMAKGYDVLTDDRNERVGSKFSDSDLIGLPIRVTVGKKAAEGIVEIKIKATGDSIEVNAENLIETLEILTKEH

SEQ ID NO: 2307 - DNA, 582 bp, Streptococcus agalactiae
atgaaaagtcgaaaaaaagataaattggtattgaggttaacaacaacactattggtttttggtttgggtggggtttggttttataattataaaaatgataatgtcgaaccgacagtcactagtgcatcggatcaaacgacgacttttattcaaacgatttctccaacagctattgaaatttctaagacctatgatttgtatgcgtcagtcttattagcacaagctattttggaatcatccagtggacaatcagatttgtctaaggctcctaattataacctctttggcatcaaaggagaatataaaggtaaatctgtccaaatgcctactttagaagatgatgggaaaggcaatatgactcaaatccaagctccttttcgcgcctatccaaattattctgcttcactatatgattatgctgagttagtatctagtcaaaagtatgcatctgtttggaaatcaaatacctcttcttataaggatgctactgcagctctaacaggtctttatgcgacagatactgcttatgctagtaaattaaaccaaattattgaaacctacagtctagatgcttatgataaa

SEQ ID NO: 2308 - protein, 194 aa, Streptococcus agalactiae
MKSRKKDKLVLRLTTTLLVFGLGGVWFYNYKNDNVEPTVTSASDQTTTFIQTISPTAIEISKTYDLYASVLLAQAILESSSGQSDLSKAPNYNLFGIKGEYKGKSVQMPTLEDDGKGNMTQIQAPFRAYPNYSASLYDYAELVSSQKYASVWKSNTSSYKDATAALTGLYATDTAYASKLNQIIETYSLDAYDK

SEQ ID NO: 2309 - DNA, 705 bp, Streptococcus pyogenes
atgacaaaaaagaaaggtaagcttgtacttatcagtctttttgttctagcagcttgtttaggagcttatagtgcaatgagacaatctcataaaacttcaaacgtgtcagctgagactatcgccagttcttcaacccgacattttattgatgaaattggtccaactgctagtactattggtcaagaacgtgatctttatgcgtctgttatgatagcacaagcgattttagaatcaagtaatggtaaatcaagtctaagtcaagcaccttattataattttttcggtattaagggtgcctataacggttcttctgtgacgatgtcaacttgggaagatgatggtaatggcaatacctatacgattgatcaagcctttagagcttatccaagtattgcagactcccttaatgactacgcggacttgctaagttctagcacttatataggtgctagaaaatcaaacacgctatcgtatcaagatgctacagcagctctaactggcttatacgctacagacaccagttataacttaaaactaaataatattattgcaacctatggtttgacggcttatgatgttgctaatagctcagctcaagaaactggtctagcaacttcgggttatgtttggaatgaatatcgtcgtaattacactgatgcggagaccctagcagttgatgaggcttgggctaaacgcatgacttat

SEQ ID NO: 2310 - protein, 235 aa, Streptococcus pyogenes
MTKKKGKLVLISLFVLAACLGAYSAMRQSHKTSNVSAETIASSSTRHFIDEIGPTASTIGQERDLYASVMIAQAILESSNGKSSLSQAPYYNFFGIKGAYNGSSVTMSTWEDDGNGNTYTIDQAFRAYPSIADSLNDYADLLSSSTYIGARKSNTLSYQDATAALTGLYATDTSYNLKLNNIIATYGLTAYDVANSSAQETGLATSGYVWNEYRRNYTDAETLAVDEAWAKRMTY

SEQ ID NO: 2311 - DNA, 4404 bp, Streptococcus agalactiae
atgtcagaattgttcaagaaacttatggatcagattgaaatgccgcttgaaattaagaattcaagtgttttttcgtctgctgatattatcgaggtaaaggttcattctctatcacgcttatgggaatttcatttttcatttccagaattattgccaattgaggtgtatcgtgaattacaaactcgtttagtgaatagttttgaaaaagcagatataaaggctacttttgatataagagcagaaactattgatttttctgatgatctgctacaggattattatcaacaagctttttgtgaacccttgtgtaatagtgcaagttttaagagttctttttcacaattaaaagttcattacaatggcagtcagatgattatttcagcacctcaatttgtcaataataatcattttcgtcagaatcatttgccgcgtttggaacaacagttttcattgtttggatttggtaaacttgctattgatatggtttctgatgaacaaatgacgcaagacttaaaatcatcatttgaaactaatcgcgagcaattgcttgaaaaagctaaccaagaagctatgcaagccttggaagcacaaaaatcactagaagattcagcgcctccatcagaagaagtgaccccaactcaaaattatgatttcaaagagcgtatcaaacaacgtcaagctggctttgaaaaagcagagattacacccatgattgaggtgacaacagaagaaaatcgtatcgtttttgaaggaatggtttttagtgttgaacgaaaaacaacccgcactggacgtcatatcattaattttaagatgactgattatacctcaagttttgctatgcaaaagtgggctaaagatgatgaagaattgaagaagtacgatatgatttctaaaggttcgtggttgcgagtcagagggaatattgagaacaataactttactaaatctttgacaatgaatgttcaagatatcaaagagattgtgcatcatgaacgtaaagacttaatgccagcagatcaaaaacgtgtggaatttcatgctcataccaatatgtcaacgatggatgctttaccaactgtcgagagcctcattgatactgcagctaagtggggacacccagctattgcaattactgaccatgccaatgttcaaagttttccgcatggctaccacagagcaaaaaaagcaggtataaaagcaatttttggattagaggcaaatattgttgaagataaagtgcctatttcctacaacgaagttgatatgaatttgcacgaagcaacttatgttgtatttgatgtggaaactacaggtctttctgcagctaataatgacctaattcagattgcagcatcaaaaatgttcaagggtaatattattgagcaatttgatgagtttattgacccaggtcatcctctttctgcctttacaactgaattgacaggtattacggataatcatgtcagaggttcaaaacctattttacaagtccttcaggaatttcagaatttttgtcaaggtacggttttagttgcgcataatgcaacctttgacgttggttttatgaatgcgaattatgaacgtcataatctgcctttgatcacacagccggtcattgataccttagaatttgcaagaaatctttatcctgaatataagcgtcatggtttggggcctctaaccaaacgtttccaagttgctttggaacatcatcatatggccaactacgatgctgaagcaacgggtcgcttactctttattttcttaaaagaggcgcgggaaaatcgtgatgtgactaatttgatggagctcaatactaaattggtagctgaagactcttacaaaaaggcacgcataaagcatgcaaccatttatgtccaaaatcaggttggacttaaaaatatatttaagttagttagcctttcaaatgttaaatattttgaaggggtggcaagaattcctaggtcagttttagatgctcacagagaaggtctcttgctaggtactgcctgttctgatggagaagtttttgatgccttgttatcaaatggaattgatgcagcagtgaccctagctaaatattatgattttattgaagtcatgccacctgctatttatcgccccttggtagtacgtgatttaattaaagatgaggtggggattcaacaaattattagagacctaatagaggtcggtcggcgtttagataagcctgttttagctacgggaaatgttcattatattgagcctgaagatgagatttaccgtgagattattgttcgtagtcttggacaaggtgccatgattaataggactataggtcgtggggaggatgctcagccagcgcctttgccaaaagcacatttccgcacaacaaatgagatgttagatgaatttgcctttcttggtaaagatttagcctatgagatcgttgtaaccaatacgaatacttttgcagatcgatttgaagacgttgaagttgtaaaaggggatctctatactccgtttgttgatcgtgctgaagaacgagttgctgaattaacttatgctaaagcattcgaaatatatggtaatcctcttcctgatattattgatttacgtatcgaaaaagagttagcatctatacttggtaatggatttgccgttatctatcttgcttcgcaaatgttggtgcaacgttctaatgaacgtggttatctagtaggatcacgtgggtctgttgggtcgagttttgtagcgaccatgataggaattactgaagttaatccaatgccacctcattatgtttgcccaaattgtcagcattctgaatttatcacagatggttcttgtggttcaggctatgatttaccaaataaaaattgtcctaaatgtggtactttgtacaagaaagatggacaggatattccgtttgaaactttcttaggatttgatggagataaggttcctgatattgatctgaatttctctggagatgatcaaccttctgctcacttagacgttcgtgatatctttggagaagaatatgcttttcgtgcaggaacggtaggtaccgtagctgaaaaaactgcctttggttttgtcaaaggttacgaacgagattacaataaattttataacgatgcagaggtcgaacggttagcgactggtgctgcgggagttaaacgttctacaggtcaacaccccggtggtattgttgttattcctaactatatggatgtttatgattttactccggttcaatatccagcagatgatatgacagctgcttggcagacaactcacttcaatttccatgatattgatgagaatgtcttgaagttagatattctaggacatgatgatcctactatgattcgtaaacttcaggatttatcaggaattgatccatcaaatatccttccagatgatccagacgttatgaagttattttctggtacggaagttttaggagtgacagaagagcaaattggaactcctacaggaatgcttggtattccagagtttggtacgaactttgttcgtggtatggtgaacgaaacccatccaaccacatttgcagaattgttgcaactgtcagggctatcacatggtacggatgtttggttaggtaatgctcaagacttaatcaaggaaggtattgctaccttatcaactgttattggttgtcgtgatgacatcatggtttatttaatgcacgctggcctacaaccaaagatggcctttacaatcatggagcgcgtgcgtaaggggttatggttgaaaatttcagaagatgagcgtaatggttatatccaagcaatgcgtgataataatgtcccggattggtatattgaatcgtgtggaaaaatcaagtatatgttccctaaagcccatgcagcagcctatgttttaatggcattacgtgtggcgtactttaaagtacattatccaatattttattattgtgcttatttttctattcgcgccaaagcttttgaattacgcacaatgagtgctggacttgatgccgttaaggcgcgcatgaaggatatcactgagaagcgtcagcgtaatgaggcgacgaatgtcgaaaatgatctttttacgacattagagttggttaatgaaatgcttgagcgtggctttaaatttgggaaattagatctttatcgtagccatgcgactgactttattattgaagaggatacgctaatccctccatttgttgctatggaaggcttgggagaaaacgttgcaaaacagatagttcgggcacgtgaagatggtgaatttttatcaaaaacagagcttcgtaaacgaggaggagtctcaagtaccttagttgaaaaatttgatgagatgggtattttgggaaatttaccagaagacaatcagttgagtctttttgatgatttcttc

SEQ ID NO: 2312 - protein, 1468 aa, Streptococcus agalactiae
MSELFKKLMDQIEMPLEIKNSSVFSSADIIEVKVHSLSRLWEFHFSFPELLPIEVYRELQTRLVNSFEKADIKATFDIRAETIDFSDDLLQDYYQQAFCEPLCNSASFKSSFSQLKVHYNGSQMIISAPQFVNNNHFRQNHLPRLEQQFSLFGFGKLAIDMVSDEQMTQDLKSSFETNREQLLEKANQEAMQALEAQKSLEDSAPPSEEVTPTQNYDFKERIKQRQAGFEKAEITPMIEVTTEENRIVFEGMVFSVERKTTRTGRHIINFKMTDYTSSFAMQKWAKDDEELKKYDMISKGSWLRVRGNIENNNFTKSLTMNVQDIKEIVHHERKDLMPADQKRVEFHAHTNMSTMDALPTVESLIDTAAKWGHPAIAITDHANVQSFPHGYHRAKKAGIKAIFGLEANIVEDKVPISYNEVDMNLHEATYVVFDVETTGLSAANNDLIQIAASKMFKGNIIEQFDEFIDPGHPLSAFTTELTGITDNHVRGSKPILQVLQEFQNFCQGTVLVAHNATFDVGFMNANYERHNLPLITQPVIDTLEFARNLYPEYKRHGLGPLTKRFQVALEHHHMANYDAEATGRLLFIFLKEARENRDVTNLMELNTKLVAEDSYKKARIKHATIYVQNQVGLKNIFKLVSLSNVKYFEGVARIPRSVLDAHREGLLLGTACSDGEVFDALLSNGIDAAVTLAKYYDFIEVMPPAIYRPLVVRDLIKDEVGIQQIIRDLIEVGRRLDKPVLATGNVHYIEPEDEIYREIIVRSLGQGAMINRTIGRGEDAQPAPLPKAHFRTTNEMLDEFAFLGKDLAYEIVVTNTNTFADRFEDVEVVKGDLYTPFVDRAEERVAELTYAKAFEIYGNPLPDIIDLRIEKELASILGNGFAVIYLASQMLVQRSNERGYLVGSRGSVGSSFVATMIGITEVNPMPPHYVCPNCQHSEFITDGSCGSGYDLPNKNCPKCGTLYKKDGQDIPFETFLGFDGDKVPDIDLNFSGDDQPSAHLDVRDIFGEEYAFRAGTVGTVAEKTAFGFVKGYERDYNKFYNDAEVERLATGAAGVKRSTGQHPGGIVVIPNYMDVYDFTPVQYPADDMTAAWQTTHFNFHDIDENVLKLDILGHDDPTMIRKLQDLSGIDPSNILPDDPDVMKLFSGTEVLGVTEEQIGTPTGMLGIPEFGTNFVRGMVNETHPTTFAELLQLSGLSHGTDVWLGNAQDLIKEGIATLSTVIGCRDDIMVYLMHAGLQPKMAFTIMERVRKGLWLKISEDERNGYIQAMRDNNVPDWYIESCGKIKYMFPKAHAAAYVLMALRVAYFKVHYPIFYYCAYFSIRAKAFELRTMSAGLDAVKARMKDITEKRQRNEATNVENDLFTTLELVNEMLERGFKFGKLDLYRSHATDFIIEEDTLIPPFVAMEGLGENVAKQIVRAREDGEFLSKTELRKRGGVSSTLVEKFDEMGILGNLPEDNQLSLFDDFF

SEQ ID NO: 2313 - DNA, 4395 bp, Streptococcus pyogenes
atgtcagatttattcgctaaattgatggaccagatagaaatgccacttgacatgagacgttcaagtgccttttcatctgctgatattatcgaggtaaaggtacattcggtgtcacgcttgtgggaatttcattttgcctttgcagcggttttaccgattgcaacttatcgtgaattgcatgatcgtttgataagaacttttgaggcggctgacattaaggtaacctttgacatccaagctgctcaggtggattattcagatgatctgcttcaagcttattaccaagaagcttttgagcatgcaccgtgtaatagtgctagttttaaatcttctttctcaaagctcaaagtgacttatgaggatgacaaactcattattgcagcgccaggttttgtgaataacgatcattttagaaacaatcatctgcctaatctggtcaagcaattagaagcctttggctttggcatcttgaccatagatatggtgtcagatcaggaaatgactgagcatttgaccaagaattttgtttccagtcgtcaggctcttgtgaaaaaggctgtgcaggataatttggaagcccaaaaatctcttgaagccatgatgccaccagttgaggaagccacacctgctcctaagtttgactacaaggaacgagcagctaagcgtcaggcagggtttgaaaaagcaaccatcacaccaatgattgagattgagaccgaagaaaaccggattgtctttgagggtatggtttttgacgtggagcgtaaaacgactaggacaggtcgccatatcatcaactttaaaatgacagactatacctcctcgtttgctctccaaaaatgggctaaagacgatgaggagctccgtaaatttgatatgattgctaagggagcttggttacgggtacaagggaatattgagaccaatccttttacgaagagtctcaccatgaatgtccagcaggtcaaagaaattgtccgtcatgagcgcaaagacctgatgccagaagggcaaaagcgggtcgaacttcatgcccacaccaatatgtctaccatggatgccttaccgacagtagaaagcttgattgatacggcagccaagtggggacacaaggcgattgctatcaccgaccatgctaatgtgcaaagttttcctcatggctaccatagggctcgcaaagctgggattaaggctatttttggcctagaagccaatattgttgaggacaaggtgcctatttcttatgaacctgttgatatggatttgcacgaagctacctatgtggtctttgacgtggaaaccacaggtctatctgctatgaataatgacctgattcagattgcggcttccaaaatgtttaaaggaaatattgtagagcagtttgatgaattcattgatcctgggcatcctctttcagcctttaccaccgaattgacaggaattaccgataagcatttgcagggcgccaagccattggttactgtcctaaaagcttttcaggacttttgcaaagatagtatcttggttgcccacaacgccagttttgacgtgggctttatgaacgccaattatgaacgccacgacttgcccaaaatcacacagcctgtgattgataccttagaatttgctagaaacttgtatcctgagtacaagcgtcacggtttgggaccgctcaccaagcgtttccaagtgagtctagaccaccatcatatggccaattacgacgcggaagccacaggacgtcttttgtttatttttctaaaagatgccagagaaaagcatggcatcaaaaatcttttgcaactcaatacagatttggtggctgaggattcttacaaaaaagcgcggattaagcatgcgactatctatgtgcaaaatcaggttggtcttaaaaatatgtttaagttggtcagcctttccaatatcaaatattttgaaggggtgccgcgtattccaagaaccgtcttagatgctcacagagagggtttgttacttggtacagcttgttctgacggcgaggtttttgatgccgttctgactaaaggaattgatgcagcggttgatttggctaggtattatgattttatcgaaatcatgccaccagccatttaccagccattggttgtccgtgaattaatcaaagatcaagcaggtattgagcaggtgattcgtgacctcattgaagtagggaaacgagctaagaaacctgtgcttgccactgggaatgtgcattatctagagcctgaagaagagatttaccgtgaaattattgtgcgtagtcttggtcagggtgccatgattaatagaacaatcggccgtggggaaggggcacagcctgctcctctacctaaagcgcactttagaacaaccaatgaaatgctggatgagtttgcctttcttggaaaagacctcgcttatcaagtagttgtgcaaaatactcaggattttgcggaccgtattgaggaagtggaagtggttaagggcgatctttacaccccgtatattgataaggccgaagagacggttgccgaattaacctatcaaaaagcctttgaaatttatggtaatcctctcccagatattattgatttacgcattgaaaaagagttaacctctatcttggggaacggttttgctgtgatttatctcgcttcccaaatgcttgttaaccggtcaaatgagcgaggctacctagttggttctaggggatctgtagggtctagctttgtcgccaccatgattgggattactgaggttaatcctatgccgcctcactacgtttgcccgtcctgccaacattctgaatttatcacagatgggtcagttggatctggctatgatttgcctaataaaccctgtccgaaatgtggcaccccttatcaaaaagatgggcaagacattccctttgagacctttcttgggtttgatggggataaggtgcccgatattgatttgaacttctctggtgatgaccagcccagtgcccatttggatgtccgagatatttttggtgacgaatacgcctttcgtgctggaacagttggtaccgtagcagaaaaaacagcttatggatttgtcaaaggctatgaacgcgactatggcaagttctatcgtgatgctgaggtggatcgtctagcagcaggtgctgctggtgtgaaacgaacgactgggcagcaccctggggggattgttgttattcctaattacatggatgtttatgattttacccccgtgcaatatccagccgatgatgtaacggcttcttggcagacaactcactttaacttccatgatattgatgaaaacgtcttgaaacttgatatcctagggcatgatgatccgaccatgattcgtaaacttcaggatttatcgggcattgatcctattactattcctgctgatgatccgggagttatggctctcttttctgggacagaggttttgggcgttaccccggaacaaattgggacaccgactggtatgctaggcattccagaatttggaaccaactttgttcgcggcatggttaatgagacgcatccgaccacttttgcggagcttttgcagttgtctggactatctcatggaaccgatgtttggcttggtaatgcacaagatttgattaaagaaggcattgcaaccctaaaaaccgttatcggttgtcgtgacgacatcatggtttacctcatgcacgcaggcttagaaccaaaaatggcctttaccattatggagcgtgtgcgtaagggattatggctaaaaatttctgaggaagaacgtaatggctatattgatgccatgcgagaaaacaatgtgcccgactggtacattgaatcgtgtggaaaaatcaagtacatgttccctaaagcccatgcggcagcttatgttttgatggcccttcgggtggcttatttcaaggtgcaccaccccattatgtattattgtgcttatttctctattcgtgcgaaggcttttgaattaaaaaccatgagtggtggtttagatgctgttaaagcaagaatggaagatattactataaaacgtaaaaataatgaagccaccaatgtggaaaatgacctctttacaaccttggagattgtcaacgaaatgttagaacgcggctttaagtttggcaaattagacctttacaaaagtgatgctatagaattccaaatcaaaggagatacccttatccctccatttatagcgctagaaggtctgggtgaaaacgtggccaagcaaatcgttaaagctcgtcaagaaggcgaattcctctctaaaatggaattgcgtaaacgaggcggggcatcgtcaacgctcgttgagaaaatggatgagatgggtattttaggaaatatgccagaagataatcaattaagtctttttgatgactttttc

SEQ ID NO: 2314 - protein, 1465 aa, Streptococcus pyogenes
MSDLFAKLMDQIEMPLDMRRSSAFSSADIIEVKVHSVSRLWEFHFAFAAVLPIATYRELHDRLIRTFEAADIKVTFDIQAAQVDYSDDLLQAYYQEAFEHAPCNSASFKSSFSKLKVTYEDDKLIIAAPGFVNNDHFRNNHLPNLVKQLEAFGFGILTIDMVSDQEMTEHLTKNFVSSRQALVKKAVQDNLEAQKSLEAMMPPVEEATPAPKFDYKERAAKRQAGFEKATITPMIEIETEENRIVFEGMVFDVERKTTRTGRHIINFKMTDYTSSFALQKWAKDDEELRKFDMIAKGAWLRVQGNIETNPFTKSLTMNVQQVKEIVRHERKDLMPEGQKRVELHAHTNMSTMDALPTVESLIDTAAKWGHKAIAITDHANVQSFPHGYHRARKAGIKAIFGLEANIVEDKVPISYEPVDMDLHEATYVVFDVETTGLSAMNNDLIQIAASKMFKGNIVEQFDEFIDPGHPLSAFTTELTGITDKHLQGAKPLVTVLKAFQDFCKDSILVAHNASFDVGFMNANYERHDLPKITQPVIDTLEFARNLYPEYKRHGLGPLTKRFQVSLDHHHMANYDAEATGRLLFIFLKDAREKHGIKNLLQLNTDLVAEDSYKKARIKHATIYVQNQVGLKNMFKLVSLSNIKYFEGVPRIPRTVLDAHREGLLLGTACSDGEVFDAVLTKGIDAAVDLARYYDFIEIMPPAIYQPLVVRELIKDQAGIEQVIRDLIEVGKRAKKPVLATGNVHYLEPEEEIYREIIVRSLGQGAMINRTIGRGEGAQPAPLPKAHFRTTNEMLDEFAFLGKDLAYQVVVQNTQDFADRIEEVEVVKGDLYTPYIDKAEETVAELTYQKAFEIYGNPLPDIIDLRIEKELTSILGNGFAVIYLASQMLVNRSNERGYLVGSRGSVGSSFVATMIGITEVNPMPPHYVCPSCQHSEFITDGSVGSGYDLPNKPCPKCGTPYQKDGQDIPFETFLGFDGDKVPDIDLNFSGDDQPSAHLDVRDIFGDEYAFRAGTVGTVAEKTAYGFVKGYERDYGKFYRDAEVDRLAAGAAGVKRTTGQHPGGIVVIPNYMDVYDFTPVQYPADDVTASWQTTHFNFHDIDENVLKLDILGHDDPTMIRKLQDLSGIDPITIPADDPGVMALFSGTEVLGVTPEQIGTPTGMLGIPEFGTNFVRGMVNETHPTTFAELLQLSGLSHGTDVWLGNAQDLIKEGIATLKTVIGCRDDIMVYLMHAGLEPKMAFTIMERVRKGLWLKISEEERNGYIDAMRENNVPDWYIESCGKIKYMFPKAHAAAYVLMALRVAYFKVHHPIMYYCAYFSIRAKAFELKTMSGGLDAVKARMEDITIKRKNNEATNVENDLFTTLEIVNEMLERGFKFGKLDLYKSDAIEFQIKGDTLIPPFIALEGLGENVAKQIVKARQEGEFLSKMELRKRGGASSTLVEKMDEMGILGNMPEDNQLSLFDDFF

SEQ ID NO: 2315 - DNA, 435 bp, Streptococcus agalactiae
ttgggagatgaaatgggaaactttaaaaattcagcggttaaatctatggttgtcatgcgaaaagcatttagaacaatagacggaaaagtctcagaatcatttaaagaatttgaattaacaccaactcagtttgcagttttggatgttctctatgctaaaggcacaatgaaaattggagaattgattgaaaatatgcttgctacatcaggtaatatgactgttgttattaaaaatatggaaaaaaagggatgggtattacgccattcttgtccgaatgataagagagcctttttggtgagtttaacaactgaaggagaagaagtgataaaaaaagctctaccagagcatattaaacgtgtagaagatgctttttcagtcttaacagaaacagagcaagaagacttgattaaccttttaaaaaaatttaaaaccttg

SEQ ID NO: 2316 - protein, 145 aa, Streptococcus agalactiae
MGDEMGNFKNSAVKSMVVMRKAFRTIDGKVSESFKEFELTPTQFAVLDVLYAKGTMKIGELIENMLATSGNMTVVIKNMEKKGWVLRHSCPNDKRAFLVSLTTEGEEVIKKALPEHIKRVEDAFSVLTETEQEDLINLLKKFKTL

SEQ ID NO: 2317 - DNA, 456 bp, Streptococcus pyogenes
gtgacataccgtataaagcgaggaaatcaaatgagtcatttagataagaacaccgctttgaaagccatggtggtgtttcgtaaagctcagcgaacgctagatgcttttggggctgatatttttaaaaaggcagatttaacagccacgcagttcagtgtgcttgaagtactatatactaaaggctgtatgcgaatcaatcacttgattgattctttgttagcgacttcggggaatatgactgttgtactaaataatatggaacgcaatggctggattagcaagtgcaaagacaaaacggataaaagagcctatgtggttaccttaacagataagggtactcgcttgattgaagctgttttgcctaaacacgtcgcacgggtggaagaagcctttgctgttttgactgaaaaagaacaactttgtctgattgaacttctcaaaaagttcaaacaatta

SEQ ID NO: 2318 - protein, 152 aa, Streptococcus pyogenes
VTYRIKRGNQMSHLDKNTALKAMVVFRKAQRTLDAFGADIFKKADLTATQFSVLEVLYTKGCMRINHLIDSLLATSGNMTVVLNNMERNGWISKCKDKTDKRAYVVTLTDKGTRLIEAVLPKHVARVEEAFAVLTEKEQLCLIELLKKFKQL

SEQ ID NO: 2319 - DNA, 612 bp, Streptococcus agalactiae
atgtcatttttggaagaattaaaaaaccgtcgctctatttacgctcttggtcgcaatacagaagtttctgatgagaaaatagtagagattattaaagaggcagttcgccaatccccatctgcttttaatagtcaaacttcccgtgttgtcattttattgaatgatgaagttactaagttctgggatgaattggttgctaatgatttggtagaaacaatgaaagtacaaggtgctccagagacagctattgctggaactaaggaaaaattagctagttttggagcttcaaagggaacagtactcttctttgaagatcaagatgttgtcaaatctcttcaagaacaattcgttctttatgcggataactttccagtttggtctgagcaatcaacaggtattgcctcagtaaatacttggacagccctttctgcagaacttggacttggtggtaatttacaacattacaatccagttattgatgcatcagtacaagctgtttatggtgttccagctagttggaaacttcgtggacaactaaattttggttcaatcgaagctgaaacaggagaaaaagaattcatgaatgatgatgaccgctttaaagtcatcgga

SEQ ID NO: 2320 - protein, 204 aa, Streptococcus agalactiae
MSFLEELKNRRSIYALGRNTEVSDEKIVEIIKEAVRQSPSAFNSQTSRVVILLNDEVTKFWDELVANDLVETMKVQGAPETAIAGTKEKLASFGASKGTVLFFEDQDVVKSLQEQFVLYADNFPVWSEQSTGIASVNTWTALSAELGLGGNLQHYNPVIDASVQAVYGVPASWKLRGQLNFGSIEAETGEKEFMNDDDRFKVIG

SEQ ID NO: 2321 - DNA, 1497 bp, Streptococcus agalactiae
ttgatgaataaaaaacataaattacttaaaaatatagaggaatttaagacgataacccaaaaaaggctaactgagagaggaaagttcccatatgataccgttcattctacgtttgaaattaaggatgaaaactttatcatggaaagattgaaatcatcagggttatctatgggtaaaccagttgattatatgggcgtaaatggtatccctatttacactaaaacattatctatagttaataagtttgcctttgaaaataattcaaaagattcttcatattcttcaaacattaatattagtgaagataaaataaaagaaaatgaccaaaaaattctagatttaatagttaaatctggagctaataatcaaaacttaacagatgaagaaaaagtaattgctttcactaaatatataggtgaaataactaattatgacaatgaagcttacagagctagaaatgtcgacacagaatattacagagcttcagatttattttctgtaacagaaagaaaacttgctatgtgcgttggctatagtgtaacagccgctagggcatttaatattatggggatacctagttatgtcgtttctggtaaaagtcctcaaggaatatctcatgcagctgtgagagcgtattataatagaagttggcatatcatagatatcacagccagtacatattggaaaaatggtaattacaaaacaacgtattccgattttattaaagaatactgtatagatggttatgacgtttatgatcccgcaaaaacaaataatagatttaaagttaagtatatggaatcaaatgaagcgtttgaaaattggatacataataatggaagcaaatctatgttatttattaatgaatctgcagctctaaaagataaaaaaccaaaagatgattttgtaccagtaacagaaaaagaaaaaaacgagctgatagataagtataaaaaattattgtcacagattcctgaaaacacacaaaatccaggagaaaaaaacataagagattatttgaaaaatgaatatgaagaaatattaaagaaagataatttatttgagcatgaacatgcagaatttaaagaaagtctaaatttaaatgaatcattctacctacaattaaagaaagaagaaatgaaaccgagtgataatctcaaaaaagaagaaaaaccaagagaaaattcagtaaaagagagggagactccagctgaaaacaatgattttgtttcagtaacagaaaaaaacaacttgattgataaatataaagaattattatcaaaaatcccagagaatacacaaaatcctggggaaaagaatatacgaaattatctagagaaagaatatgaagaactactacaaaaagataaattattcaagcatgagtacacagagtttacaaaaagtctaaatttgaatgaaacattctattcacaattaaaagaaggagaaatgaaactaagtgaaaatcccgaaaaaggagaaacgaacacgaat

SEQ ID NO: 2322 - protein, 499 aa, Streptococcus agalactiae
MMNKKHKLLKNIEEFKTITQKRLTERGKFPYDTVHSTFEIKDENFIMERLKSSGLSMGKPVDYMGVNGIPIYTKTLSIVNKFAFENNSKDSSYSSNINISEDKIKENDQKILDLIVKSGANNQNLTDEEKVIAFTKYIGEITNYDNEAYRARNVDTEYYRASDLFSVTERKLAMCVGYSVTAARAFNIMGIPSYVVSGKSPQGISHAAVRAYYNRSWHIIDITASTYWKNGNYKTTYSDFIKEYCIDGYDVYDPAKTNNRFKVKYMESNEAFENWIHNNGSKSMLFINESAALKDKKPKDDFVPVTEKEKNELIDKYKKLLSQIPENTQNPGEKNIRDYLKNEYEEILKKDNLFEHEHAEFKESLNLNESFYLQLKKEEMKPSDNLKKEEKPRENSVKERETPAENNDFVSVTEKNNLIDKYKELLSKIPENTQNPGEKNIRNYLEKEYEELLQKDKLFKHEYTEFTKSLNLNETFYSQLKEGEMKLSENPEKGETNTN

SEQ ID NO: 2323 - DNA, 96 bp, Streptococcus agalactiae
gtgtctaaaaaacgactattaatgatatcactcaactatcaaaacttcaaaataacggtacactcaaaagctgagacgcagaaaaaatacttctgt

SEQ ID NO: 2324 - protein, 32 aa, Streptococcus agalactiae
MSKKRLLMISLNYQNFKITVHSKAETQKKYFC

SEQ ID NO: 2325 - DNA, 636 bp, Streptococcus agalactiae
atgataaaatcaaagattttgttgcaattaatgcaaggaaaaatagttgctgtcattcgtggaaatagccaagaagaagcttttcaagctgctcaagcatgcataaaaggtggtatttctgctatcgaaatcgcctatactaatagcaaagctagccaagtcattgaacaactagtcacacaatatactaaccaagaacaagttgtcgttggggcaggaactgttctagactcagaaactgcccgaatggctattttagcaggagcaaagtttattgtatctcccgcatttaatctacagactgctaaactatgtaatcgttatgctattccttatttaccaggttgcatgaccttatcagaggtaacaacagcacttgaagccggttgcgaaataattaaaatattcccaggaggtactctaggaacatctttcatctcatcactaaaggcacctttacctcaagtacaaattatggtgactggtggggtaaatctcacaaatgccaaagactggtttctatctggagtaacagccattggtattggtggagagttcaataaactagcagctttgggggaatttgataaaatcacagaaatggctaaacaatacaaaatacagctaaatctgaat

SEQ ID NO: 2326 - protein, 212 aa, Streptococcus agalactiae
MIKSKILLQLMQGKIVAVIRGNSQEEAFQAAQACIKGGISAIEIAYTNSKASQVIEQLVTQYTNQEQVVVGAGTVLDSETARMAILAGAKFIVSPAFNLQTAKLCNRYAIPYLPGCMTLSEVTTALEAGCEIIKIFPGGTLGTSFISSLKAPLPQVQIMVTGGVNLTNAKDWFLSGVTAIGIGGEFNKLAALGEFDKITEMAKQYKIQLNLN

SEQ ID NO: 2327 - DNA, 1005 bp, Streptococcus agalactiae
atgtctaagattctttttttcggtgaacctctcattcgcatcactccaaaagaaaatgactattttgcagatagtatctcaactaaactattctatggtggctctgaagttaataccgcaagagctctacaaggctttgggcaagatactaaactcctctcagccttacccaataatcccataggtaatagttttcttcaatttttaaaagcacagggtattgatactcattctattcagtgggttggagaacgtgttgggttatattttttagaagattcctttgcttgcagaaaaggtgaggtggtctacgaccgcgatcatagtagtttacatgactttaggataaatcaaattgatttcgatcaattatttgaaggagtttctctctttcattttagtggtattacactatcattggatgagtctatccaagagataacactgcttcttttaaaagaagctaaaaaaagagagataacaatctccttagatctcaattttcgcagtaaactaatttctcctaaaaatgccaaaatccttttttctcagttcgctacctttgcggatatttgttttggtattgaacctcttatggttgactcacaggacactaccttcttcaatcgcgatgaagctacaatagaggacgtcaaagaacgaatgatttcgcttataaatcactttgactttcaagtcattttccatactaaacgtctacaggatgaatggggacgaaaccactaccaagcttacatagcaaatcgtaaacaagagtttgtcacttcaaaagaaatcaccacagctgtaaaccagagaattggaagcggagatgcttttgtggcgggagcgctatatcaactacttcagcactcagacagcaagacagtcattgatttcgctgtcgctagtgcatctttaaaatgtgctttggaaggggacaatatgtttgagaccgttaccgcagttaacaaagtactaaatcaatcgaaagacattattcgt

SEQ ID NO: 2328 - protein, 335 aa, Streptococcus agalactiae
MSKILFFGEPLIRITPKENDYFADSISTKLFYGGSEVNTARALQGFGQDTKLLSALPNNPIGNSFLQFLKAQGIDTHSIQWVGERVGLYFLEDSFACRKGEVVYDRDHSSLHDFRINQIDFDQLFEGVSLFHFSGITLSLDESIQEITLLLLKEAKKREITISLDLNFRSKLISPKNAKILFSQFATFADICFGIEPLMVDSQDTTFFNRDEATIEDVKERMISLINHFDFQVIFHTKRLQDEWGRNHYQAYIANRKQEFVTSKEITTAVNQRIGSGDAFVAGALYQLLQHSDSKTVIDFAVASASLKCALEGDNMFETVTAVNKVLNQSKDIIR

SEQ ID NO: 2329 - DNA, 636 bp, Streptococcus agalactiae
atgaaaattgcattaatcaacgaaaatagccaagcaagtaaaaatactattatctacaaagaattgaaagcggtttctgatgaaaaaggatttgaagttttcaactacggaatgtatggcaaagaagaagaaagccagctaacttatgtacaaaatggtttactgactgctattttacttaatagcggtgctgcagattttgttattacaggctgtgggacaggaattggagcgatgcttgcttgtaatagttttcctggcgtagtctgtggattcgctgctgatcctgtcgacgcttacttattctctcaagtaaacggaggaaatgctctttcccttccttttgctaaaggatttggttggggagctgaattgaatctgaggtatttatttgaacgtcttttcgaagatgaaaaaggagggggataccctaaagagagggctgtacctgagcaacgcaatgcacgtatccttagcgaaataaaacagattacttacagagatttactctctgttttaaaagaaattgatcaagatttcttaaaggaaactatttctggggagcatttccaagaatatttcttcgctaattgccaaaatcaaaatatagcagactacttgaaatctgtcttagac

SEQ ID NO: 2330 - protein, 212 aa, Streptococcus agalactiae
MKIALINENSQASKNTIIYKELKAVSDEKGFEVFNYGMYGKEEESQLTYVQNGLLTAILLNSGAADFVITGCGTGIGAMLACNSFPGVVCGFAADPVDAYLFSQVNGGNALSLPFAKGFGWGAELNLRYLFERLFEDEKGGGYPKERAVPEQRNARILSEIKQITYRDLLSVLKEIDQDFLKETISGEHFQEYFFANCQNQNIADYLKSVLD

SEQ ID NO: 2331 - DNA, 639 bp, Streptococcus pyogenes
atgaaaattgcattaattaatgaaaatagccaagcggctaaaaatggtatcatttacgatgcccttaccacagtgacagataaacacggctaccaagtctttaactatggtatgtatggcacagaaggtgaaagccagttgacctatgttcaaaatggactcttagcttctattttattgaccactaaggcggctgattttgtggtgactggttgtgggacaggtgttggagctatgttggccttgaacagcttcccaggtgttacctgtggttttgcgagtgagccaacagaagcttatctcttttctcaaatcaatggtggtaatgccttgtccattccttttgccaaaggttttggttggggagcagagttgaatttgaccttaatatttgaacgcctctttgcagaaccaatgggtggtggttaccctaaagagcgagctattcctgaacagcggaatgcacgtattttaagtgatctgaaaaaaattacttacagagatttgttggcaattgtcaaagacatcgaccaagatttcctcaaagaaacgatttctggcgctcatttccaagagtacttctttgccaatgcggagccgtcagaattagtcacttatttgaaatcagtacttgaacag

SEQ ID NO: 2332 - protein, 213 aa, Streptococcus pyogenes
MKIALINENSQAAKNGIIYDALTTVTDKHGYQVFNYGMYGTEGESQLTYVQNGLLASILLTTKAADFVVTGCGTGVGAMLALNSFPGVTCGFASEPTEAYLFSQINGGNALSIPFAKGFGWGAELNLTLIFERLFAEPMGGGYPKERAIPEQRNARILSDLKKITYRDLLAIVKDIDQDFLKETISGAHFQEYFFANAEPSELVTYLKSVLEQ

SEQ ID NO: 2333 - DNA, 93 bp, Streptococcus agalactiae
atgcctttgtcaacgagttcttgcttaatatcattgaagacaatagttgctccagctctagcaaaagcagttgctattgaaaaaccaatgccg

SEQ ID NO: 2334 - protein, 31 aa, Streptococcus agalactiae
MPLSTSSCLISLKTIVAPALAKAVAIEKPMP

SEQ ID NO: 2335 - DNA, 810 bp, Streptococcus agalactiae
atgactgaacaattcttaaaagacaacttttcactagaaggtaaagtcgccttaataacaggcgcttcttacggcattggtttttcaatagcaactgcttttgctagagctggagcaactattgtcttcaatgatattaagcaagaactcgttgacaaaggcatctccgcctataaaaaacttggcattaaggcccatggctatgtttgtgatgttacagatgaagatggaatcaacgaaatggtggacaaaatttctcaagatgttggggtaattgatattctagttaacaacgcaggtattataaaacgcacccctatgctagagatgagcgctgcagattttcgacaagttattgatattgatttgaatgctccctttatcgtatcaaaagcggtattacctggaatgatccaaaaaggacatggtaaaatcatcaatatttgctccatgatgagtgagcttggacgcgaaacagttgctgcctatgctgctgccaaagggggacttaaaatgttaaccaagaacatcgcttctgaatacggttctgctaacatccaatgtaacggtatcgggcccggctatattgccacaccacaaacagctccccttcgtgaacgtcaagatgatggttcacgtcatccattcgaccaatttatcatcgctaaaacacctgccgctcgctggggtgaggcagaagatttaggtgcaccagctatcttccttgctagtgatgcatcaaactttatcaatggtcacatactctatgtagatggcggtattttagcttacatcggtaaacaacctcaa

SEQ ID NO: 2336 - protein, 270 aa, Streptococcus agalactiae
MTEQFLKDNFSLEGKVALITGASYGIGFSIATAFARAGATIVFNDIKQELVDKGISAYKKLGIKAHGYVCDVTDEDGINEMVDKISQDVGVIDILVNNAGIIKRTPMLEMSAADFRQVIDIDLNAPFIVSKAVLPGMIQKGHGKIINICSMMSELGRETVAAYAAAKGGLKMLTKNIASEYGSANIQCNGIGPGYIATPQTAPLRERQDDGSRHPFDQFIIAKTPAARWGEAEDLGAPAIFLASDASNFINGHILYVDGGILAYIGKQPQ

SEQ ID NO: 2337 - DNA, 432 bp, Streptococcus agalactiae
atgataaaaattattattgtagcacacggcaactttccagatggtattttaagctctttagaacttattgctgggcatcaggaatatgttgttggtattaactttattgcaggcatgtcttctaatgatgttagagttgctttgcaaagagaggttatcgatttcaaagaaattttagtattgactgatttgctaggtgggactcctttcaatgtttcttccgccttatcagtagaatatacagataaaaagataaaagttttatcgggcttgaacctttcaatgttaatggaagctgttttatctagaacgatgtttgaacatgtagatgatcttgttgataaagttataacatcatctcatgaaggaattgttgatttttctacttgccttgctacacaaactgcagaagcaacttttgagggaggcatt

SEQ ID NO: 2338 - protein, 144 aa, Streptococcus agalactiae
MIKIIIVAHGNFPDGILSSLELIAGHQEYVVGINFIAGMSSNDVRVALQREVIDFKEILVLTDLLGGTPFNVSSALSVEYTDKKIKVLSGLNLSMLMEAVLSRTMFEHVDDLVDKVITSSHEGIVDFSTCLATQTAEATFEGGI

SEQ ID NO: 2339 - DNA, 435 bp, Streptococcus pyogenes
atgattgctattatcgttatgggacatggacattttgcgagtggtattgtttcagccttagaattgatcgcaggcaaacaagaaaaggtaactgcaattgattttactactgagatgaccgccgctgatgtgcaggaccaattatctcgtgctttaatcccagaagaggaaaccttagttctttgtgaccttctaggaggtaccccttttaaagtcgctgcaaccttaatggaatctcttccaaacacgacgtgtaatgttctttctggccttaacttagccatgctgattgaagctagttttgcaagacaaacagcagcttcttttgacgacttagtatcaggacttataacatgttctaaagaaggcattgttgactggaaaactctttctcagcaagaagacggtgcgacagacgatgagttaggaggcatt

SEQ ID NO: 2340 - protein, 145 aa, Streptococcus pyogenes
MIAIIVMGHGHFASGIVSALELIAGKQEKVTAIDFTTEMTAADVQDQLSRALIPEEETLVLCDLLGGTPFKVAATLMESLPNTTCNVLSGLNLAMLIEASFARQTAASFDDLVSGLITCSKEGIVDWKTLSQQEDGATDDELGGI

SEQ ID NO: 2341 - DNA, 1194 bp, Streptococcus agalactiae
atgatgaaaataaaaccggtcaaggttgagtcaattgaaaatccaaagcgttttttaaacagtagattattaactaagattgaagttgaggaagcgattgaaaaagccttgaagcaactttatattaatattgattactttggtgaagagtatccaacgcctgcaacattcaataatatttataaagttatggataacacagaatggacaaatggtttttggacagggtgcttgtggttagcttatgagtataatcaggataaaaagttaaaaaacatagcccacaaaaatgtattgtcatttctaaatcgtattaataatcgtatagcattagatcaccacgacttaggatttctttacacaccatcttgtacagcagaatatcgtatcaatggtgatgttaaagctttagaagccactataaaagctgcagataaattgatggagcgctatcaagaaaaaggtggatttattcaggcttggggagaactcgggtataaggaacactatcgcttaattatcgattgcttacttaatatccaactcttattttttgcttatgaacagacaggtgatgaaaagtatagacaagttgcggtgaatcacttctacgcttcagctaacaatgtggtgcgtgatgattcttctgcttttcatactttttatttcgacccagaaactggagaaccgttaaaaggtgtcacacgacagggttatagtgatgagtcatcttgggcaagagggcaagcatggggcatctacggtattccgcttagttaccggaaaatgaaagattatcagcagattatcctttttaaaggtatgacaaactattttctaaatcgtttacctgaagacaaggtatcctattgggaccttatttttacggatggctcgggccagcctagagatacatccgcaacagcaacggctgtgtgtggaattcatgagatgcttaaatatttaccagaagtagatcctgataaagagacatacaaatatgctatgcatacaatgcttcgtagtctgattgaacagtatagtaataatgaacttatagcaggacgtcctcttctattgcacggtgtgtattcgtggcattcaggtaaaggagtagatgaaggtaatatttggggagattattattacttagaagccttaataagattctataaagactgggaactttattgg

SEQ ID NO: 2342 - protein, 398 aa, Streptococcus agalactiae
MMKIKPVKVESIENPKRFLNSRLLTKIEVEEAIEKALKQLYINIDYFGEEYPTPATFNNIYKVMDNTEWTNGFWTGCLWLAYEYNQDKKLKNIAHKNVLSFLNRINNRIALDHHDLGFLYTPSCTAEYRINGDVKALEATIKAADKLMERYQEKGGFIQAWGELGYKEHYRLIIDCLLNIQLLFFAYEQTGDEKYRQVAVNHFYASANNVVRDDSSAFHTFYFDPETGEPLKGVTRQGYSDESSWARGQAWGIYGIPLSYRKMKDYQQIILFKGMTNYFLNRLPEDKVSYWDLIFTDGSGQPRDTSATATAVCGIHEMLKYLPEVDPDKETYKYAMHTMLRSLIEQYSNNELIAGRPLLLHGVYSWHSGKGVDEGNIWGDYYYLEALIRFYKDWELYW

SEQ ID NO: 2343 - DNA, 1197 bp, Streptococcus pyogenes
atggcacgacctttaaaaaccattgctcttgaacctatcaagcagcctgaacgatttaccaaagaagatttcctaagccaagaagacattactcaggcccttgacttagccctcaaacaagttcggcttaatatggactattttaaagaagactttccaacgccagctaccaaagataaccaatatgccattatggataatacagaatggaccaatgccttttggacaggttgcctttggttagcttacgaatacagtggggatgatgctattaaagctctggctcaagcaaatgacctttctttcctagatcgagtaacaagagacattgagctagatcaccatgatttgggctttctttacaccccttcttgcatggctgagtggaaacttttaaaaacacctgagtctagagaagctgctttgaaagcagccgacaaattagtccaacgctatcaagacaaaggcggctttattcaggcctggggagaactgggtaaaaaagaagattaccgtttaatcattgattgtctcctaaacatccaattactcttttttgctagccaagaaactggagacaaccgttaccgtgacatggcgatcaatcatttctacgcctcagccaatcatgtcatccgagatgacgcctctgcttaccacaccttctactttgatccagaaacaggtgatcctgttaaaggggtcacccgacaaggttatagcgatgattctgcttgggccagagggcaagcttggggcatttatggtattcctttgacctatcgtttcctaaaagaacctgaactcattcaactcttcaagggcatgacccattatttcttgaaccgtcttcctaaagaccaggtgtcctactgggatttaatttttggagatggtagcgagcagtctcgtgatagttcagcaaccgccattgctgtgtgtggtattcatgaaatgttaaaaaccttaccagatcatgatcctgataaaaaaacatatgaagctgccatgcacagcatgctaagagccttgattaaggattatgctaacaaagatctcaagcctggtgctcctctactgcttcacggagtctattcttggcactctggaaaaggggttgacgagggaaatatctggggagactattactatcttgaagctctgcttcgtttctacaaagactggaacccttactgg

SEQ ID NO: 2344 - protein, 399 aa, Streptococcus pyogenes
MARPLKTIALEPIKQPERFTKEDFLSQEDITQALDLALKQVRLNMDYFKEDFPTPATKDNQYAIMDNTEWTNAFWTGCLWLAYEYSGDDAIKALAQANDLSFLDRVTRDIELDHHDLGFLYTPSCMAEWKLLKTPESREAALKAADKLVQRYQDKGGFIQAWGELGKKEDYRLIIDCLLNIQLLFFASQETGDNRYRDMAINHFYASANHVIRDDASAYHTFYFDPETGDPVKGVTRQGYSDDSAWARGQAWGIYGIPLTYRFLKEPELIQLFKGMTHYFLNRLPKDQVSYWDLIFGDGSEQSRDSSATAIAVCGIHEMLKTLPDHDPDKKTYEAAMHSMLRALIKDYANKDLKPGAPLLLHGVYSWHSGKGVDEGNIWGDYYYLEALLRFYKDWNPYW

SEQ ID NO: 2345 - DNA, 492 bp, Streptococcus agalactiae
atggcagcaggaccaaatattgtaatgacacgtgttgatgagcgtcttattcatggacaaggacaactttgggtgaaatttttaagttgtaatactgttattgtggcaaatgatgatgtctccaaagatcatcttcaacaaacgttaatgaagacggtggtgccagaatcaatagcattgcgattttttgatattcaaaaagttattgatattattcacaaggccaacccagcacagacgatttttataattgttaaagatttgaaagatgtctatagacttgtagcagggggcgtcccaattaaagagattaatattggaaatattcataatggagaaggtaaagagcaggtaagtcgctctatcttcttagggatgaaggataaagagataattagaaaattaaaccaagaatatcacattgcatttaatactaaaacaactccaacaggtaacgatggtgctgtggaagttaatattttagattatatt

SEQ ID NO: 2346 - protein, 164 aa, Streptococcus agalactiae
MAAGPNIVMTRVDERLIHGQGQLWVKFLSCNTVIVANDDVSKDHLQQTLMKTVVPESIALRFFDIQKVIDIIHKANPAQTIFIIVKDLKDVYRLVAGGVPIKEINIGNIHNGEGKEQVSRSIFLGMKDKEIIRKLNQEYHIAFNTKTTPTGNDGAVEVNILDYI

SEQ ID NO: 2347 - DNA, 486 bp, Streptococcus pyogenes
atgacacaaccaaacattatcatgacgcgagttgatgagcgtttgattcacggacaggggcaattatgggtcaaattcctcaactgcaacaccgttatcgtcgctaacgatgcggtttctgaagataagattcaacaatccctcatgaaaacagttattccatccagtattgccattcgttttttctccattcaaaaagtgattgacatcattcataaagcaagtcctgctcaaagtatcttcatcgtggtcaaagatttgcaagatgccaaactcctagttgaagggggtgttcccatcacagaaatcaatatcggtaatattcataaaactgatgataaggttgcgattacccagtttatttcgctgggagaaacagacaagtctgctattcgttgcttagcccatgaccaccacgtggtttttaacaccaaaacaactccagctggcaatagcgcctctgacgttgacatcttagattatatt

SEQ ID NO: 2348 - protein, 162 aa, Streptococcus agalactiae
MTQPNIIMTRVDERLIHGQGQLWVKFLNCNTVIVANDAVSEDKIQQSLMKTVIPSSIAIRFFSIQKVIDIIHKASPAQSIFIVVKDLQDAKLLVEGGVPITEINIGNIHKTDDKVAITQFISLGETDKSAIRCLAHDHHVVFNTKTTPAGNSASDVDILDYI

SEQ ID NO: 2349 - DNA, 864 bp, Streptococcus agalactiae
atggatattagtattcttcaggctgtcttaattggactgtggacggctttctgttttagtggcatgttgcttggcctctatacaaatcgttgtatcgttctctctctaggcgttggtgttattttaggagatattcaaacagctttggcagttggagcaatatctgaactggcttacatgggatttggtgtgggagcgggagggacagttcctccaaacccaatcggtcctgggatttttggaactttgatggctattacaacagctggaactaaaggaaaaatcacaccggaagctgctcttgcattatcaaccccaattgcagttggtattcaatttcttcaaacagcaacttatactgcttttgcaggggcgcctgaaacagctaaaaaagctttgcaagcaggtaatttccgaggatttaaaattgcagcaaatggtacaatttgggcattcgctggattgggatttggtttaggagtactgggtgctctttcaacgcaaactttgacagatttatttgctctcattccccctgttttgcttaatggtctaaccttagctgggaaaatgcttcctgcaattggttttgcgatgattctctctgtaatggctaaaaaagaactcattccttatatcctacttggatatgttctagctgtttattttggtttgccagttctaactccaacagcaaatggagacggagttttaacatcagtggctactaacagtgtgcttggggttccaactatcggggtagctataattgcaacaatatttgctttgcttgatattttcagaaaaccagctgcacctactaaagaaactaagacagaaggagacaaccaagatgactggatc

SEQ ID NO: 2350 - protein, 288 aa, Streptococcus agalactiae
MDISILQAVLIGLWTAFCFSGMLLGLYTNRCIVLSLGVGVILGDIQTALAVGAISELAYMGFGVGAGGTVPPNPIGPGIFGTLMAITTAGTKGKITPEAALALSTPIAVGIQFLQTATYTAFAGAPETAKKALQAGNFRGFKIAANGTIWAFAGLGFGLGVLGALSTQTLTDLFALIPPVLLNGLTLAGKMLPAIGFAMILSVMAKKELIPYILLGYVLAVYFGLPVLTPTANGDGVLTSVATNSVLGVPTIGVAIIATIFALLDIFRKPAAPTKETKTEGDNQDDWI

SEQ ID NO: 2351 - DNA, 780 bp, Streptococcus pyogenes
atggatatcaatttgttacaggcacttttaattggtctttggacagccttttgtttcagcggaatgttacttggcatctacaccaaccgttgtattattctgtcttttggtgtagggattatcttaggtgacttgccaactgcacttagcatgggagctatctccgaattagcttatatgggatttggagtgggtgccggtggtaccgttcctcctaatcctatcggccctggtatctttggtaccttgatggctattaccagtgctggtaaagtcaccccagaagcggcactagccttatcaacaccaatcgcagttgccatccaattccttcaaacattcgcctatacagcttttgctggcgctcccgaaaccgctaaaaaacaattgcaaaaaggcaatattagaggcttcaaattcgctgccaacggcactatctgggctttcgcttttatcggattaggccttggtttattaggtgccttgtcaatggatactctccttcacttggttgattatatcccacctgtcttgctcaatggattgactgtcgctggtaaaatgttacctgctatcggatttgccatgatcttatctgttatggccaagaaagaattgattccttttgtactaattggttatgtttgtgcagcctacctccaaattccaaccattggtatcgccattattggtatcattttcgccttgaatgaattttacaacaaacctaaacaagtcgatgcaacaactgtccaaggaggccaacaagatgactggatc

SEQ ID NO: 2352 - protein, 260 aa, Streptococcus pyogenes
MDINLLQALLIGLWTAFCFSGMLLGIYTNRCIILSFGVGIILGDLPTALSMGAISELAYMGFGVGAGGTVPPNPIGPGIFGTLMAITSAGKVTPEAALALSTPIAVAIQFLQTFAYTAFAGAPETAKKQLQKGNIRGFKFAANGTIWAFAFIGLGLGLLGALSMDTLLHLVDYIPPVLLNGLTVAGKMLPAIGFAMILSVMAKKELIPFVLIGYVCAAYLQIPTIGIAIIGIIFALNEFYNKPKQVDATTVQGGQQDDWI

SEQ ID NO: 2353 - DNA, 255 bp, Streptococcus agalactiae
atgccagtaactaatttaattcccgttaaaatagtattcatagccacaaagaacagaatcggtcccatcaccaaaccatctgtcgctaaagaggctgcaatcgttgagaacaagggtgctaagcaaaattgtgataaagaatcaccgatacctgcaagaggccccataagcgccatcttaataccgcgaatttcttcttctggccgctcattatcaagcattgctaaatgtaagctagttacaaaaggtaagaaa

SEQ ID NO: 2354 - protein, 85 aa, Streptococcus agalactiae
MPVTNLIPVKIVFIATKNRIGPITKPSVAKEAAIVENKGAKQNCDKESPIPARGPISAILIPRISSSGRSLSSIAKCKLVTKGKK

SEQ ID NO: 2355 - DNA, 885 bp, Streptococcus agalactiae
ttgctttgcttgatattttcagaaaaccagctgcacctactaaagaaactaagacagaaggagacaaccaagatgactggatctaaaaaattagcaaaaagtgattacactaaaacagctttacgtgccttttatttacaaaatggctttaattacagtaactatcaaggtcttggttatgctaatgtcatatatccagctctcaaaaaatattatggagatgacaaaaaagctttagcgggagctctagaagaaaatgtggagttttacaatacaaaccctcatttcttaccttttgtaactagcttacatttagcaatgcttgataatgagcggccagaagaagaaattcgcggtattaagatggcgcttatggggcctcttgcaggtatcggtgattctttatcacaattttgcttagcacccttgttctcaacgattgcagcctctttagcgacagatggtttggtgatgggaccgattctgttctttgtggctatgaatactattttaacgggaattaaattagttactggcatgtatggttatcgtcttgggaccagttttattgataaattgagtgaacaaatgtcagttatctcacgggcagctaatatcgttggtgtaacggtcatctcaagtttagctgcaacacaagttaagcttacaatcccttacacttttgctccagaaaaagtaactagtacaacgcaaaagattgttactgtccaaggtatgcttgataaaattgcaccagctctacttccagcactctacactttccttatgttttaccttattaaaaataaaaaatggacaacttataagttagttatccttacagttattattggtatccttggtagctggttaggtattttagct

SEQ ID NO: 2356 - protein, 295 aa, Streptococcus agalactiae
MLCLIFSENQLHLLKKLRQKETTKMTGSKKLAKSDYTKTALRAFYLQNGFNYSNYQGLGYANVIYPALKKYYGDDKKALAGALEENVEFYNTNPHFLPFVTSLHLAMLDNERPEEEIRGIKMALMGPLAGIGDSLSQFCLAPLFSTIAASLATDGLVMGPILFFVAMNTILTGIKLVTGMYGYRLGTSFIDKLSEQMSVISRAANIVGVTVISSLAATQVKLTIPYTFAPEKVTSTTQKIVTVQGMLDKIAPALLPALYTFLMFYLIKNKKWTTYKLVILTVIIGILGSWLGILA

SEQ ID NO: 2357 - DNA, 879 bp, Streptococcus pyogenes
atgaattttacaacaaacctaaacaagtcgatgcaacaactgtccaaggaggccaacaagatgactggatctaataaattaaccaagaaagattacctcaaaacagctctgagagctttcttcctacaaaatgggtttaattacaataattaccaaggtatcggatacgccaatgtcatctatcctgccttgaaaaaacattttggcaatgataaaaagggcttatatcaagctttagaagataactgtgagttttacaatactaatcctcacttccttcctttcatcaccagtctgcacttggtcatgttagaaaataatcgccctgaagaagaaacccgaaacatcaaaatggcacttatggggcctttagctggtatcggtgactccttatcacaattttgcttggcgccactcttttcaacgattgcagcttccttagctagtgatggtctggttttgggaccaatcctcttcttcctagccatgaatattatcctaaccgctattaaaattggttctggactctatggctacaaggtcggcacaagctttattgataaattaagtgaacaaatggcggttgtgtcgcgcatggcaaatattgtcggcgttaccgttatcgctggactagcagctacttctgttaaaattactgttcccattacttttgccgctggcaaggtggatgcggccaatacagcacaaaaatttgtgactattcaaggaatgcttgataagattgcccctgcacttttaccagctctctttaccttactcatgtattaccttattaaaaacaaaaaatggacaacctacaaattggtcattttaactgttatcattggtgttattggcagttggttgggtattttagct

SEQ ID NO: 2358 - protein, 293 aa, Streptococcus pyogenes
MNFTTNLNKSMQQLSKEANKMTGSNKLTKKDYLKTALRAFFLQNGFNYNNYQGIGYANVIYPALKKHFGNDKKGLYQALEDNCEFYNTNPHFLPFITSLHLVMLENNRPEEETRNIKMALMGPLAGIGDSLSQFCLAPLFSTIAASLASDGLVLGPILFFLAMNIILTAIKIGSGLYGYKVGTSFIDKLSEQMAVVSRMANIVGVTVIAGLAATSVKITVPITFAAGKVDAANTAQKFVTIQGMLDKIAPALLPALFTLLMYYLIKNKKWTTYKLVILTVIIGVIGSWLGILA

SEQ ID NO: 2359 - DNA, 1902 bp, Streptococcus agalactiae
atgaaagatcgcttatataataaattcaaggattttgatagggaattttgtcaaaagtatattaaaacataccaatctaatgcctatcaagaaatgaaagcctctgttaatttgatgatgaggaacacttttgtatttaatgataattgggatatggaaccttgttctaaagcatattgtcttgatcctttggagtgggataagccagtaacagatgatccagaatggttgtatatgctaaatcgtcaaacttatctttttaaattcctggtggtctacattgttgaaggcgataagtcttaccttagacaaatgaaatattttatgtaccattggattgattgtcaatttacactaaagccagaaggggcggtaagtcgtactattgacactgggatacgttgcatgtcatggctcaaagttttgatttttttagattattttggattaataacagaaactaaaaaaattaaactattaactagtttacgggagcagataacttatatgagggactattatcgtgaaaaagatagtctaagtaactggggaattttacaaacaacagcaatattggcgtgtttatactattatgaagatgaattaaatctacctgaaattcagagttttgctgaagaagaattattacttcaaatcaagcttcaaattttagatgacgggagccagtatgaacaatcaattatgtatcatgtagaagtcttgaagtccttaatggaactagttatccttgcgcctaaatattatctaccattagaagaaactattgaaaaaatggttacctatctaattgctatgactggtccggattattgtcaactagctataggggacagtgatgtgaccgatactcgtgatattctaactttggcaacacttgtgttgaaatcttctaaaacaaaatcattttcttttgataatgttaatttagaaactttacttttgtttgggaagccatcaatttatctttttgaagaaataccgcgtgcgacaataggagagtctgcttatctttttccagattctggtcatgtgtgtttacgtgatgataggcgttatatattttttaagaacggtccatttggtagcgctcatactcatagtgataataatagtgtttgtctctatgataaaaagaaacctattttcattgatgcaggaagatatacttacaaagaagaacaactaaggtatgattttaaacgttcgactagtcattcaacatgtacccttgatgggcaacccttagaaatgatcaaggactcttggacatacaattcttatccaaaatgtgactattgtcagttgacttcaaaggataggtaccatttagtcgaaggacaactacatgtccaaagagcttctgatatctattaccataagcgatggttgttaactttaccgcaggccattaccttagttattgataaggtgagttgtccaggagagcatgtcttaacaaatcaatatattttagatgatcaggtcatttatgaaaatgggtttgttaatgacttgaaattagtaagtcctacgacctttaatctagaagattgccttatttctaagcggtataatcaattgacagaaagtcataaattagttaagaaaataaaatttgttgatgaggtgatggattataccttgatagttgatcggaactgtcaggtgaaatatgttcctttagtgcaaacgaacagtcataaggaactaagtaatagcattgcatttgatattaggtctcaagactttcattatttaattggagtgcttatggatgatattatctttggggataaactctatttgatgcaagggataaaatgcaaaggaaaagtcattgtatatgataaaaataatggcaaaatgagtcgtttaaaaaat

SEQ ID NO: 2360 - protein, 634 aa, Streptococcus agalactiae
MKDRLYNKFKDFDREFCQKYIKTYQSNAYQEMKASVNLMMRNTFVFNDNWDMEPCSKAYCLDPLEWDKPVTDDPEWLYMLNRQTYLFKFLVVYIVEGDKSYLRQMKYFMYHWIDCQFTLKPEGAVSRTIDTGIRCMSWLKVLIFLDYFGLITETKKIKLLTSLREQITYMRDYYREKDSLSNWGILQTTAILACLYYYEDELNLPEIQSFAEEELLLQIKLQILDDGSQYEQSIMYHVEVLKSLMELVILAPKYYLPLEETIEKMVTYLIAMTGPDYCQLAIGDSDVTDTRDILTLATLVLKSSKTKSFSFDNVNLETLLLFGKPSIYLFEEIPRATIGESAYLFPDSGHVCLRDDRRYIFFKNGPFGSAHTHSDNNSVCLYDKKKPIFIDAGRYTYKEEQLRYDFKRSTSHSTCTLDGQPLEMIKDSWTYNSYPKCDYCQLTSKDRYHLVEGQLHVQRASDIYYHKRWLLTLPQAITLVIDKVSCPGEHVLTNQYILDDQVIYENGFVNDLKLVSPTTFNLEDCLISKRYNQLTESHKLVKKIKFVDEVMDYTLIVDRNCQVKYVPLVQTNSHKELSNSIAFDIRSQDFHYLIGVLMDDIIFGDKLYLMQGIKCKGKVIVYDKNNGKMSRLKN

SEQ ID NO: 2361 - DNA, 1923 bp, Streptococcus pyogenes
ttggaaaggaaatgtcctatgttttttgccttcgcacgctttaaagaaacagtcaatccagacttttgcaggaattacctgctagactatcagactgacagctatgctgatcaaaaaagaatagctgacctactcttaaccaatacctttttatttgaagataattgggatatggagccctgccacatcccttaccacttagatcccattacttggcaagaggctgtcatagatgatcctgagtggaactttatgttaaatcgacagacctatctccaaaaattaatcctcgtctaccttgttgaaagagatgaacggtatctcttaacagctaaaggtttcatcctcaattggattgaatcagctattcctttagaccctaaggggttagctactagaaccttagatactggcatccgttgttttgcttgggtcaaatgtttgatttaccttaatctttttaacgccttaaccaagcaagaggaaagcctcatcctagcttccctggaaaaacaacttcaatttctccatgccaactaccttgataaatacagcctcagcaattggggaatcttgcaaaccactgcgattttattagctgatgcctactttggttctgaccttgatattgctgcagcaacagctttcgctagaaaagaattgacgcaacaaatcgcactacaaattctcgaagacggcagtcaatttgaacaatcaaccatgtatcatgtggaagtactcaaagcccttctggaattaactgctctagtccctgattatcttccacagcttagacctactttgcttgccatgagtgattatctcctcaaaatgactggtccagatcataaacaaatccctcttggtgatagcgatgttacagataccagagatattctaacgcttgcagccactatccttgaagaaccacacttaaaagctgctgcttttcccacacttgatatcgatagtcttctccttctaggagaaaaaggtgtccacacttttgaacagttacccgtccaaaccttaccaacttttgcgcatcactttgaacattccgggcacattaccatcaatcaagaaaattattatctttttttcaaaaatgggcccatcggtagttcccatacccatagcgaccaaaatagtctctgtctctattataaaggacaaccacttttctgtgatgctgggcgatacacttacaaagaagaaccattacgctatgccctaaaaagcgctagccatcattctaccgccttcttagaagaacaattacctgagcagattgatagctcctgggcttacctttcttaccccaaatccaattattgtcaccttcgacaaaatggacacgtttactttattgaaggtagctaccagacgcaattctctgataggaacaactaccaacatgaccgacaaattctcatcttaccaccaggaatttttcttatcattgatacgatacaggctcaaggcaaccactgtcttgtcagtcaatttattcttgataatcacttagacgtaaagacagatcaccttagtgacctcagactaatcagtgactgccctttcactatcgaagaaacgattttgtcaaaaaaatacaaccaatacctgactagtcacaaactcatcaaacgaaaaccctttaaagacaagggttgcaccagtaccctattagtccctgacgataccaaagttactcccttaacaccacttcaaacaggcaaacgcaacccaattgagactgccctttcctggcatttaaaaggaaagcagtttgactacagtatctgtgttctccaagaggatttaattaaaggagaaaaactagttctcctaaatagtcataaaatcagaggaaaggtggttgttatcaaccatatcacgaatgagattattcgattgaaacac

SEQ ID NO: 2362 - protein, 641 aa, Streptococcus pyogenes
LERKCPMFFAFARFKETVNPDFCRNYLLDYQTDSYADQKRIADLLLTNTFLFEDNWDMEPCHIPYHLDPITWQEAVIDDPEWNFMLNRQTYLQKLILVYLVERDERYLLTAKGFILNWIESAIPLDPKGLATRTLDTGIRCFAWVKCLIYLNLFNALTKQEESLILASLEKQLQFLHANYLDKYSLSNWGILQTTAILLADAYFGSDLDIAAATAFARKELTQQIALQILEDGSQFEQSTMYHVEVLKALLELTALVPDYLPQLRPTLLAMSDYLLKMTGPDHKQIPLGDSDVTDTRDILTLAATILEEPHLKAAAFPTLDIDSLLLLGEKGVHTFEQLPVQTLPTFAHHFEHSGHITINQENYYLFFKNGPIGSSHTHSDQNSLCLYYKGQPLFCDAGRYTYKEEPLRYALKSASHHSTAFLEEQLPEQIDSSWAYLSYPKSNYCHLRQNGHVYFIEGSYQTQFSDRNNYQHDRQILILPPGIFLIIDTIQAQGNHCLVSQFILDNHLDVKTDHLSDLRLISDCPFTIEETILSKKYNQYLTSHKLIKRKPFKDKGCTSTLLVPDDTKVTPLTPLQTGKRNPIETALSWHLKGKQFDYSICVLQEDLIKGEKLVLLNSHKIRGKVVVINHITNEIIRLKH

SEQ ID NO: 2363 - DNA, 999 bp, Streptococcus agalactiae
atgtctaaaaaaatgaccattaatgacatcgctcaattatcaaaaacttccaaaacaacggtttcttttttcttgaatcaaaaatttgaaaaaatgtcggatgagacgaggcaacgtattcaagaggtgattgatgaaacaggttatagaccaagtacgatagcaagaagtctaaattctaaaaaaacaaaactactaggtgtcttaattggagatataacaaacacattttcaaatcaaattgtaaaaggaattgagcacatcaccaaacaaaaaggctatcaaattattgtgggtaatagtaattacgatgccaaaagtgaagaagattatattgaaaatatgttaaatttaggtgttgatggtttcattattcagcctacatcaaattttcgaaagtattctcgtattttaaaagaaaaaaagaaaccaatggtattttttgatagtcaactttatgaacataagacgagttgggttaaggctaataactatgatgctgtttatgatatgacacaggagtgtctaaatcgagggtataaaaagtttattatgattactgctgatacgagcttgcttagtacacgtattgagagagcttcgggattcatggatgctttaaaggacaatggtttcggttatgacactttggtgattgaagatgatgatcattcaaaaagtgatatagaagactttctaaaagcggtagttccagataaggaggagacattagtatttgcaccaaattgttgggctttaccaatggtttttactgccatgaagaatctcaattttgatatgccacgagttggtttagttgggtttgacaatattgaatggacagacttttcatctcctaaagtgtcaacaattgtccagccggcttatgaagaaggtgaacaagtagcacagattttgattaatcgtattgaaggagatgactccgtcgataaccaacagattgtagattgccagatgttttggaaagagtcgactttt

SEQ ID NO: 2364 - protein, 333 aa, Streptococcus agalactiae
MSKKMTINDIAQLSKTSKTTVSFFLNQKFEKMSDETRQRIQEVIDETGYRPSTIARSLNSKKTKLLGVLIGDITNTFSNQIVKGIEHITKQKGYQIIVGNSNYDAKSEEDYIENMLNLGVDGFIIQPTSNFRKYSRILKEKKKPMVFFDSQLYEHKTSWVKANNYDAVYDMTQECLNRGYKKFIMITADTSLLSTRIERASGFMDALKDNGFGYDTLVIEDDDHSKSDIEDFLKAVVPDKEETLVFAPNCWALPMVFTAMKNLNFDMPRVGLVGFDNIEWTDFSSPKVSTIVQPAYEEGEQVAQILINRIEGDDSVDNQQIVDCQMFWKESTF

SEQ ID NO: 2365 - DNA, 1029 bp, Streptococcus pyogenes
atgactaaccattactattttaaaggagtgtatgcaatgcagcgcaaagtaaccatcaaagatattgctgaattagcgaaaacttcaaaaacaacagtttctttctacttaaatggcaggtttgacaagatgtctgaagaaactaaaaaccgcatcagcgagagtatcaaagctactaattataaaccgagcattgctgctagaagtctcaatgcaaaatcgactaaactcattggtgttgttataggtgacatcacaaacagtttttcaaaccaaattgtcaaaggaattgaaagcaaagcccaggaatttggttaccaaattatcatcggaaacagcaactacgacccttctcgcgaagatgaactcattgaaaagatgctcaatcttggtgttgatggttttattattcaaccaacttctaactttagaaaatattcacgtattatcgatattaaaaaaaagaaggttgtcttttttgatagccaactttacgaacatcgcacaaactgggtcaaaactaataattatgatgctgtttatgataccattcaacaatgtatcgataaaggttatgaacattttatcatgatcacgggtaaccccaatttacttagcactcgtattgaacgcgcttcaggcttcattgatgtgttagaagctaatcatcttactcatcaagaaatgattattgatgaaaatcagacttcttcagaggcaattgctcagtttttgcaaggatcactgactaaaaagagtttggtttttgtccccaattgttgggctcttccaaaagtatttacagctatgaagtctcttaaatttaatataccagagattggactagtaggatttgataacattgagtggacaaaattttcttcaccaacactaacaactattatccaacccgcctatgaagaaggcgaacaggctactaagattttaatcgatgatattgaaggtcacagtcaagaagccaaacaacaaatttttgactgtcaagtcaattggcaagaatcaactttt

SEQ ID NO: 2366 - protein, 343 aa, Streptococcus pyogenes
MTNHYYFKGVYAMQRKVTIKDIAELAKTSKTTVSFYLNGRFDKMSEETKNRISESIKATNYKPSIAARSLNAKSTKLIGVVIGDITNSFSNQIVKGIESKAQEFGYQIIIGNSNYDPSREDELIEKMLNLGVDGFIIQPTSNFRKYSRIIDIKKKKVVFFDSQLYEHRTNWVKTNNYDAVYDTIQQCIDKGYEHFIMITGNPNLLSTRIERASGFIDVLEANHLTHQEMIIDENQTSSEAIAQFLQGSLTKKSLVFVPNCWALPKVFTAMKSLKFNIPEIGLVGFDNIEWTKFSSPTLTTIIQPAYEEGEQATKILIDDIEGHSQEAKQQIFDCQVNWQESTF

SEQ ID NO: 2367 - DNA, 612 bp, Streptococcus agalactiae
atgtctgctattgataaattagtaaaagctagtcatttaattgacatgaatgacattatccgtgaaggcaatccaacccttcgcaaagtggctgaagaagtcacattcccactttctgagaaagaagaaattctcggagaaaaaatgatgcaatttttaaaacactctcaagatccaattatggctgagaagctaggcttacgtggtggtgttggtttagccgcaccacaattagacatctcaaaacgcatcattgccgtccttgttccaaacgttgaggatgctcaaggaaatccacctaaagaagcttatagcctccaagaagtaatgtacaaccctaaagttgtatcgcattctgttcaagatgctgctttatctgacggggagggatgcctatcagtagatcgtgaagtacctggctatgtcgtccgccacgcgcgtgtaactattgaatatttcgacaaaactggtgaaaaacatcgactcaaattaaaaggttacaactctattgttgttcaacatgaaattgaccacattgatggtattatgttttacgaccgtatcaatgagaaaaatcctttcgctgtcaaagaaggcttacttattttagaa

SEQ ID NO: 2368 - protein, 204 aa, Streptococcus agalactiae
MSAIDKLVKASHLIDMNDIIREGNPTLRKVAEEVTFPLSEKEEILGEKMMQFLKHSQDPIMAEKLGLRGGVGLAAPQLDISKRIIAVLVPNVEDAQGNPPKEAYSLQEVMYNPKVVSHSVQDAALSDGEGCLSVDREVPGYVVRHARVTIEYFDKTGEKHRLKLKGYNSIVVQHEIDHIDGIMFYDRINEKNPFAVKEGLLILE

SEQ ID NO: 2369 - DNA, 612 bp, Streptococcus pyogenes
atgtctgcacaagataaattaattaaacctagtcatctgattaccatggatgacattattcgtgaagggaatccaactttaagagctgtcgccaaagaagtgagcttacccttgtgtgatgaggatatcctattaggagaaaagatgatgcaatttttgaagcattctcaagatcctgtaatggcggaaaaacttggtcttagggccggtgttggtctagcagctcctcagattgatgtgtcaaaacgtatcatcgctgtgctcgttcctaatcttcctgataaagaaggaaatcctcctaaagaagcctatagctggcaagaagtcctgtataatcctaaaatcgtttctcattctgttcaagatgcagccctttctgatggcgaaggttgtttatctgtcgatcgtgttgttgaagggtatgtggttcgccatgctcgtgttacagtagactactatgataaagaaggacaacagcatcgcatcaaattaaagggatacaacgctattgtggttcaacatgaaattgaccatatcaatggtgttttgttctacgatcggatcaatgctaaaaacccctttgaaaccaaagaagagctcttgattttagac

SEQ ID NO: 2370 - protein, 204 aa, Streptococcus pyogenes
MSAQDKLIKPSHLITMDDIIREGNPTLRAVAKEVSLPLCDEDILLGEKMMQFLKHSQDPVMAEKLGLRAGVGLAAPQIDVSKRIIAVLVPNLPDKEGNPPKEAYSWQEVLYNPKIVSHSVQDAALSDGEGCLSVDRVVEGYVVRHARVTVDYYDKEGQQHRIKLKGYNAIVVQHEIDHINGVLFYDRINAKNPFETKEELLILD

SEQ ID NO: 2371 - DNA, 684 bp, Streptococcus agalactiae
atgacatatgtcctaaaactatctcaaatagggagtcaatacatggatatagaaaactactgccaagactactgtttggagactatctttccaaaacattatttcaaggatttacaagtaatcaccctaactgccggccaatccgtctgtaaacagggagaacaattagaatacttgcactacatcgtcaagggacgttttaaaattgtacgtcgactctttaacggcaaagaacatattttagatattaaaacaaaaccaacactgattggtgatattgaacttttgactaatagacaaattgtatcatctgttattgccttagaggatcttacagtcattcaattatcacttaaaggacggaaagagaaactgttaacagacgcaactttcctcctaaaacttagtcaagagctagctcaggcttttcatgatcaaaacatcaaagcgtctactaatctagggtataccgtcaaagagttacttgcaagtcatattttagcaattgaagaacaaggttactttcaacttgagttaagtagtttagctgattcgtttggcgtcagttatcgtcatttattaagagttatccacgatatggtcaaagaaggccttatccaaaaagaaaaaccaaaatactttatcaaaaatcgtttcgcactagaatcattaaatattcagcca

SEQ ID NO: 2372 - protein, 228 aa, Streptococcus agalactiae
MTYVLKLSQIGSQYMDIENYCQDYCLETIFPKHYFKDLQVITLTAGQSVCKQGEQLEYLHYIVKGRFKIVRRLFNGKEHILDIKTKPTLIGDIELLTNRQIVSSVIALEDLTVIQLSLKGRKEKLLTDATFLLKLSQELAQAFHDQNIKASTNLGYTVKELLASHILAIEEQGYFQLELSSLADSFGVSYRHLLRVIHDMVKEGLIQKEKPKYFIKNRFALESLNIQP

SEQ ID NO: 2373 - DNA, 267 bp, Streptococcus pyogenes
ttgacacaaaatgtttgccaacaaaacattacctataccgtcaaagagcgctttgcttcctatacccttgaagcgcaagccaaccaagaggttcatctaaaccttacattattagcaaaccgttttggaacaagcgatcgccatcttaagcacgtacttaagcagcccatttttcagaggattatcgaacgcatctgcttcaaaacctatcgtattgccgatttagacgctctaactcaattaagacctctgaggtatgcagcccat

SEQ ID NO: 2374 - protein, 89 aa, Streptococcus pyogenes
LTQNVCQQNITYTVKERFASYTLEAQANQEVHLNLTLLANRFGTSDRHLKHVLKQPIFQRIIERICFKTYRIADLDALTQLRPLRYAAH

SEQ ID NO: 2375 - DNA, 1161 bp, Streptococcus agalactiae
ttgaaaatctttatggagaagctaagtttactctctttatcacttatcttgctatcaactttttcgacatcaccagccctaccacaaatgatatcttattatagagataagggcttaccatcaccccaagttgaattattgttttcaattccttcgatggctattatcttcatcttgcttatcacaccttggttaagtaaaaaactttctgagaaacatatgattatctttgggctattgctaacagcattagggggaggattgccggttgtcagtcagaactaccttttagtatttgtatcgcgtcttttattggggagtggtattggttttattaatactagggccattagtgtgattagtgaatattatcaaggcaaagaaagaagaaaactcttaggattaagggggtcctttgaagttttaggaaatgctggtttgacagctttagttgggctgttgttgacttttggttggtccaaatcatttatgatttattttttagctttaccaatcttagttctatatcttgtttttgcgcctaagaaagtggtgaaagatacaaatgacaagattaaaactaaaggtcaaaaaatccctaaagctgatttaacttatattgtcgccttagctattttagcaggatttgtcataactataaatactgggattaatcttaggatacctctgctagtagtagaatttggtttgggtacgccagctcaagctagtcttgttcttagtgcgatgatgcttatgggaataatagcaggtatgagttttggtcagttgatagctatgtttcataaacaattaattccaatctgcctcgtcttattttctttaacattgcttggagttggattgccttctaatctaatggtactaacaattagtgcgatggcatcaggtttcctttacagcctgatggtcactgctgtgtttagcctagtagcagaccgtgttgaatattcgttggttggttctgcaacgacattagttttagtattttgtaatattggtggagctagtgcggctattcttctgtcttgttttgatcatttactaggacaaataaatgcagttttctatgtttatgctattttaagtttagcagttggtatgatttatttctttaaacgcctattttttaagaaaatg

SEQ ID NO: 2376 - protein, 387 aa, Streptococcus agalactiae
MKIFMEKLSLLSLSLILLSTFSTSPALPQMISYYRDKGLPSPQVELLFSIPSMAIIFILLITPWLSKKLSEKHMIIFGLLLTALGGGLPVVSQNYLLVFVSRLLLGSGIGFINTRAISVISEYYQGKERRKLLGLRGSFEVLGNAGLTALVGLLLTFGWSKSFMIYFLALPILVLYLVFAPKKVVKDTNDKIKTKGQKIPKADLTYIVALAILAGFVITINTGINLRIPLLVVEFGLGTPAQASLVLSAMMLMGIIAGMSFGQLIAMFHKQLIPICLVLFSLTLLGVGLPSNLMVLTISAMASGFLYSLMVTAVFSLVADRVEYSLVGSATTLVLVFCNIGGASAAILLSCFDHLLGQINAVFYVYAILSLAVGMIYFFKRLFFKKM

SEQ ID NO: 2377 - DNA, 1218 bp, Streptococcus pyogenes
atgtcaacattatcattggacaccacaaataagcgagctttagtggcagctattgcagcttcaggaacggatgacttgaatgtcatgtttcttgccttttccatgtcttccattatgacagacttgggtcttagtggcactcagggtggctggattgcgaccattaccaatttaggaatgttggtgggaggcctcttattcgggttgctggctgataggcaccacaagtttaaggtctttaaatggacgattttactgttttcagtagcaacaggattaatttattttacccagtctttgccctacctgtacctgatgcgatttattgctggcataggagttggaggtgagtacggtgtagccattgccataatggcagggattgtaccaccagaaaaaatgggtcggatgtcttctttaaatggtattgctggccagcttggctctattagttcggctcttttagcagggtggctggctccaagtctaggctggcgtggcctttttctctttggattacttccgattctcttggtgatttggatgactttagccatagatgaccaaaaaatttgggatcattatgggcaagaggaggaagaatgcagtcaaccaattaaaatcaatgaactattcaaaacaaaatccttaacagctcaaacccttgctttaatggtcatgacgactgtgcagattgcgggctattttggaatgatgaattggttgccaaccattattcaaacaagcttaaacctttcagtaaaaagttcgtccttgtggatggtggctactattgtcggcatgtgtttggggatgctgtattttggtcagcttttagattgctttggtccacgtctgatttattccctctttttattagcatcatctatttgtgtttacctttttcaatttgccaattccatggcgagtatggttattggaggtgctattgtcggtttttttgtcaatgggatgtttgctggctacggggctatgattaccagactttatccccatcacattcgatccacggctaataatgttattttgaatgttggccgtgctctaggaggattttcgtccgttgctattggtagtattttagatgcctcaggtatttcaatggtcatgattttcctagcttctctgtatgtgattagttttggagccatgtggtctattggtcagttaaaagcagaacgctaccaacaattgcgt

SEQ ID NO: 2378 - protein, 406 aa, Streptococcus pyogenes
MSTLSLDTTNKRALVAAIAASGTDDLNVMFLAFSMSSIMTDLGLSGTQGGWIATITNLGMLVGGLLFGLLADRHHKFKVFKWTILLFSVATGLIYFTQSLPYLYLMRFIAGIGVGGEYGVAIAIMAGIVPPEKMGRMSSLNGIAGQLGSISSALLAGWLAPSLGWRGLFLFGLLPILLVIWMTLAIDDQKIWDHYGQEEEECSQPIKINELFKTKSLTAQTLALMVMTTVQIAGYFGMMNWLPTIIQTSLNLSVKSSSLWMVATIVGMCLGMLYFGQLLDCFGPRLIYSLFLLASSICVYLFQFANSMASMVIGGAIVGFFVNGMFAGYGAMITRLYPHHIRSTANNVILNVGRALGGFSSVAIGSILDASGISMVMIFLASLYVISFGAMWSIGQLKAERYQQLR

SEQ ID NO: 2379 - DNA, 981 bp, Streptococcus agalactiae
atgattgaaaaatattataattgggcaacgcttggaaccggcgttattgccaacgaattagcccaagcactagaagcacgtggacaaaaattatattctgtagctaatagaacttacgacaaaggacttgaatttgctaccaaatatggtatccaaaaagtttatgatcacatagatcaagtatttgaagaccctgaagtggatatcatttatatctctactccccacaatactcacatctcatttttacgaaaggctttagcaaatggtaagcacgttctttgcgaaaaatctattactttaaacagcactgaacttaaagaagccatagatttagccgaaactaaccatgttgtcttagctgaagccatgactatttttcatatgccaatttatcgccaattaaaaacattagttgatagtggaaaattaggaccgttaaaaatgattcaaatgaatttcggaagttataaagaatatgatatgactaaccgttttttcagtcgtgacctagcaggcggtgctttgctggacattggtgtttatgcactttcttgtattcgctggtttatgtcagaagcacctcacaacattacctctcaagttacatttgcaccaacaggagttgatgaacaagttggtatcctactaaccaatcctgcaaatgagatggcgactgtcagccttagtttacatgcaaaacaacctaaacgagcaactatcgcttacgataaaggctacattgaactttttgaatatccgcgaggacaaaaggcagttattacttatactgaggatgggcatcaagatattctcgaagctggcaaaactgaaaatgccctccaatatgaggtagctgatatggaagaagccgtttcaggaaaaactaaccacatgtacttaaactataccaaagacgttatggatatcatgacacagctacgtcaagaatggggatttacctacccagaagaagaaaaa

SEQ ID NO: 2380 - protein, 327 aa, Streptococcus agalactiae
MIEKYYNWATLGTGVIANELAQALEARGQKLYSVANRTYDKGLEFATKYGIQKVYDHIDQVFEDPEVDIIYISTPHNTHISFLRKALANGKHVLCEKSITLNSTELKEAIDLAETNHVVLAEAMTIFHMPIYRQLKTLVDSGKLGPLKMIQMNFGSYKEYDMTNRFFSRDLAGGALLDIGVYALSCIRWFMSEAPHNITSQVTFAPTGVDEQVGILLTNPANEMATVSLSLHAKQPKRATIAYDKGYIELFEYPRGQKAVITYTEDGHQDILEAGKTENALQYEVADMEEAVSGKTNHMYLNYTKDVMDIMTQLRQEWGFTYPEEEK

SEQ ID NO: 2381 - DNA, 1893 bp, Streptococcus agalactiae
atgataaaatatcaagatgatttttaccaagcggttaatggggagtgggctaagacagctgttattcctgatgacaaaccaaggacaggtggtttttctgatcttgctgatgacattgaagcattaatgctgtcaacgacagataagtggctggctgatgaaaataaaccaagtgatacgattttaaatcattttattgcttttcataaaatgacagctgattatcaaaaacgtgaagaggtaggagtatcaccagtattaccattaattgaagaatataaaggcctacaatctttctctgagtttgcatcaaaagttgcagaatatgaactagagggtaaaccaaatgaatttccatttggtgtggctcctgactttatgaatgctcaattgaatgtactttgggctgaagcgcctgggattattttaccagatacaacttattatagtgaagataatgaaaaaggaaaggaactccttgctttttggcgtaaaagtcaagaagacctactgcctttgtttggcctttcagaacaggaaattaaagatatcttggataaggttttagcattggatgcaaaattggcacaatatgtcttatctcgcgaagagagttcggaatatgttaaactttaccatccttataactgggaagatttcacaaaattagcacctgaacttccattagatgctattttccaaaagatattaggacaaaaaccagataaagttattgttcctgaagaacgtttctggacagaatttgcatctgactattactcagaatctaattgggaattattaaaggcagatcttattttatcagctgcgaatgcctataatgcttacttaactgatgatattcgtatcaaatcgggagtttacagtcgagctttatcaggcacaccacaagcaatggataagaaaaaagcagcttactaccttgcttcaggaccttacaatcaagctctaggtttgtggtatgcaggagaaaaattctctccagaagctaaagctgatgttgagcataagattgcaacgatgattgatgtctataagtcacgcttagaaaaggcggattggcttgcacagtcaacgcgagaaaaagctattatgaaacttaatgttatcacaccacatattggataccctgagaaactaccagagacttatactaaaaaaatcattgatcctaaactatcgcttgtcgaaaatgctactaatttagacaaaatttcaatagcctatggttggagtaaatggaataaaccagttgatagaagtgaatggcatatgcctgcccacatggtcaatgcgtattatgatccacaacaaaaccaaattgtcttcccagcagccattttacaagaaccattttatgctttagagcaaagttcatcagcaaattatgggggaattggtgcagtgattgcacatgaaatatcacacgcttttgacactaatggagcttcatttgatgaacatggaagtttgaataattggtggactgatgaagattttgaagctttcaaaaaacttacagataaagtagttgagcagtttgatggactggaatcttatggcgcaaaagtcaatggtaaactaacagtatcagaaaatgttgcagatttaggtggagttgcttgtgctttagaagctgcgcagcgtgagtcagatttttcagcgagggatttctttattaactttgcgacaatttggcgtatgaaggcacgtgatgagtatatgcaaatgttagctagtgtagatgttcacgccccagcacaatggcgaactaatattacagtaacgaattttgaagaattccataaagagtttgatgttaaagatggtgataacatgtggcgtccagttgaaaaacgtgttattatttgg

SEQ ID NO: 2382 - protein, 631 aa, Streptococcus agalactiae
MIKYQDDFYQAVNGEWAKTAVIPDDKPRTGGFSDLADDIEALMLSTTDKWLADENKPSDTILNHFIAFHKMTADYQKREEVGVSPVLPLIEEYKGLQSFSEFASKVAEYELEGKPNEFPFGVAPDFMNAQLNVLWAEAPGIILPDTTYYSEDNEKGKELLAFWRKSQEDLLPLFGLSEQEIKDILDKVLALDAKLAQYVLSREESSEYVKLYHPYNWEDFTKLAPELPLDAIFQKILGQKPDKVIVPEERFWTEFASDYYSESNWELLKADLILSAANAYNAYLTDDIRIKSGVYSRALSGTPQAMDKKKAAYYLASGPYNQALGLWYAGEKFSPEAKADVEHKIATMIDVYKSRLEKADWLAQSTREKAIMKLNVITPHIGYPEKLPETYTKKIIDPKLSLVENATNLDKISIAYGWSKWNKPVDRSEWHMPAHMVNAYYDPQQNQIVFPAAILQEPFYALEQSSSANYGGIGAVIAHEISHAFDTNGASFDEHGSLNNWWTDEDFEAFKKLTDKVVEQFDGLESYGAKVNGKLTVSENVADLGGVACALEAAQRESDFSARDFFINFATIWRMKARDEYMQMLASVDVHAPAQWRTNITVTNFEEFHKEFDVKDGDNMWRPVEKRVIIW

SEQ ID NO: 2383 - DNA, 1893 bp, Streptococcus pyogenes
atgacaacttatcaagatgatttttaccaggctgtgaatggaaagtgggctgaaacagcagttattccagacgacaagcctcgaacaggtggattttcagacttagcagatgaaattgaggcattaatgctagacactacagatgcttggctagctggagaaaatatccctgatgatgctattttaaaaaattttgtgaaattccatcgtttggtggctgactacgctaaacgtgatgaagttggagtaagtccaattctccctttaattgaagaatatcagtccttaaaatctttttcagaatttgttgctaatatagcgaaatatgaattggcaggtttaccaaatgaatttccctttagtgtggcaccagactttatgaatgctcagctgaatgtgctttgggcagaagcaccaagcattcttttgccagatacaacatactacgaagaaggcaacgaaaaagctgaggaattgcgtggtatttggcgtcagtcgcaagaaaagcttttacctcaatttggtttttcaacagaagaaatcaaggatcttttggataaggtaattgagctagataagcaattggccaagtatgtcttgtctcgtgaggaaggctcagaatatgccaaattataccatccttatgtgtgggctgattttaaaaaactagctccagagcttcctttggatagcatttttgaaaagattttaggccaagtacctgacaaggttattgttcctgaggaacgtttttggacagaatttgcagccacttattactctgaagccaattgggatttactcaaggctaatttgattgtggacgcggctaatgcttacaatgcttacttgacggatgatattcgtgtggaatcaggcgcttattcgcgcgctctttcaggaacacctcaagctatggacaaacaaaaagcagccttttatttggcgcaaggaccgtttagccaagcgcttggcttgtggtatgctggtcaaaaattctccccagaagctaaggctgatgtggaaagtaaggtagcacgcatgattgaggtttataagtctcgtctagaaacggctgattggttagcaccagccacacgtgaaaaagccattactaaattaaatgttatcacgccacatattggttacccagaaaaattaccagaaacctatgctaaaaaagtgattgatgagagcttgtcattggttgaaaatgcacagaacttggctaaaatcacgattgctcacacttggagtaaatggaacaagccagttgaccgtagtgaatggcatatgccagcccacttagtcaatgcttattatgatcttcagcaaaatcagattgtctttcctgcggcaatcttacaagagccattttattctttagatcagagttcttcagccaattatggaggaattggtgcagtcattgcgcatgagatttcacatgcctttgacaccaatggtgcttcctttgatgaacatggtagcctaaatgattggtggacacaagaagactatgctgcctttaaagagcgcacagataagattgtggcgcagtttgacggcttagagtcacatggtgctaaggtcaatggtaaattgacagtttcagaaaacgtcgctgatctaggtggggtagcttgtgctttagaagcggcacaatcagaagaagacttctcagcccgtgacttctttattaactttgcgacgatttggcgtatgaaggcccgtgaggaatacatgcaaatgctagctagcattgatgttcatgctccgggtgaactgcgaacaaatgtcaccttaaccaactttgatgctttccatgagacctttgatattaaagaaggcgatgctatgtggagagctccgaaagaccgtgtgattatttgg

SEQ ID NO: 2384 - protein, 631 aa, Streptococcus pyogenes
MTTYQDDFYQAVNGKWAETAVIPDDKPRTGGFSDLADEIEALMLDTTDAWLAGENIPDDAILKNFVKFHRLVADYAKRDEVGVSPILPLIEEYQSLKSFSEFVANIAKYELAGLPNEFPFSVAPDFMNAQLNVLWAEAPSILLPDTTYYEEGNEKAEELRGIWRQSQEKLLPQFGFSTEEIKDLLDKVIELDKQLAKYVLSREEGSEYAKLYHPYVWADFKKLAPELPLDSIFEKILGQVPDKVIVPEERFWTEFAATYYSEANWDLLKANLIVDAANAYNAYLTDDIRVESGAYSRALSGTPQAMDKQKAAFYLAQGPFSQALGLWYAGQKFSPEAKADVESKVARMIEVYKSRLETADWLAPATREKAITKLNVITPHIGYPEKLPETYAKKVIDESLSLVENAQNLAKITIAHTWSKWNKPVDRSEWHMPAHLVNAYYDLQQNQIVFPAAILQEPFYSLDQSSSANYGGIGAVIAHEISHAFDTNGASFDEHGSLNDWWTQEDYAAFKERTDKIVAQFDGLESHGAKVNGKLTVSENVADLGGVACALEAAQSEEDFSARDFFINFATIWRMKAREEYMQMLASIDVHAPGELRTNVTLTNFDAFHETFDIKEGDAMWRAPKDRVIIW

SEQ ID NO: 2385 - DNA, 828 bp, Streptococcus agalactiae
gtgtcattctctaagcactatctagaaaatgatatcctctattctgcttcgattactagccgtgtagaagatttacatgaagcatttgccgacccttctgttgatgccatattagcaaccattggcggattcaattccaacgagcttttaccatatttagattatgatttaatctctaagaatcccaaaataatttgtggttactcagattcaacggccttccttaatgctatttttgccaaagcaaaaatccaaacttacatgggccctgcttattcttctttcaaaatgaaggaaggtcaaccttaccaaacacaagcttggcttactgccatgacagaaaaccactatgaactttggcctagtgaagaatggtctagtgatccctggtatgatcccagcaaaccacgccaatttttcccaacagaatggaaaatttataatcacggaaaagcttccggtacgattatcggaggtaatctctctacgtttggcctacttcgaggtactccttatgcaccgaaaattgaacgctatgtcctcttgattgaagaggctgaggaaagtaatttttatgaatttgaccgcaaccttgctgcaattttacaagcttatcctcatccacaagctattcttatggggcgctttcctaaagaatgcggcatgactccacaagtctttgaatatatcctttcaaaacatgctattttcaaggaaattcctgttatttatgatatggattttgcgcacacccaacctcttttgacagtgactattggagctgagctaagcgttgacactactacattatctctatctataaaagaa

SEQ ID NO: 2386 - protein, 276 aa, Streptococcus agalactiae
MSFSKHYLENDILYSASITSRVEDLHEAFADPSVDAILATIGGFNSNELLPYLDYDLISKNPKIICGYSDSTAFLNAIFAKAKIQTYMGPAYSSFKMKEGQPYQTQAWLTAMTENHYELWPSEEWSSDPWYDPSKPRQFFPTEWKIYNHGKASGTIIGGNLSTFGLLRGTPYAPKIERYVLLIEEAEESNFYEFDRNLAAILQAYPHPQAILMGRFPKECGMTPQVFEYILSKHAIFKEIPVIYDMDFAHTQPLLTVTIGAELSVDTTTLSLSIKE

SEQ ID NO: 2387 - DNA, 726 bp, Streptococcus pyogenes
gtggatgtcatcatgacttccataggtggctacaattctaattctgtattaaagtatatagactacgatctatttaaacagaaatttcctatctttattggatattctgacacaacagctcttgctttagccttatataaaaagactggatgtataacttacctgtctcagagcgttatctctaattttggagagtttgaaccgtttaatgaattaaattatttctattttgacttcatgcttcagagtaagtgcgaaaccttaatggtacaaataccagatgtttggacggatgagtggataaattgggaaacctatgaaagaaccaaaaaaacaaataaaaatgagtggattatttttaacaaaggtgaatttaatggtactttgatcggaggaaatctcgataccattgtaggaataataggaactgagtatatgccaaaaataacagaggataccatactcttgttagaagatgtatatacggatctaggaagactatataggaatttcacaacgcttgccttacatggtatttttgataaaataggaggacttattatttcaaaatttgaaacaataggggaaaatagcgatgttattaatgatatcattaatgaatttgtagggcatagaaagattcctattttattgaattttgattgtggtcatacccatcctagctgtttaatgcctattggtggtaaaattacgttgagtttaagc

SEQ ID NO: 2388 - protein, 242 aa, Streptococcus pyogenes
VDVIMTSIGGYNSNSVLKYIDYDLFKQKFPIFIGYSDTTALALALYKKTGCITYLSQSVISNFGEFEPFNELNYFYFDFMLQSKCETLMVQIPDVWTDEWINWETYERTKKTNKNEWIIFNKGEFNGTLIGGNLDTIVGIIGTEYMPKITEDTILLLEDVYTDLGRLYRNFTTLALHGIFDKIGGLIISKFETIGENSDVINDIINEFVGHRKIPILLNFDCGHTHPSCLMPIGGKITLSLS

SEQ ID NO: 2389 - DNA, 99 bp, Streptococcus agalactiae
ttggctaataggttagcctcaaaaccacccagacgctcaatggaagaagagggactaagaacacgaatgtggctgccttttgttaattttttcattggt

SEQ ID NO: 2390 - protein, 33 aa, Streptococcus agalactiae
MANRLASKPPRRSMEEEGLRTRMWLPFVNFFIG

SEQ ID NO: 2391 - DNA, 237 bp, Streptococcus agalactiae
atgatgtctcaattatctttggaagaacaattgaatcgactaaaagataaatacctttcttctaaaaatcaagaattttcaaatgttcacttaagtaaagtaaagaagaaaaagaagaaattaataatacttgaaaaagaaagatgtcgctgtcgattggagagagaagatactaaaaaaatcgatgataaaattgagaaattgaagaaagaattgatagatgttatgaaggaggaa

SEQ ID NO: 2392 - protein, 79 aa, Streptococcus agalactiae
MMSQLSLEEQLNRLKDKYLSSKNQEFSNVHLSKVKKKKKKLIILEKERCRCRLEREDTKKIDDKIEKLKKELIDVMKEE

SEQ ID NO: 2393 - DNA, 2067 bp, Streptococcus agalactiae
atggaagaaactattctaatagtcagctttctcctgtttttgattttatctaatgttatcaataggatatttcctaaattaccattaccatttatccagttggtctttgggattctctctggcttagtttttcataagtcacaagtccatatcgatcctgagttattccttgcctttgttattgctcctttgaactttagggaaggtcaagaaagtgatattggtagttttataaagtatcgggctattattctttacttaatcttaccaacggtatttttaacagctattgtcgttggttatgtagcagggcaccttttgccagttagtttaccacttgcggcatgctttgcgcttggagcagccttaggcccaacagatgccgttgcctttatatcgattgctaagaggtttcaatttcctaaacgggcagaaaatatcctcaaattggaaggtcttttaaatgacgctagtggtctagtttccttccagtttgctttaacagcccttgtaacaggttatttctccttagcaaaagctagtctcaagttagcattggccataatgggtggttttttaattggcttgctttttgcttttctaatgaggttatgtctcactgtcctagagaaatttgatgctgctgatgttacaggggctctacttttggaattaaccttaccttttgttgcttatttcgttgctgatttgttgggattttcagctattattgcggtggtagtggcaggagtaatgcaagcaaatcgtttgaaaaaagtgactctctttgatgctcaagtagatcgcgttacctctgttatttgggaaaccttaaattttattttaaatggtttagttttcttaatatttggaagagaactgacacgtatcattggtcctcttttaacaagtaacgcttatagtaattttgatcttattagtattgttgttttagttacttgcacactttttctagttcgctttctagcagtttcttgcttttatgcttggagatctttcaaataccataaatcatttaaaaagtattggagagagattcaactgttgactttttcaggagttaaaggaagtgtttccatagcaacaatactcttattacccaagcactcagtcataggagagttggggtatagtttgattcttttcactgttggtgcagtaacgctaatgagttttttaacgggacttttagtattaccaaagttagcgcctcccttacaggtgaaagatgattatttaatacgtctatcgattttaacaaaagtattatctgtcttagaagaagatggtaagagttctgaaaatcaagcttcattttatgcagttatagataattataatagccgtattcgtcatctcattttagaacaagaatctagtgacattaagaaggacttagctgaattgcaactgatgatgcttagtatagaaagcgatggacttgaagctgcttatcgttatggcaatatttctatcaaagaatatcgtatttaccaacgttatttaaaatacttagaacgccaagttaatcgtagctttgtgtcaaatatcacttatagtttaacgattcttatgcgtgttattcgtggtattgttcatgagtttttaacatttggacaaggaatacgaaatcggaaaaaacatttcaaaaacaggaaacggttgttagcagaagtcaatcgtcagcacttaacagatttgtacttatcaaataatgacctcattttagaaacgctagaagatatggaaggttattataatgcaactttgatagatttcttacaaaatgaacgcattcgagacgcagaattaattaaatcaggtttatttgtagaacgtgtcattgcacgcataacgccagatattttaaatgaaaccctaagaggatattacttggaacgcagaacaatctctgaatttgaaagggacggtttaattagttctaaagagtctcaaattttaagggataatgtcaatgaattagaaagctattcattaagagatagtcaatcttctataccttatcaattattggatttaaaaaaa

SEQ ID NO: 2394 - protein, 689 aa, Streptococcus agalactiae
MEETILIVSFLLFLILSNVINRIFPKLPLPFIQLVFGILSGLVFHKSQVHIDPELFLAFVIAPLNFREGQESDIGSFIKYRAIILYLILPTVFLTAIVVGYVAGHLLPVSLPLAACFALGAALGPTDAVAFISIAKRFQFPKRAENILKLEGLLNDASGLVSFQFALTALVTGYFSLAKASLKLALAIMGGFLIGLLFAFLMRLCLTVLEKFDAADVTGALLLELTLPFVAYFVADLLGFSAIIAVVVAGVMQANRLKKVTLFDAQVDRVTSVIWETLNFILNGLVFLIFGRELTRIIGPLLTSNAYSNFDLISIVVLVTCTLFLVRFLAVSCFYAWRSFKYHKSFKKYWREIQLLTFSGVKGSVSIATILLLPKHSVIGELGYSLILFTVGAVTLMSFLTGLLVLPKLAPPLQVKDDYLIRLSILTKVLSVLEEDGKSSENQASFYAVIDNYNSRIRHLILEQESSDIKKDLAELQLMMLSIESDGLEAAYRYGNISIKEYRIYQRYLKYLERQVNRSFVSNITYSLTILMRVIRGIVHEFLTFGQGIRNRKKHFKNRKRLLAEVNRQHLTDLYLSNNDLILETLEDMEGYYNATLIDFLQNERIRDAELIKSGLFVERVIARITPDILNETLRGYYLERRTISEFERDGLISSKESQILRDNVNELESYSLRDSQSSIPYQLLDLKK

SEQ ID NO: 2395 - DNA, 96 bp, Streptococcus agalactiae
ttggggcgaatttggggcgaaacaaccaaaaaccttgataaaccaaggttttcaaatccgtctaccgccttaaatataaaagattttatccaaaga

SEQ ID NO: 2396 - protein, 32 aa, Streptococcus agalactiae
MGRIWGETTKNLDKPRFSNPSTALNIKDFIQR

SEQ ID NO: 2397 - DNA, 1128 bp, Streptococcus agalactiae
ttgccaatctggcaagtcttttcttgtactcattttatcagaaatgaggtaaaaaaacaaatggcatcatatcgaaaaagagagaacgggctgtgggaataccgcatttcctacaaaaccatagatggaaaatataaacggaaagagaaaggtggttttaagaccaagaagcttgctcaggcggcagcaatcgaaattgaaaagaaattgacccaaaacatcttgacaaatgacgaagtaactctatatgactttgtcaagacctggtcagaagtctataagcgtccgtatgtaaaagataagacttgggaaacctattcaaaaaactttaagcacatcaagaactatttccaagagttgaaggtcaaagatattacaccgctttactaccaaaaaaagttgaatgagtttggcgagaaatatgcccaagaaactcttgagaaatttcactatcaaataaaaggggctatgaaagttgctgtaagggaacaggttgttacctttaattttgcagaaggtgcaaaagtgaaatctcaggtagagcccaaaaatgaagaggaagattttttagaggagcgcgaatataaggctctcttggcccttacaagagagaacatccaatatgtatcctatttcactctttaccttcttgcagtcacaggactgcgtttttctgaggctatggggctaacctggagcgatatagacttcaaaaatggcattttggatataaacaagagttttgattactcgaatactcaagattttgcagatctgaagaatgagtcatcaaaaagaaaagttccaattgattcaaatacaatagatattcttcgagaatataagaaaaatcattggcaagctaatatcaagaatagagtgtgctttggtgtatctaattcagcttgcaataaactgattaagaaaattgtgggtaggaaagtcagaaatcactcattacggcacacatacgcttcgtttttgattttgaacggggttgacattgtgacaatttctaagctccttggacatgaaagtccagatattactctgaaagtttatacacatcagatggaagcactggctgagagaaattttgagaaaatcaaaaatatttttttagtcgca

SEQ ID NO: 2398 - protein, 376 aa, Streptococcus agalactiae
MPIWQVFSCTHFIRNEVKKQMASYRKRENGLWEYRISYKTIDGKYKRKEKGGFKTKKLAQAAAIEIEKKLTQNILTNDEVTLYDFVKTWSEVYKRPYVKDKTWETYSKNFKHIKNYFQELKVKDITPLYYQKKLNEFGEKYAQETLEKFHYQIKGAMKVAVREQVVTFNFAEGAKVKSQVEPKNEEEDFLEEREYKALLALTRENIQYVSYFTLYLLAVTGLRFSEAMGLTWSDIDFKNGILDINKSFDYSNTQDFADLKNESSKRKVPIDSNTIDILREYKKNHWQANIKNRVCFGVSNSACNKLIKKIVGRKVRNHSLRHTYASFLILNGVDIVTISKLLGHESPDITLKVYTHQMEALAERNFEKIKNIFLVA

SEQ ID NO: 2399 - DNA, 402 bp, Streptococcus agalactiae
atggcattatttggtggcaaagacaaagaacctgaagtagaaatttttacagctgagccaaacgagcgagtttttgagtttaagaaatcaaagacgatagtaagaatagatgactactttatcagaattgcaagaaaaagcaacatgtcaaatatgcttctacatggacttgatggcgaaaaatcaattttgttatcagcaataactgcatatcaattaaaagagccaggggcaacggttggatatttacaattggtatatcctggatcagcagatactaaaggtggtgtctttgatgctgttaaggatgagaatacagtcacttttgtcaaagaagataaacaagccatcttagaattgaagatagcaatagaaaccgcattaaaaaataaggttcagaaa

SEQ ID NO: 2400 - protein, 134 aa, Streptococcus agalactiae
MALFGGKDKEPEVEIFTAEPNERVFEFKKSKTIVRIDDYFIRIARKSNMSNMLLHGLDGEKSILLSAITAYQLKEPGATVGYLQLVYPGSADTKGGVFDAVKDENTVTFVKEDKQAILELKIAIETALKNKVQK

SEQ ID NO: 2401 - DNA, 384 bp, Streptococcus agalactiae
ttgcctatgaaactagaccaactctgtaaagagtttggagtggaattgtgcctgttcgatgccagcgactggcatagttcgggattttacaatccaataaccaaggtcttaggggttgatgtgaatctgtctgagcaagaacaaaaacaagtcgccctacatgagttacagcataaaaatcactttccatatcagtatcagctttttagagagagatgtgaactcgacgcaaataggaatatgatccaccatcttttgaaggaagaattggaaatcgctgaggaccacactcaattcaattacctggtctttatggaaaagtacaaattaaagaccatagctgatgaggctatgatcaaggaagagtatttgaatttagttgga

SEQ ID NO: 2402 - protein, 128 aa, Streptococcus agalactiae
MPMKLDQLCKEFGVELCLFDASDWHSSGFYNPITKVLGVDVNLSEQEQKQVALHELQHKNHFPYQYQLFRERCELDANRNMIHHLLKEELEIAEDHTQFNYLVFMEKYKLKTIADEAMIKEEYLNLVG

SEQ ID NO: 2403 - DNA, 360 bp, Streptococcus agalactiae
atgtctgttttaattgataggatacgtgaactcagtaataaaaagggaatgtctcttaatgacttagaagatacacttggctacagtcgtaattctctgtatagcttgaatgaaaattctaagatgggtaaaccaaaggaaattgcacagtattttaatgtctcactagattacctactaggtctaacagataatccacgaattgccagcgatgagacagctatcattgacggtcaagttgtggatctgagagaagcagctgcccataccatgctgtttgatggtaagccacttgatgaagatgatatagattttattacagcagtcctgtctgcacacttcaaaaataaacaaaaggat

SEQ ID NO: 2404 - protein, 120 aa, Streptococcus agalactiae
MSVLIDRIRELSNKKGMSLNDLEDTLGYSRNSLYSLNENSKMGKPKEIAQYFNVSLDYLLGLTDNPRIASDETAIIDGQVVDLREAAAHTMLFDGKPLDEDDIDFITAVLSAHFKNKQKD

SEQ ID NO: 2405 - DNA, 162 bp, Streptococcus agalactiae
atgggaatcggttcaatgacagtgacagttaaagttactaacatggataaatttattgaacttagtaaagagttcaataaaaaagcccgcgagctagaagaactagctcacgaactgaagtcatttgattttgaaggcgaagttgtatcaactgatagcaac

SEQ ID NO: 2406 - protein, 54 aa, Streptococcus agalactiae
MGIGSMTVTVKVTNMDKFIELSKEFNKKARELEELAHELKSFDFEGEVVSTDSN

SEQ ID NO: 2407 - DNA, 486 bp, Streptococcus agalactiae
atgaaaggaggtcaagccatgaatttgaatcaaattcgtatcatagaggcatgccataaatttctaattggcatcacaaatttcgaagaagagttacaagatgacgttctcgtctatcgttacaaaggtaaccttgtcagctttgaaacctatcaagaatatgaacaacggtcatttgtagactataatctaaaatatggctatcttgatgacactagaacttacctagatgacagagctgatttgatagcagctttccctagcgaagagcacttgagagccttgcaaagagttaacgatgctgaacaagctcgtgtgcaaatctttaagctactatctcaggtcaatcttgactctctctccgaaaaaaattccaacatcaaaaaagataattttggatatgatttcttcaattttgcaactaaagaagaataccctgtttatcttttttcagatgatgaatcatttgagctagttgctatcagt

SEQ ID NO: 2408 - protein, 162 aa, Streptococcus agalactiae
MKGGQAMNLNQIRIIEACHKFLIGITNFEEELQDDVLVYRYKGNLVSFETYQEYEQRSFVDYNLKYGYLDDTRTYLDDRADLIAAFPSEEHLRALQRVNDAEQARVQIFKLLSQVNLDSLSEKNSNIKKDNFGYDFFNFATKEEYPVYLFSDDESFELVAIS

SEQ ID NO: 2409 - DNA, 264 bp, Streptococcus agalactiae
ttgacctcctttcataaaagatttcaagtcaattataccaaactagaaaggaaaaatatgagtcaacaacagaaaaaatggattcagctagtgaaagataagctgaatgaagaacagatgacacaaacacatctagctcgttcttgtggtgttgctaaggcaactatctcagaattgctgaaatatggcaaagggagcgacaaactcaaaaataaggtatctgatgtattacacatagatgagagctggacgaggttggaggat

SEQ ID NO: 2410 - protein, 88 aa, Streptococcus agalactiae
MTSFHKRFQVNYTKLERKNMSQQQKKWIQLVKDKLNEEQMTQTHLARSCGVAKATISELLKYGKGSDKLKNKVSDVLHIDESWTRLED

SEQ ID NO: 2411 - DNA, 708 bp, Streptococcus agalactiae
atgaacgaaatttttgtttttcacgggcaggaagtccgtactgtaaccattaacaacgagccttggtttgttgggaaagacgtggctgatattttaggctattcaaaatcacgaaatgcgattgcactccatgttgatgaggatgacgccctaaaacagggcatcacagacaatttaggtcgcatgcaagaaactattatcatcaatgaatctggtctttactcacttatcttatccagtaaattgccacaggtcaaagaattcaaacgttgggtcactagcgaggtattgccacagattcggcaacagggagcttatgtgcctgaaaatctatcagatgaggctttcatcgctctatttactggacagaagaaactgaaagagcaccagttggcattggctcaagatgttgattatctgaaaaatgagcaaccaattcatcctagctttgctcaagccttactgaagaagagaaaagctcgtgttgtctcttgtctaggtggaatggacagtccagcctatgctgataaagtcttcgcacagtcggtctttagacaagctgaggttgattttaaagaccatttcaatatcaatcgctatgacatgttgccaaagaaatttgctgaagcagcattatcttactggatgacatgggaaccaagcacaaataccaaaatgaaaattttggagatgaacgcttatgaactg

SEQ ID NO: 2412 - protein, 236 aa, Streptococcus agalactiae
MNEIFVFHGQEVRTVTINNEPWFVGKDVADILGYSKSRNAIALHVDEDDALKQGITDNLGRMQETIIINESGLYSLILSSKLPQVKEFKRWVTSEVLPQIRQQGAYVPENLSDEAFIALFTGQKKLKEHQLALAQDVDYLKNEQPIHPSFAQALLKKRKARVVSCLGGMDSPAYADKVFAQSVFRQAEVDFKDHFNINRYDMLPKKFAEAALSYWMTWEPSTNTKMKILEMNAYEL

SEQ ID NO: 2413 - DNA, 744 bp, Streptococcus pyogenes
atggaattacaagtatttactaatgaacagtttggagaagtgcgtacagcgacaatcaacaatcaaatttatttcaatcttaacgattgttgtcagattttggaattaagcaatcctcgtaaaacaattgaaagacttaataaagatggtgtaactactagtgacatcatcgacagtcttggtcgaactcaacaagccaacttcatcaacgaaagcaacttctacaagctagtcttccaatctcgcaagccagaagctgaaaagtttgcggactgggtaacatcggaagtcctaccatcaatccgcaaacatggcgcatatatgaccgaacagactttagagcaggcgctgacaagcccagacttcctcatacggcttgccaatgagttaaaagaggaaaaggagcgcagtcgtcagttagaggctgagaagtcaattttgagcgttgagaacatggttatgaagccaaaggctgattattttgatgatttggttgaccgcaatttattgactagtttccgtgaaactgctaaacaattaaaagttaaggaacgacgattcattcaatttctacttgataagaaatacgtttacagagacaagaaaggtaagcttatgccgtttgcagataaaaataacgggttatttgaagtcaaggaaagtgttaacgaaaagaccaactgggcaggaactcaaaccttaataactccaaaaggtcgtgaaacttttagactgttatttatt

SEQ ID NO: 2414 - protein, 248 aa, Streptococcus pyogenes
MELQVFTNEQFGEVRTATINNQIYFNLNDCCQILELSNPRKTIERLNKDGVTTSDIIDSLGRTQQANFINESNFYKLVFQSRKPEAEKFADWVTSEVLPSIRKHGAYMTEQTLEQALTSPDFLIRLANELKEEKERSRQLEAEKSILSVENMVMKPKADYFDDLVDRNLLTSFRETAKQLKVKERRFIQFLLDKKYVYRDKKGKLMPFADKNNGLFEVKESVNEKTNWAGTQTLITPKGRETFRLLFI

SEQ ID NO: 2415 - DNA, 528 bp, Streptococcus agalactiae
atgaacgaagtttggaaagatataccaattgttaaaggatattatcaagtttccaatcttggtcgtgttcggtctattggtagaacagtcaatgcaaaacagagaacaagaaaaacaaaaggacgcatcttaaaacagagcttatcttcaggctatgcaatagtgacactttcagtcaatggattaaggaagtcgataagagttcatagactagtagctgaagcatttataccaaatccaatcaataagcgaacgataaatcatattgatgaaaataaacttaataatagagtagataatttagaatgggcgacagataaggaaaatgctaatcatgggaatagaacaacgaaatcatctttaggtcgttgtaaacctgtagaacaatttacacttgaaggggaattcataaacacgtttgactcaataaaatctgcatcaatgaaaacaggtatctcgtcacaaagaataacagcaacagcaatggggcaccaaaaacagactcacggatataaatggaggtacgca

SEQ ID NO: 2416 - protein, 176 aa, Streptococcus agalactiae
MNEVWKDIPIVKGYYQVSNLGRVRSIGRTVNAKQRTRKTKGRILKQSLSSGYAIVTLSVNGLRKSIRVHRLVAEAFIPNPINKRTINHIDENKLNNRVDNLEWATDKENANHGNRTTKSSLGRCKPVEQFTLEGEFINTFDSIKSASMKTGISSQRITATAMGHQKQTHGYKWRYA

SEQ ID NO: 2417 - DNA, 297 bp, Streptococcus agalactiae
atggaggtacgcataatgaatgatctaatgattcaaatgcttgaccagttcgaagctggtctaatggacagaacgatgaaagtaatgcacgttgtgacagacgaaaagtatagatttcctttagaactcaacaagtctcaatgcgctttaatgctcttaggtactaaagatactgggacatttgatgaacgctttaactgtcataaggattttccgaggattccaaatgctcgtgagaaataccctcgtgatgaagtcattgaatggtatcacaagaattggcaaagaactgttatc

SEQ ID NO: 2418 - protein, 99 aa, Streptococcus agalactiae
MEVRIMNDLMIQMLDQFEAGLMDRTMKVMHVVTDEKYRFPLELNKSQCALMLLGTKDTGTFDERFNCHKDFPRIPNAREKYPRDEVIEWYHKNWQRTVI

SEQ ID NO: 2419 - DNA, 261 bp, Streptococcus agalactiae
ttggcaaagaactgttatctaagaaagaacaaaaggaactatatcatgaacaatttacaaattatcgcagtaggcacacttatttcagtaaccctgattgagtctcttatctcaaatatcaagctcagaaaagctctcaagaacaaacagacagctgggactgtcattgctcaatatatcccacaacgaggcttcattgactacaagactggaagacgtgttgacattgaccctgaaacaaagaaagaagtctttgttgac

SEQ ID NO: 2420 - protein, 87 aa, Streptococcus agalactiae
MAKNCYLRKNKRNYIMNNLQIIAVGTLISVTLIESLISNIKLRKALKNKQTAGTVIAQYIPQRGFIDYKTGRRVDIDPETKKEVFVD

SEQ ID NO: 2421 - DNA, 1329 bp, Streptococcus agalactiae
atggatgaattaaaagtattgcctcacgatatccaggctgagcagtcggttcttggttcaatttttatcaaacctgaaaaaatgattgaggtggctgagtatctgaaaccaaatgacttttacaggccagctcacaagattctatttaaggccatggtgagccttgctgatcgtggcgaggccatcgatattgtcacaatcaagtcaacgctggaaagtacggatgaacttggcatggttggcggtatcagctacatcgctgagattgttaatgcagtgccaaccagctcacacgctgagcattatgccaagattgttgctaaaaaagcacagctacggtctatcattgacaacttgtctgactcaattggcaatgcctatgatgaggacatggatattgatgagattatcgcaaaagctgagcgatcacttatcgaagttagtcaagccagtaacaagagtagtttcagacctatccatgatgtccttttggaaaatcattcaaagattgaggaacgctcaaacaataccagtcaaatcactggtattgaaacaggattttatgactttgacaagctgataacaggcttgcatgaagaccagctaattgtcttagcggcacggccagcgatggggaagacagccctagctcttaacatagctcagaatgtggcaactaagtccaataaggctgtggccgtcttctcgcttgaaatgggggctgaaagccttgttgagcggatgttgtcagctgaaggaacaatcatcaaccatcatattagaacaggaaatttgacggttaatgagtggcaacgtcttatctatgcacagggtcagcttgctgaagctccaatctttatagatgacacagctggagtcaagattactgacatcagagcaagagctaggaggctatctcaagagactgacggacttggattgatagtcattgactatcttcaactcattcaagggtcacggtctgacaaccgacagcaagaggtatctgagatttctaggcagttaaagattattgccaaggaattaaaagtgccagtcattgcactatcacagcttagccgtggggttgagcaaagaaacgacaaaaggcctatcatgtccgacttaagggaatcaggcagcattgagcaagacgctgatattgtcgccttcctctatcgtgatgcttattaccaagacaaaaaagaaggtcagccagaaaacgacatcactgagctgatcatcagaaagaacagacacggaaaccttggcacagtcaagctgtatttccacaaggaatataccaagttttctagcgttgaggaggaa

SEQ ID NO: 2422 - protein, 443 aa, Streptococcus agalactiae
MDELKVLPHDIQAEQSVLGSIFIKPEKMIEVAEYLKPNDFYRPAHKILFKAMVSLADRGEAIDIVTIKSTLESTDELGMVGGISYIAEIVNAVPTSSHAEHYAKIVAKKAQLRSIIDNLSDSIGNAYDEDMDIDEIIAKAERSLIEVSQASNKSSFRPIHDVLLENHSKIEERSNNTSQITGIETGFYDFDKLITGLHEDQLIVLAARPAMGKTALALNIAQNVATKSNKAVAVFSLEMGAESLVERMLSAEGTIINHHIRTGNLTVNEWQRLIYAQGQLAEAPIFIDDTAGVKITDIRARARRLSQETDGLGLIVIDYLQLIQGSRSDNRQQEVSEISRQLKIIAKELKVPVIALSQLSRGVEQRNDKRPIMSDLRESGSIEQDADIVAFLYRDAYYQDKKEGQPENDITELIIRKNRHGNLGTVKLYFHKEYTKFSSVEEE

SEQ ID NO: 2423 - DNA, 1374 bp, Streptococcus pyogenes
ttggaggttatgaggttgcctgaagtagctgaattacgagttcaaccccaagatttactagcagagcaatctgttcttgggtcaatctttatctcacctgataagctgattgcagtgagagaatttatcagtccagacgatttttataagtacgctcataaaattatctttcgggcaatgattaccctcagcgatcgtaatgatgccattgatgcaaccactataagaacaatcctagatgatcaagatgatctgcaaagtattggtggcttatcctatattgttgaactagttaatagtgtcccaactagtgctaatgcagaatattatgctaaaattgtagctgagaaagctatgttgcgtgatattattgctaggttgacagaatctgtcaacctagcttatgatgaaattttaaaaccagaagaggttatcgctggagttgagagagctttaattgaactcaatgaacatagtaatcgtagtgggtttcgcaaaatttcagatgtgctaaaagttaattacgaggctttagaagcacgttctaagcagacttcaaatgttacaggtttaccaactggttttagagaccttgacaagattacaacaggtttacacccagatcaattagttattttagctgctcggccagcagtggggaagactgcctttgttcttaatattgcgcaaaatgtggggactaagcaaaaaaagactgttgctattttttctttggaaatgggtgctgaaagtttagtagatcgtatgcttgcagcagaaggaatggttgattcgcacagtttaagaacagggcaactcacagatcaggattggaataatgtaacaattgctcagggagctttggcagaagcaccgatttatattgacgatacgcccgggattaaaattactgaaatccgcgcaagatcacggaaattgtctcaagaagtggatggtggtttaggtctcattgtaattgactacttacagttgattacaggaactaaacccgaaaatcgtcagcaagaggtttcagatatttcaagacagcttaaaatcctagctaaagaattgaaagtaccagttattgccctaagtcagctttctcgtggcgttgagcaaaggcaagataaacgaccagttttatcagatattcgtgaatcaggatctattgagcaggatgccgatattgtagccttcttataccgggacgattattaccgtaaagaatgtgatgatgctgaagaagctgttgaagataacacaattgaagttatcctcgagaaaaatagagctggggcgcgtggaacagtcaaactgatgttccaaaaagaatacaacaaattctcaagtatagcccagtttgaagaaaga

SEQ ID NO: 2424 - protein, 458 aa, Streptococcus pyogenes
LEVMRLPEVAELRVQPQDLLAEQSVLGSIFISPDKLIAVREFISPDDFYKYAHKIIFRAMITLSDRNDAIDATTIRTILDDQDDLQSIGGLSYIVELVNSVPTSANAEYYAKIVAEKAMLRDIIARLTESVNLAYDEILKPEEVIAGVERALIELNEHSNRSGFRKISDVLKVNYEALEARSKQTSNVTGLPTGFRDLDKITTGLHPDQLVILAARPAVGKTAFVLNIAQNVGTKQKKTVAIFSLEMGAESLVDRMLAAEGMVDSHSLRTGQLTDQDWNNVTIAQGALAEAPIYIDDTPGIKITEIRARSRKLSQEVDGGLGLIVIDYLQLITGTKPENRQQEVSDISRQLKILAKELKVPVIALSQLSRGVEQRQDKRPVLSDIRESGSIEQDADIVAFLYRDDYYRKECDDAEEAVEDNTIEVILEKNRAGARGTVKLMFQKEYNKFSSIAQFEER

SEQ ID NO: 2425 - DNA, 666 bp, Streptococcus agalactiae
ttggcacagtcaagctgtatttccacaaggaatataccaagttttctagcgttgaggaggaatgaaatgaaaaaatttgaccactatttcagcaaccatattgctgtaaaaaacgaatctgatacagtcaccattgttgactattacaatccagaaaagggctatgagtataacttacgttacattttcgatagaaaaaattcatcccttgctatcacaggagactttggggaattagttgcacgaaatttctacaatatgggtgaatgggacacattctacaatcactatactggtcatctggggtattttcttgaaaagttactatgttcaagtaggccagttcattactatgatactgacaaggctaaaagagaaattctcaatgaattctttgatggtgctgattatgatgatttagattttgatgatgaattcctacttgatcaattatttgacaattttgacgaagataaaggatttacttatattcttccagaggcttttgaacgttttagcgaagatatggaagaatatgaggtctatgaatttctatcaagggctggccgatacgtcaatgatgtctttgaactttacttagacgcttataagagagcttatgagtatctaacaaaggaggttgatgatggcacaacgcagaatgtt

SEQ ID NO: 2426 - protein, 222 aa, Streptococcus agalactiae
MAQSSCISTRNIPSFLALRRNEMKKFDHYFSNHIAVKNESDTVTIVDYYNPEKGYEYNLRYIFDRKNSSLAITGDFGELVARNFYNMGEWDTFYNHYTGHLGYFLEKLLCSSRPVHYYDTDKAKREILNEFFDGADYDDLDFDDEFLLDQLFDNFDEDKGFTYILPEAFERFSEDMEEYEVYEFLSRAGRYVNDVFELYLDAYKRAYEYLTKEVDDGTTQNV

SEQ ID NO: 2427 - DNA, 96 bp, Streptococcus agalactiae
ttgaaagcggtcagactggatatagttgtgaatccgccaatgacggataacgactacaccactatcaaagggaatcaagaacccttttgcaatcag

SEQ ID NO: 2428 - protein, 32 aa, Streptococcus agalactiae
MKAVRLDIVVNPPMTDNDYTTIKGNQEPFCNQ

SEQ ID NO: 2429 - DNA, 750 bp, Streptococcus agalactiae
ttgatgatggcacaacgcagaatgtttagtagaaaaatcactgagactgaccgttttttggaaatgccactatcatcccaagctctctatttccatttgaacatgggagctgatgatgagggctttatagataaggcaaagacgattcagagaactattggcgctagtgatgatgatatgaaattactgattgcaaaagggttcttgattccctttgatagtggtgtagtcgttatccgtcattggcggattcacaactatatccagtctgaccgctttcaatcaaccttataccagtcagaaaaggctcagctagagtatgacaagtcaaaaacagctagtcttaaacctattggaaattgtatacaaaatgtatccaaaatggagacacaggttaggttaagtaagggtagcttagataaggatagcttaactacctatcctacagtttcagacaatgaggaagaagatattccatacaaggaaattatttcttacttgaatgaaaaagctaatagaaattacagacctaacattcagaaaaacaaaactcttatcaaggctagatggtcagaaggattcaggttagatgatttcaaacatgtgattgataccacggtcaaggattggtcaggcactaagtatgaaaagtatctcagacctgaaacgctctttggttctaagtttgaaggctatttgaatcaagcaccacgaatcaagacggaaacaattgacggaaggttgggcttt

SEQ ID NO: 2430 - protein, 250 aa, Streptococcus agalactiae
MMMAQRRMFSRKITETDRFLEMPLSSQALYFHLNMGADDEGFIDKAKTIQRTIGASDDDMKLLIAKGFLIPFDSGVVVIRHWRIHNYIQSDRFQSTLYQSEKAQLEYDKSKTASLKPIGNCIQNVSKMETQVRLSKGSLDKDSLTTYPTVSDNEEEDIPYKEIISYLNEKANRNYRPNIQKNKTLIKARWSEGFRLDDFKHVIDTTVKDWSGTKYEKYLRPETLFGSKFEGYLNQAPRIKTETIDGRLGF

SEQ ID NO: 2431 - DNA, 819 bp, Streptococcus agalactiae
atgaatccttttaagaattttgaaactaggcaagtcttggaagaaacctgcgaggttcacggttgccagctctggctgactaaagtaccgattaagggacggcttgaagaactcaagcagtgtccagagtgtaccaaggccgctatcaacatctttgaaaataagttgaacagtcagagcaaaatcaacagcaagcttgctgatacatatgctgtctttgaaagagatagcttggtatcagataagctgagggctaagagtcttgagaactatgaaatcaaggatgaaattgaccagcatgctatcaattatgccaagcgtatggaacagttctaccgacaggatagaacaggcaatgccattattactggcccttctggtgttggcaaaagtcatctgacttacggcttggccaagttcatgaacgaacaattcaaagcctacgaatcaccaaaatcagttctttttatctcactggtgagcctttttaccaaaataaaagaaagcttcaaggttgacaatgggtacagacaggctgacatgattgagctgctaactagggtggactacctctttctggacgatttgggcaaggagagtcgcaaaggcgacagccagaacaatgagtggacacatcagattctctatgagattttggacaatcggagcaacacaatcatcaacactaacctgagtagtaaggagattaaggccttgtatgctgacaattatggcaacggtgctttgtctagtcggattcttgagggtgtgactggaaatagctttgcttatccgaaggatatggaagataggaggtat

SEQ ID NO: 2432 - protein, 273 aa, Streptococcus agalactiae
MNPFKNFETRQVLEETCEVHGCQLWLTKVPIKGRLEELKQCPECTKAAINIFENKLNSQSKINSKLADTYAVFERDSLVSDKLRAKSLENYEIKDEIDQHAINYAKRMEQFYRQDRTGNAIITGPSGVGKSHLTYGLAKFMNEQFKAYESPKSVLFISLVSLFTKIKESFKVDNGYRQADMIELLTRVDYLFLDDLGKESRKGDSQNNEWTHQILYEILDNRSNTIINTNLSSKEIKALYADNYGNGALSSRILEGVTGNSFAYPKDMEDRRY

SEQ ID NO: 2433 - DNA, 1314 bp, Streptococcus agalactiae
ttgatgaaatttttagacctctttgctggcattggtggttttcgccttggaatggagcaagctgggcatgagtgcataggattctgtgaaataaataaatttgctagagctagctacaaagtaatacatgatactgaaggagaaattgaactacatgacatcacaagagtttcagatgagtttattcgaggaatcggaagtgtggacgttatctgtggcggatttccgtgccaggctttctcaattgctggaaatagacgaggttttgaagatacacgaggaactttgttctttgaaattgctaggttcgcatctattctcagacctaagtatctattccttgagaacgttaaaggactcctcaaccacgaagggggggctacattcgagaccatcatcagaaccttggatgaattggggtacaacgtggaatggcaaatctttaacagcaagaattttggagtcccccagaatagggaacgagtgtttattatcggacatcttagaggagaaggtaccagaccaatttttcctttcgaatcaagcatcacagaaaattatcctatccacaccagaaaaataggaaatgttaatccatctggtaatggaatgaatggggaagtgtatgattcggaaggtttatctccaactctaacaacaaataagggagaaggagttaaaatcgctgtaaatgttgtaggcagattacctgggaaatttgaaatgccaaatagagtctacgatccagatggcctagcaccgactatcagaactatgcaaggtggagggttagagccaaaaataattcagcgaggcagaggctataatcagggaggagaatatgaaatttctccaactgtcacatgcaacagttggcaagaaaacaatcttttaaagataaaagaagccactaaaaaaggctattcagaggcagaggctggcgattcagtaaacttatctcacccaaattctgagacaagacgtggacgagttggtaaaggtattgccaatactctcttgactggagaagaacaaggtgtggttgtttatgacttgtacaacagaagaaagaaagatattgttggcactttaacagctagcggtcataacggtaatactactacgggtacttttggtatctctaacggatttagaatcagaaagcttacacctcgtgagtgttggaggctacaaggcttccctgactgggcttttgacaaggcgagtcaggtcaatagcaacagtcaattatataaacaagctggtaatagcgtaacagtaaacgtcattgctgcaattgcaaggagattgcta

SEQ ID NO: 2434 - protein, 438 aa, Streptococcus agalactiae
MMKFLDLFAGIGGFRLGMEQAGHECIGFCEINKFARASYKVIHDTEGEIELHDITRVSDEFIRGIGSVDVICGGFPCQAFSIAGNRRGFEDTRGTLFFEIARFASILRPKYLFLENVKGLLNHEGGATFETIIRTLDELGYNVEWQIFNSKNFGVPQNRERVFIIGHLRGEGTRPIFPFESSITENYPIHTRKIGNVNPSGNGMNGEVYDSEGLSPTLTTNKGEGVKIAVNVVGRLPGKFEMPNRVYDPDGLAPTIRTMQGGGLEPKIIQRGRGYNQGGEYEISPTVTCNSWQENNLLKIKEATKKGYSEAEAGDSVNLSHPNSETRRGRVGKGIANTLLTGEEQGVVVYDLYNRRKKDIVGTLTASGHNGNTTTGTFGISNGFRIRKLTPRECWRLQGFPDWAFDKASQVNSNSQLYKQAGNSVTVNVIAAIARRLL

SEQ ID NO: 2435 - DNA, 330 bp, Streptococcus pyogenes
atgagagatatgaagtttttagatttgtttgcaggaattggaggctttcgattgggtttaattaatcagtgccatgagtgtattggcttttgtgagattgataagtttgcgaggcaatcttacaaagccatctatgagaccgaaggagaaatagaatttcatgacattagacaagtcacagaccaagactttagacaacttagagggcaagtggatatcatctgcggtggtttttcccttgtcaagcattttcactcgcaggcagacgactgggatttgagggcactaggagaactctcttctttgagattactcgagcgaccaaacaga

SEQ ID NO: 2436 - protein, 110 aa, Streptococcus pyogenes
MRDMKFLDLFAGIGGFRLGLINQCHECIGFCEIDKFARQSYKAIYETEGEIEFHDIRQVTDQDFRQLRGQVDIICGGFSLVKHFHSQADDWDLRALGELSSLRLLERPNR

SEQ ID NO: 2437 - DNA, 402 bp, Streptococcus agalactiae
atgacctatgaagctacattcatgctatatggttacaaagctgttccaattggccagtttgaatctaaggagttggctgcccaagcaattattgaccatatcattgagaactctggcatacatagaccaagggtagttgcaacaatgaaaatacggagcaaggaaatcagaattgattatggttctaaaacttgctactacttgattactttaattaaaaaaaaacggaggaaaaacaaaatgagcaataatattgactataagcagggctatcgtgatgctatacagtttgccatctcagaaatcaatgaaagtgcagacaattttcttatcgatgaaaaagaggctgatagaatcaacgaaaatctaaaaacaatattaagaaaggtttatcaaaatgac

SEQ ID NO: 2438 - protein, 134 aa, Streptococcus agalactiae
MTYEATFMLYGYKAVPIGQFESKELAAQAIIDHIIENSGIHRPRVVATMKIRSKEIRIDYGSKTCYYLITLIKKKRRKNKMSNNIDYKQGYRDAIQFAISEINESADNFLIDEKEADRINENLKTILRKVYQND

SEQ ID NO: 2439 - DNA, 489 bp, Streptococcus agalactiae
atgactaaaacaatgacacttgaagagaaggttgaacagtggtttattgaccgtaacttacacgaggcaaatcctgtcaagcagtttcagaagctgattgaggaaactggggagctttactctggtattgcaaagggtaagagtgaaatcatccgtgattcacttggggacatgcaagttgtcctgattggcattgaacaacaaatcaagaacggtgctcagattgaagcaagtccacaagatatggagctgttgctacttgcttcaagtttgggggagatggctcagaaactctacaagcatatcttccacaacgaaacaaaaacaccgcttatccgtccagaacttagcttgcttcactctaatattcattccattgcaatccacaatctgacaacggctgatgattgcttggctattgcctatgaagaaatcaaggacagaaaaggcaagttaatcaatggaatttgggttaaagaggaggatttg

SEQ ID NO: 2440 - protein, 163 aa, Streptococcus agalactiae
MTKTMTLEEKVEQWFIDRNLHEANPVKQFQKLIEETGELYSGIAKGKSEIIRDSLGDMQVVLIGIEQQIKNGAQIEASPQDMELLLLASSLGEMAQKLYKHIFHNETKTPLIRPELSLLHSNIHSIAIHNLTTADDCLAIAYEEIKDRKGKLINGIWVKEEDL

SEQ ID NO: 2441 - DNA, 327 bp, Streptococcus agalactiae
atgaaaaacctgaattgggaagaattcttcaacaatctcaaggcttttgctagtgccatcatcatcactgtatttgtttttggattcaactatctgttttatgatattggctaccagaaaggccatcaggaagctgacagggtgattatctatgtggctgacaatgctggcgctgaaatgtttggcaaaatcactgataaagaaatcattgaaggccgtcacacagttacagctggcgcttatggcaagttcttggttactgaggaacaatacaatgaaattactgttggtgatgacattcctgactatttgaaaggacgtggaaac

SEQ ID NO: 2442 - protein, 109 aa, Streptococcus agalactiae
MKNLNWEEFFNNLKAFASAIIITVFVFGFNYLFYDIGYQKGHQEADRVIIYVADNAGAEMFGKITDKEIIEGRHTVTAGAYGKFLVTEEQYNEITVGDDIPDYLKGRGN

SEQ ID NO: 2443 - DNA, 354 bp, Streptococcus agalactiae
atgacaaaatgtgattttatgacaaaacggctcaatattctaaatgatgaagatgaggaaatgaagaaactcattgaacaaggctacacaaagatagaaagtgagctaggtaagataactggattcagaatcttgcatgacaatgtaaactatcctagccattatcaagggaaatacggtttagagtcaattgatgttctcaggaactttatgacccctgaaatgctcaaaggattttatctaggaaatgccctaaagtaccaactacggtaccgaaagaaaaacggccttgaagacctcaaaaaagcaagaaagaaccttgactggttgattgaagaaatggagaaagagaaa

SEQ ID NO: 2444 - protein, 118 aa, Streptococcus agalactiae
MTKCDFMTKRLNILNDEDEEMKKLIEQGYTKIESELGKITGFRILHDNVNYPSHYQGKYGLESIDVLRNFMTPEMLKGFYLGNALKYQLRYRKKNGLEDLKKARKNLDWLIEEMEKEK

SEQ ID NO: 2445 - DNA, 204 bp, Streptococcus agalactiae
atgaaaaaatcaataggaatccttgaatttaaagaatttgatgcttttgttggtggaaaggttatgcctgtctatcttcatagtgctaacccaaacgtgccaacgactaataaaaatgaggctatgagggttaccaaaaagagatacagaaaagagttctctgacaagtacattttcagaaaggttggtgaggttgatgatcaa

SEQ ID NO: 2446 - protein, 68 aa, Streptococcus agalactiae
MKKSIGILEFKEFDAFVGGKVMPVYLHSANPNVPTTNKNEAMRVTKKRYRKEFSDKYIFRKVGEVDDQ

SEQ ID NO: 2447 - DNA, 426 bp, Streptococcus agalactiae
ttggtgaggttgatgatcaataatgttgtacttattggccgcttgacaagagatgttgagctacgttacacgccgtcaaacatcgcaaacgctacttttaacctagcagtcaatcgaaatttcaagaatgctgctggtgatcgtgaagctgatttcatcaactgtgtgatgtggcgacaacaagctgaaaacttggccaattggacgaaaaaaggaatgctgattggtattactggacgaatccagacaagaagctacgaaaatcagcaaggtcagcgtatctatgtgactgaggttgttgctgacagcttccagattcttgaaaagcgtgataattcaacgaaccaggcaagcatggatgaccaattgccaccatcatttggaaatagtcagcctatggatatttcagatgatgatctaccgttt

SEQ ID NO: 2448 - protein, 142 aa, Streptococcus agalactiae
MVRLMINNVVLIGRLTRDVELRYTPSNIANATFNLAVNRNFKNAAGDREADFINCVMWRQQAENLANWTKKGMLIGITGRIQTRSYENQQGQRIYVTEVVADSFQILEKRDNSTNQASMDDQLPPSFGNSQPMDISDDDLPF

SEQ ID NO: 2449 - DNA, 264 bp, Streptococcus agalactiae
gtgcttatgaacgaatataagaaacccacctacatcgtcattcaagaggcaatggctgagcgtattagatttcttgaagatgaattatataacagagcatacaaagacattgaacggctagaagttgagaatgaccgtctgaaggttagatgccttgatttgcagttggaaaatgctgactatgtctgggatgacatgtgtcgctctgctattgctcgtgcaaaatcagaaaatcgaagaccacacagaagatggaggggaaga

SEQ ID NO: 2450 - protein, 88 aa, Streptococcus agalactiae
MLMNEYKKPTYIVIQEAMAERIRFLEDELYNRAYKDIERLEVENDRLKVRCLDLQLENADYVWDDMCRSAIARAKSENRRPHRRWRGR

SEQ ID NO: 2451 - DNA, 123 bp, Streptococcus agalactiae
ttgatttgcagttggaaaatgctgactatgtctgggatgacatgtgtcgctctgctattgctcgtgcaaaatcagaaaatcgaagaccacacagaagatggaggggaagatgaagttaaggct

SEQ ID NO: 2452 - protein, 41 aa, Streptococcus agalactiae
MICSWKMLTMSGMTCVALLLLVQNQKIEDHTEDGGEDEVKA

SEQ ID NO: 2453 - DNA, 357 bp, Streptococcus agalactiae
atggaggggaagatgaagttaaggcttgaagaactaagaaacaaacttggcctcagtcgcagagatgtgcatgaagccactggcatttctatgaacacgctgctacattatgaaaaaggcggtacaccatctattggtcaggttgaaaatatcgctaaggcttacaatatcaacccagcctggttgcttggttggattgatgaaggccagcaaccacaaccacttgaaaccgttgttgaaaagattatctatgtggaaaaggaaggctgtagattaccgccatattggaacaatgataataatggcagaatcatcaagtggaaagaatcaagaagagcattccaaaggagaacaatt

SEQ ID NO: 2454 - protein, 119 aa, Streptococcus agalactiae
MEGKMKLRLEELRNKLGLSRRDVHEATGISMNTLLHYEKGGTPSIGQVENIAKAYNINPAWLLGWIDEGQQPQPLETVVEKIIYVEKEGCRLPPYWNNDNNGRIIKWKESRRAFQRRTI

SEQ ID NO: 2455 - DNA, 462 bp, Streptococcus agalactiae
ttgacaaagaaaacagcaagtaagacaagacgtgatttccttgagtttgagcttgaggctaagtatctaaaaattgataaacttattgggcagcgccgtcatgaactggaaagaatctatgcagtcaaaaacctgacaatgccaggaatcgatgattcaggagctagtcgcagtggaacttcaactaatacttctgaaaatctagctgttgcttatgccagtgacccaatgattctgaaactggaagagttccaaaatgcgatatcagaattactagaggtacttgaacccgatgataagaaaattttccatctgaggtggggagaacatactggatatgattggattcaagtttggcacatcatggaaaatggcgagacaggttatctttacagacatagcaagcagatttatagaagacgtgaagtcatccttgatacacttgcaaaattattgttcatg

SEQ ID NO: 2456 - protein, 154 aa, Streptococcus agalactiae
MTKKTASKTRRDFLEFELEAKYLKIDKLIGQRRHELERIYAVKNLTMPGIDDSGASRSGTSTNTSENLAVAYASDPMILKLEEFQNAISELLEVLEPDDKKIFHLRWGEHTGYDWIQVWHIMENGETGYLYRHSKQIYRRREVILDTLAKLLFM

SEQ ID NO: 2457 - DNA, 540 bp, Streptococcus agalactiae
atgaatattgttgaaccgctacgagacaaagacgatatacaagccatgaaggactatctatcatcttggaatgaaaagtattacatgctatttcttttgggcatcaatacaggtttccgtgttggagatattctcaagctaaaggtcaaagatgtccaaggctggcacatcaaagttagggaacaaaagactggtaagtataaaagtattaagatgacaaggccactcaaaaacgaattgagggaatttgtcaaagacaaggaacttcatgagtatctatttcagagtcgtgtcggaaagaacaaggcgctcagttataagacggtttactggtttcttaaaagagctgctgaagacctcggcattgacaatgttggaactcatacaatgcgaaaaacctttggctatcattactacaagaagtacaagaacgttgctgacttgatgtcactattcaatcattcaagcccagcagttacactaatctacatttgtgtaaggcaagatgagcttgatactaagatgagtaattttagcctc

SEQ ID NO: 2458 - protein, 180 aa, Streptococcus agalactiae
MNIVEPLRDKDDIQAMKDYLSSWNEKYYMLFLLGINTGFRVGDILKLKVKDVQGWHIKVREQKTGKYKSIKMTRPLKNELREFVKDKELHEYLFQSRVGKNKALSYKTVYWFLKRAAEDLGIDNVGTHTMRKTFGYHYYKKYKNVADLMSLFNHSSPAVTLIYICVRQDELDTKMSNFSL

SEQ ID NO: 2459 - DNA, 285 bp, Streptococcus agalactiae
atgaaagatgaaaatgcatttgatggaattaggcttgaagctggtagcactttagaaatctatctcacgaagaacgacttagaacatattgcaaatggatatgaggtgactttagatattaagcctaacgagactgtaaataaaatcgtaataaagccaagttttgtaaataatattctaaatccgttaatcaactatgacaaaagaatagtgagtgaagcagatttaaagtttagagacatttcaagagaggttgcaagagatagttttgcattggggtcaatg

SEQ ID NO: 2460 - protein, 95 aa, Streptococcus agalactiae
MKDENAFDGIRLEAGSTLEIYLTKNDLEHIANGYEVTLDIKPNETVNKIVIKPSFVNNILNPLINYDKRIVSEADLKFRDISREVARDSFALGSM

SEQ ID NO: 2461 - DNA, 141 bp, Streptococcus agalactiae
atggggggagtccacaaaaattcaaaaataaaaaaatcaaaaataaatttatattccgattatctaaatttaaatttattttactttgaaaagtttttgtgttgtgacattcaagacaaagtaactgacagttctcttcgt

SEQ ID NO: 2462 - protein, 47 aa, Streptococcus agalactiae
MGGVHKNSKIKKSKINLYSDYLNLNLFYFEKFLCCDIQDKVTDSSLR

SEQ ID NO: 2463 - DNA, 111 bp, Streptococcus agalactiae
ttgtatcaattttcgtcaattttgggggagaggtacacaagaggattgacaccgttattattttggcgctgtcaaaattcaaaatggggggagtccacaaaaattcaaaaa

SEQ ID NO: 2464 - protein, 37 aa, Streptococcus agalactiae
MYQFSSILGERYTRGLTPLLFWRCQNSKWGESTKIQK

SEQ ID NO: 2465 - DNA, 501 bp, Streptococcus agalactiae
ttgatacaagaaaggagcatgattttgaaaatcaatgaagttttagaaaagctaggaataagtcgtgctacccttacaaggtatcgaaaaaagctgggcatatttgaagaaactaggtcaaatatcaccaaaagtcagttcaaagagttggaaaagcttgccaatcaacggcaaaagtacacaaggcaggaacgtgttgagctatctcgtaagactttcaagctgattccaaaagaaaaaatgcttgaaatcagtgataatgattcagttgggttgaaaaatctcaaaactcaatacaatcacaatcaaaaagtgattgaaaacttccagcttgaaatcaataaggtcatcaatgacggtgagctacctgataagtacctacttgatggaatggaaaagtatcaaaagcttaacatgcagatcatgtcaacgattgaaaagcaaagtccacagggtgacaggctcaaagaaatgattcaggagaagttagcacgttatggt

SEQ ID NO: 2466 - protein, 167 aa, Streptococcus agalactiae
MIQERSMILKINEVLEKLGISRATLTRYRKKLGIFEETRSNITKSQFKELEKLANQRQKYTRQERVELSRKTFKLIPKEKMLEISDNDSVGLKNLKTQYNHNQKVIENFQLEINKVINDGELPDKYLLDGMEKYQKLNMQIMSTIEKQSPQGDRLKEMIQEKLARYG

SEQ ID NO: 2467 - DNA, 1710 bp, Streptococcus agalactiae
atggttgagatgagatattttgataagtatgctcagctcatctatactggtaagattcgtatttgtaagctcacaatgaaatcaattagacgtgttgagcgatacaaagagcaatacctcttcaaacaggaggaagctgacaaacggattgagttcattgaggaagagtgcagcaatactaaaggccttgctggtaagttacgcttagcattaccacaaaaggtttggttagaaacaacgtggggcttttatcacacggttgaggttactaagaccaatcctgataccttggaagaatacacagattatgaagaaaggcgtctcattcatgaggtgcctattattgtgcctcgtggcacaggtaagactactcttggttctgctattgctgaggttggtcaaatcattgacggtgagtggggtgctgatattcagcttcttgcttacagtcgtgaacaggctggctatttgttcaatgcctcaagggcgatgttgtcgaatgaagaaagcttgctgcactatatgcgtgaggctgacatcctacggtcaaccaagcaaggtatcttgtatgaaacaactaacagtcttatgtctatcaagacttctgactatgaaagccttgacggtactaatgctcactacaatatctttgatgaggtgcacacttatgatgatgacttcatcaaggttgtgaatgatggttccagccgtaagcgtaagaattggataacctggtacatttccacaaatggaacgaagcgtgacaagctctttgataagtattacaacatctgggtagatatccttgatgacaagattatcaatgattctgtcatgccttggatttatcagttggacgatgtgtcagagattcatgaccctgatatgtggcagaaagctatgccattacttggtatcacgacagagaaagaaaccatcgctcgtgatattgagatgagcaagaatgatccagcacaacaagctgagctgatggctaagactttcaatcttcctgtcaacaactatcttgcttacttcagcaatgaagagtgtaaaggttggtcagataagtttgatgagagtttgtttgtcggagatgatgaacggaacgcccgttgtgtgattgggattgacttgtcagatgtcaatgacatctgctctatctcttttatggttgtgcgtggggaagaacggcactatctaaacaagaaattcatgccacggcataccattgagacattgccaaaggaactgcgtgataagtacactgagtgggaattaagtggcatgctgcatgtgcatgaattggactacaatgaccaagcctatatatttgaagagttacggcagtttatgagtgacaacagaattttgcctgtggcagtcggttatgaccgctacaatgcaagggaacttattcgcttgtttaacgactactacggggatatttgtcacgatattccccagacggtcaaatcgttatcaaatccgctcaaggtttacaaggagaaggctaagatgggcaaaatcatctttgatgatcctgtggcgacatggaatcatgccaacgtccgtgtcaaaattgatgccaataacaatatttttccaaacaaggaaaaggcaaaagaaaagattgatgtctttgctagtcagctagatgcctttatctgttatgaaaatttcaaggaagacttgagctactactttgat

SEQ ID NO: 2468 - protein, 570 aa, Streptococcus agalactiae
MVEMRYFDKYAQLIYTGKIRICKLTMKSIRRVERYKEQYLFKQEEADKRIEFIEEECSNTKGLAGKLRLALPQKVWLETTWGFYHTVEVTKTNPDTLEEYTDYEERRLIHEVPIIVPRGTGKTTLGSAIAEVGQIIDGEWGADIQLLAYSREQAGYLFNASRAMLSNEESLLHYMREADILRSTKQGILYETTNSLMSIKTSDYESLDGTNAHYNIFDEVHTYDDDFIKVVNDGSSRKRKNWITWYISTNGTKRDKLFDKYYNIWVDILDDKIINDSVMPWIYQLDDVSEIHDPDMWQKAMPLLGITTEKETIARDIEMSKNDPAQQAELMAKTFNLPVNNYLAYFSNEECKGWSDKFDESLFVGDDERNARCVIGIDLSDVNDICSISFMVVRGEERHYLNKKFMPRHTIETLPKELRDKYTEWELSGMLHVHELDYNDQAYIFEELRQFMSDNRILPVAVGYDRYNARELIRLFNDYYGDICHDIPQTVKSLSNPLKVYKEKAKMGKIIFDDPVATWNHANVRVKIDANNNIFPNKEKAKEKIDVFASQLDAFICYENFKEDLSYYFD

SEQ ID NO: 2469 - DNA, 1140 bp, Streptococcus agalactiae
atgaacaactatttgaaaaatttgaaggaggtttttgctaggattttccgtccaaacaatcggaaatctacaagaacctatcttcaaagaagtatctcctactggcgtaggaactccatctatttggataacatctacaataagatttcaactgacacagctcagttaaggtttaagcatgtcaagattactcgtaacccaggcggtgtcgattcgatggtttggtatgagcatagtgatttggctgaggtgctaacagtttcaccaaatccactagaagtgcctgttgtcttttggtcaaatgtaactagggctatgctgcgtgacggtgtggcggttgttgtaccacgttggaagaatggccgactggttgaaatatggcttgctaagaagacagtgacttggacagcagagagcgtggagcttatgcttgatgatgttgctgttgagcttcctcttactgatgtgtgggtatttgaaaatcctaagttgaatgtcacggctcaactcaatcagattactgagcttattgacattaacttgaatgctttgacagaaaagcttagcgatggcaattctagcttgagaggtttcttaaagctaccaactaaggcagctgatgaacatttgaagcaacaagccagggaccgtgttgatagtatgcttgacttggccaagaacggtggcattgcttatcttgagcaaggcgaagaattccaggaacttagcaaagactattctactgcttctaaggaagaattagagttcttgaaatcacagctttataatgctcatggtatcaatgagaaattatttacctgtgactatactgaggaacaatatagagcctactattctagcgtcatgaagttatatcagcgtgtctattctgaggagattaacagaaaatacttcacgaagacagcacggactcagggcaataagttactggtcttctttgatatggctgacatgatttcatttaaggatttggttgaaggtggcttcaagtccaaatatgctggattgatgaactcaaatgagttccgtgaaacctatcttggtttacctggctatgagggcggtgaagtatttgaaaccaacctgaatgctgttcgtatcggtgcagaagaatctgag

SEQ ID NO: 2470 - protein, 380 aa, Streptococcus agalactiae
MNNYLKNLKEVFARIFRPNNRKSTRTYLQRSISYWRRNSIYLDNIYNKISTDTAQLRFKHVKITRNPGGVDSMVWYEHSDLAEVLTVSPNPLEVPVVFWSNVTRAMLRDGVAVVVPRWKNGRLVEIWLAKKTVTWTAESVELMLDDVAVELPLTDVWVFENPKLNVTAQLNQITELIDINLNALTEKLSDGNSSLRGFLKLPTKAADEHLKQQARDRVDSMLDLAKNGGIAYLEQGEEFQELSKDYSTASKEELEFLKSQLYNAHGINEKLFTCDYTEEQYRAYYSSVMKLYQRVYSEEINRKYFTKTARTQGNKLLVFFDMADMISFKDLVEGGFKSKYAGLMNSNEFRETYLGLPGYEGGEVFETNLNAVRIGAEESE

SEQ ID NO: 2471 - DNA, 540 bp, Streptococcus agalactiae
atggaaaaactaaaaacctttgttgtgaagtcggttgaggatgaatcagctgactttcattttgaggcttacgcttcaacctatgacaatacagacagagaaggcgatgtgatggccaaggggtgttttgataacactctgaaatctaaggctgttgtccctatgtgtcttaatcatgaccgtaactgtgttattggtaagcatgaattgtctgtggatgaaaaaggcttgcgaacacgttcaacgtttaatcttagtgatccagaggctaagaaaacttatgacctcatgaaaatgggggcattggatagcctgagtattgggttctttattaaagattatgagcctattgacgctaagcaaccttatggcggatggattttcaaggaagttgaaatctttgaaatttctgttgtgaccgtgccagctaaccctcaagcaactgttgacaatattaaggaatttgatatgtcggcggttgataagcgaatcgctcaggcgaacatgaggcaagaaatcatgagtaaacttgcaaaaatt

SEQ ID NO: 2472 - protein, 180 aa, Streptococcus agalactiae
MEKLKTFVVKSVEDESADFHFEAYASTYDNTDREGDVMAKGCFDNTLKSKAVVPMCLNHDRNCVIGKHELSVDEKGLRTRSTFNLSDPEAKKTYDLMKMGALDSLSIGFFIKDYEPIDAKQPYGGWIFKEVEIFEISVVTVPANPQATVDNIKEFDMSAVDKRIAQANMRQEIMSKLAKI

SEQ ID NO: 2473 - DNA, 1284 bp, Streptococcus agalactiae
ttgcaaaaatttaaaggagacatgatgaaaaaatcactcattgagcttttggaagctcgtcaaaaagcaactgatgaactggctgaggtaaagcttaaaaaagccactattgaagcaaagatgaaatcttcaaccattgaagacgatgacttggaacagttaaaaactgatgcagaaagtttggtttctcaagcaacagctattaaggaaacaattgctgggctggattctgacattgaagaaactgaagaagaactcagcaaagctgctaaaatcattaaagaaaaacagaaaggtaatacacctatggattatttgaaaaccaaagccgctgctcttgactttgtccgtattctgatggacaacgaaggtagcgcaaacagtgcccgtaaagcgtgggaagctaaccttgttgaaaaaggagtgactaacctcactaagattcttccagaacctgttcttatcgctattcaagatgcctttactaactataatgggatcttgaaccacgtttcaaaagatccacgttatgcggtgcgtgttgctcttcaaactcaagtatctcaagctaaaggacacaaagctggtaagactaagaaagatgaagacttcacattcttggatttcactatcaactctgcgacagtttatatcaaatatgcctttgaatattctgacttgaagaaagatacaacaggcgcttacttcaactatgtgatgaaagaacttgctcaaggcttcatccgaactattgaacgtgctgttgtcattggtgatggaaaatctaacagtgctgaagacaaaatcactgaaatcaaatcaattgctgaagaaactgaagcgaatctctttgaaacacaagaaatcaatgttgctggtgtatttgacaatgctgttcttgaaacgctggttgctggtattgataagatggttccaaatactactccaattcttgtcacttcaaaagccattgctcgtaaattgaaattggtcaaagatgcagaaggtcgctacatcgatcctcaaccatttgctccaattgcaaccaacggaaatgttattgctggttttcaagtttacatctatgactggatggacggtgcaactaacccaatcattgcatttgctgaccaagcttataagatgattggtgatgaggctgccgctgaccgctttgatgattatgatgtaacagtcaaccgccgtcatattgagcttgctagtgttatgggtggtcgtttggctcagtacaaatcagcggttaagtttacaaacccagcaggt

SEQ ID NO: 2474 - protein, 428 aa, Streptococcus agalactiae
MQKFKGDMMKKSLIELLEARQKATDELAEVKLKKATIEAKMKSSTIEDDDLEQLKTDAESLVSQATAIKETIAGLDSDIEETEEELSKAAKIIKEKQKGNTPMDYLKTKAAALDFVRILMDNEGSANSARKAWEANLVEKGVTNLTKILPEPVLIAIQDAFTNYNGILNHVSKDPRYAVRVALQTQVSQAKGHKAGKTKKDEDFTFLDFTINSATVYIKYAFEYSDLKKDTTGAYFNYVMKELAQGFIRTIERAVVIGDGKSNSAEDKITEIKSIAEETEANLFETQEINVAGVFDNAVLETLVAGIDKMVPNTTPILVTSKAIARKLKLVKDAEGRYIDPQPFAPIATNGNVIAGFQVYIYDWMDGATNPIIAFADQAYKMIGDEAAADRFDDYDVTVNRRHIELASVMGGRLAQYKSAVKFTNPAG

SEQ ID NO: 2475 - DNA, 333 bp, Streptococcus agalactiae
atgacaatccttaaaacaatcaaagaaatggtagaagttgacgttgaagaggatatctttgacgtccaacttttacgatatatcaacagtgggatttcatatttacaaagaaatgctattcctgttatccgtatcgataaagaaacggagttagagggatggacagacattaaggaagaagatagggagacagtgcttgactggttacatctgagatgcgttcaacgttttgacaaatctttgatgacaggcagtgctgctactatggaatggattgacggagagatgacaaatcttttgtatcaactcaaggcaatctatgaagtgaagaca

SEQ ID NO: 2476 - protein, 111 aa, Streptococcus agalactiae
MTILKTIKEMVEVDVEEDIFDVQLLRYINSGISYLQRNAIPVIRIDKETELEGWTDIKEEDRETVLDWLHLRCVQRFDKSLMTGSAATMEWIDGEMTNLLYQLKAIYEVKT

SEQ ID NO: 2477 - DNA, 303 bp, Streptococcus agalactiae
atgaaatcttcaagagtagctatcattctttgctatgatgagcgtgttgaggttgaaaaaggtgtctgggagaaaaagaccgtagaaaagaaagtcaaagctgagaaagagaaaatctatcagcgaaggcttgataaagctatggcagacggtcaagttctgactgctaggtttagtgttcgttccaactatgtgactgacactcttgactatgtcaaatataatggcaaagagtacaaggttaacattgggacagaatcagatgatggtcattacactatcatcgaacttggagaactgaaa

SEQ ID NO: 2478 - protein, 101 aa, Streptococcus agalactiae
MKSSRVAIILCYDERVEVEKGVWEKKTVEKKVKAEKEKIYQRRLDKAMADGQVLTARFSVRSNYVTDTLDYVKYNGKEYKVNIGTESDDGHYTIIELGELK

SEQ ID NO: 2479 - DNA, 357 bp, Streptococcus agalactiae
ttgaggtgtttacaaatgggcggtggtagcgtgaagatgacaccgctaaaggtggatatcaagaatcaagttttagagaacattaagaaggctgcccaaagtacagaaaatgacattagaactggaagccctagacgaaacggtgtttacgaaaaaggttggacacacgacatcatagatgacgccgctgttgttcataataatggcaaagaaaaatctctatcccacctattagagaatggtcatgccactaaaaacggtggctttgttgcccctagagagcatatcagaccagcctacctcaagaataaggagaaattccttaatgatatgaaatccattaaaatcacacctaaa

SEQ ID NO: 2480 - protein, 119 aa, Streptococcus agalactiae
MRCLQMGGGSVKMTPLKVDIKNQVLENIKKAAQSTENDIRTGSPRRNGVYEKGWTHDIIDDAAVVHNNGKEKSLSHLLENGHATKNGGFVAPREHIRPAYLKNKEKFLNDMKSIKITPK

SEQ ID NO: 2481 - DNA, 681 bp, Streptococcus agalactiae
atgacttatcaatacgatacaagggaagtcactcacggtaatgcgaatggtttttatgccaaaattgctaaaactgatgctggtgccttagacttgcagaaaccttatccctttacagggctacgaagcacatcctttgaaacttctcaggaatcaaatgcctactatgcagacaatgtggaacatgttcgtttgcaaggtaaaaaatccacagaagggtctattacaacctatcagattcctaaacagtttatgattgatcacttaggtaaaaagcttacgaactctacaccaccagctttgattgatactggtgtcaatactaacttcatttggggttatgctgaaactgttacagatgagtttggagctgagattgaagagttccacatttggacgaacgttaaggcatctgcacctaaaggcagcacatcaactgatgaaacatcagcgacaccaaaagaaattgaaatcccttgtactgcctctccaaataacttcattgtggattctgaaaagaaacctgtatcagaaattgtatggcgtgatgacagcaaaggaaccgtccgtgggaagtttgacaagttgtttgctgacaagtcaccaggcaagctgattgatttcatcaatgaagcgcttggaacaaccactacacctaccacaactgttagcggaggctct

SEQ ID NO: 2482 - protein, 227 aa, Streptococcus agalactiae
MTYQYDTREVTHGNANGFYAKIAKTDAGALDLQKPYPFTGLRSTSFETSQESNAYYADNVEHVRLQGKKSTEGSITTYQIPKQFMIDHLGKKLTNSTPPALIDTGVNTNFIWGYAETVTDEFGAEIEEFHIWTNVKASAPKGSTSTDETSATPKEIEIPCTASPNNFIVDSEKKPVSEIVWRDDSKGTVRGKFDKLFADKSPGKLIDFINEALGTTTTPTTTVSGGS

SEQ ID NO: 2483 - DNA, 474 bp, Streptococcus agalactiae
atgattaaaaaagaactatcattcacagcgtttgatagttacggtgaagaaagagagcacactgaaacagtgcgctttctttactctttaccagctatcaagatgtatgaacagcgaactggtcgtaacttctttgatgacaaccaaaaagcacttacagcatatacacaacttgctcttgcaactggtgtaaactgtaacctatctgatttaactgatgaagagaaaatcaagatgatgcctctacttatggaacctgatttcatgaacttcttgactgaagtcattccttgcctttatggtgaggttgaaaatggacgtttagtacaaaatgagcttaccgctgaaacagcttcattagctccttggtttggtgatttgattgatattggtttcttctcagacctcttctatgaatttaaccgaagcagagcaaaggtgccgcaagataaaaaaaagcctcttcagaagttg

SEQ ID NO: 2484 - protein, 158 aa, Streptococcus agalactiae
MIKKELSFTAFDSYGEEREHTETVRFLYSLPAIKMYEQRTGRNFFDDNQKALTAYTQLALATGVNCNLSDLTDEEKIKMMPLLMEPDFMNFLTEVIPCLYGEVENGRLVQNELTAETASLAPWFGDLIDIGFFSDLFYEFNRSRAKVPQDKKKPLQKL

SEQ ID NO: 2485 - DNA, 126 bp, Streptococcus agalactiae
atggatgttttttgggcagaatcccaacactttaactatttgatgggaacgcttcaccaaatgagcatcaatcaggaagaaaagaaaaccttatccaacgctgatttacttagcgtgatgtcagat

SEQ ID NO: 2486 - protein, 42 aa, Streptococcus agalactiae
MDVFWAESQHFNYLMGTLHQMSINQEEKKTLSNADLLSVMSD

SEQ ID NO: 2487 - DNA, 168 bp, Streptococcus agalactiae
ttggacaaggaactagtaaagctagaccacaaagactgtccagttgagactactgaagaccaaaggccagaaagccaggcagtgaaatttgaccacgctgtggtggcagtcgtgactatgttagtccacaattcagaaagccaggcagcacaagaatcccacgttgac

SEQ ID NO: 2488 - protein, 56 aa, Streptococcus agalactiae
MDKELVKLDHKDCPVETTEDQRPESQAVKFDHAVVAVVTMLVHNSESQAAQESHVD

SEQ ID NO: 2489 - DNA, 2733 bp, Streptococcus agalactiae
atgactgaaacgtttgaaggcttatacgtcaaatttggtgctaatactgttgaatttgataggtctgtaaaaggtatcaacactgccttatctagtttgaaaaaagacttcaataacatcaacagacaattgaagatggatccagacaatgttgacttgttgaatcgtaagttggttaacttgcaagaacaggctcgtgttggtgctataaaaattgctgaactcaaaaagcaacagaaggcactgggagaatctgaagttgggtcagcacagtggaataagcttcaacttgaaattgctaaggttgaatcacagatgaagattgttgataaggcaatggagtcaacaaagaaacacattgaagatgtaggagacccaaagtctattctgaatcttaacaaagaacttgataatgttgctaaagagcttgatattgtcaatcaaaagcttgagctagaccctgacaatgtcgaactagcagagcaaaaaatgaaactacttggcaaacagtcggaattggctggggataaagtccaagaattaaagaaaaaacaagctgcccttggcgatgagaaaataggtacagaagaatggcgtcaacttcaaaatgaaatcggtcaagctgaagttgaagttctaaagattgaccgtgcaatggacattcttggtgagtcaagccgttctgcaactggagacatcaaagaggcaaccagctatttaagagctgatgtcatgatggatgttgcagataaggctggtcagattggccagaaaatggttgacgctgggaaaatgacagtagatgcttggtctgagatagatgaggctctggacaccgtcacaaccaaaactggtctgactggtgatgccttagcagagcttcaggaaattgctaaagacattgctactggtatgcctaccagctttcagaatgctggtgatgccgttggggaattgaatactcagttcggtttgactggggaaaagctgaaatcagcatctgaattacttatcaagtatgctgagattaacgaaacagacatttcaagctctgccatttctgcaaaacaagctattgaagcttacggtttgacagctgaagacttgggaatggtcttagacaatgtgaccaaagccgctcaagatacaggacagtcagttgacacgattgttcaaaaagccattgacggtgctcctcagattaaaggtttgggactttcttttgaagaaggtgctgcactgatcggtaagtttgagaaaagcggtgtggattcatctgctgctctatcctctctatcgaaagctgctgtcatctatgctaaagacggtaagactctgacagatggattgaatgagactgttagtgctattcaaaattctactagtgagacagaggctttaagtattgcctcagaaatctttggtagtaaggctgctcctagaatggtcgatgctattcagcgtggtgcttttagctttgatgacttagctgaagcagctaaaagttcctctggtactgtctccaccacatttgatgagacgcttgacccaatagataagttgactcagtattctaaccaagcaaaagagggaatggcagaacttggcggtaaattgcttgagactgtcatcccagctttagaacctttgatgggtatgcttgaatcttctgtcaattggtttactagcctaaacgaaactgatcaacagactatcgtgattcttggcctagttacaactgctgtgatgatgttgcttggtgcaattgcaccgctggtcatcgccataggggcaataggtgcgcctgtcggaattgtagtggcggcaatagtaggggctattgccgtcataacacttatcatccaagcaatcatgaactggggagccataactgaatggcttcagtcaacgtgggattcttgtgctgcctggctttctgaattgtggactaacatagtcacgactgccaccacagcgtggtcaaatttcactgcctggctttctggcctttggtcttcagtagtctcaactggacagtctttgtggtctagctttactagttccttgtccaatattttctcaagtttgattacaggtgctcagtctctgtggtcaagtttcacttccactctttccaatttgtggtctggactggtctcaactgggtcaaatttgtttaataatttgagtagcacgatttcaggaatttttaatgggatactttcaacagcaagcaatatttggaattccataaaatccactatttccaatgcaatagatggggcgaaaaatgcagtgtccaacggggtcaatgccatcaagaatctgtttaacttccagattaaatggcctcatattccactacctcacttccgtgtgagtggttctgctaaccctctggattggctaaaaggtggcttaccaagtatcggcattgactggtatgccaagggcggtatcatgaccaaaccaaccctatttggcatgaatggaaaccgtgcaatggttggcggtgaggctggcgctgaagccatcttgccattgaataagtcaaccctgggggcaattggtcaaagtattgctaacacgatgaatacatcgaacaatattaacgttaacttctctggcgtcactatcagggaagaagctgaccttaacagactagccaacgtggttggaaatcgtattgctgaagaattgcaacgtaaaactaatttgagaggaggaatggca

SEQ ID NO: 2490 - protein, 911 aa, Streptococcus agalactiae
MTETFEGLYVKFGANTVEFDRSVKGINTALSSLKKDFNNINRQLKMDPDNVDLLNRKLVNLQEQARVGAIKIAELKKQQKALGESEVGSAQWNKLQLEIAKVESQMKIVDKAMESTKKHIEDVGDPKSILNLNKELDNVAKELDIVNQKLELDPDNVELAEQKMKLLGKQSELAGDKVQELKKKQAALGDEKIGTEEWRQLQNEIGQAEVEVLKIDRAMDILGESSRSATGDIKEATSYLRADVMMDVADKAGQIGQKMVDAGKMTVDAWSEIDEALDTVTTKTGLTGDALAELQEIAKDIATGMPTSFQNAGDAVGELNTQFGLTGEKLKSASELLIKYAEINETDISSSAISAKQAIEAYGLTAEDLGMVLDNVTKAAQDTGQSVDTIVQKAIDGAPQIKGLGLSFEEGAALIGKFEKSGVDSSAALSSLSKAAVIYAKDGKTLTDGLNETVSAIQNSTSETEALSIASEIFGSKAAPRMVDAIQRGAFSFDDLAEAAKSSSGTVSTTFDETLDPIDKLTQYSNQAKEGMAELGGKLLETVIPALEPLMGMLESSVNWFTSLNETDQQTIVILGLVTTAVMMLLGAIAPLVIAIGAIGAPVGIVVAAIVGAIAVITLIIQAIMNWGAITEWLQSTWDSCAAWLSELWTNIVTTATTAWSNFTAWLSGLWSSVVSTGQSLWSSFTSSLSNIFSSLITGAQSLWSSFTSTLSNLWSGLVSTGSNLFNNLSSTISGIFNGILSTASNIWNSIKSTISNAIDGAKNAVSNGVNAIKNLFNFQIKWPHIPLPHFRVSGSANPLDWLKGGLPSIGIDWYAKGGIMTKPTLFGMNGNRAMVGGEAGAEAILPLNKSTLGAIGQSIANTMNTSNNINVNFSGVTIREEADLNRLANVVGNRIAEELQRKTNLRGGMA

SEQ ID NO: 2491 - DNA, 3633 bp, Streptococcus pyogenes
atgggagaatcttattctgttgaagcggttttgacagctgttgataaaacctttggcaaaacattacaatcggcaatccgttcaatcgatggcttggaaaagcgttcaaccggtttttcatcggtgtctcaaaaagctagttccatgtttaaatccatgttaggagcgaatttagccggacaagctatctcagcaatgacaaggacagtgtcatcaggccttggctctatgcttggcgagatgaatagttcagcgaaagcgtggaaaacttttgacgccaatttagcggacattgggtttggaaaaaaacaaattttggcagctaaaacggcgatgcaagactatgcaactaaaacaatctactcggcatcagatatggctagcacgtatgcacagttagcggcagttggtgtgaaagataccggaaagctcgtaaaagcttttggcggtttagctgcatctgctgaaaacccgaagcaggccatgaagtctatcagtcaacaaatgacgcaagcagtaggaagaccaacagttgcatggcaagactttaggataatgctggaacaggcgcctgcagggatggctaaagtcgctaaatctatgggtaaaaatcttgatgaactcgtcgccgatatccaggcgggtagggttaaaaccagcgattttttggaagcggtaaaaaaagcaggcaatgataagagtttccaaaagatggcaactgagttcaaaactgttgaccaagccatcgacggtatgcgagaaggcttatccaacaaattgcaaccagcgtttgaaaaagtgaaccaatttggaattagagcgatcgaagcaatcggtaaacaactcgataaagttgatttttctaagtttgctagtaatcttgggaaattccttgaaggaattaatatcgataaaattgtatctaatatttcatcggcgatttcatctgtcacttcaaaggttaaagaattttggggcggtttcaaacaaactggagcaattagtgctttttcaggagctttaaaaagtgtttggggagcgttaaaaaatgtagctagcgctatgagtggaggcagttggaaaaactttggctctattgtaggcggaattgtaaagcatgtgtctaattttgcaaaagctattgctgatgttgtcggtaaaatggaacctggcagattgcaaagctggatagccacttttgcagcagtcgggggagggttaaagttatttgaaaagctaacaggacaaagcgttgttggctcttttttagataaaatcagtacaaaatttggattatttggcaaaaaagctaaagaaggaaccgatcaagcagcgaatggctctcgtaaaagtggtggaatcatcagccaaatctttaatggcttgggtaatatcgttaagtctgctggtacagccatatcaacagctgcaaaaggtatcggtacagggattaaaaccgccttgtctggggcacctcctatcattagttctctaggaaccgcaatatcaacagttgcgcaaggtataggcactgggctagcaatcgcttttagaggtttaggagctgcaatcgctatggtgcctcccaccacttggctagctttaggaacggctattttaatggtaggagcggcttttgccttagcaggaactcaggctgatggcattagtcaaattttaaggactattggcgatgttgttgtacaagttttacaacaggtcactgatagtctagccactttactaactattatcgcaaacgctattggctctatgttgccaattgtagctggagctatctctcagattgtaggcgcagtagcgggcggattatctcagctcattatagccgtttcaacaggggtatctctcgttataggagctttcacaggacttcttggtggtatttctggggttattaactccattagcgctgttatccaatcgctaactggtgtgattaccgcagtattcaatggcatagctactgttatttcatctgtcggttcgactatcaaagatgtattgacgggtctaggaaccgcttttgaaggatttgggaatggtgtaaaatcagctctagaaggtgttggggcagtaattgaatcatttggtagtgcagttaggaatgtccttgacggtgttgcaaatatccttgattctatggggactgcggcacttaatgcaggccgtggcgtcaaagagatggctaaaggtattaagatgcttgttgatttatcccttggagatttggttgctacattagcagctgtggcaagcggtctagggaagatggctagctcagctggcgaaatgacaacattaggttctgctatgagcaaagtagccaatggtatgacacgtctagcaacaagtgctacgatagcaattactggattaacagtctttgccaccaccatggcaactattaagacagcagttgcaactctaccgccagtcctaacgatggcagcgagtgggtttaccacatttactactcaggcggtggcagcagtgactggattggctgcaattaatgctccaatcactatgtttaaagctcaactaatgacaataacaccagctctagcacaagctggcgctggctttgccgcgtttgttgctcaatcatcaacatttagtacaggtttagcatctgccggtcctacaatagcagcattcaatgctaatttgatgagcttatctgcaacaacaggagtgctagttgcatcaatagctggtttatcagctgtgctttctgttgtatcagctggctttagccaaataggggcttctgcgacagcaactgttggtcaaatacaagcttttgcttctagtacaacagttgtttcgtcagcatttgctagcatgcaatctatgattcaatctgccatggctgcaatagtaagcagcattataacatcatttaatcaagcggcctctcaaatgcaatcaatcttatctcgaatgctatctcaggccaggacatttgggtctcaactagagcaacaaatgagacaatcgggacagcgttcaggacaaaatcttgctcgggggctatcttctcaacaaggtgctgttattaatgctatttctagcatggttaatgctgcggtatcaagagccaacgcgggagctggtcctatgcgtcaagctggagcgtacatcggacaagggcttgcgcaaggaatgtattcagcgctaggagctgtaacagctgcagcaaacgcccttgtagcacaagccgagagagcagcaagagccaaggcgatgattcattcgccgtcaaggttgtttgcaaaacgagttggtcaatatatcccgcaaggggtagctatgggtatcgacaaaaacgctgatgtcgttgacgactctgttggcgggttatttgatagcatcaatagctttgattttaatatcgcagatagactgactagcattggagctaaattccaaggtgttgtcaaatcagagagttcgcaatcgttatcgcagcaacaagagtttgtacatacagctcaaccagcgtatataaactttagtttaggcggaaacgaatacgaagcatttgtaagtgacatcactaatcaacaagcaaaaattgaaaaaatcagactaaagagaagcagctgg

SEQ ID NO: 2492 - protein, 1211 aa, Streptococcus pyogenes
MGESYSVEAVLTAVDKTFGKTLQSAIRSIDGLEKRSTGFSSVSQKASSMFKSMLGANLAGQAISAMTRTVSSGLGSMLGEMNSSAKAWKTFDANLADIGFGKKQILAAKTAMQDYATKTIYSASDMASTYAQLAAVGVKDTGKLVKAFGGLAASAENPKQAMKSISQQMTQAVGRPTVAWQDFRIMLEQAPAGMAKVAKSMGKNLDELVADIQAGRVKTSDFLEAVKKAGNDKSFQKMATEFKTVDQAIDGMREGLSNKLQPAFEKVNQFGIRAIEAIGKQLDKVDFSKFASNLGKFLEGINIDKIVSNISSAISSVTSKVKEFWGGFKQTGAISAFSGALKSVWGALKNVASAMSGGSWKNFGSIVGGIVKHVSNFAKAIADVVGKMEPGRLQSWIATFAAVGGGLKLFEKLTGQSVVGSFLDKISTKFGLFGKKAKEGTDQAANGSRKSGGIISQIFNGLGNIVKSAGTAISTAAKGIGTGIKTALSGAPPIISSLGTAISTVAQGIGTGLAIAFRGLGAAIAMVPPTTWLALGTAILMVGAAFALAGTQADGISQILRTIGDVVVQVLQQVTDSLATLLTIIANAIGSMLPIVAGAISQIVGAVAGGLSQLIIAVSTGVSLVIGAFTGLLGGISGVINSISAVIQSLTGVITAVFNGIATVISSVGSTIKDVLTGLGTAFEGFGNGVKSALEGVGAVIESFGSAVRNVLDGVANILDSMGTAALNAGRGVKEMAKGIKMLVDLSLGDLVATLAAVASGLGKMASSAGEMTTLGSAMSKVANGMTRLATSATIAITGLTVFATTMATIKTAVATLPPVLTMAASGFTTFTTQAVAAVTGLAAINAPITMFKAQLMTITPALAQAGAGFAAFVAQSSTFSTGLASAGPTIAAFNANLMSLSATTGVLVASIAGLSAVLSVVSAGFSQIGASATATVGQIQAFASSTTVVSSAFASMQSMIQSAMAAIVSSIITSFNQAASQMQSILSRMLSQARTFGSQLEQQMRQSGQRSGQNLARGLSSQQGAVINAISSMVNAAVSRANAGAGPMRQAGAYIGQGLAQGMYSALGAVTAAANALVAQAERAARAKAMIHSPSRLFAKRVGQYIPQGVAMGIDKNADVVDDSVGGLFDSINSFDFNIADRLTSIGAKFQGVVKSESSQSLSQQQEFVHTAQPAYINFSLGGNEYEAFVSDITNQQAKIEKIRLKRSSW

SEQ ID NO: 2493 - DNA, 243 bp, Streptococcus agalactiae
ttgaaccctcaaaaccccattaccagtcaatgtctggatgtcagtggtcttgaaaaacttggtagggtggcagatgaaggtaacatcgaccacccaggcaccaaattcgtcttttccaatctcaaagctatcaaccttataacaccaaagcctaatagttggttcctgttcattttccaaccaaaacttttcacggttcaaaagagcagaaaagcgataaatttcttcatcgcttggctcaat

SEQ ID NO: 2494 - protein, 81 aa, Streptococcus agalactiae
MNPQNPITSQCLDVSGLEKLGRVADEGNIDHPGTKFVFSNLKAINLITPKPNSWFLFIFQPKLFTVQKSRKAINFFIAWLN

SEQ ID NO: 2495 - DNA, 720 bp, Streptococcus agalactiae
atgacaaaaatcaatgaacttaccattgacggtgtgaaaacatcatcttttaagtgtgatgtattggttgaaactagaccaaatgtcattgtctccagctccaaaacagctctattagagcatgatggtattagtggtgcagttgtgcaatcgaatagacaccgtggactaattgagaagccttatcatatcactttaattgagccaagcgatgaagaaatttatcgcttttctgctcttttgaaccgtgaaaagttttggttggaaaatgaacaggaaccaactattaggctttggtgttataaggttgatagctttgagattggaaaagacgaatttggtgcctgggtggtcgatgttaccttcatctgccaccctaccaagtttttcaagaccactgacatccagacattgactggtaatggggttttgagggttcaagggtcagctcttgcttttccgaagattacagtggttggtcagagcgcttctgagacatcgtttacgataggtaaccaagtgattaagcttgaaaagctctcagaatcgctcgtgatgaccaatgatcctgacaatcctagctttaagacggctagtggaaaactcattaagtgggctggtgattttatcacagttgatactgctaaggggcagaatgtcggtgttgttttaggtgctggcataacatctttgaaatttgaaacagtttgggggtgggca

SEQ ID NO: 2496 - protein, 240 aa, Streptococcus agalactiae
MTKINELTIDGVKTSSFKCDVLVETRPNVIVSSSKTALLEHDGISGAVVQSNRHRGLIEKPYHITLIEPSDEEIYRFSALLNREKFWLENEQEPTIRLWCYKVDSFEIGKDEFGAWVVDVTFICHPTKFFKTTDIQTLTGNGVLRVQGSALAFPKITVVGQSASETSFTIGNQVIKLEKLSESLVMTNDPDNPSFKTASGKLIKWAGDFITVDTAKGQNVGVVLGAGITSLKFETVWGWA

SEQ ID NO: 2497 - DNA, 693 bp, Streptococcus pyogenes
atgatacctaaagttattattgatgattttgacacatcttcaatccctaattgtgttttgaccggttacgatgtgggggatattctatcccctagttttgtcgaaaatgaagcttatggcatgaatggaactagtagggaattggagtcatataatgaatctaaaccaaccataatgtggcatttgagtacttttgatgatgcagttaatctaattaatcatttagacggccttagtaaaaaaatcgaattttggcacatacctaactctatttattactatgattgcttatctgtcaaaatcaatgcggtaaccatgtcatcatggcgtgtgactctcaaacttgctctttatccatttagatacgcaaaaggtgtctcagatgtagtaattgcaggcaacggaaacattaacaatgcaggaaatgttttcagcgaacctaagatagttgttgagggtactggtaaaggaacgctaaccattggcaaacaggtcatggaattaaatttgtcaggtaaagcaacgattgagtgcaaacatggccaacaatgcgtctatgatgctgaaggtaatgtgaaaaactcaatccgaataagaggaagtttttttgaaatacaacctggcacacaaggtattgccgtcagtggaggcattactagaacaataattagtccaaggtggaggtataaggtt

SEQ ID NO: 2498 - protein, 231 aa, Streptococcus pyogenes
MIPKVIIDDFDTSSIPNCVLTGYDVGDILSPSFVENEAYGMNGTSRELESYNESKPTIMWHLSTFDDAVNLINHLDGLSKKIEFWHIPNSIYYYDCLSVKINAVTMSSWRVTLKLALYPFRYAKGVSDVVIAGNGNINNAGNVFSEPKIVVEGTGKGTLTIGKQVMELNLSGKATIECKHGQQCVYDAEGNVKNSIRIRGSFFEIQPGTQGIAVSGGITRTIISPRWRYKV

SEQ ID NO: 2499 - DNA, 3672 bp, Streptococcus agalactiae
ttgctctttttacttgatgcaaatgtaagaacggtcaaatggaatggcattccactacatgaagccagctctgccattgtcaaagaagaaaccaacggtgatttctacctgactgttcgctatcctatcacggattcaggtatctatcagcttatcaaagaggatatgctgattaagtcgcctgtgcctgtgctgggcgctcagctgttccgtatcaagaagcctattgagaatgacgacagcatggacatcactgcctatcatgtctctgatgacatcatgaagcggtctatcactcctgtgagtgtggttggtcaaggctgtgctatggcactgtctcagatggttcaaaatgctaagactgggctaggtgatttctcctttaccagcgatattatggacagccgaacctttaacacgactgaaacggaaacgctctactctgtccttatggacggtaaacacagtattgttggaacgtgggaaggtgagcttgtccgtgataactttgccttatctatcaaacgtagccgtggggctgatcgtggtgttgtcatcacaacacacaagaacctcaaatcctatcaacgaaccaagaactctcagggtgttgtcacaaggattcatgcacggtcaaccttcaaacctgatggagctgaagatgaagtgacgctcagagtgtctgttgacagtccactaataaactcttatccctacatcaatgagaaagagtatgagaacaacaacgctgaaaccgttgaagaccttagaaagtgggctgaggctaagtttacaaatgagggcattgataaggtttctgatgccattgagattgaagcctatgagcttgacggtcaagttgtaaatctgggcgacacggttaacctcaagagtagaaagcacagtgctgacctctacaagaaggccattgcctacgagtttaacgctttaacggaagagtatatctccataacttttgatgataagccaggagttggtggttctggggtgtcaagtggcttgtctaatgttgctgatgctatacttgtagcaagtgccacagctcaggacgttgctgttcaaagggctgtgaaaaatgctaacgctgcctttgatgcagagtttggtaaaacaaaaacaaaaattaatgatgatatcgaaatcgcaaaagccaaagtagaaagctttaaatcggaactatctaatcgcatggataatcagcttcttccccttgcgacagaagctaagaatttagccagtcaggcacaagcagacttgaccagaaaagaaatagagcttagagctgaattaaatagacaagtcacaagcacagaagctgtaaaaatctctctaacaaatcttagtcacaatatggatatcattaagcaaaaagccctaaacgaccttagagacgcagagacaaggctaaaggaagctgatagcgtccaacaacttgcgacaaagcgggttgaggataaactgacaggacttagcacgaaactggagtcattctctgttggtggctataattatgtcattgacggcggagaacctaaagaactaatggctaacttctatggtaagacctatgatattaatccccaactactcgaacgaactagtcaagcgaccttgagttttagctatgaagcagaatcaactagtcgtttagaagttagactttataaaaagatgcacaccggggacactagtaagattacaattattgtcatgcctaactttgacttatctccagggaaaggctttatctctcagagctttgatttaggtggtgttatgcctgaccctagaaaccaagcctggcttgtgatgcgggggacaaatgctaaccccttgacgctctcgaaagttaagctggaacgtggtaccgttgctacagactggaataatcgcgatgaaaccttaaaagctagcttcgccgaatacaagcagaccgttgatgaaaacttagccaaccttagaacaagtacggaaaccttggcaggtcaactgacaagtgctgagtctagcattaggcagacgtcggaatcctttagcaatcgtttagttagtcttgagacctataaagatagtgaaccaaatcgagctagtcgttactttgaagcaagcaagtctgaaaccgctaagcagctatcagccttacgaacagaggttaatggctcttatgtggataagtcaacctatgaggaaaatgcaagaggtttgataagacgctttgaaagtctgtcatcagggacacagaactatgctttggggactgaaagagatgtctatctaaacgtttcagggactaccgtctatgacctttatagcttcggtactaccttagccgtaaaagggattgaaatgggagatactgtaactattgcatttaactattttgcggatagtcggacggcttttggttcttatgaactggagctatacggacatgcaggcaaaatcgaacgggttggtgaggtacagagaacgatatcaaatcgtggtacctataccgcatcttttgtggcaaacaatgccaatttcagggcaaactcccttaaaattagatttacggatagccaacttaagtttagagtgacaacacttcgtgtgactaaggggacaattcctgcggactggagtccatctccagatgacctgaaagcctactcagatactaagcttgaacagacagctaatgagattaaagctagtgtaacaagtcttgatcataaaactcttaagcaaactgatattactatgacttctgaagggattgtcctgagagcaggcaagacgagtaatgatgtggcaagagctattggctcttactttaaggtcactcctgatgctatagctctgtttagctcactgataaaagttagcgggaacatgttggttgatggttctgtaactagtcgtaagttggtaacaggcgctgtcgaaacgggacatgttaaggctggagcaatcacaggagtgcttttagcagctgaagctgtaacggcagaaaaacttaaagtcgaccaagctttctttaacaagttgatggccaacgatgcctacttgaagcaactatttgccaagtcagccttcatcactcaggttcaatccgtgacaatatctgccagtcagatttcgggcggtgttattaaagctttgaataatgccatggaaatccagatgaacagtggtcagatactttactacactgaccaagctgcactgaaacgggttttgagtggctatcctactcagtttgttaagttcgcaactggtacagtatctggtaaaggaaatgctggtgttacggtcattggttctaaccgctacggtacagaatcaaccaatgatggtggatttgttggagtccgtgcatggaacggctcaaacattgactcacttgacttagttggtgatgaaatccgattagcaagctctgcctttgacaattcagatggttgggatgttcggacacttgattcaggcttgaaaatcacaccacacaatagggctgctgaacgcaatagccgaattgaggttggtgatgtctggattttaaaaggaaatggatcctattcttctctcagagatattttgaactcattcaatgagaacttctcaaaaggcccaaatgctgactcttacacttactacccttcagggttc

SEQ ID NO: 2500 - protein, 1224 aa, Streptococcus agalactiae
MLFLLDANVRTVKWNGIPLHEASSAIVKEETNGDFYLTVRYPITDSGIYQLIKEDMLIKSPVPVLGAQLFRIKKPIENDDSMDITAYHVSDDIMKRSITPVSVVGQGCAMALSQMVQNAKTGLGDFSFTSDIMDSRTFNTTETETLYSVLMDGKHSIVGTWEGELVRDNFALSIKRSRGADRGVVITTHKNLKSYQRTKNSQGVVTRIHARSTFKPDGAEDEVTLRVSVDSPLINSYPYINEKEYENNNAETVEDLRKWAEAKFTNEGIDKVSDAIEIEAYELDGQVVNLGDTVNLKSRKHSADLYKKAIAYEFNALTEEYISITFDDKPGVGGSGVSSGLSNVADAILVASATAQDVAVQRAVKNANAAFDAEFGKTKTKINDDIEIAKAKVESFKSELSNRMDNQLLPLATEAKNLASQAQADLTRKEIELRAELNRQVTSTEAVKISLTNLSHNMDIIKQKALNDLRDAETRLKEADSVQQLATKRVEDKLTGLSTKLESFSVGGYNYVIDGGEPKELMANFYGKTYDINPQLLERTSQATLSFSYEAESTSRLEVRLYKKMHTGDTSKITIIVMPNFDLSPGKGFISQSFDLGGVMPDPRNQAWLVMRGTNANPLTLSKVKLERGTVATDWNNRDETLKASFAEYKQTVDENLANLRTSTETLAGQLTSAESSIRQTSESFSNRLVSLETYKDSEPNRASRYFEASKSETAKQLSALRTEVNGSYVDKSTYEENARGLIRRFESLSSGTQNYALGTERDVYLNVSGTTVYDLYSFGTTLAVKGIEMGDTVTIAFNYFADSRTAFGSYELELYGHAGKIERVGEVQRTISNRGTYTASFVANNANFRANSLKIRFTDSQLKFRVTTLRVTKGTIPADWSPSPDDLKAYSDTKLEQTANEIKASVTSLDHKTLKQTDITMTSEGIVLRAGKTSNDVARAIGSYFKVTPDAIALFSSLIKVSGNMLVDGSVTSRKLVTGAVETGHVKAGAITGVLLAAEAVTAEKLKVDQAFFNKLMANDAYLKQLFAKSAFITQVQSVTISASQISGGVIKALNNAMEIQMNSGQILYYTDQAALKRVLSGYPTQFVKFATGTVSGKGNAGVTVIGSNRYGTESTNDGGFVGVRAWNGSNIDSLDLVGDEIRLASSAFDNSDGWDVRTLDSGLKITPHNRAAERNSRIEVGDVWILKGNGSYSSLRDILNSFNENFSKGPNADSYTYYPSGF

SEQ ID NO: 2501 - DNA, 1956 bp, Streptococcus pyogenes
ttgatatcgattaaagatgataatacccctcttgtagcagcctttgaagatgagattacacaggaggccaatagtgattacaaactaaattttaagtatcctgctaaacacgagtatcgccctttaataaaaaaaggaataatcttagaagctgatgatctgcatggttctcagctttttaggatttttgaaattactaagcggcatggctatattaacgtttacgctaatcaggtcgctgatgacttaaatggctatgcaattgacactatcagtgttgatagggtgcaaggcatgacagtaatgtcagagttagcaggtagtatcaagcgtgagcatccttttagcttttttagtgatattgacggtcgtcacacatttaatcaatcagacgtatctgttatggacgctttagctaatggcaagcactcaatcatggggcagtggggtggcgaacttgtacgaaataaataccaaattaacttgctcaaaaaagctggcaaagataccgaaaccttgttcatgtacaagaaaaacctcaaatcttatgaggaaacagatactatcaaagggcttgtctctatccttcatttagttgctgaagtagaagaagaacatgaagtagaaaccagagaagcttcagatggaaacattggtcatagtgaatcaccgaaaaagaaaacaattagggtatctgttgagagcaagctcaaagacactcatccgataattgttgaaaagactatcaaggtgcaggatcaagatgtcaaaacagaagaggacttgcttgcatatggtaagaaatactttgaaaaaactctttgcgacataccaggtaatagtttaaaaattgatgttactaataactacgagggcgctgttaggctatttgacacagcaattgtcttccacgagctctatgacagagacttacgaatgcaaatcactggctatcggttcgcccctatggctaatcggttaaaatccatcatctttggagagattaagaccaacttagcaaaacaaattagcaatcaaattgacaataaggtagctgaatcaactgctcaacatgacgcagcatttgaagcaaaattacaaaagcagattgataatgctaatcgtatttttgacacaaaagaagctaaactccgtgaagagattgaagatggcatcaaaaaagctgaagctaatgcagaggtcaaagttgctgaggttaacgctaaagtgctggaagctgaggagctagccaaggcagtcgatgagcgactcaaaaaatttttatctgatgctgacactaaagagcaagattttgataaaaaacttgaagaatttagaacgtctcttaaagaccttgaagttgatgaaaagcagattgatgatgctttggccaaagccggttttagcaaggatagcttagctgacattaaagctaaactggaagacacgtctgaaactgccacagttacagctaacattgttggatcaactggcggcacgttttacaatcgcaacagactggatggtgatactgacaaagttatcacttttgaacaaggttatattgacattgcccataatggtgaaggttttgaagaaggcaagacatacactatcagctttgaggcaacctgtgagctactgcgtaaagtaggaatcacagtgacacaggctaacatgaaaggtgctcgcttagtgttaacacctaaaaatcccaaattagttgtcgagagttttggcttgactaaggatactgagactatcaatgtctatccgtttagctacacagtgcttgtaaccagcgactggtataaatctaagcagatagatttaaacgcgtcggaggtgcaggaattggctctggagatggattataaagatgttgttgacggtaataatgccacaatcacagggcagtggtcagacagcccacaaattatattagacggaggtaat

SEQ ID NO: 2502 - protein, 652 aa, Streptococcus pyogenes
LISIKDDNTPLVAAFEDEITQEANSDYKLNFKYPAKHEYRPLIKKGIILEADDLHGSQLFRIFEITKRHGYINVYANQVADDLNGYAIDTISVDRVQGMTVMSELAGSIKREHPFSFFSDIDGRHTFNQSDVSVMDALANGKHSIMGQWGGELVRNKYQINLLKKAGKDTETLFMYKKNLKSYEETDTIKGLVSILHLVAEVEEEHEVETREASDGNIGHSESPKKKTIRVSVESKLKDTHPIIVEKTIKVQDQDVKTEEDLLAYGKKYFEKTLCDIPGNSLKIDVTNNYEGAVRLFDTAIVFHELYDRDLRMQITGYRFAPMANRLKSIIFGEIKTNLAKQISNQIDNKVAESTAQHDAAFEAKLQKQIDNANRIFDTKEAKLREEIEDGIKKAEANAEVKVAEVNAKVLEAEELAKAVDERLKKFLSDADTKEQDFDKKLEEFRTSLKDLEVDEKQIDDALAKAGFSKDSLADIKAKLEDTSETATVTANIVGSTGGTFYNRNRLDGDTDKVITFEQGYIDIAHNGEGFEEGKTYTISFEATCELLRKVGITVTQANMKGARLVLTPKNPKLVVESFGLTKDTETINVYPFSYTVLVTSDWYKSKQIDLNASEVQELALEMDYKDVVDGNNATITGQWSDSPQIILDGGN

SEQ ID NO: 2503 - DNA, 228 bp, Streptococcus agalactiae
atgaaccaagaacaacaactcaatcaagcgctacgcttgacggtcaatgaattgacagcccagttggccaatgagtcaaccactaagaacttgctggctatccagctgactgaagttgttcaggagaaacagcaactgactcagcaaaatgctgaacttcaagcaagagtttccgaactagaaggcttgcttgatgaacaaactcaaccagaaatcattgaaggagaa

SEQ ID NO: 2504 - protein, 76 aa, Streptococcus agalactiae
MNQEQQLNQALRLTVNELTAQLANESTTKNLLAIQLTEVVQEKQQLTQQNAELQARVSELEGLLDEQTQPEIIEGE

SEQ ID NO: 2505 - DNA, 336 bp, Streptococcus agalactiae
gtgactacaacagaaaataatttacttgaccttgaaacaatcacagaaccctttgacttggcgacagcactcaagtacatgaaggaaaatggtgagttcatccgttgcaagaatgctgtcaatgacttctacatgtaccgtgacatgcagaaacgtcctgtcatcgtcaatggccgccgtcaattcaaggacgtagaaactgtctgggcatttaaccaatggggcgggacaacacccacaatcaacatagctgatttctttaatcttgaatactacatcatgacctttgatgagaacggaaatcctgactggactgagcctcacttggaggataag

SEQ ID NO: 2506 - protein, 112 aa, Streptococcus agalactiae
MTTTENNLLDLETITEPFDLATALKYMKENGEFIRCKNAVNDFYMYRDMQKRPVIVNGRRQFKDVETVWAFNQWGGTTPTINIADFFNLEYYIMTFDENGNPDWTEPHLEDK

SEQ ID NO: 2507 - DNA, 408 bp, Streptococcus agalactiae
atgccaccatggttaatagatagcactgtggttgtggcgatggtgacggtgctgggcggtctgttcagcactattatcaccacttcagccaatcggaaagaccagctgataaaacatcagtatgaggatatcaaggaagatttgtctggcttgattgacaaggttaagacgattgatcatacaaccacggaaacaaagaaaatttcagaaatcacaaaagacggtacgcttaaaatccagcgttaccgtctttttcacgatttgacaaaggaaatttctcaaggctacacaactattgaacatttcagggagttgagcattctctttgagagttatcaactgcttggcggaaatggggaaattgaagccttgtttgagaaattcaaacagttaccaattgaggaggac

SEQ ID NO: 2508 - protein, 136 aa, Streptococcus agalactiae
MPPWLIDSTVVVAMVTVLGGLFSTIITTSANRKDQLIKHQYEDIKEDLSGLIDKVKTIDHTTTETKKISEITKDGTLKIQRYRLFHDLTKEISQGYTTIEHFRELSILFESYQLLGGNGEIEALFEKFKQLPIEED

SEQ ID NO: 2509 - DNA, 327 bp, Streptococcus agalactiae
atgacacaaattacagatattatcatcagctcagctatgggaattttgaccattttggcaggaattgcagtgcaagctgtcaaggtttatttgattaaaaaaggcggtgaaaaggccgtcttgattacagaaatcttggccaagaacgctgttaatgctgtggagcaagtggccactgaaactggcttcaaaggagctgacaagctaacttctgctaaggctcagattttagctgagttgcaaaaatacaatatccacatgtcagacgatgatctcactttgtttgttgaatcagctgtcaaacaaatgcacgatgcctggaaggag

SEQ ID NO: 2510 - protein, 109 aa, Streptococcus agalactiae
MTQITDIIISSAMGILTILAGIAVQAVKVYLIKKGGEKAVLITEILAKNAVNAVEQVATETGFKGADKLTSAKAQILAELQKYNIHMSDDDLTLFVESAVKQMHDAWKE

SEQ ID NO: 2511 - DNA, 162 bp, Streptococcus agalactiae
ttgcctggatgtctgcacgtcaaggcaaggtcagctattccatggactaccgtgacggccctaacagctatgactgttccagctctgtctattatgctctcaggtcagctggtgcaagctcagcaggttgggcggtcaacactgagtacatgcacgattggc

SEQ ID NO: 2512 - protein, 54 aa, Streptococcus agalactiae
MPGCLHVKARSAIPWTTVTALTAMTVPALSIMLSGQLVQAQQVGRSTLSTCTIG

SEQ ID NO: 2513 - DNA, 1404 bp, Streptococcus agalactiae
atggaaatcaacactgaaatagccattgcctggatgtctgcacgtcaaggcaaggtcagctattccatggactaccgtgacggccctaacagctatgactgttccagctctgtctattatgctctcaggtcagctggtgcaagctcagcaggttgggcggtcaacactgagtacatgcacgattggctgattaaaaacggttatgagcttattgctgaaaacgtggattggaatgctgtccgtggtgatatagcaatttggggcatgcgagggcactcaagcggagctggtggtcatgtagtcatgtttattgaccctgaaaatatcattcactgtaactgggcaaataatggcatcacagtgaacaactacaatcagacagcggctgctagtggctggatgtattgctacgtttaccgtttgaaaagcggagcttctacccaaggaaaaagccttgataccttggtcaaggaaacccttgctggtaactacggtaatggcgaagcacgcaaggcagtgcttggcaatcaatatgaggctgttatgtcagtcatcaatggcaaaactacgactaatcaaaagactgttgaccaacttgttcaagaggtaatcgctggcaaacatggcaacggtgaagctcgtaaaaagtcgcttggtagtcaatatgatgcagttcagaaacgagtgacggaattgctcaaaaaacagccctctgagccgtttaaggctcaagaggtaaacaagcccacggaaaccaaaacaagccaaacagagctaactggacaagccacagccaccaaagaagagggcgacctctctttcaatgggactatcttgaaaaaagcggtgctggacaagattctgggcaactgtaaaaagcatgatattcttccaagttatgcactgactatcctacactatgaaggtctttggggaacttcagcagttgggaaggcagataataactggggcggtatgacctggactggtcaaggcaaccgtccaagcggtgtcactgtcacacaaggttccgcacgtccttcaaatgagggcggtcactatatgcactatgcaagcgtggatgactttctgacagactggttttatcttctaagggctggtggctcttacaaggtgtctggtgctaaaaccttcagtgaggctatcaagggaatgtttaaagttggcggtgctgtctatgattatgctgcaagcggctttgatagctatattgtcggagcttcaagccgcctcaaggctattgaggcagaaaatggttcactggacaagtttgataaagctaccgacattggtgacggtagcaaagacaagattgacattactattgaaggtattgaagttaccatcaacggtatcacttatgaactgactaaaaagccagtt

SEQ ID NO: 2514 - protein, 468 aa, Streptococcus agalactiae
MEINTEIAIAWMSARQGKVSYSMDYRDGPNSYDCSSSVYYALRSAGASSAGWAVNTEYMHDWLIKNGYELIAENVDWNAVRGDIAIWGMRGHSSGAGGHVVMFIDPENIIHCNWANNGITVNNYNQTAAASGWMYCYVYRLKSGASTQGKSLDTLVKETLAGNYGNGEARKAVLGNQYEAVMSVINGKTTTNQKTVDQLVQEVIAGKHGNGEARKKSLGSQYDAVQKRVTELLKKQPSEPFKAQEVNKPTETKTSQTELTGQATATKEEGDLSFNGTILKKAVLDKILGNCKKHDILPSYALTILHYEGLWGTSAVGKADNNWGGMTWTGQGNRPSGVTVTQGSARPSNEGGHYMHYASVDDFLTDWFYLLRAGGSYKVSGAKTFSEAIKGMFKVGGAVYDYAASGFDSYIVGASSRLKAIEAENGSLDKFDKATDIGDGSKDKIDITIEGIEVTINGITYELTKKPV

SEQ ID NO: 2515 - DNA, 129 bp, Streptococcus agalactiae
  misc_feature (1)..(129): n = a, c, g, or t
ttgctatttgattttctcgaagaaaaaataaaactgaaagcatacctgatgaccgccttacttgatgatggagaaattaaccttgatcactttaaaacagaatatgctttgagtgnnnnnttaattaat

SEQ ID NO: 2516 - protein, 43 aa, Streptococcus agalactiae
  MISC_FEATURE (1)..(43): Xaa = Any Amino Acid
MLFDFLEEKIKLKAYLMTALLDDGEINLDHFKTEYALSXXLIN

SEQ ID NO: 2517 - DNA, 240 bp, Streptococcus agalactiae
atggataccattgaaaatctcattattgctattgtgaaacctttgatttcacaaccagatcagttaaccataaaaattcaggatggcccagaatttttagagtaccatcttgatttagatacccaagacatcggtcgtgttatcggcaaaaagggtcgtacaattacagcgataaggtcgattgtctattcggtaccaacacaagggaaaaaagtaagactcatcattgatgagaaagaa

SEQ ID NO: 2518 - protein, 80 aa, Streptococcus agalactiae
MDTIENLIIAIVKPLISQPDQLTIKIQDGPEFLEYHLDLDTQDIGRVIGKKGRTITAIRSIVYSVPTQGKKVRLIIDEKE

SEQ ID NO: 2519 - DNA, 237 bp, Streptococcus pyogenes
atggataccattgaaaatcttattatcgctattgtgaaacctttgatttcacaaccagataatcttaccattaaaattgaagatactcctgactttttagagtatcatcttgacttggatgctcaagacatcggtcgtgttatcggcaaaaaaggtcgaactattactgcgataagatcgattgtctactcggttccaacactaggaaaaaaagttcgcttagttattgatgagaaa

SEQ ID NO: 2520 - protein, 79 aa, Streptococcus pyogenes
MDTIENLIIAIVKPLISQPDNLTIKIEDTPDFLEYHLDLDAQDIGRVIGKKGRTITAIRSIVYSVPTLGKKVRLVIDEK

SEQ ID NO: 2521 - DNA, 270 bp, Streptococcus agalactiae
atggcagtaaaaatccgtttaactcgtatgggttctaagaagaaacctttctaccgtatcaatgttgcagattcacgtgcaccacgtgacggacgttttattgaaactgttggaacatacaacccattagttgcagaaaaccaagttacaatcaaagaagaacgtgttcttgaatggttatcaaaaggtgcacaaccttcagatacagttcgtaaccttctttcaaaagctggagttatgactaaattccacgatcaaaaattctcaaaa

SEQ ID NO: 2522 - protein, 90 aa, Streptococcus agalactiae
MAVKIRLTRMGSKKKPFYRINVADSRAPRDGRFIETVGTYNPLVAENQVTIKEERVLEWLSKGAQPSDTVRNLLSKAGVMTKFHDQKFSK

SEQ ID NO: 2523 - DNA, 270 bp, Streptococcus pyogenes
atggcagtaaaaatccgtttaactcgtatgggttctaagaaaaaacctttctaccgtattaatgttgcagattcacgtgcaccacgtgatggtcgttttatcgaaacagttggaacatacaacccattagtggctgaaaatcaaattactattaaagaggatcgtgttcttgagtggttatctaaaggagcgcagccttctgataccgttcgtaacatcttgtctaaagctggtgttatggctaagttccacgaccaaaaattctctaaa

SEQ ID NO: 2524 - protein, 90 aa, Streptococcus pyogenes
MAVKIRLTRMGSKKKPFYRINVADSRAPRDGRFIETVGTYNPLVAENQITIKEDRVLEWLSKGAQPSDTVRNILSKAGVMAKFHDQKFSK

SEQ ID NO: 2525 - DNA, 1245 bp, Streptococcus agalactiae
atggaaaattggaagtttgccctatcatcgattctagggcacaagatgcgtgcttttctgaccatgttagggatcatcattggggttgcatcagttgtgttaattatggccttaggtaagggcatgaaagattcggttacaaatgagattacaaagtctcagaagaaccttcagatttattataaaacaaaagaagaccaaaaaaatgaggataactttggagctcaaggggctttcatgcaaggtagtgataccaaccgtaaggaaccaattattcaagaatcatggttaaaaaagattgctaaggaagtagatggtgttagtggctactatgtaaccaatcaaacaaatgctccagtagcttaccttgaaaaaaaggcaaagacggttaatataacaggaattaaccgcacttaccttggtatcaaaaagttcaaaattaaaagtggtcgtcaattccaagaggaggattataaccaattctcgagagttattttactagaagaaaaattagctcagagattattccagacaaatgaagcagcgttaaataaggtggtgactgtaaaaaataaatcttacttagtagtgggggtttattcggatccagaagctggttcaggcttatatggaagtaattctgatgggaatgctattttaaccaatacacagttagcttcggagtttggtgctaaagaagcagaaaacatatattttcatcttaatgatgtatcgcaatccaatcgcattggtaaagaaataggcaaacgtttaacagacattagtcatgctaaggatgggtactatgataattttgacatgacatctatagttaaatctatcaatacccaagttggtattatgacaggtgttattggagcgattgcagcaatttctctcctagttggtggtatcggagtgatgaatattatgttagtctctgtaactgagcgcacgagagaaattggccttcgtaaagcccttggggcaactcgacgtaaaattttagctcaatttttaattgaatcaatggtcttaacgattttgggtggattaattgggttattactagcctatggaggtacgatgttaattgctaatgcgcaagataagattactccttctgtgtcacttaacgtggctataggcagtttaattttctcagcatttattggaattatatttggtttattacctgctaataaagccagcaaattaaacccaattgatgctttacgatatgaa

SEQ ID NO: 2526 - protein, 415 aa, Streptococcus agalactiae
MENWKFALSSILGHKMRAFLTMLGIIIGVASVVLIMALGKGMKDSVTNEITKSQKNLQIYYKTKEDQKNEDNFGAQGAFMQGSDTNRKEPIIQESWLKKIAKEVDGVSGYYVTNQTNAPVAYLEKKAKTVNITGINRTYLGIKKFKIKSGRQFQEEDYNQFSRVILLEEKLAQRLFQTNEAALNKVVTVKNKSYLVVGVYSDPEAGSGLYGSNSDGNAILTNTQLASEFGAKEAENIYFHLNDVSQSNRIGKEIGKRLTDISHAKDGYYDNFDMTSIVKSINTQVGIMTGVIGAIAAISLLVGGIGVMNIMLVSVTERTREIGLRKALGATRRKILAQFLIESMVLTILGGLIGLLLAYGGTMLIANAQDKITPSVSLNVAIGSLIFSAFIGIIFGLLPANKASKLNPIDALRYE

SEQ ID NO: 2527 - DNA, 708 bp, Streptococcus agalactiae
gtgacaactaatcgaaaagaactgattagattgcatcagattgttaaaagttatcaaaatggggatcaaaaacttcaagtcttaaagaacattgatttgacggtttatgaaggtgaatttcttgcaatcatggggccatctggttcagggaaatccacactaatgaatattattggcttgttggattctccaacttcaggagattatagtttaaatggtaaacgtgtcgaagaactaagtcaaacaaaattagctcaagttcgaaataaggaaattggttttgtctttcaacaatttttcttgttatctaaactaacggctttacaaaatgttgaattacccttaatttatgcgggtgtacctcctaaaaagcgtaaaaatttagcaaaacaatttttagataaagttgaattaagagagcgtatgaaccatctgccaacagaattatctgggggacagaagcaacgtgtagcaatcgcgcgtgctttggtgaatagcccatctattattctagcagatgagccgactggtgccttggatacaaagacgggtgagcaaattatgcagttcctaacggaattaaatcaagaaggtaaaaccattatcatggtaactcatgaaccagaaatcgccgattatgcgactcgtaaaattgttattcgtgatggcgaaattacagcagatactactgatagtattagaattgat

SEQ ID NO: 2528 - protein, 236 aa, Streptococcus agalactiae
MTTNRKELIRLHQIVKSYQNGDQKLQVLKNIDLTVYEGEFLAIMGPSGSGKSTLMNIIGLLDSPTSGDYSLNGKRVEELSQTKLAQVRNKEIGFVFQQFFLLSKLTALQNVELPLIYAGVPPKKRKNLAKQFLDKVELRERMNHLPTELSGGQKQRVAIARALVNSPSIILADEPTGALDTKTGEQIMQFLTELNQEGKTIIMVTHEPEIADYATRKIVIRDGEITADTTDSIRID

SEQ ID NO: 2529 - DNA, 708 bp, Streptococcus pyogenes
gtgtcgcatgaaaaaaaacaattaatgcaattatcaaatattgtgaagagctatcaaaatggggatcaagttcttaaagttttgaaaggtattaatttaacagtatatgagggtgaatttttagctattatgggtccgtctggttcgggaaaatcaacactaatgaatattattggtttattagatcgtccaacatccggagattacacattacataatactaaaatagaaatccttaatgatcgtgaattagcaaaagtacgaaatgatgaaatcggctttgtctttcaacaattctttctgttagctaaattaactgcattacaaaatgttgaattgcctcttatttatgctggtgtaaacgtctcaaaaagacgtgaacaggctaagcaatttcttgaaaaagtaggacttggacgacgtatcaaacatctaccgtcagaactgtcaggaggtcaaaagcaaagggtggctatcgcacgagctttagtaaatgacccatctattattttagcggatgaaccaacaggtgcactagatactaaaacaggtcagcaaattatggaactcttgacagagttaaacaaagaaggtaaaacaattattatggttactcatgaaccagaaattgctgattttgcaactcggaaaattattattcgtgatggtgatatcacaacggatactacagctagtgttgttattgac

SEQ ID NO: 2530 - protein, 236 aa, Streptococcus pyogenes
VSHEKKQLMQLSNIVKSYQNGDQVLKVLKGINLTVYEGEFLAIMGPSGSGKSTLMNIIGLLDRPTSGDYTLHNTKIEILNDRELAKVRNDEIGFVFQQFFLLAKLTALQNVELPLIYAGVNVSKRREQAKQFLEKVGLGRRIKHLPSELSGGQKQRVAIARALVNDPSIILADEPTGALDTKTGQQIMELLTELNKEGKTIIMVTHEPEIADFATRKIIIRDGDITTDTTASVVID

SEQ ID NO: 2531 - DNA, 1248 bp, Streptococcus agalactiae
atggacatgagtaaacgacaaaatttaggaattagtaaaaaaggagcaattatatcagggctctcagtggcactaattgtagtaataggtggctttttatgggtacaatctcaacctaataagagtgcagtaaaaactaactacaaagtttttaatgttagagaaggaagtgtttcgtcctcaactcttttgacaggaaaagctaaggctaatcaagaacagtatgtgtattttgatgctaataaaggtaatcgagcaactgtcacagttaaagtgggtgataaaatcacagctggtcagcagttagttcaatatgatacaacaactgcacaagcagcctacgacactgctaatcgtcaattaaataaagtagcgcgtcagattaataatctaaagacaacaggaagtcttccagctatggaatcaagtgatcaatcttcttcatcatcacaaggacaagggactcaatcgactagtggtgcgacgaatcgtctacagcaaaattatcaaagtcaagctaatgcttcatacaaccaacaacttcaagatttgaatgatgcttatgcagatgcacaggcagaagtaaataaagcacaaaaagcattgaatgatactgttattacaagtgacgtatcagggacagttgttgaagttaatagtgatattgatccagcttcaaaaactagtcaagtacttgtccatgtagcaactgaaggtaaactccaagtacaaggaacgatgagtgagtatgatttggctaatgttaaaaaagaccaggctgttaaaataaaatctaaggtctatcctgacaaggaatgggaaggtaaaatttcatatatctcaaattatccagaagcagaagcaaacaacaatgactctaataacggctctagtgctgtaaattataaatataaagtagatattactagccctctcgatgcattaaaacaaggttttaccgtatcagttgaagtagttaatggagataagcaccttattgtccctacaagttctgtgataaacaaagataataaacactttgtttgggtatacaatgattctaatcgtaaaatttccaaagttgaagtcaaaattggtaaagctgatgctaagacacaagaaattttatcaggtttgaaagcaggacaaatcgtggttactaatccaagtaaaaccttcaaggatgggcaaaaaattgataatattgaatcaatcgatcttaactctaataagaaatcagaggtgaaa

SEQ ID NO: 2532 - protein, 416 aa, Streptococcus agalactiae
MDMSKRQNLGISKKGAIISGLSVALIVVIGGFLWVQSQPNKSAVKTNYKVFNVREGSVSSSTLLTGKAKANQEQYVYFDANKGNRATVTVKVGDKITAGQQLVQYDTTTAQAAYDTANRQLNKVARQINNLKTTGSLPAMESSDQSSSSSQGQGTQSTSGATNRLQQNYQSQANASYNQQLQDLNDAYADAQAEVNKAQKALNDTVITSDVSGTVVEVNSDIDPASKTSQVLVHVATEGKLQVQGTMSEYDLANVKKDQAVKIKSKVYPDKEWEGKISYISNYPEAEANNNDSNNGSSAVNYKYKVDITSPLDALKQGFTVSVEVVNGDKHLIVPTSSVINKDNKHFVWVYNDSNRKISKVEVKIGKADAKTQEILSGLKAGQIVVTNPSKTFKDGQKIDNIESIDLNSNKKSEVK

SEQ ID NO: 2533 - DNA, 1269 bp, Streptococcus pyogenes
atgtctaaaagaggaaaaattaaaataacaacgaaaacaaagcttattacagctagtgttataacgctagtattaattataactggaatagtcttgtggaaacaacaacgaaatacgctaacagctgatatcgctaaagaaccttactctactgttagtgtaactgaagggagtattgcttcttcgactttactatcaggtactgtaaaggctttatcagaggaatatatttattttgatgctaataaaggaaatgatgcaactgttacagttaaagtaggtgatcaggtaacgcagggccagcaattagttcaatataatacaacaacagctcagtcagcttatgatactgctgttaggagtcttaacaagattggccgacaaattaatcatcttaaaacatacggagttcctgctgttagtacagaaactaatagagatgaagctaccggtgaagagacgacaacaacagttcaaccatcagctcagcaaaatgctaattataaacagcagctgcaagatttaaatgatgcttatgcagatgcacaagcagaagtaaataaagcgcagatagcgttaaatgatacagtagttatcagtagtgtctctggaactgttgtggaagtaaataatgatattgatccttcttcaaagaacagtcaaacacttgttcacgtagcaaccgaaggacagcttcaggtgaaaggaacattgacagagtatgatttagcaaacgttaaggttggtcaatctgtaaaaattaagtctaaagtttattctaatcaagaatggactggaaaaatatcatatgtttcaaactatccaactgagtctaatgcaggttcaacaacgccagcaggtagcactggagcgggaagttctacaggagctacctatgattacaagattgatattataagtcctctcaaccagcttaaacaaggcttcactgtttctgttgaggttgttaatgaagcaaaacaggccttagttcctttaacggctgttattaagaaagataaaaaacactatgtttggacttatgatgatgctactggcaaagccaaaaaagtagaggtgacacttggaaacgcagatgcacaacaacaagaaattcataaaggagtagctgttggtgacattgttattgccaatccagataaaaatatcaaaccggataaaaaactagaaggggttatttcaataggtaccaacacaaaaccggaaaaagattctcaatcaaagaataaaaaatcaggggtggataaa

SEQ ID NO: 2534 - protein, 423 aa, Streptococcus pyogenes
MSKRGKIKITTKTKLITASVITLVLIITGIVLWKQQRNTLTADIAKEPYSTVSVTEGSIASSTLLSGTVKALSEEYIYFDANKGNDATVTVKVGDQVTQGQQLVQYNTTTAQSAYDTAVRSLNKIGRQINHLKTYGVPAVSTETNRDEATGEETTTTVQPSAQQNANYKQQLQDLNDAYADAQAEVNKAQIALNDTVVISSVSGTVVEVNNDIDPSSKNSQTLVHVATEGQLQVKGTLTEYDLANVKVGQSVKIKSKVYSNQEWTGKISYVSNYPTESNAGSTTPAGSTGAGSSTGATYDYKIDIISPLNQLKQGFTVSVEVVNEAKQALVPLTAVIKKDKKHYVWTYDDATGKAKKVEVTLGNADAQQQEIHKGVAVGDIVIANPDKNIKPDKKLEGVISIGTNTKPEKDSQSKNKKSGVDK

SEQ ID NO: 2535 - DNA, 108 bp, Streptococcus agalactiae
ttgtaccaagtcaaactttatccgatgctgctaggcaaacaattcgagatgttgcatttgatgtgtgtcgaaaagcaaacattattggagtatgttactttagtttct

SEQ ID NO: 2536 - protein, 36 aa, Streptococcus agalactiae
MYQVKLYPMLLGKQFEMLHLMCVEKQTLLEYVTLVS

SEQ ID NO: 2537 - DNA, 1596 bp, Streptococcus agalactiae
atgctaaatacaaaggataaacagcctattttgcttattattttcggacagaaaatgaaagaatatgacgatttaattagatcaactgttgagaggttatctaaaagggatagacctgttagtattcttatctcgaaggagctaaaccatgtgattcaccattatgatgcacaatttgaaaatcttgagacgcttgtggggtatataaatacacatgaagatagtttgatttaccccctttgcttagataaaaatcatgagctatttcaagagtttttagcgtggcagagtcattattcaaggcagtatatcagcgataatttatcagaaaaaagtgttcaggcaatagacaataatcaagactttgtgcaagtagattgtttagtaatgagagactctttgaataattgtttatatgtctctgatttagaatatattgaatctaataaaacaactggtaagtctctagcgattgtaccaagtcaaactttatccgatgctgctaggcaaacaattcgagatgttgcatttgatgtgtgtcgaaaagcaaacattattggagtatgttactttagtttcttaatagatttgaacagtttggattatcatataattagtttatcatctggtttgtctcatcaaagcattttatttgagactattacgacctatcctgttttagagatagcaactaaattgacagtgggatatacttttagtcaactgaagcattcttattacccaaatacctctgcctttttagagccgcaattagactatgtagctaccgtatcttttagttttgaaaaagttgactatatcttttttgctcgtaatatagagcaattatttttaaatttactcgaggctagcagtcatgatcattttccatttctgagtgatattagcgaggaagatttgatgtttgctttgattcagaaaaaagaaaatcgtctagcttatcttttggaggcttttagacgtggctttgatttgtatgatttatcctcagttactaaaatcaaccctttttacttagataaatgtttacatattgtagagttgtatgaaaacctgaataaaagccaatataatgtagatatttataaggaagctaaaaggtatggtttttcggatgactatattgctagtagttggcaaatctctttgatagacatgttagaatatcgaaaaaaacatagtgtcgcacctgttctgaagcaagtcgaacaaagttctggtgttctaactggccatcaaattcagtattttcgaagctatgattggcattcagactacatttctagcggttgtcaaaaggctttgataatggtagacaagggttattccctagtaaaattaaatgagttaattaagcaaatcaaacaaactcatttagaattattaattgttaccaatcaacctctcctcatagaacaattaaatgatacatctataatttttgacactataggtattgagaccatattaacaattatgggtatagaagaggtggaagaagtgtatttattgggagaaagtcaagcagacatgttttcaaaaatgaaaaatttttctatctcttgtcagtctatt

SEQ ID NO: 2538 - protein, 532 aa, Streptococcus agalactiae
MLNTKDKQPILLIIFGQKMKEYDDLIRSTVERLSKRDRPVSILISKELNHVIHHYDAQFENLETLVGYINTHEDSLIYPLCLDKNHELFQEFLAWQSHYSRQYISDNLSEKSVQAIDNNQDFVQVDCLVMRDSLNNCLYVSDLEYIESNKTTGKSLAIVPSQTLSDAARQTIRDVAFDVCRKANIIGVCYFSFLIDLNSLDYHIISLSSGLSHQSILFETITTYPVLEIATKLTVGYTFSQLKHSYYPNTSAFLEPQLDYVATVSFSFEKVDYIFFARNIEQLFLNLLEASSHDHFPFLSDISEEDLMFALIQKKENRLAYLLEAFRRGFDLYDLSSVTKINPFYLDKCLHIVELYENLNKSQYNVDIYKEAKRYGFSDDYIASSWQISLIDMLEYRKKHSVAPVLKQVEQSSGVLTGHQIQYFRSYDWHSDYISSGCQKALIMVDKGYSLVKLNELIKQIKQTHLELLIVTNQPLLIEQLNDTSIIFDTIGIETILTIMGIEEVEEVYLLGESQADMFSKMKNFSISCQSI

SEQ ID NO: 2539 - DNA, 1068 bp, Streptococcus agalactiae
atggcaaaaaaattgttaattctagaggatggtacggtttttgaaggactatcctttggttcatctcttgatgtaactggcgaattagttttttgtacggggaataccggctatcaggaaataataacgaatccttcacataatggaaaaattttagtttttacctcaccgctaataggaaattatggtattcatcgcagttactctgaagccattattcccacttgtttaggagttgttgttgcagagtattccagatgtgtaagtagcgatactagcaagatgaatctagatgaatttttgaaaatgaaaaaggttcctgcaatgtcgggggtcgatacaaggtatttgatgcaagttattaaagaaaaaggatttgtaaaagctactttagcagaagcaggtgatgttttatcacatttacaggatcaattaatagcgacagtattaccgacaaataatgtggaacaagtttcgacaaaaacagcttatccgtcgcctgctagcggtcgaaatattgttgtacttgattttggtcttaaacattctattttgagagaattgtctaaacgtcagtgtgacgtgactgtcattccctacaatacgtctttagaaggtattaaaaatctatacccagaaggtatcatattatctaatggtccggggaatccagaaaagcttcaggaaatcttaaacactattaaagaattacaaaaatctgttcctatgttaggtattggtttggggcaccaattaattgccatggcaaatggtgcagaaattatgagactcccagttgctaagaaggggccaaattatcccatgagagatattgctacgggtcgtttagaaacagttagtcagtttaatcattttaccgttaaccggctaaatcttccgcatgatttactggtaacacacgaaggtttgaatgatcaagagattgttgctctaaggcaccgctcatttccagtgatgtccgtgcaattttacccagaggctgctccaggccctcatgatgtgacctatttttttgatgaatttttagaaatgattggatcacgcgct

SEQ ID NO: 2540 - protein, 356 aa, Streptococcus agalactiae
MAKKLLILEDGTVFEGLSFGSSLDVTGELVFCTGNTGYQEIITNPSHNGKILVFTSPLIGNYGIHRSYSEAIIPTCLGVVVAEYSRCVSSDTSKMNLDEFLKMKKVPAMSGVDTRYLMQVIKEKGFVKATLAEAGDVLSHLQDQLIATVLPTNNVEQVSTKTAYPSPASGRNIVVLDFGLKHSILRELSKRQCDVTVIPYNTSLEGIKNLYPEGIILSNGPGNPEKLQEILNTIKELQKSVPMLGIGLGHQLIAMANGAEIMRLPVAKKGPNYPMRDIATGRLETVSQFNHFTVNRLNLPHDLLVTHEGLNDQEIVALRHRSFPVMSVQFYPEAAPGPHDVTYFFDEFLEMIGSRA

SEQ ID NO: 2541 - DNA, 555 bp, Streptococcus agalactiae
ttgaaggggctcttttatcttagagaggatactgcaatgaaaagaaaagaaattattgatgatgtgaccatgaaacgtgctattacacgtattacctacgaaattatagaacgtaacaaaaatttagataatattgtcttagcaggcattaaaacaagaggtgtttttttagccaaacgcattcaagaacgcttgaagcaattagaaaatttagatattcccgttggagaattggatactaaacctttccgtgatgatatgaaagttgaagttgacaccacaactatgccagttgacatcactgataaagatattatattaattgatgatgttctctatacaggtcgcactattcgagctgctattgataatcttgttagtttagggcgtccgagtcgtgtcagtttagctgtattaattgaccgtgggcatcgtgaactacctattcgtgcagattatgtggggaaaaatattccaacaagtcaatttgaagaaattctagttgaagtgatggaacatgatggttacgatcgtgtgagtattattgatccgagt

SEQ ID NO: 2542 - protein, 185 aa, Streptococcus agalactiae
MKGLFYLREDTAMKRKEIIDDVTMKRAITRITYEIIERNKNLDNIVLAGIKTRGVFLAKRIQERLKQLENLDIPVGELDTKPFRDDMKVEVDTTTMPVDITDKDIILIDDVLYTGRTIRAAIDNLVSLGRPSRVSLAVLIDRGHRELPIRADYVGKNIPTSQFEEILVEVMEHDGYDRVSIIDPS

SEQ ID NO: 2543 - DNA, 519 bp, Streptococcus pyogenes
atgaaaactaaggaaattgttgatgacgtgaccatgaaacgcgccattacccgtattacttatgaaattattgaacgtaataaacaattagacaatgtggttttggcaggcatcaaaacgagaggtgtttttctagctcgtcgcattcaagaaagactgcatcaattagaagggttggatttaccaattggtgagttagacatcaagccttttagagatgacatgagagttgaggaagacacaactctgatgtcagtagatattacaggcaaggatgtgattttgattgatgatgtgctttatactggtcgtaccatccgcgcagccatcgataacttagtgagtttaggtcgaccagcccgtgttagtctagctgttttggtggatcgtggccatcgggaattaccgattcgcgcggattacgttgggaaaaatattccaacaagcagtgtagaagaaattgttgttgaggttgtcgaagtcgatggccgtgatcgtgttagcattattgactcaaca

SEQ ID NO: 2544 - protein, 173 aa, Streptococcus pyogenes
MKTKEIVDDVTMKRAITRITYEIIERNKQLDNVVLAGIKTRGVFLARRIQERLHQLEGLDLPIGELDIKPFRDDMRVEEDTTLMSVDITGKDVILIDDVLYTGRTIRAAIDNLVSLGRPARVSLAVLVDRGHRELPIRADYVGKNIPTSSVEEIVVEVVEVDGRDRVSIIDST

SEQ ID NO: 2545 - DNA, 912 bp, Streptococcus agalactiae
ttgcactttggaaagaggaaagtaatggaaatcacaattaaaatagcaggagttaggctagataaagctttagcggataattctgaactgtcgcgtagtcaagctaatgaagaaattaaaaaagggattgtgttagtaaatggacaagtaaaaaaagcgaaatatactgttcaagaaggagatcggattacttttgatattcctaaagaggaagtactagattatcaagctgaaaatatccctttagatattatctatcaagatgatgacgttgctgtggttaataagccgcaagggatggttgttcacccttctgcaggccacagttcgggcaccttagttaacgccttgatgtatcatattaaggatttatcatcaattaatggcgttgttcgcccagggatcgttcatcgtattgataaagatacttctggtttattgatggttgcaaaaaatgatagagctcaccaagtgttggctgaagagttaaaagataaaaaatcgcttcgtaaatatttagcaattgtgcatggtaatttaccaaatgatcgaggtgtgattgaggctccgattggtagaagcgataaagatcgtaagaagcaagccgtgactgctaaaggtaagccagcaataactcgttttcatgttttagaacgttttggtgattataccttagttgaattgtcattggagacaggtcgaacacaccaaattcgggttcatatggcttatattggccatcctctagccggtgatcctgtctacggtccccgtaagactttagggggtaaaggacagtttttgcatgcacaaacactaggttttacgcaccctagtaacggagagaatttgattttttcagtagaggttccggaaatttttcagacaaccttagaaaagttgagaaaaaat

SEQ ID NO: 2546 - protein, 304 aa, Streptococcus agalactiae
MHFGKRKVMEITIKIAGVRLDKALADNSELSRSQANEEIKKGIVLVNGQVKKAKYTVQEGDRITFDIPKEEVLDYQAENIPLDIIYQDDDVAVVNKPQGMVVHPSAGHSSGTLVNALMYHIKDLSSINGVVRPGIVHRIDKDTSGLLMVAKNDRAHQVLAEELKDKKSLRKYLAIVHGNLPNDRGVIEAPIGRSDKDRKKQAVTAKGKPAITRFHVLERFGDYTLVELSLETGRTHQIRVHMAYIGHPLAGDPVYGPRKTLGGKGQFLHAQTLGFTHPSNGENLIFSVEVPEIFQTTLEKLRKN

SEQ ID NO: 2547 - DNA, 888 bp, Streptococcus pyogenes
atggaaattaatgtgataacatcggggcaacgcttggataaggcactagctgatttaagtcccctgtcacgtggtcaagccaatgaccaaattaagcaaggccttgttttagttaatggtcagcaaaaaaaggctaaatatacggttcaagcaggagatgtgatttgttttgaactccctaaagaagaagtcttagagtaccaagctcagaatattcccttggacattatctatgaagatgatgctctcgccattattaacaagccacagggaatggtagttcacccttcggcgggacacccttcaggaacaatggttaatgccttgatgtatcatatcaaggatttgtcctcaatcaatggtgtggttcgtccaggaattgttcatcggattgataaggacacctccggtctcttaatggtagctaaaacagatgcggctcatcaagccttagcagaagaattgaaggctaaaaaatctctcagaaaatacctcgccattgtccatggaaacctaccgaatgatcgcgggatgattgaagctcctataggtcgtagcgaaaaggaccgtaaaaaacaggctgttactgcaaaaggcaaagaagcagtgacacgttttacagtgctagaacgttttggcgattacagtctagtggaattacaactggaaactggtcgaacgcaccaaattcgtgttcatatggcctatattggtcatcctgttgctggggaccctttatatggaccacgtaagacactatcaggtcatggccaatttcttcatgcaaaaacattgggattaacgcatcctatgacaggaaaagaaatgatatttactgttgaagctcccgaaatttttcaaaaggtgttaaagctgctaagaaaaaaa

SEQ ID NO: 2548 - protein, 296 aa, Streptococcus pyogenes
MEINVITSGQRLDKALADLSPLSRGQANDQIKQGLVLVNGQQKKAKYTVQAGDVICFELPKEEVLEYQAQNIPLDIIYEDDALAIINKPQGMVVHPSAGHPSGTMVNALMYHIKDLSSINGVVRPGIVHRIDKDTSGLLMVAKTDAAHQALAEELKAKKSLRKYLAIVHGNLPNDRGMIEAPIGRSEKDRKKQAVTAKGKEAVTRFTVLERFGDYSLVELQLETGRTHQIRVHMAYIGHPVAGDPLYGPRKTLSGHGQFLHAKTLGLTHPMTGKEMIFTVEAPEIFQKVLKLLRKK

SEQ ID NO: 2549 - DNA, 903 bp, Streptococcus agalactiae
atgaatattcaacaactgcgttatgttgttgctatcgcaaatagtggtacttttcgtgaagcagctgcaaaactatttgttagtcagccaagtttatctgttgccgttcgtgatttggaaacagaattagggtttcagatttttacgcgtacaactactggtgcagtgttgaccaatcaaggcatgactttttatgagaatgctttagaagttgtgaaaagctttgattcattcgaaaaacagttttcgcaatctgaagctacagagcaagaattctcaatagcaagtcaacattatgattttctacctcctttaatcacagcgttttcaaaatgtaatgataattttagctatttccgtattttcgaatcaacaacaatacgtatcttagatgaagttgctcaagggaatagcgaaataggtatcatttatatcaatagtcaaaataaaaaaggtctacttcagcggttggacaaattggggttagagtttgtagagcttattccttttaaaactcatatttatcttgggaaagaccatcccttggctagtaaaacatctctgataatgacagatttagaaggattaccaaccgtacgttttacacaggatagagatgattatcggtattactcggagaattttgtggaagtacttgatagttctgttacctataatgttactgatagagcaacattaaatggtattttagaaagaacccaagcttatgcgacgggctcaggattcttggatagccgcagtgtgaatggtatcactgttattccattagaagatcatctagataaccaaatgatttatatcaaacgaaaagatcgtaatttatctcagatggctttaaaatttgttgctgttatggaagagtattttaagggatttaattca

SEQ ID NO: 2550 - protein, 301 aa, Streptococcus agalactiae
MNIQQLRYVVAIANSGTFREAAAKLFVSQPSLSVAVRDLETELGFQIFTRTTTGAVLTNQGMTFYENALEVVKSFDSFEKQFSQSEATEQEFSIASQHYDFLPPLITAFSKCNDNFSYFRIFESTTIRILDEVAQGNSEIGIIYINSQNKKGLLQRLDKLGLEFVELIPFKTHIYLGKDHPLASKTSLIMTDLEGLPTVRFTQDRDDYRYYSENFVEVLDSSVTYNVTDRATLNGILERTQAYATGSGFLDSRSVNGITVIPLEDHLDNQMIYIKRKDRNLSQMALKFVAVMEEYFKGFNS

SEQ ID NO: 2551 - DNA, 912 bp, Streptococcus pyogenes
atgaatattcaacaattacgctatgtggtagccatcgctaataatggaacttttcgagaagctgcctctaaattgtttgtcagtcagcctagcttatcagtttctatcaaagatttagaggcggaattagggtttcaaatttttaatcggactacttcaggaacagtcttgacaagtcaaggactagttttttatgagaaagctttagaagtagtcaagtcttttgattcttttgaaaaaaccttttctcaagctgatctggatcaaaatgaattttctattgctagccaacattatgactttttgccacctcttattacagctttttcgcaacaatacgatggtcatcgtgtctttcgtatctttgaatcaacaactattcaaattttagatgaagttgctcaaggaaacagtgaaattggtattatttacttgaatgtagacaatcaaaaaggtctctttcagcggatggataagctgggcttagaatatgtttctctaattccttttactactcatatttatctttcaaaaacgcatccattggctaatcgcgaagcgctttatttgaacgatattcaaggattacctgcggtaaggtttacccaagaaagggacgagtatttgtattattctgaaaattttgtggatactagtgaatgccctcgtatttataatgtgtcagatagggcaaccttgaacggtattttagagagaaccaatgcctttgcgacaggatcaggttttctcgatcatcggagtgttaatgggattaaagtgatacctctagctgatcatattgacaatcaaatgatttatgtcaaacgaaaagataaaaacctttctgttgctggggccacttttgtgactattttaaaagactattttgataaaagaaggaaggccttaaca

SEQ ID NO: 2552 - protein, 304 aa, Streptococcus pyogenes
MNIQQLRYVVAIANNGTFREAASKLFVSQPSLSVSIKDLEAELGFQIFNRTTSGTVLTSQGLVFYEKALEVVKSFDSFEKTFSQADLDQNEFSIASQHYDFLPPLITAFSQQYDGHRVFRIFESTTIQILDEVAQGNSEIGIIYLNVDNQKGLFQRMDKLGLEYVSLIPFTTHIYLSKTHPLANREALYLNDIQGLPAVRFTQERDEYLYYSENFVDTSECPRIYNVSDRATLNGILERTNAFATGSGFLDHRSVNGIKVIPLADHIDNQMIYVKRKDKNLSVAGATFVTILKDYFDKRRKALT

SEQ ID NO: 2553 - DNA, 291 bp, Streptococcus agalactiae
atgttaaaaatgaatcttgctaacttgcaacttttcgcccacaaaaaaggtggaggttctacatcaaacggacgtgattcacaagcaaaacgtcttggagctaaagcagctgacggacaaacagtatcaggtggatcaattctttaccgtcaacgcggtacacacatctatccaggtgctaacgttggacgtggtggggacgatacactttttgctaaagttgaaggtgttgttcgtttcgaacgtaaaggacgcgataaaaaacaagtgtctgtttacccaatcgcaaaa

SEQ ID NO: 2554 - protein, 97 aa, Streptococcus agalactiae
MLKMNLANLQLFAHKKGGGSTSNGRDSQAKRLGAKAADGQTVSGGSILYRQRGTHIYPGANVGRGGDDTLFAKVEGVVRFERKGRDKKQVSVYPIAK

SEQ ID NO: 2555 - DNA, 291 bp, Streptococcus pyogenes
atgttaaaaatgaatcttgctaacttgcaacttttcgcccacaaaaaaggtggaggttctacatcaaacggacgtgactcacaagctaaacgccttggtgctaaagctgctgacggtcaaactgtttcaggtggatcaatcctttaccgtcaacgtggaactcatatctacccaggtgtaaacgtaggccgtggtggagatgacacactttttgctaaagttgaaggtgttgtacgtttcgaacgtaaaggacgcgataaaaaacaagtttctgtttacccagtagctaaa

SEQ ID NO: 2556 - protein, 97 aa, Streptococcus agalactiae
MLKMNLANLQLFAHKKGGGSTSNGRDSQAKRLGAKAADGQTVSGGSILYRQRGTHIYPGVNVGRGGDDTLFAKVEGVVRFERKGRDKKQVSVYPVAK

SEQ ID NO: 2557 - DNA, 336 bp, Streptococcus agalactiae
atgattaaagcaacttttactcgtaatcaatcaggctatctttatagtgctgaaatcagcggtcatgctggtagtggcgagtacggctttgatgtgatttgtgcagctgttagtactttatcaattaattttattaattcattagaggctttaacaacctgccaagcgcaattgattatcaatgacgttgaaggtggttatatgaagatagatttatcttctataccacaacataaagaggataaggttcaattattatttgagtcttaccttcttggaatgactaatctgtctaaagattcttctgaatttgttagtacagtagtcatgacacac

SEQ ID NO: 2558 - protein, 112 aa, Streptococcus agalactiae
MIKATFTRNQSGYLYSAEISGHAGSGEYGFDVICAAVSTLSINFINSLEALTTCQAQLIINDVEGGYMKIDLSSIPQHKEDKVQLLFESYLLGMTNLSKDSSEFVSTVVMTH

SEQ ID NO: 2559 - DNA, 324 bp, Streptococcus pyogenes
atgattaaagcaatttttactcgccaaaaaaatggtcaactgagcagtgttacactgacaggtcatgctggtagtggtaaacatggctttgatattgtttgtgcctctgttagtactctagccattaactttgttaattctcttgaggtgttagcagattgccaagcattagtagatcttaatgatgttgaaggtgggtatatggctattacaataccaccacatgacaacaaggaggaagttcaattattatttgaatcttttcttctaggaatgactagtttggcgaaggattcttcgaaatttgtcaacactcaggtcatc

SEQ ID NO: 2560 - protein, 108 aa, Streptococcus pyogenes
MIKAIFTRQKNGQLSSVTLTGHAGSGKHGFDIVCASVSTLAINFVNSLEVLADCQALVDLNDVEGGYMAITIPPHDNKEEVQLLFESFLLGMTSLAKDSSKFVNTQVI

SEQ ID NO: 2561 - DNA, 312 bp, Streptococcus agalactiae
atgagcacatacgcaatcatcaaaactggtggtaaacaagttaaagttgaagtaggacaagctatctacgttgaaaaacttgacgttgaagcaggagcagaagttacatttaacgaagttgttcttgttggtggtgaaacaactaaagttggtactccagttgttgaaggagctactgttgttggtactgttgaaaaacaaggcaaacaaaagaaagttgtttcttacaaatacaaacctaaaaaaggtagccaccgtaaacaaggtcaccgtcaaccttatacaaaagttgttatcaacgcaatcaacgct

SEQ ID NO: 2562 - protein, 104 aa, Streptococcus agalactiae
MSTYAIIKTGGKQVKVEVGQAIYVEKLDVEAGAEVTFNEVVLVGGETTKVGTPVVEGATVVGTVEKQGKQKKVVSYKYKPKKGSHRKQGHRQPYTKVVINAINA

SEQ ID NO: 2563 - DNA, 312 bp, Streptococcus pyogenes
atgagcacatacgcaatcatcaaaactggtggaaaacaagttaaagttgaagtaggtcaagcaatctacgttgagaaaattgacgctgaagctggcgcagaagtcacttttaacgaagttgttcttgtaggtggtgacaaaactgtagttggtactccagttgttgaaggagctactgtcgttggaactgttgaaaaacaaggaaaacaaaagaaagttgtaactttcaaatacaaacctaaaaaaggtagccaccgtaaacaaggtcatcgtcaaccttacactaaagttgtcatcaacgcaatcaacgct

SEQ ID NO: 2564 - protein, 104 aa, Streptococcus pyogenes
MSTYAIIKTGGKQVKVEVGQAIYVEKIDAEAGAEVTFNEVVLVGGDKTVVGTPVVEGATVVGTVEKQGKQKKVVTFKYKPKKGSHRKQGHRQPYTKVVINAINA

SEQ ID NO: 2565 - DNA, 1164 bp, Streptococcus agalactiae
atgaagagcgctgctatgactatggaatttgagcgtgcggctgaatatcgagatttgatcgaagcaattagtttgttgcgtactaagcagcgtgttattcatcaagatatgaaggatagagatgtttttggttatttcgttgataagggttggatgtgtgtacaggtcttttttgttcgaaatggaaaattgattcagcgtgacgtgaatatgtttccttattataatgaaccagaggaagattttctaacttacatagggcaattttatcaagatacaaaacattttctacccaaagaagtctttattccacaggatattgatgctaagtcggttgaaacaattgtaggctgtaagattgttaaaccacaacgtggtgaaaagaaacagttagtaaatctggcaataaaaaatgctcgtgtcagtttacaacagaagtttgacttactggaaaaagatattcgtaaaactcatggggcaattgaaaatttaggtaatcttcttaatatccctaaaccagtacgcatagaagcatttgataattccaatattcaagggacaagtccagtagctgctatggtggtatttgtgaatggaaagccaagtaaaaaagactatcgaaagtttaaaattaagactgttatcggaccagatgattatgctagtatgagagaagtcattcatcggcgttatagtagggttttaaaagatggcttgacacctccggacttgattgtaattgatggtggtcaggggcaagtaaatatagcgcgtgatgttattgagaaccaatttggtttagccatacctattgcaggtttgcaaaagaatgataaacaccaaacacatgaattactttttggagatcctttagaagtagtagagctaccgcgtaattcagaagaatttttcttacttcaccgtattcaagatgaggtacatcgttttgctattacttttcatcgtcaattacgctccaaaaattccttttcttcaaaattagatggtatcactgggttgggaccaaaacgtaaacaattgctaatgaaacattttaaaagcttacctaatatccaaaaagctgagattgaggacattattatgtgtggtattcctaggactgttgcagaaagtctccgagattctcttaatgatcctcctaaa

SEQ ID NO: 2566 - protein, 388 aa, Streptococcus agalactiae
MKSAAMTMEFERAAEYRDLIEAISLLRTKQRVIHQDMKDRDVFGYFVDKGWMCVQVFFVRNGKLIQRDVNMFPYYNEPEEDFLTYIGQFYQDTKHFLPKEVFIPQDIDAKSVETIVGCKIVKPQRGEKKQLVNLAIKNARVSLQQKFDLLEKDIRKTHGAIENLGNLLNIPKPVRIEAFDNSNIQGTSPVAAMVVFVNGKPSKKDYRKFKIKTVIGPDDYASMREVIHRRYSRVLKDGLTPPDLIVIDGGQGQVNIARDVIENQFGLAIPIAGLQKNDKHQTHELLFGDPLEVVELPRNSEEFFLLHRIQDEVHRFAITFHRQLRSKNSFSSKLDGITGLGPKRKQLLMKHFKSLPNIQKAEIEDIIMCGIPRTVAESLRDSLNDPPK

SEQ ID NO: 2567 - DNA, 1794 bp, Streptococcus pyogenes
atgaacgaactgattaaacataaactagaactcttaccagacagccctggctgttacttacataaagataaagaaggaactattatctatgtcggtaaggccaagaatttgaaaaaacgcgtccggtcctattttcgtgggagccatgataccaaaacagagttactagtatctgagattgtagatttcgaatatattgtaacagagtcagataccgaagcgcttttgttggaaattaacttgattcaaaaaaatatgcctaagtacaacatcaagttaaaagatgataaatcttatccctttctcaaaatcacaaatgagtcttttcctcggttagtgattacaagatatattaagaaaaatgatggattgtactttgggccctacccagattcttacactgctaatgaagttaaaaagttattagataggatttttccatttaaaaagtgtaaaaatcctatcaataaggtctgtttttattaccatttaggccagtgctgtgctcataccatttgtcatacagacaaggcctattgggatcgtttaattgatgatgttaagcactttttaaatggtaaagatgacaaaattattgaagatcttcgttctaagatgttagcagcttctaaagaaatggcatttgaacgtgccgctgaatatcgagatttgatttcaggtattgccaccatgcgcaccaagcagcgggtgatgagcaaggatttgcaagatagagatatctttggctattatgttgataagggatggatgtgtgtccaagttttctttgtgcgtcaagggaaattaattcagcgtgatgttaacctttttccctattataccgatgcagaagaagatttcttaacttatatggggcaattttaccaagataaacagcatttcatccctaaagaagtctttattccagaagctattgatgaagaactggtagccgctattgtgccaaccaaaatcatcaaacccaaacgcggtgaaaaaaaacaactggtagctttggctactaagaatgctcgtgttagtctgcaacaaaaatttgatttattagaaaaagatatcaaaaaaacgagtggtgctatcgaaaatttaggtcagttacttaggattgacaagcctgtgcgcattgaagcctttgataattctaacattcaagggacaagtccagttgcggctatggttgtttttgttgatggcaaacctagtaagaaagattatcgtaaatttaagattaaaacagtggtgggaccagatgattatgccagtatgagagaagtgctttttcgaaggtacagtcgggtgaaaaaggagggactgcaagctcctaacttgattattgttgatggaggcgttggacaagtcaatgtggccaaagatgtgatagaaaaacaacttggactcactattcctgttgcgggacttcaaaaaaacgataagcaccagacccatgatttgctttttggaaacccacttgaagttgtaccgttgccgcgccgttctgaagagtttttcttactgcatcggattcaagacgaagtgcatcgctttgcagttacatttcatagacaagtgcgacgtaaaaattctttttcatcaacattagatcatatttcagggcttggcccaaagcgaaaacagttattactaagacactttaaaaccataacagcgattgcatcagctacctctgaggagattcaagctttaggtatacctaaaacagtagttgaagcaatacagcaacagataacagacaataaaaatgatagatcgtcccct

SEQ ID NO: 2568 - protein, 598 aa, Streptococcus pyogenes
MNELIKHKLELLPDSPGCYLHKDKEGTIIYVGKAKNLKKRVRSYFRGSHDTKTELLVSEIVDFEYIVTESDTEALLLEINLIQKNMPKYNIKLKDDKSYPFLKITNESFPRLVITRYIKKNDGLYFGPYPDSYTANEVKKLLDRIFPFKKCKNPINKVCFYYHLGQCCAHTICHTDKAYWDRLIDDVKHFLNGKDDKIIEDLRSKMLAASKEMAFERAAEYRDLISGIATMRTKQRVMSKDLQDRDIFGYYVDKGWMCVQVFFVRQGKLIQRDVNLFPYYTDAEEDFLTYMGQFYQDKQHFIPKEVFIPEAIDEELVAAIVPTKIIKPKRGEKKQLVALATKNARVSLQQKFDLLEKDIKKTSGAIENLGQLLRIDKPVRIEAFDNSNIQGTSPVAAMVVFVDGKPSKKDYRKFKIKTVVGPDDYASMREVLFRRYSRVKKEGLQAPNLIIVDGGVGQVNVAKDVIEKQLGLTIPVAGLQKNDKHQTHDLLFGNPLEVVPLPRRSEEFFLLHRIQDEVHRFAVTFHRQVRRKNSFSSTLDHISGLGPKRKQLLLRHFKTITAIASATSEEIQALGIPKTVVEAIQQQITDNKNDRSSP

SEQ ID NO: 2569 - DNA, 96 bp, Streptococcus agalactiae
atgaatgaaaatgtaccagcaacaacagctagtgcaactgttccaattacagatataaataaactggttaaaataattttacttagaagacgccac

SEQ ID NO: 2570 - protein, 32 aa, Streptococcus agalactiae
MNENVPATTASATVPITDINKLVKIILLRRRH

SEQ ID NO: 2571 - DNA, 651 bp, Streptococcus agalactiae
atggatgttatcatgacaaaagatcataaattagtagtcatccatgatgataatctcaaacgactctctggtatgaacaaagatgtttctaaactaactttagatcaagttacaaaaatcccaattcaccaagggcgttttgctagtcacattccatcatttacagaatttatgaagaccgctcagtcactagatcaaaaaatcatgattgaattgaaaccgtataatcaaaacctcgatatctatgcggatgaatttatcaaagaatttaaagagcttcgtctctcaaccaagcataaagtaatgtctctcaacttgacactcattgaaaaagttgagaaaaaattgccacaacttgatacaggttacctaatcccactacattggggaacgcttcaaaatcataacgttgacttttatgggattgaggaattttcatacaatgattggattgcatatctcgcccaagaatataataaacagctctatgtttggactattaaccgtgataaccttatgatacgttatttacaaagcccagttaatggaatcatcacagatgaactcaaccttttcaaggtcattaataaagatatcaaaaatagccctaattattatcaaagagctctccaacttattgatagcgagggt

SEQ ID NO: 2572 - protein, 217 aa, Streptococcus agalactiae
MDVIMTKDHKLVVIHDDNLKRLSGMNKDVSKLTLDQVTKIPIHQGRFASHIPSFTEFMKTAQSLDQKIMIELKPYNQNLDIYADEFIKEFKELRLSTKHKVMSLNLTLIEKVEKKLPQLDTGYLIPLHWGTLQNHNVDFYGIEEFSYNDWIAYLAQEYNKQLYVWTINRDNLMIRYLQSPVNGIITDELNLFKVINKDIKNSPNYYQRALQLIDSEG

SEQ ID NO: 2573 - DNA, 1773 bp, Streptococcus pyogenes
ttgtcaggcaatgagttgtttaaaataaaggagattagttcaatgacatttttatctgatttgatatcattaatgacaaaaatcagattatcttgggtaataaaggcgggtatttttcaattattatttgtaacgattgctaatattgtcttatcagaatttttctattttatattagacgttactggtcaatatcatttagataaagacaatgttgtgacttttttaaaaaatcctatagcacttgctttattaggtgcctatttatttttattagctgcttttattcaccttgagttttttgctctatatcgaattattgcggatcaagaaattagtttctatctttttagaaaacagttttcttattacctaagggggctttggaaaacattttctggttaccaattattactttttttgctttatatcctattgactattccagtcttacatattggtttatcttctgtgattactcaaaagctttatcttccagaatttattgttggggaattatcaaagataactagcacaaagtacttgctttatggcagtcttattcttgtgttttaccttaacctaagattagtatattttttaccattgatagcaatcaaccatcgtacggttgctcaagcatggagagagagttggcaaaagactaaaaagaaacatgtattgttatggatgaaactttttgcaatcaatggtcttacgattgtagtcttatcgctagctatttccatgattcttatttttgttgatatgtttaatcctaaggggaataatattattgttcagctgggagctttgacctttacatgggaactcattttttttactactattttttttaaactctgttcagcaatgattttaaaagaggcaattgaaccacaaaagcaatatgatgagccaagaagaagtaataaggcatatgttgtaatctttatcgtggttacagtaggttttgcttatcaatctcttgaacgtttaactttttttgacacatctcactctaagacagttatcgcgcatagaggacttgtatcagcaggtgtagaaaattctctggaagcccttgaaggtgctaagaaagcaggaagtgattatgtagaactggatctaatcttgactaaggataatcactttgtggtgtctcatgataatcgattgaagcgtttagctggagtaaataagacgattcgcaacttaaccttaaaagaagttgaacatctaacgagtcatcaaggacatttttcagggcgttttgtttcttttgacactttttatcaaaaggctaagaagttgaatatgccattacttattgaactcaagccaattggtacagaacctggaaattatgtcgatttgtttttagaaacttatcatcgacttggtataagcaaagataataaagtcatgtctttagatttagaagtaatagaagctatcaagaaaaaaaatccatcaattacgactggttatatcataccaattcaatttggattttttggagatgaatttgttgatttctatgtcattgaagacttttcttatcggtcttatttgtcgtcccaagctttttggaataataaagaaatttacgtttggactattaatgatcccaagcgcatagagcattatctcctaaagcctattcagggaattattacagaccaaccagctttaactaatcaattgattaaagacttaaaacaagataattcttattttagtcgattagtcagaattattagtagtctttat

SEQ ID NO: 2574 - protein, 591 aa, Streptococcus pyogenes
LSGNELFKIKEISSMTFLSDLISLMTKIRLSWVIKAGIFQLLFVTIANIVLSEFFYFILDVTGQYHLDKDNVVTFLKNPIALALLGAYLFLLAAFIHLEFFALYRIIADQEISFYLFRKQFSYYLRGLWKTFSGYQLLLFLLYILLTIPVLHIGLSSVITQKLYLPEFIVGELSKITSTKYLLYGSLILVFYLNLRLVYFLPLIAINHRTVAQAWRESWQKTKKKHVLLWMKLFAINGLTIVVLSLAISMILIFVDMFNPKGNNIIVQLGALTFTWELIFFTTIFFKLCSAMILKEAIEPQKQYDEPRRSNKAYVVIFIVVTVGFAYQSLERLTFFDTSHSKTVIAHRGLVSAGVENSLEALEGAKKAGSDYVELDLILTKDNHFVVSHDNRLKRLAGVNKTIRNLTLKEVEHLTSHQGHFSGRFVSFDTFYQKAKKLNMPLLIELKPIGTEPGNYVDLFLETYHRLGISKDNKVMSLDLEVIEAIKKKNPSITTGYIIPIQFGFFGDEFVDFYVIEDFSYRSYLSSQAFWNNKEIYVWTINDPKRIEHYLLKPIQGIITDQPALTNQLIKDLKQDNSYFSRLVRIISSLY

SEQ ID NO: 2575 - DNA, 591 bp, Streptococcus agalactiae
gtggtacaatatctaatgactataaaaaaggagctattcatgctacgagcattaaaagaagatttttttctaaccttaacctctttaaaaaatcaattttgggtttacattggaactggtatcttaatccaaactttagttgcttatttagtaaaaggaattctgagttttatctttcgtcggatattgatattgtcaaatactcccgcagtgactaaagacaattggactttactttttaatcatcccttagctttattactctttatactttatatcgtaatcctaattgggttcatctatactgagttcgctatctatactattgccatactgaaaactgaattttctctcagtatcaaaaaatggctaacaatctttcctaaaaaaataaaatcacttttaggaccacagctaatttgggtatcaatctacttacttttgacaattcctctagctaaccttggtctaaggtcaagtatactagagcatcttaaaattcctgactttatttctggcgagttaacaaagacagtctttggaaagataggttactctacccttttactgcttatttgttacttaaacctt

SEQ ID NO: 2576 - protein, 197 aa, Streptococcus agalactiae
MVQYLMTIKKELFMLRALKEDFFLTLTSLKNQFWVYIGTGILIQTLVAYLVKGILSFIFRRILILSNTPAVTKDNWTLLFNHPLALLLFILYIVILIGFIYTEFAIYTIAILKTEFSLSIKKWLTIFPKKIKSLLGPQLIWVSIYLLLTIPLANLGLRSSILEHLKIPDFISGELTKTVFGKIGYSTLLLLICYLNL

SEQ ID NO: 2577 - DNA, 246 bp, Streptococcus agalactiae
ttgaaaactaccataaaaaacaaacaaacttgtggtacaatatctaatgactataaaaaaggagctattcatgctacgagcattaaaagaagatttttttctaaccttaacctctttaaaaaatcaattttgggtttacattggaactggtatcttaatccaaactttagttgcttatttagtaaaaggaattctgagttttatctttcgtcggatattgatattgtcaaatactcccgcagtgac

SEQ ID NO: 2578 - protein, 82 aa, Streptococcus agalactiae
MKTTIKNKQTCGTISNDYKKGAIHATSIKRRFFSNLNLFKKSILGLHWNWYLNPNFSCLFSKRNSEFYLSSDIDIVKYSRSD

SEQ ID NO: 2579 - DNA, 105 bp, Streptococcus agalactiae
ttgttttttatggtagttttcaaaccggtttcacttttttatcaattttgccttcaaaagctgaaacgcattttaaaaagtgatagaatagtagggaaaatcaaa

SEQ ID NO: 2580 - protein, 35 aa, Streptococcus agalactiae
MFFMVVFKPVSLFYQFCLQKLKRILKSDRIVGKIK

SEQ ID NO: 2581 - DNA, 600 bp, Streptococcus agalactiae
atgaaatttctagaattaaataagaagcgccatgctgtgaaacattttaatgataaaccagtcgactttaaagatgttagaactgctattgaaattgcgacattagcgccatctgctaataatattcagccttggaagtttgtcgttgtccaagaaaaaaaatctgctctagcagaaggtttaccggaaagtaattgtaaccaaattaatcaagcgcagtatgttattgctttatttacagatacagatttaggacagagatcacggaaaatagctcgtattggtcgtagatctcttcctgatgatttaattggttattacatggaaactctaccaccacgctatgctttatatagtgaaaaacaaactggagagtatctctctttaaatgcaggtatcgttgctatgaatttagtacttgccttgacagatcaaggtattagttctaatatgattttagggttcgataaagcgattactaatgatgtcttagagatagataaacgttttagaccagaaatattaattactgttggttatagtgatgaaaaggttgaacctagttatcgtttgccagttgatcatattattgaaaaacgt

SEQ ID NO: 2582 - protein, 200 aa, Streptococcus agalactiae
MKFLELNKKRHAVKHFNDKPVDFKDVRTAIEIATLAPSANNIQPWKFVVVQEKKSALAEGLPESNCNQINQAQYVIALFTDTDLGQRSRKIARIGRRSLPDDLIGYYMETLPPRYALYSEKQTGEYLSLNAGIVAMNLVLALTDQGISSNMILGFDKAITNDVLEIDKRFRPEILITVGYSDEKVEPSYRLPVDHIIEKR

SEQ ID NO: 2583 - DNA, 600 bp, Streptococcus pyogenes
atgaaatttctagagttaaacaaaaaacgccatgccattaagacctttaatgaccagccagttgactacgaggatttgcgaacagccattgagattgcaaccttagcacctagtgccaataacattcaaccttggaaatttgtagtcgttcaagagaaaaaagctgagttagcaaaagggttacctctagcaaataaagtgcaggttgaacaggctcaatatgtagtggcgctattttcagacactgatttagctttacgttctcgtaaaattgcccgtatcggtgtcaaatcattaccagacgacttaattggttattatatggagactttgccaccacgttttgctgcttttaatgaggttcaaaccggtgagtacttagctattaatgcaggcattgtggctatgaacttggtgttatccttgacggatcaaaagattgcttccaatattatccttggttttgataagtcaacgaccaatgagattttagacatcgatccgcgttttcgtccagaattattgattactgttggctatagtgacgagaaaccagaaccaagttatcgtttgcctgttgatgaagtcatcgaaagaaga

SEQ ID NO: 2584 - protein, 200 aa, Streptococcus pyogenes
MKFLELNKKRHAIKTFNDQPVDYEDLRTAIEIATLAPSANNIQPWKFVVVQEKKAELAKGLPLANKVQVEQAQYVVALFSDTDLALRSRKIARIGVKSLPDDLIGYYMETLPPRFAAFNEVQTGEYLAINAGIVAMNLVLSLTDQKIASNIILGFDKSTTNEILDIDPRFRPELLITVGYSDEKPEPSYRLPVDEVIERR

SEQ ID NO: 2585 - DNA, 1404 bp, Streptococcus agalactiae
atgacaattgattttagagcagaagtagacaaacgcaaagacgctttgatggacgatttaataaatcttcttcgcattaactcggagcgtgatgattcacaagctgatgcagagcatccatttggtcctggacctgtaaaagccttggaatttttccttgagatggctgagcgagatggctacgaaacaaaaaacgtagataattatgcgggacactttacatttggtcaaggcgaagaagaactaggtatttttgggcatttagatgttgttcctgcaggcagcggttgggatacagacccttatgaaccagttatcaaggataaccgtttatatgctcgaggctcatcagacgataagggaccaacaatggcatgttattatgctctaaaaattattaaagagcttgggctaccaacatctaagaaagttcgttttgttgtaggaactgatgaagaatctggatggggagatatggattactacttcgaacatgttggtcttccaaaacctgattttggtttctctccagatgcagaatttccaattataaatggtgaaaaaggtaatattactgaatatttacatttttcaggagaaaataagggagctgttagactgcatagcttttctggcggacttcgcgaaaacatggttccagaatcagccacagcacgtttcacaagtcatttagatcagacaacacttggggctagtctagctgattttgcaagtaaacataatttgaaagcagaattatctgtagaagatgagcaatatacagcaacagtttatggtaaatctgctcatggttcaacaccacaagaaggtgttaatggggcgacttatttagctctttatctaagtcaatttgattttgaaggtcctgctcgtgctttcttagatgttacagccaacattattcacgaagacttctcaggtgaaaaacttggagtagcttatgaagatgactgtatgggaccattgagcatgaatgcaggtgtcttccagtttgatgaaactaatgatgataatactatcgctcttaatttccgttacccacaagggacagatgctaaaactatccaaactaagcttgagaaacttaacggagttgaaaaagtgactctttctgaccatgaacacacaccacactatgtacctatggacgatgaattagtatcaaccttactagctgtctatgaaaagcaaactggtcttaaaggacatgaacaggttattggtggtgggacatttggtcgcttacttgaacggggtgttgcatacggtgccatgttcccaggagatgaaaacactatgcatcaagctaatgagtacatgcctttagaaaatattttccgttcggctgctatctacgcagaagctatctatgaattaatcaaa

SEQ ID NO: 2586 - protein, 468 aa, Streptococcus agalactiae
MTIDFRAEVDKRKDALMDDLINLLRINSERDDSQADAEHPFGPGPVKALEFFLEMAERDGYETKNVDNYAGHFTFGQGEEELGIFGHLDVVPAGSGWDTDPYEPVIKDNRLYARGSSDDKGPTMACYYALKIIKELGLPTSKKVRFVVGTDEESGWGDMDYYFEHVGLPKPDFGFSPDAEFPIINGEKGNITEYLHFSGENKGAVRLHSFSGGLRENMVPESATARFTSHLDQTTLGASLADFASKHNLKAELSVEDEQYTATVYGKSAHGSTPQEGVNGATYLALYLSQFDFEGPARAFLDVTANIIHEDFSGEKLGVAYEDDCMGPLSMNAGVFQFDETNDDNTIALNFRYPQGTDAKTIQTKLEKLNGVEKVTLSDHEHTPHYVPMDDELVSTLLAVYEKQTGLKGHEQVIGGGTFGRLLERGVAYGAMFPGDENTMHQANEYMPLENIFRSAAIYAEAIYELIK

SEQ ID NO: 2587 - DNA, 1458 bp, Streptococcus pyogenes
ttggcttattttaagttaaacattatccctaaaacgaataaggagagtataatgacaaccattgattttaaagcagaagttgacaaacgtaaaaaagctatgctagcagatttagttgacctattacgcattaattcagaacgcgatgaccaattagctgatgataaacacccatttggcccaggtccagttaaggccttggagcatttcctcgcaatggctgagcgtgatggctacaaaacgcgtaatattgataactatgcaggtgactttgaatttggtcaaggtgatgaagtactaggaatctttggtcaccttgatgttgtgccagctggtagcggttgggatacagacccttatgagccagtgattaaagacgatcgcatctatgcgcgtgggtcttcggatgataaaggaccaaccatggcgtgttactacgctctgaaaatcattaaagaactgggtcttcctgtgtctaaaaaagttcgtttcattgttggtaccgatgaagaatctggctggggggatatggattattactttgctcataatggcttgaaaaatccagattttggtttctcaccagatgctgaatttccaattatcaatggtgagaaaggaaatatcactgaatacctccatttcgctggtgacaacaagggcgcttttgtgcttcatcgcttccaaggtgggttgcgtgaaaacatggtaccagaatctgccacagctgtcattacggcaccgcatgaccttgatgtgctagaagcagctttggagcaatttttatcagaacatggtgttaaaggttctatgaaggctactgatggtaaaattgaagtaactattattggtaagtctgctcacgggtcgactccagaagcgggtgttaatggtgctaccttgttggctaaattcctgaatcaatttacctttgaaggggctgctaaggattatttacatgtggcaggtgaggtgcttcatgaagactttgcggcagaaaaactaggccttgcttatactgatgaccgtatgggagccctgagcatgaacgcaggtgtcttcacctttgatagtcaatcagctgacaataccatcgccttgaatttccgctatcccaaaggaactgatgcggcaaccttaaaagcaggattggaaaaattaccaggattaactaaggtaagcctttctgagcatgaacatacacctcattatgtgccaatggatgatgaattagtagctaccttacttgctgtttacgaaaaacaaacaggtcttaaaggctacgaacaagttatcggcggaggaacctttgggcgcttgctagaacgtggtgtggcctttggagcgatgttcccaggtgatgaaaacactatgcaccaagctaatgagtatatgcctttagaaaatatttatcgctcagcagctatttatgctgaagcaatctacgaattaattaaa

SEQ ID NO: 2588 - protein, 486 aa, Streptococcus pyogenes
LAYFKLNIIPKTNKESIMTTIDFKAEVDKRKKAMLADLVDLLRINSERDDQLADDKHPFGPGPVKALEHFLAMAERDGYKTRNIDNYAGDFEFGQGDEVLGIFGHLDVVPAGSGWDTDPYEPVIKDDRIYARGSSDDKGPTMACYYALKIIKELGLPVSKKVRFIVGTDEESGWGDMDYYFAHNGLKNPDFGFSPDAEFPIINGEKGNITEYLHFAGDNKGAFVLHRFQGGLRENMVPESATAVITAPHDLDVLEAALEQFLSEHGVKGSMKATDGKIEVTIIGKSAHGSTPEAGVNGATLLAKFLNQFTFEGAAKDYLHVAGEVLHEDFAAEKLGLAYTDDRMGALSMNAGVFTFDSQSADNTIALNFRYPKGTDAATLKAGLEKLPGLTKVSLSEHEHTPHYVPMDDELVATLLAVYEKQTGLKGYEQVIGGGTFGRLLERGVAFGAMFPGDENTMHQANEYMPLENIYRSAAIYAEAIYELIK

SEQ ID NO: 2589 - DNA, 582 bp, Streptococcus agalactiae
atgactgacttggaaaaaattattaaagcaataaaaagtgattcacagaatcaaaattatacagaaaatggtattgatcctttgtttgctgctcctaaaacagctaggatcaatattgttggccaagcacctggtttaaaaactcaagaagcaagactctattggaaagataaatctggagatcgtctacgccagtggcttggagttgatgaagagacattttaccattctggaaaatttgctgttttacctttagatttttattacccaggcaaaggaaaatcaggagatttatcccctagaaaaggttttgcggagaaatggcaccctcttattttaaaagaaatgcctaatgttcaattgaccttgctagttggtcagtatactcagaaatattatcttggaagctccgcacataaaaatctaacagaaacagttaaagcttacaaagactatctacccgattatttacccctggttcacccatcaccgcgaaatcaaatttggctaaagaagaatccatggtttgaaaaagatctaatcgttgatttacaaaagatagtagcagatattttaaaagat

SEQ ID NO: 2590 - protein, 194 aa, Streptococcus agalactiae
MTDLEKIIKAIKSDSQNQNYTENGIDPLFAAPKTARINIVGQAPGLKTQEARLYWKDKSGDRLRQWLGVDEETFYHSGKFAVLPLDFYYPGKGKSGDLSPRKGFAEKWHPLILKEMPNVQLTLLVGQYTQKYYLGSSAHKNLTETVKAYKDYLPDYLPLVHPSPRNQIWLKKNPWFEKDLIVDLQKIVADILKD

SEQ ID NO: 2591 - DNA, 573 bp, Streptococcus pyogenes
atggatgatttaaccaaagctattatggcagatgaggctaatctctcctataccgaaagaggtatttttcctttatatgatgctcctcaaacagctaggattattattgttggccaagctcctggaatagtagctcaaggaaccaaactttactggaatgatcgtagtggcatccgcttacgagactggctaggtgtggacaatgacaccttttaccactcaggattgtttggcattatccctatggatttctattatcctggtaagggaaaatccggtgacttaccacctagagaaggttttgcggctaagtggcacccgccattaagagcattgatgccagaagttgaattgacgattttggttggtcgctatgctcaggacttttaccttggtaacaaggcttacaaaaccttaactgaaacagtccgtcactttgaggattacttgccagactattttccacttgttcatccttctccaagaaaccaattgtggttagctaagaacccctggtttgagcaggatttattacctatcttgcaaaaacgtgtggaggcaattctaaccaaa

SEQ ID NO: 2592 - protein, 191 aa, Streptococcus pyogenes
MDDLTKAIMADEANLSYTERGIFPLYDAPQTARIIIVGQAPGIVAQGTKLYWNDRSGIRLRDWLGVDNDTFYHSGLFGIIPMDFYYPGKGKSGDLPPREGFAAKWHPPLRALMPEVELTILVGRYAQDFYLGNKAYKTLTETVRHFEDYLPDYFPLVHPSPRNQLWLAKNPWFEQDLLPILQKRVEAILTK

SEQ ID NO: 2593 - DNA, 252 bp, Streptococcus agalactiae
atgagagataatcatctacacacgtatttttcctatgattgtcaaacggcatttgaggactatattaatggttttacaggtgaatttatcacaacagaacattttgatttatcaaatccttacaccggtcaagacgatgttcctgattatagtgcttattgtcaaaaaatagattatcttaatcagaaatatggaaatcgatttaaaaaggaattgaaatcggttattttaaagatagggaatcagatattt

SEQ ID NO: 2594 - protein, 84 aa, Streptococcus agalactiae
MRDNHLHTYFSYDCQTAFEDYINGFTGEFITTEHFDLSNPYTGQDDVPDYSAYCQKIDYLNQKYGNRFKKELKSVILKIGNQIF

SEQ ID NO: 2595 - DNA, 441 bp, Streptococcus agalactiae
ttgtcaatccatcataatggtaggtatgattatctgcaagaagaagctctgaaagtaccaacaaaggagcttttagcagattactttaatcgtatggaatttgccataggccgtgtggaagcgcacgttttagctcactttgattatggttttcgtaagttaaacttagatgtagaagatttaaaaccgtttgaaacgcaattgaagcgcattttcataaagatgttatctaaggggttagcttttgaactaaataccaaatccctttatctatatgggaatgaaaaactttatcgctatgctttagagatactcaaacagcttggttgtaaacaatactctataggctctgacggtcatattcctgaacatttttgttatgaatttgatagacttcaaggtctgctaaaggactatcaaattgatgaaaatcatttgata

SEQ ID NO: 2596 - protein, 147 aa, Streptococcus agalactiae
MSIHHNGRYDYLQEEALKVPTKELLADYFNRMEFAIGRVEAHVLAHFDYGFRKLNLDVEDLKPFETQLKRIFIKMLSKGLAFELNTKSLYLYGNEKLYRYALEILKQLGCKQYSIGSDGHIPEHFCYEFDRLQGLLKDYQIDENHLI

SEQ ID NO: 2597 - DNA, 3756 bp, Streptococcus agalactiae
atgaaaagaaaagacttatttggtgataaacaaactcaatacacgattagaaagttaagtgttggagtagcttcagttgcaacaggggtatgtatttttcttcatagtccacaggtatttgctgaagaagtaagtgcttctcctgcaaatacagcgattgcagagtcgaatattaatcaggttgacaaccaacaatctactaatttaaaagatgacataaactcaaactctgagacggttgtgacaccctcagatatgccggataccaagcaattagtatcagatgaaactgacactcaaaagggagtgacagagccggataaggcgacaagcctgcttgaagaaaataaaggtcctgtttcagataaaaataccttagatttaaaagtagcaccatctacattgcaaaatactcccgacaaaacttctcaagctataggtgctccaagccctaccttgaaagtagctaatcaagctccacggattgaaaatggttactttaggctacatcttaaagaattgcctcaaggtcatcctgtagaaagcactggactttggatatggggagatgttgatcaaccgtctagtaattggccaaatggtgctatccctatgactgatgctaagaaagatgattacggttattatgttgattttaaattatctgaaaaacaacgaaaacaaatatcttttttaattaataacaaagcagggacaaatttaagcggcgatcatcatattccattattacgacctgagatgaaccaagtttggattgatgaaaagtacggtacacatacttatcaacccctcaaagaagggtatgtccgtattaactatttgagttcctctagtaactatgaccacttatcagcatggctctttaaagatgttgcaaccccctcaacaacttggccagatggtagtaattttgtgaatcaaggactatatggaaggtatattgatgtatcactaaaaactaacgccaaagagattggttttctaatcttagatgaaagtaagacaggagatgcagtgaaagttcaacccaacgactatgtttttagagatttagctaaccataaccaaatttttgtaaaagataaggatccaaaggtttataataatccttattacattgatcaagtgcagctaaaggatgcccaacaaattgatttaacaagtattcaagcaagttttacaactctagatggggtagataaaactgaaattttaaaagaattgaaagtgactgataaaaatcaaaatgctatacaaatttctgatatcactctcgatactagtaaatctcttttaataatcaaaggcgactttaatcctaaacaaggtcatttcaacatatcttataatggtaacaatgtcatgacaaggcaatcttgggaatttaaagaccaactttatgcttatagtggaaatttaggtgcagttctcaatcaagatggttcaaaagttgaagccagcctctggtcaccgagtgctgatagtgtcactatgattatttatgacaaagataaccaaaacagggttgtagcgactaccccccttatgaaaaataataaaggtgtttggcagacgatacttgatactaaattaggtattaaaaactatactggttactattatctttacgaaataaaaagaggtaaggataaggttaagattttagatccttatgcaaagtcattagcagagtgggatagtaatactgttaatgatgatattaaaacggctaaagcagcttttgtaaatccaagtcaacttggacctcaaaatttaagttttgctaaaattgctaattttaaaggaagacaagatgctgttatatacgaagcacatgtaagagacttcacttctgatcgatctttggatggaaaattaaaaaatcaatttggtacctttgcagccttttcagagaaactagattatttacagaaattaggagttacacacattcagcttttaccggtattgagttatttttatgttaatgaaatggataagtcacgctcaacagcttacacttcctcagacaataattacaattggggctatgacccacagagctattttgctctttctgggatgtattcagagaaaccaaaagatccatcagcacgtatcgccgaattaaaacaattaatacatgatattcataaacgtggcatgggggttatacttgatgtcgtctataatcacactgcaaaaacttatctctttgaggatatagaacctaattattatcactttatgaatgaagatggttcaccaagagaaagttttggagggggacgtttaggaaccactcatgcaatgagtcgtcgtgttttggttgattccattaaatatcttacaagtgaatttaaagttgatggtttccgttttgatatgatgggagatcatgatgcggctgcgattgaattagcttataaagaagctaaagctattaatcctaatatgattatgattggtgagggctggagaacattccaaggcgatcaaggtcagccggttaaaccagctgaccaagattggatgaagtcaaccgatacagttggcgtcttttcagatgatattcgtaatagcttgaaatctggttttccaaatgaaggtactccagctttcatcacaggtggcccacaatctttacaaggtatttttaaaaatatcaaagcacaacctgggaattttgaagcagattcgccaggagatgtggtgcagtatattgctgcacatgataaccttaccttgcatgatgtgattgcaaaatcaattaataaagaccctaaggtagctgaagaagagattcatagacgtctgcgtttaggaaatgtaatgattttaacatctcaagggacagcattcattcattctggtcaagagtatggtcgtacgaagcgtttacttaaccctgattacatgacaaaagtttcagatgacaaattgcctaataaagcaacacttattgaagctgttaaagaatacccatattttattcatgattcatatgattcttcagatgccattaatcattttgattgggcagcagccacagataataacaaacacccaatttcaacgaaaacacaggcctatacagcaggtttaatcacattaaggcgttcaacagatgctttccgaaaattgagcaaagcagaaattgatcgtgaggttagcttgattacagaggtaggtcaaggtgatattaaagaaaaagatttggttattgcttaccaaacaatagattctaaaggtgatatttacgcagtatttgttaatgctgatagtaaagctagaaacgttttactaggtgaaaaatataaacaccttttaaaagggcaagtaattgttgatgctgatcaagcggggattaaaccaatctcaactcctagaggtgttcattttgaaaaagatagtttgctgattgatccattaacagcaattgtgattaaagttggcaaagttgctcctagccctaaggaggaattgcaagcagattatcccaaaacacaatctttcaaggaatctaaaacggtagaaaaagtaaatagaatagctaataagacctcaataactcctgtagtttctaagaaggccgattcatatctgacaaatgaagctaatttgccaaaaactggagataagtcatcaaaaatactaagtgtagtaggaataagcattctagcaagtctacttgctctagtaggtctctctttaaagaggaatcgtcacttaaaa

SEQ ID NO: 2598 - protein, 1252 aa, Streptococcus agalactiae
MKRKDLFGDKQTQYTIRKLSVGVASVATGVCIFLHSPQVFAEEVSASPANTAIAESNINQVDNQQSTNLKDDINSNSETVVTPSDMPDTKQLVSDETDTQKGVTEPDKATSLLEENKGPVSDKNTLDLKVAPSTLQNTPDKTSQAIGAPSPTLKVANQAPRIENGYFRLHLKELPQGHPVESTGLWIWGDVDQPSSNWPNGAIPMTDAKKDDYGYYVDFKLSEKQRKQISFLINNKAGTNLSGDHHIPLLRPEMNQVWIDEKYGTHTYQPLKEGYVRINYLSSSSNYDHLSAWLFKDVATPSTTWPDGSNFVNQGLYGRYIDVSLKTNAKEIGFLILDESKTGDAVKVQPNDYVFRDLANHNQIFVKDKDPKVYNNPYYIDQVQLKDAQQIDLTSIQASFTTLDGVDKTEILKELKVTDKNQNAIQISDITLDTSKSLLIIKGDFNPKQGHFNISYNGNNVMTRQSWEFKDQLYAYSGNLGAVLNQDGSKVEASLWSPSADSVTMIIYDKDNQNRVVATTPLMKNNKGVWQTILDTKLGIKNYTGYYYLYEIKRGKDKVKILDPYAKSLAEWDSNTVNDDIKTAKAAFVNPSQLGPQNLSFAKIANFKGRQDAVIYEAHVRDFTSDRSLDGKLKNQFGTFAAFSEKLDYLQKLGVTHIQLLPVLSYFYVNEMDKSRSTAYTSSDNNYNWGYDPQSYFALSGMYSEKPKDPSARIAELKQLIHDIHKRGMGVILDVVYNHTAKTYLFEDIEPNYYHFMNEDGSPRESFGGGRLGTTHAMSRRVLVDSIKYLTSEFKVDGFRFDMMGDHDAAAIELAYKEAKAINPNMIMIGEGWRTFQGDQGQPVKPADQDWMKSTDTVGVFSDDIRNSLKSGFPNEGTPAFITGGPQSLQGIFKNIKAQPGNFEADSPGDVVQYIAAHDNLTLHDVIAKSINKDPKVAEEEIHRRLRLGNVMILTSQGTAFIHSGQEYGRTKRLLNPDYMTKVSDDKLPNKATLIEAVKEYPYFIHDSYDSSDAINHFDWAAATDNNKHPISTKTQAYTAGLITLRRSTDAFRKLSKAEIDREVSLITEVGQGDIKEKDLVIAYQTIDSKGDIYAVFVNADSKARNVLLGEKYKHLLKGQVIVDADQAGIKPISTPRGVHFEKDSLLIDPLTAIVIKVGKVAPSPKEELQADYPKTQSFKESKTVEKVNRIANKTSITPVVSKKADSYLTNEANLPKTGDKSSKILSVVGISILASLLALVGLSLKRNRHLK

SEQ ID NO: 2599 - DNA, 3522 bp, Streptococcus pyogenes
ttgaatgttatactaaatggaggtcttatgaaaaagaaagtcaaccaaggatcaaagcgctatcaatatctgttaaaaaagtgggggataggttttgtaatcgctgcaactgggactgtcgtgttagggtgcacccctagtatcttaacacatcaagttgctgctaaaaccattgttggactagcccgcgatgaagctcaacaaggagatggcaatgctaaatctggtgatggtcttcaatcgtctagcaaggaggcaaaaccagttttagacagctcgtcagctaatcctgctagtattgctgagcatcatttgcgtatgcattttaaaacattgccagctggtgagtcgctaggaagcttgggactttgggtgtggggagatgtggatcaaccttcaaaggattggccaaatggtgctatcaccatgacaaaagcgaaaaaagatgactatggctattatctagatgtgccactagcagctaaacaccgccagcaagtgtcttatctcattaataataaagctggagagaatctttcaaaggaccagcacatctcgcttctcacgccaaaaatgaatgaagtttggatagacgagaattaccatgcgcacgcttatcgacctttgaaaaaaggttaccttcgaatcaactaccacaatcaatcgggacactacgataacttagctgtctggacctttaaagatgtcaaaaccccaacgaccgactggccaaatggacttgacttgtcacataaagggcattatggagcttatgttgatgtccccttaaaagaaggagctaacgaaatcggatttttaatccttgataaaagtaagacaggagatgctattaaagtgcaaccaaaagattatctatttaaagagttagacaatcatactcaggtttttgtcaaagacactgacccaaaagtttacaacaatccttattatattgatcaggttagtctcaaaggagctgaacaaaccacgccaaatgagattaaagccatttttacgaccttagatgggcttgatgaagatgcggtgaaacaaaacatcaagatcactgacaaagcagggaaaactgttgcaattgatgagttgacacttgacagggataagtctgtaatgacattaaagggtgattttaaggcgcaaggtgcagtctacacggttacatttggagaagttagccaagtcgctcgccaatcctggcaattaaaagataaactctatgcttacgatggtgaacttggagctaccctagctaaggatggttctgttgatttagcgctatggtctccaagtgctgatactgttaaggttgtcgtttatgataaacaagatcagacaagggtggttggtcaagctgatttgaccaagtcggacaagggtgtttggagagctcatctaacttctgacagtgtcaagggcattagtgattacacaggctactattacctttatgaaatcacgcgcggtcaggaaaaagtcatggttttggatccttacgccaaatctctcgctgcctggaatgatgcgactgctactgatgacatcaaaacagcaaaagctgcctttattgatccaagcaaactaggaccaacaggccttgattttgccaaaattaacaactttaaaaagcgtgaagacgctattatctatgaagcacatgtgcgagattttacgtcagataaggctctagaaggcaagttaacacacccttttgggactttttcagctttcgttgaacagctagactatctcaaagacttgggggttacccacgttcaattgctaccggttttgagttatttttatgccaatgagctggacaagagccgctcaacagcctacacgtcttcagacaataattacaactggggttatgacccacaacactactttgccctttctggcatgtattcggcaaatcctaatgaccctgctttacgtatcgcagagcttaaaaaccttgtcaatgagattcacaaacgtggtatgggtgttatttttgatgtggtttataaccacacggctagaacctatctctttgaagatttggaacccaactactatcattttatgaatgctgatggtacagctagagagagttttggcggaggtcgtctaggaacgacacatgccatgagtcgtcgtatcttggtggattcgattacttatctgactcgtgaattcaaggtagatggttttcgtttcgacatgatgggtgaccatgatgcggcagctattgagcaagcctttaaggcagccaaagccattaatccaaataccattatgattggcgaaggctggcgtacctaccaaggtgatgaggggaaaaaagaaattgcggcagatcaagattggatgaaagcaaccaatacggtcggtgttttctctgatgatatcagaaataccctcaagtcaggttttccaaatgaaggcacagcagcctttattactggtggcgcaaaaaatctagaaggtttattcaaaacgatcaaagcacagcctggtaactttgaagcagatgccccaggagatgtagtgcagtatattgcagcccatgacaacctgaccttacatgatgtcattgccaaatccatcaataaggatcctaaagtggctgaagaagagattcacaagcgtattcgtctaggaaataccatgattttaactgctcaagggactgcctttatccattctggtcaggaatatggacgaaccaagcagcttctaaatcccgactacaagacaaaggcgtctgatgacaaggtgccaaataaggcgactctgattgatgctgtagcgcaatacccttacttcatccacgattcttatgattcgtctgatgcggtcaatcattttgactgggcaaaggcaacagattccatagctcacccgattagcaaccaaacaaaagcctatacacagggactaattgcgttgcgtcgctcaacagatgcctttacaaaagcaaccaaagctgaggtagatcgggatgtgaccttgatcacccaagcaggacaagatggtattcaacaagaggacctcatcatgggttaccaaacagtggcatcaaatggagatcgctatgctgtctttgtcaatgcagacaacaagacccgcaaggtagttttacctcaagcctaccgctatttgctaggagcccaagtgcttgttgatgctgagcaagctggtgttactgccattgctaagcctaagggagtccagtttaccaaagaaggcttgactattgaaggcctaactgccctggtcctcaaagtatcctcaaaaacggctaatccctctcagcaaaagagtcagacagacaatcatcaaaccaaaacaccagatggctcaaaagacctagacaaatcattaatgactagaccaaaaagagctaaaacaaaccaaaagctcccaaaaacgggtgaagcctcctcaaaaggcttattagcagctggaatagctctgcttttattggctattagcctgttgatgaagcgccaaaaagat

SEQ ID NO: 2600 - protein, 1174 aa, Streptococcus pyogenes
LNVILNGGLMKKKVNQGSKRYQYLLKKWGIGFVIAATGTVVLGCTPSILTHQVAAKTIVGLARDEAQQGDGNAKSGDGLQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHISLLTPKMNEVWIDENYHAHAYRPLKKGYLRINYHNQSGHYDNLAVWTFKDVKTPTTDWPNGLDLSHKGHYGAYVDVPLKEGANEIGFLILDKSKTGDAIKVQPKDYLFKELDNHTQVFVKDTDPKVYNNPYYIDQVSLKGAEQTTPNEIKAIFTTLDGLDEDAVKQNIKITDKAGKTVAIDELTLDRDKSVMTLKGDFKAQGAVYTVTFGEVSQVARQSWQLKDKLYAYDGELGATLAKDGSVDLALWSPSADTVKVVVYDKQDQTRVVGQADLTKSDKGVWRAHLTSDSVKGISDYTGYYYLYEITRGQEKVMVLDPYAKSLAAWNDATATDDIKTAKAAFIDPSKLGPTGLDFAKINNFKKREDAIIYEAHVRDFTSDKALEGKLTHPFGTFSAFVEQLDYLKDLGVTHVQLLPVLSYFYANELDKSRSTAYTSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSITYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPGNFEADAPGDVVQYIAAHDNLTLHDVIAKSINKDPKVAEEEIHKRIRLGNTMILTAQGTAFIHSGQEYGRTKQLLNPDYKTKASDDKVPNKATLIDAVAQYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLVDAEQAGVTAIAKPKGVQFTKEGLTIEGLTALVLKVSSKTANPSQQKSQTDNHQTKTPDGSKDLDKSLMTRPKRAKTNQKLPKTGEASSKGLLAAGIALLLLAISLLMKRQKD

SEQ ID NO: 2601 - DNA, 957 bp, Streptococcus agalactiae
ttgtgttataatagatgtaaacgtttttttatgaggtatatgatgaaaaattgggaaaaaccaccattagtgatggcgggattagtattagggctattagctttggggaaccttctagagggatatggcacctatgttcgctattgtttagggctagtagcacttgttttttggatttttttaatcaaaggaatattaaaaaataaaaaagaaagcaggaaggagttaagcaatcctttgattgcttctgtctttactactttttttatggcaggtatgattttatcaacctatatcttattatttagaagtttaggaatatgggtagcagttctgtcaaaaggtgtatggtggttgtcatttattgcgttaatcattcatatggctattttttcatggaaatatttgagacacttttcgatggctaatctttttccttcttggtctgtcctctatgttggtataggggtagctagcctgacagcaccaattagtggacaatttactattgggaaaatagtcttttggtatggttttattgcaactttagtattattaccatttctattcattaaagcatataaaatcgggctaccttcggcagttaagcctaatataactactatttgcgctccaatgtcgctaatcacagcgggatatgtcaatagttttgtgtcaccaaatagaggtttattactgctattaatcgtaatggcacaatttctttattttttcattctttttcaggtgcctaaattactgattggtgattttacaccaggtttctcagcctttactttcccccttgttatctcagctacctcacttaaattaagtattcagcatctatcattaccagttgatatacaggggctagtccactttgaaattgggacaacaactcttattgttatgatagtaatggtacgttatattttctttttaaggcgaacaatt

SEQ ID NO: 2602 - protein, 319 aa, Streptococcus agalactiae
MCYNRCKRFFMRYMMKNWEKPPLVMAGLVLGLLALGNLLEGYGTYVRYCLGLVALVFWIFLIKGILKNKKESRKELSNPLIASVFTTFFMAGMILSTYILLFRSLGIWVAVLSKGVWWLSFIALIIHMAIFSWKYLRHFSMANLFPSWSVLYVGIGVASLTAPISGQFTIGKIVFWYGFIATLVLLPFLFIKAYKIGLPSAVKPNITTICAPMSLITAGYVNSFVSPNRGLLLLLIVMAQFLYFFILFQVPKLLIGDFTPGFSAFTFPLVISATSLKLSIQHLSLPVDIQGLVHFEIGTTTLIVMIVMVRYIFFLRRTI

SEQ ID NO: 2603 - DNA, 948 bp, Streptococcus pyogenes
atgtcactaaaaatagctgttaataggcagaaaaggacacttatgaaacaccttaaaaccccaccattggtcatgtcaggattggcattaggaacgttgtcatttggcaatttgttggctacttatgtttcgatttttaattatttgggaattctggcagctctttttatctatggtatcttgcttgttggcatggttaggaaccttaacgataccaaaatgcagttacgacaacctctaattgcctctgtttttccaactttttttatgacagggatgttgttgtcttcactctttctcaaagtgacaggagggtgttggttaggctttctcacttggtggctattctttttgggaaatcttgtcctgattgcttattaccagtatcgttttgtcttttctttttcatgggataacgtttttccttcctggtccgtgctttttgttggaattgcaatggcggcattaacagcacctgctagtaggcagtttttattaggacaggtgattttttgggtttgtcttctcttaactgctgtgattttaccttttatggccaaaaagacttatgggattggtctaggtcaagcagtaatgcccaatatttcaacgttttgtgcccctctgtccttactttcagcgtcttatttagcaacctttcctagaccacaagtaggaatggttatctttcttctcgtcagctcacaactgttatatgcttttgtggttgtacagcttcctcgcttactcaatcgtccctttaacccaggtttttcagcttttacctttccgtttgtgattagtgccacttccttaaaaatgaccttatcttttttaggttggcaaggtttaggttggcaggttcttttgctaggagaggtattgttggcgacagctttagtcacttatgtttatggggcttacctgagatttctatttcaaaataag

SEQ ID NO: 2604 - protein, 316 aa, Streptococcus pyogenes
MSLKIAVNRQKRTLMKHLKTPPLVMSGLALGTLSFGNLLATYVSIFNYLGILAALFIYGILLVGMVRNLNDTKMQLRQPLIASVFPTFFMTGMLLSSLFLKVTGGCWLGFLTWWLFFLGNLVLIAYYQYRFVFSFSWDNVFPSWSVLFVGIAMAALTAPASRQFLLGQVIFWVCLLLTAVILPFMAKKTYGIGLGQAVMPNISTFCAPLSLLSASYLATFPRPQVGMVIFLLVSSQLLYAFVVVQLPRLLNRPFNPGFSAFTFPFVISATSLKMTLSFLGWQGLGWQVLLLGEVLLATALVTYVYGAYLRFLFQNK

SEQ ID NO: 2605 - DNA, 174 bp, Streptococcus agalactiae
atggttaaaaaattcgcatttgctaaaggaatagcaacaggagtcgttgcaacagctgctactcttgcaggtgctgcatttgctatcaaaaaaacaattattgaacctgaggaagaaaaaatagcttttatcgaagaaaatcgtaaaaaagctgcacgtaaacgtgtctctcat

SEQ ID NO: 2606 - protein, 58 aa, Streptococcus agalactiae
MVKKFAFAKGIATGVVATAATLAGAAFAIKKTIIEPEEEKIAFIEENRKKAARKRVSH

SEQ ID NO: 2607 - DNA, 174 bp, Streptococcus pyogenes
atggttaagaaatatcaatttgttaaaggtcttgctactggcgtcctagcaactgctgctactgttgctggtgctgtctttgctgtaaaaaaaacaatcattgaccctgaagaagaaaaagctgctttcattgaagaaaaccgcaaaaaagctgcgcgtcgtcgtgtagctcgc

SEQ ID NO: 2608 - protein, 58 aa, Streptococcus pyogenes
MVKKYQFVKGLATGVLATAATVAGAVFAVKKTIIDPEEEKAAFIEENRKKAARRRVAR

SEQ ID NO: 2609 - DNA, 900 bp, Streptococcus agalactiae
ttgagaagtatcatgagaaaaatcaaacttatagcagttgttggtccaactgcggttgggaagacagcattaggaattgaattagctaaaactttcaatggcgaaatcattagtggtgatagtcagcaagtttatcagaagttagatatcggaacggctaaagctagtaaagaagagcaagaacaagcttatcatcacttgattgatgttcgtgaagtaaatgagaactattcggtttatgatttcgtcaaagaggcaaaagtagctattgatacgattatttctaaggggaaaattcctattattgttggaggtactggcctatatttacagagtttgtttgagggctatcatttaggaggcgaagtcaatcaagaaactcttatggcctatcgtgaaaaattagagtctctaagtgatgaagatttatttgaaaagttgacagaacaatccattattataccacaagttaatcgtcgacgtgccattcgtgcattagaattggcgaagtttgggaatgatttgcaaaatagtgaaagtccgtatgatgttttattaattggattgaatgatgatcgtcaggtgctttatgatcgtatcaatagacgagttgatttgatgatggacaatggtctcttagatgaagctaaatggctatacgataactacccgagtgttcaagcaagtaaaggaattggctataaagaattatttccttacttttcaaagcaaataccattagaagaagctgttgataaactaaaacaaaataccagacgttttgcaaaacgccaattaacatggtttagaaaccgtatgaatgtcgaatttattatggttggtgaggaaaattatcaacaaaaaatcaagcgaaaagtcagtgattttttatcatcaaag

SEQ ID NO: 2610 - protein, 300 aa, Streptococcus agalactiae
MRSIMRKIKLIAVVGPTAVGKTALGIELAKTFNGEIISGDSQQVYQKLDIGTAKASKEEQEQAYHHLIDVREVNENYSVYDFVKEAKVAIDTIISKGKIPIIVGGTGLYLQSLFEGYHLGGEVNQETLMAYREKLESLSDEDLFEKLTEQSIIIPQVNRRRAIRALELAKFGNDLQNSESPYDVLLIGLNDDRQVLYDRINRRVDLMMDNGLLDEAKWLYDNYPSVQASKGIGYKELFPYFSKQIPLEEAVDKLKQNTRRFAKRQLTWFRNRMNVEFIMVGEENYQQKIKRKVSDFLSSK

SEQ ID NO: 2611 - DNA, 897 bp, Streptococcus pyogenes
atgacaaaaataaaaatagttgtgattgttggtccgacagcggttggaaaaacagcacttgggattagtttagccaaggcttttaatggagaaattatttcaggagatagccagcaagtttatcgacagttggatattggaacagccaaggccactcaagaagagcaagaagcagcggttcatcacttaattgatattcgtgaggtgacggagtcttattcggcctacgattttgttcaagatgctcaaaaatctatttcagatattgttagtcgtgggaaattaccaattattgtaggtggaactggtctttacttacaaagtttactcgaaggttatcatctaggaggtcaagttgatcaagaggcggtaaaagcctatcggaatgagttggagcaattggacgatcacgacttgtatgaacgcttgcaagtcaataacattaccattgagcaggtgaatcgcagacgggcgatccgagcccttgaattggctcagtttgctgatgaattagagaatgccgagacggcttatgagccgcttattatcggcttgaatgatgaccgccaagtcatctatgaccgtatcaatcagcgcgtgaatcgtatgattgaaaacggcttattggaagaagcaaaatggttatatgagcattacccgactgttcaggctagtcgtggcataggttataaggaattattcccctattttgtaggtgaaatgactttggcagaagctagtgatcaattaaaacaaaacacgagacgttttgccaagcgacagctaacttggttccgcaatcgaatggctgttagcttcactgccataacggctcctgattacccacaggtagtacatgatagggtcagggattttcttggtcagaaagagaagtca

SEQ ID NO: 2612 - protein, 299 aa, Streptococcus pyogenes
MTKIKIVVIVGPTAVGKTALGISLAKAFNGEIISGDSQQVYRQLDIGTAKATQEEQEAAVHHLIDIREVTESYSAYDFVQDAQKSISDIVSRGKLPIIVGGTGLYLQSLLEGYHLGGQVDQEAVKAYRNELEQLDDHDLYERLQVNNITIEQVNRRRAIRALELAQFADELENAETAYEPLIIGLNDDRQVIYDRINQRVNRMIENGLLEEAKWLYEHYPTVQASRGIGYKELFPYFVGEMTLAEASDQLKQNTRRFAKRQLTWFRNRMAVSFTAITAPDYPQVVHDRVRDFLGQKEKS

SEQ ID NO: 2613 - DNA, 1236 bp, Streptococcus agalactiae
gtgatagaaactaaagaagagcaagaacgtgttattttagttggggtagaacttcaagatactgagaattttgaaatgtccatggaagaacttgctagcttagctaagacagcaggagcaaatgttgttaatcattattatcaaaaaagagataaatatgatagtaaatcatttatcggatctggtaaattagaggagataaaagctattgtagaagcagatgagattgataccgttgtggttaataatcgtttgactccgcgacaaaactctaatttggaagctgaacttggtgttaaagttattgaccgtatgcaacttattttagatatctttgctatgcgtgctagaagtcatgaaggaaaattacaggttcatctagcgcaattgaaatatatgttaccacgcttagttggacaaggtattatgcttagtcgtcaagcaggaggaatcggaagccgaggtccaggagaatctcagttagagttgaatcgtcgttccattcgtcatcaaatttctgatatcgaaagacaattgaagattgtagaaaaaaatcgcgagacagttcgagaaagacgtgttgattcgacaacctttaaaattggattaattggatatacaaatgctggcaagtcaactattatgaatgttttaaccgatgataagcaatatgaagccaatgaattatttgcaacgttagacgctacaaccaagcagatctatttacaaaatcaatttcaagtcactttaacagatactgttggttttattcaagatttacctacagagttagttgcggctttcaagtctaccttagaagaaagtcgacatgtcgatttattatttcatgttattgatgctagtgaccctaatcatgaagaacacgaaaaagttgttatggagattcttaaagacttagatatgatagatattcctcgtttagcgatatacaacaagatggatgtcactgagcagctgaatgcaacaacttttccaaatgtgagaattgcagccaaaaaacaagggagtaaggatttattacgccgtcttattgtggatgaaatacgacatatctttgacgaattttcgattagagtgcatcaaaatcaagcatataagctctatgatctcaataaaatagcattgcttgatacctacacctttgaagaagaatacgagaatattacaggctatatttctcctaaacaaaaatggaagctggaagaattttatgat

SEQ ID NO: 2614 - protein, 412 aa, Streptococcus agalactiae
MIETKEEQERVILVGVELQDTENFEMSMEELASLAKTAGANVVNHYYQKRDKYDSKSFIGSGKLEEIKAIVEADEIDTVVVNNRLTPRQNSNLEAELGVKVIDRMQLILDIFAMRARSHEGKLQVHLAQLKYMLPRLVGQGIMLSRQAGGIGSRGPGESQLELNRRSIRHQISDIERQLKIVEKNRETVRERRVDSTTFKIGLIGYTNAGKSTIMNVLTDDKQYEANELFATLDATTKQIYLQNQFQVTLTDTVGFIQDLPTELVAAFKSTLEESRHVDLLFHVIDASDPNHEEHEKVVMEILKDLDMIDIPRLAIYNKMDVTEQLNATTFPNVRIAAKKQGSKDLLRRLIVDEIRHIFDEFSIRVHQNQAYKLYDLNKIALLDTYTFEEEYENITGYISPKQKWKLEEFYD

SEQ ID NO: 2615 - DNA, 1248 bp, Streptococcus pyogenes
ttggtaaaggtgatgattgagacaaagcgtcagcaagaaagagtgattcttttaggagttgagcttcagacaacagaacattttgacatgtccatgacagaattagctaatcttgccaaaacagctggtgtcaaagttatggcaagtttcagccaaaaacgagaacgttacgacagcaaaacctttatcggctcagggaaactggatgagattaaggcgattgtggaagctgatgagattgatgcagttattgtgaacaatcggttgactgctaggcaaaatgctaatctagaagctgttttagaggtaaaagtcattgaccgtatgcagttaatcttagatatttttgccatgcgtgccagaagccatgagggcaaattacaagtacaccttgcccaattgaaatatatgttacctcgtttggttggacagggcatcatgttaagtcgtcaagcaggtggtattgggagccgtggaccaggtgaaagccaactagagttaaatcgccgttcgattcgtcatcagattgctgatattgaacgccaattaactcaggtagagaaaaatcgtcaaacaattagagatcgtcgtgtgggttcagatacctttaaaattggcttgattggctacaccaatgctggcaagtcaaccattatgaacttgttgacagatgacagccactatgaagccaatgaattatttgctaccttagatgcaactacaaagcaactctatttagaaaatcaatttcaagcaaccttaacagacaccgtaggctttattcaagacttgccaacggaattagtggctgcttttaaatcaaccctagaagaaagcaaatatgtggatttgctgttacatgtgattgatgcgagtgatcccaatcatagtgagcaagaaaaagtggttttaaaccttctaaaagagctagacatgcttaatattccgcgtttagctatttataacaaggtggatatagcagaacaattcacagctactgcttttccaaatatcaggatttcagcccgttcaaaggatagcaaaattctcttgagacgtttaatcattgaccaaattcgagaccagtttgttccttttagaatcaaagtgcatcaagacaaggcgtacaagctatatgatttgaatcgagttgctcttttagaccactacacgtttgaccaagaaatagaggatatttcgggctacatttccccaaaacagcaatggagacttgacgatttttatgaa

SEQ ID NO: 2616 - protein, 416 aa, Streptococcus pyogenes
LVKVMIETKRQQERVILLGVELQTTEHFDMSMTELANLAKTAGVKVMASFSQKRERYDSKTFIGSGKLDEIKAIVEADEIDAVIVNNRLTARQNANLEAVLEVKVIDRMQLILDIFAMRARSHEGKLQVHLAQLKYMLPRLVGQGIMLSRQAGGIGSRGPGESQLELNRRSIRHQIADIERQLTQVEKNRQTIRDRRVGSDTFKIGLIGYTNAGKSTIMNLLTDDSHYEANELFATLDATTKQLYLENQFQATLTDTVGFIQDLPTELVAAFKSTLEESKYVDLLLHVIDASDPNHSEQEKVVLNLLKELDMLNIPRLAIYNKVDIAEQFTATAFPNIRISARSKDSKILLRRLIIDQIRDQFVPFRIKVHQDKAYKLYDLNRVALLDHYTFDQEIEDISGYISPKQQWRLDDFYE

SEQ ID NO: 2617 - DNA, 645 bp, Streptococcus agalactiae
atgattgattatattgatttagctttgacttatggtggttttacgagcttagataaagtttatctagagaaaaaactagatggcctctctaagcagcaacgacttgattttatcaccccacctcctagtgtgattaatgcttattttgctgaaatatatcaaaagcaagggccagaagctgcaactgattactattttgatctttccaaagccttgggcttgtttccaaaacatttatcgtttgatgaagaaaaaccttttattcgtttgaatttatcaggaaaatcatttggttttgcttacctaaatgatcaagaagaagcgagtgttttttctgaagttaaagaagtcattacaccgcagttactcttagaaattgcacagatttttcctcaatataaagtctatcgagatcggtctggtatcagaatggcaaaaatagattttgacgaaacagaatctcaaaatattacaccagaaacaagtttactagggaatgtcttacaacttaaaaaagatattattaaaataactagtttcaatcaagaagagctattagagttggttaaaacaaagtcaggtaaatactattattctagtcaaggacgtgagtcagttatttatattgatactaaatctactaat

SEQ ID NO: 2618 - protein, 215 aa, Streptococcus agalactiae
MIDYIDLALTYGGFTSLDKVYLEKKLDGLSKQQRLDFITPPPSVINAYFAEIYQKQGPEAATDYYFDLSKALGLFPKHLSFDEEKPFIRLNLSGKSFGFAYLNDQEEASVFSEVKEVITPQLLLEIAQIFPQYKVYRDRSGIRMAKIDFDETESQNITPETSLLGNVLQLKKDIIKITSFNQEELLELVKTKSGKYYYSSQGRESVIYIDTKSTN

SEQ ID NO: 2619 - DNA, 645 bp, Streptococcus pyogenes
ttgacgatttttatgaataattatattgatttagcaaaaacctatggtggatttactagtctggataccaactacctaaaccatctgttagccagtttgacagaccagcaaaaactagcttttatcacaccaccaccaagtgttattaatgcctactttgctgaaatctaccagaaacagtcaccgcaagctgcaactgattattattttaatctttctaaggctttggggctttttactgaccaaccatcttttgaggaagaaaagccctttgtacgcctcaatttgtctggaaaagcttatggttttgcttaccaaaatgaccaagaagttgcattggtattttctgaaaaagcagagcctaagaaacccgaactcttctttgaattaacacaaattttcccacaatatatggtttatgaggacaaaggccagcttaaaatgcaggctaagcagtttgagcaaggagaatgtgaagacattacacctgatgacacactcttgtcgaagatttaccgtctggcaaacggtatcaccatgcttaaggggtttaatgtagaggagttatgggctcttagccaaacattttctggtcaaaagtattatgattttgcccaacgagaatttatgatttacatcacccaa

SEQ ID NO: 2620 - protein, 215 aa, Streptococcus pyogenes
LTIFMNNYIDLAKTYGGFTSLDTNYLNHLLASLTDQQKLAFITPPPSVINAYFAEIYQKQSPQAATDYYFNLSKALGLFTDQPSFEEEKPFVRLNLSGKAYGFAYQNDQEVALVFSEKAEPKKPELFFELTQIFPQYMVYEDKGQLKMQAKQFEQGECEDITPDDTLLSKIYRLANGITMLKGFNVEELWALSQTFSGQKYYDFAQREFMIYITQ

SEQ ID NO: 2621 - DNA, 927 bp, Streptococcus agalactiae
atggaaattcaatttttaggaactggagctggtcaaccagcgaaagctcgtaatgtttcaagtttagtcttgaaattattagatgaaattaacgaggtttggatgtttgattgtggagagggtacacagcgtcaaattttagaaactacgattaaacctcgtaaagttaaaaaaatttttatcacgcacatgcacggagaccatgtttttggtcttccaggttttttatccagtcgggcttttcaagccaatgaagagcagacagatttagatatttatggaccggttggtataaaaagttttgttatgactgccttaaggacatcaggttcacgtttaccttatcgaatccattttcacgagtttgatgaatcatcactcggaaaaattatggaaacagataaatttaccgtttatgcagaaaagctagatcatactatcttttgtatgggatatcgtgttgtgcaaaaagatcttgagggcactttagatgctgaagcattgaaactagcaggtgttccatttggtcctctttttgggaaagtcaaaaatggtgagaatgttaccttagaagatggtagagaaattattgctaaagattatatttctgaaccgaaaaagggtaaagtaatcactattttgggagatactagaaaaacagatgcaagtattaggttagctttgggcgctgatgttttagttcacgaatctacttatggtaagggtgatgagcgaattgctaaatcgcatgggcattcaaccaatatgcaagcagctgatatcgctaaacaagcaaatgctaaacgactattattaaatcatgttagtgctcgttttatggggcgagattgttggcaaatggaagaagatgcaaagacgattttttcaaatacccatcttgttagagatttggaagaagtaggtata

SEQ ID NO: 2622 - protein, 309 aa, Streptococcus agalactiae
MEIQFLGTGAGQPAKARNVSSLVLKLLDEINEVWMFDCGEGTQRQILETTIKPRKVKKIFITHMHGDHVFGLPGFLSSRAFQANEEQTDLDIYGPVGIKSFVMTALRTSGSRLPYRIHFHEFDESSLGKIMETDKFTVYAEKLDHTIFCMGYRVVQKDLEGTLDAEALKLAGVPFGPLFGKVKNGENVTLEDGREIIAKDYISEPKKGKVITILGDTRKTDASIRLALGADVLVHESTYGKGDERIAKSHGHSTNMQAADIAKQANAKRLLLNHVSARFMGRDCWQMEEDAKTIFSNTHLVRDLEEVGI

SEQ ID NO: 2623 - DNA, 927 bp, Streptococcus pyogenes
atggaattacaatttttaggaactggagctggtcaaccagccaagcagcgcaatgtgtcaagtcttgccttgaaattactagacgaaatcaatgaagtctggatgtttgattgcggtgaaggaacgcaaagacaaattttagaaacgacgattaagccacgaaaaataagaaagattttcattactcatttgcatggagaccacatttttggattaccaggatttttatcaagtcggtcttttcaagctagtgaagaacagacagatcttgatatttatggaccaattggcattaaaacttacgtgttaactagtctaaaagtttctggagcgcgtgtaccttatcagattcattttcatgaatttgatgacaaatcattaggtaaaataatggaaacagataagtttgaggtctatgcagagcgtctggcgcataccattttttgcatgggttatcgagtagttcaaaaagacttagaaggaaccctagacgcagaagccttaaaagcagcgggtgttccttttggaccactctttggcaaaattaaaaatggtcaagacgttgagttggaagacggccgcctgatttgtgccaaagattatatttctgcccctaaaaaaggcaaaatcatcaccattatcggcgatacgcgcaaaacgtctgccagtgttaaactcgctaaagatgcagatgttttggttcatgaatccacctatggtaagggtgacgagcggattgcgagaaatcacgggcattctaccaacatgcaggcagcacaaatcgctcatgaagcaggcgcaaaacgcctcttgctcaatcatgtatcagctcgctttttagggcgtgattgtcgccagatggaaaaagatgccgccactatatttgaaaatgttaaaatggtacaagatttagaggaagtgattatt

SEQ ID NO: 2624 - protein, 309 aa, Streptococcus pyogenes
MELQFLGTGAGQPAKQRNVSSLALKLLDEINEVWMFDCGEGTQRQILETTIKPRKIRKIFITHLHGDHIFGLPGFLSSRSFQASEEQTDLDIYGPIGIKTYVLTSLKVSGARVPYQIHFHEFDDKSLGKIMETDKFEVYAERLAHTIFCMGYRVVQKDLEGTLDAEALKAAGVPFGPLFGKIKNGQDVELEDGRLICAKDYISAPKKGKIITIIGDTRKTSASVKLAKDADVLVHESTYGKGDERIARNHGHSTNMQAAQIAHEAGAKRLLLNHVSARFLGRDCRQMEKDAATIFENVKMVQDLEEVII

SEQ ID NO: 2625 - DNA, 759 bp, Streptococcus agalactiae
atggcaagaacgatactgattacaggagcttctggtggtttagcacaggcaattattaaccaattaccccaagacgaccatttaattgtcacagggagatcaagagaaaaacttgaaaagctttatggaaagagaccaaacaccttatgtttatcactagatataactaatgacaatgctgtaacgaatatgattgaaaaaatttatggtgaatttggtcaaattgatattttaattaataatgctggatttggttcttttaaagaattttgggattatagtgatgaagaagtcaaagacatgtttgctgtgaatacatttgcaacgatgtctatagctcgtcagataggacataagatgtctcttgtaaaatctggtcatatcgttaatattgcaagcatggctggcctcatagcaacaagtaaagctagcgtttatggggctagtaagtttgctgtcgttggattttcgaatgctcttcgtttagaattagcagaaaaaaatgtttatgtgacaagtgtaaaccctggaccaatcaaaacaggattttttgctcaggctgatccaagtggtgattatttagcaagtataggtcgttttgctctaacaccagaaaaagtatctaaaaaagtagtttctattcttggaaaaaataagagagaattaaatcttccttttatattagcttttgcgcataaatattatagtttatttccaaaaacagctgattattttgccagaaaggtattcaattataaa

SEQ ID NO: 2626 - protein, 253 aa, Streptococcus agalactiae
MARTILITGASGGLAQAIINQLPQDDHLIVTGRSREKLEKLYGKRPNTLCLSLDITNDNAVTNMIEKIYGEFGQIDILINNAGFGSFKEFWDYSDEEVKDMFAVNTFATMSIARQIGHKMSLVKSGHIVNIASMAGLIATSKASVYGASKFAVVGFSNALRLELAEKNVYVTSVNPGPIKTGFFAQADPSGDYLASIGRFALTPEKVSKKVVSILGKNKRELNLPFILAFAHKYYSLFPKTADYFARKVFNYK

SEQ ID NO: 2627 - DNA, 762 bp, Streptococcus pyogenes
atggcacaaagaatcattgttatcacgggagcttctggaggactggctcaggcaattgttaagcagttacccaaggaagacagcttgattttattaggacgtaacaaagaacgcctagaacactgttatcagcatattgacaacaaagaatgcctcgagttggatattaccaatccagtagccattgagaaaatggtcgcccagatttaccagcgctatggccgtattgatgtcttgattaataatgctggctacggagctttcaaaggctttgaagagttttctgcccaagaaatagctgatatgtttcaggttaacaccctagcgagcattcactttgcttgcttgattggtcagaaaatggcagagcaggggcaaggtcaccttattaatattgtgtccatggcaggcttgattgcgtcagccaaatcgagcatttattcagccaccaagtttgcccttatcggattttccaatgcccttcgcttagaattagcggataaaggggtttacgtgaccaccgtgaatccaggtcccattgccaccaagttttttgaccaagctgacccgtctggacattatttggaaagcgttggtaaatttactctccaaccaaatcaagtggctaagcgtttggtttctattatcgggaaaaataaacgagaattgaatttgccctttagtttagcggtgacccatcaattttacacccttttccctaaattatctgattatcttgcaagaaaggtatttaattataaa

SEQ ID NO: 2628 - protein, 254 aa, Streptococcus pyogenes
MAQRIIVITGASGGLAQAIVKQLPKEDSLILLGRNKERLEHCYQHIDNKECLELDITNPVAIEKMVAQIYQRYGRIDVLINNAGYGAFKGFEEFSAQEIADMFQVNTLASIHFACLIGQKMAEQGQGHLINIVSMAGLIASAKSSIYSATKFALIGFSNALRLELADKGVYVTTVNPGPIATKFFDQADPSGHYLESVGKFTLQPNQVAKRLVSIIGKNKRELNLPFSLAVTHQFYTLFPKLSDYLARKVFNYK

SEQ ID NO: 2629 - DNA, 2196 bp, Streptococcus agalactiae
atgatatctgctaagtatagttgggtcctcaataaccaaaagccagacgctggcttttttgaggcttcaaaaaaagaaaagataagtgaagcggtggcttccttaatttattcgcgaggtattaagacatcagcggaattacatcattttttacaaactaatttggaaaatctccatgatccttatttgttaaatgatatggataaagctgttaatcgtattagacgagctattgaaaataatgaaactattttagtttatggagactatgatgctgatggaatgacatcagcatcaatcatgaaagaagcattagatatgatgggagctgaagtccaggtttatctcccaaatcgctttacagatggttacggtcccaatcaaagtgtttataaatattttattgaacaacaagatgtttcattaatcattacggttgataatggtgtggcagggcatgaagcaattacatatgctcaaaatcaaggtgtggacgtggtagttactgatcatcacagtatgccagcagatttaccttgtgcttatgctattattcacccagaacatcctgatgctaattatccatttccttatttagcagggtgtggtgttgctttcaaagtagcttgtgctctcttagaaacaatcccgacagaaatgttggatttggttgctattgggacgattgcagatatggttagcctaactgatgaaaatcgtatcatggtaaaagctggacttgaagttatgaaagatagtgaaagaataggcttacaggagctaatatctttatcaaatattgatttaaaaacactaaatgaagaaactattggatttaaaattgctccacaattaaacgctttaggaagacttgatgaccctaatccagctattgaattactaacagggtttgatgatgaagaatctcaagcaatagcccaaatgattgatcaaaaaaatgaagagcgcaaagaaatcgttcaaactatctttgaccaagctatgcaaatgcttgatcaaacaaagcctgtacaagttttagcaaaagaaaattggcatccaggggttttaggtattgtggcgggtcgtattttagagagaactggacaacctgttattgttttgaatattgaagatggtattgctaaaggaagtgccagaagtgtagaagcacttgatatttttcaagcttttgaccagcatcgagaattattcattgcttttggaggtcacagcggagcagcaggcatgactttagaggaaagtaaagtaggtgatctttctcaagttttatgtgactatatctctaaaaaacaattggacatgagtcagaaaaaaactctgacaattgatagtgagctacgttttgacgaacttagtttagacactgttagagattttgaaaagttagcgccatttggaatggataataaaaaaccagtctttttgttaaaagattttaaagtgagtcaagccagagtcatggggcaaaacggtgctcatctgaaattaaaactagaacaagatggacaagcacttgatttggtagcatttaatatggggagtcaactacaagagttccaacaagcacaacatttggagttagctgtcactttatctgttaatcaatggaatggtgccacaaccctacaattaatgttggaggatgcgcgtgtagacggtattcaattatttgatattagaagcaaagcaagtagtttacctcatggagtgccaatcctgtctcaagaagagcagagcaaagaagttattcttttgactgttcccgatcatccacaagaattaaaacaaatgactcaaggtaaacagtttgatgccatctattttaaaaatgagataccaaaaaattattttatatctggttatggtacacgtgatcagtttgctagtttatataaaacaatatatcaattcccagaatttgacgttcgttataagttaaaagagctcagttcctaccttcatatccctgatattttattaattaaaatgattcaaatttttgaagaactacattttgttacgattacagaagggattatgacagtcaataaagaagcagaaaagcgagatatctctgagagtcaaatttatcaagaattaaaagagacagttaagtttcaagaattaatggctttagggacacctaaagaaatatatgattttatgatgagt

SEQ ID NO: 2630 - protein, 732 aa, Streptococcus agalactiae
MISAKYSWVLNNQKPDAGFFEASKKEKISEAVASLIYSRGIKTSAELHHFLQTNLENLHDPYLLNDMDKAVNRIRRAIENNETILVYGDYDADGMTSASIMKEALDMMGAEVQVYLPNRFTDGYGPNQSVYKYFIEQQDVSLIITVDNGVAGHEAITYAQNQGVDVVVTDHHSMPADLPCAYAIIHPEHPDANYPFPYLAGCGVAFKVACALLETIPTEMLDLVAIGTIADMVSLTDENRIMVKAGLEVMKDSERIGLQELISLSNIDLKTLNEETIGFKIAPQLNALGRLDDPNPAIELLTGFDDEESQAIAQMIDQKNEERKEIVQTIFDQAMQMLDQTKPVQVLAKENWHPGVLGIVAGRILERTGQPVIVLNIEDGIAKGSARSVEALDIFQAFDQHRELFIAFGGHSGAAGMTLEESKVGDLSQVLCDYISKKQLDMSQKKTLTIDSELRFDELSLDTVRDFEKLAPFGMDNKKPVFLLKDFKVSQARVMGQNGAHLKLKLEQDGQALDLVAFNMGSQLQEFQQAQHLELAVTLSVNQWNGATTLQLMLEDARVDGIQLFDIRSKASSLPHGVPILSQEEQSKEVILLTVPDHPQELKQMTQGKQFDAIYFKNEIPKNYFISGYGTRDQFASLYKTIYQFPEFDVRYKLKELSSYLHIPDILLIKMIQIFEELHFVTITEGIMTVNKEAEKRDISESQIYQELKETVKFQELMALGTPKEIYDFMMS

SEQ ID NO: 2631 - DNA, 2208 bp, Streptococcus pyogenes
atgattaaatccaaatatagctggaaaataaaagacaagaagccagatgatggcttctttaagctagcaaagacaaaaggtctaacccagaccgccgctcagttgatttatgatcgagggataaggactgaagaagccttagatgagtttttaacagcggacttgtctcaactgcatgatccttacttgctacatgacatggcaaaagctgtgccaagaattcgtcaagctattgaagagggcgaacgaattctcatttacggcgactatgatgctgatggcatgacgtcggcttctattgtcaaagaaaccctagacatgatgggagcagagcctttggtttatcttcccaaccgctttacagatggctatggccccaaccagagcgtctataaatattttattgagcaggaagctgtgtccctaattatcacggttgataatggcgtggccggacatgaagcgattagatatgctcaagaacaggaagttgatgttattgtaactgaccatcatagcctgcctgaagaattgccagaagcctttgccatcattcatcctgagcatcctgatgctgattatccctttaaacacttagctggctgtggcgttgcctttaaattggcaacagctttgctagaaagtttaccaacagactgtctagacttggtagctattggaaccattgccgatatggtaagcttgacaggtgaaaaccgtgttttagtcaaaaatggtctggccatgctcaaacacaccgaaagagtgggcttgcaggagttgatgtccttgtctcctattgatttggaacattttaatgaagacgccattggctttcagattgctccgcaattaaatgctttagggcgcttagatgaccctaatccagccattgagctactgacgggctttgatgaccaagaagctcaagcgattgccttgatgattaagaaaaaaaatgaagagcgtaaggccttagtccaagacatttttgatcaagcgatggctatggttgatcctcaaaaacctgttcaagtcttggcacaagctggctggcatcctggtgttcttgggattgtcgctggtcgtatcatggaaactattggacaaacggtcgtcgttttgaccattgataatggctttgcaaaaggctcggccagaagtttagaagctattaatatttttgaagccttaaatggcaagcgtgagttatttacagcctttgggggacatgctggtgcagcaggaatgaccctgcccgttgacaacttggaagctctttcagactttctttgtcagtttgtgatagaacgtggcttagatcagactgccaaaaatacgttaactattgatgaaagactgtctttggacgaccttagccttgatattttaaagagtttagataaattagccccttatgggatggatcatcaaaagccggtcttttatgtcaaggacataagggttagtcaagcgcgtaccatagggcaagaccagagccatcttaaatttaaagtcagtcagggcaaagcttcctttgacgtactggcttttggtcaaggaagtcaactgcaagagttccgacaagctactggtttagaattagcagttaccttatctgtcaaccattggaatgggaacacgagtctccaattcatgttagtagatgctcgtgttgacggagtgcaacttcttgacttaaggacaaaaacagccaaagttcctgaaggtattccgactattgaagaagacccaaatgccagagtcattctgattaatgacatccctgaagatttcaaaacctggcgcaaccagtttgttcacaaggattttgacgccatctattttaaaaatcagatgaaacatccttattatttaacaggatttggcagcagagagcagtttgccaagctctacaaaaccatctatcagtttcctgaatttgatttacgacataaattgacagagttgagtcactatttaaacatagaaaaacttttactgattaagttgattcaaatttttgaagagttgtcttttgtgacgattgacgatgggctgatgacggttaacccccaagcgcaaaaacgagagatttcagagagccacatttaccaagacttaaaagaattggtgaaatttcaagaaatcatggctttggctagcccgaaagagatgtatgattatttggtgaaatcaaacgatcaa

SEQ ID NO: 2632 - protein, 736 aa, Streptococcus pyogenes
MIKSKYSWKIKDKKPDDGFFKLAKTKGLTQTAAQLIYDRGIRTEEALDEFLTADLSQLHDPYLLHDMAKAVPRIRQAIEEGERILIYGDYDADGMTSASIVKETLDMMGAEPLVYLPNRFTDGYGPNQSVYKYFIEQEAVSLIITVDNGVAGHEAIRYAQEQEVDVIVTDHHSLPEELPEAFAIIHPEHPDADYPFKHLAGCGVAFKLATALLESLPTDCLDLVAIGTIADMVSLTGENRVLVKNGLAMLKHTERVGLQELMSLSPIDLEHFNEDAIGFQIAPQLNALGRLDDPNPAIELLTGFDDQEAQAIALMIKKKNEERKALVQDIFDQAMAMVDPQKPVQVLAQAGWHPGVLGIVAGRIMETIGQTVVVLTIDNGFAKGSARSLEAINIFEALNGKRELFTAFGGHAGAAGMTLPVDNLEALSDFLCQFVIERGLDQTAKNTLTIDERLSLDDLSLDILKSLDKLAPYGMDHQKPVFYVKDIRVSQARTIGQDQSHLKFKVSQGKASFDVLAFGQGSQLQEFRQATGLELAVTLSVNHWNGNTSLQFMLVDARVDGVQLLDLRTKTAKVPEGIPTIEEDPNARVILINDIPEDFKTWRNQFVHKDFDAIYFKNQMKHPYYLTGFGSREQFAKLYKTIYQFPEFDLRHKLTELSHYLNIEKLLLIKLIQIFEELSFVTIDDGLMTVNPQAQKREISESHIYQDLKELVKFQEIMALASPKEMYDYLVKSNDQ

SEQ ID NO: 2633 - DNA, 96 bp, Streptococcus agalactiae
ttgcaaatattattaaaatataataaaattaagaaaataatggaatttttgataaagaatattaaaggcgaggataaaatctatgagacctatcgt

SEQ ID NO: 2634 - protein, 32 aa, Streptococcus agalactiae
MQILLKYNKIKKIMEFLIKNIKGEDKIYETYR

SEQ ID NO: 2635 - DNA, 2562 bp, Streptococcus agalactiae
atgagacctatcgttagaaaaaagatgtacaaaaaaggcaaattttgggtcgttgcaggtatcgttaccattttaggtggtagtgcaattcttggtcaagatgtcaaggcagaacaggcagaagcagtaacttcaacgatctcagagaaaactgatagcagtcagactatttcggatacttccaagttaacgttacctgttaattcctcggaggctatgaaaaatagtgcagagcctttaataaaaacagcctttgctacatctgtttcatctaatcctagagagatagcagctaccccagtcaaaacctttgatgctagctcaaaagttgttgtaaaagctagtactgctgagcactcagcaaatcaaacaaattctaatgttaatcaagtagctaatgatagtgaagttattactcaacaaaattcaacaaagcaattaccaacagtgacttactctgctcatgttcaagatattggatggcaaaagtcggttgataatgcaacagtttcaggaacagtaggacaagaaaagcaggttgaggcaataaaattgtctattaaagcacctgaaggaataacaggaaaacttagctataaaacttatgttaaaggacaaggttggcaaccttcagtagagagtggtcaagttagtggtactgttggtcagagtagacctattgaagcactaagcattaaccttactgataatttacaaaaattatatgatgtctattatcgtgttcatgttcaagatatcgggtggatggcttgggctaaaaatggagcttacgctgggactttgggaatgtcaaagcgccttgaagcttacgaagtaaaatttacccttaaaggacaatctgttttaacaccaactatacctaaggaagagagacctgtcttaaattatcaggttaaggtaggccaaaatggttggcaatctaataaacttgaaggacaaatggcgggaactttaggagaatccaaagccctagatggagtaaaattcactcttagcaccttgaagtatggggacattctctatcgtactcatgtacaagataaaggttggggagaaattttaggtagtcaaacaagtaaggattatcaaggaaaaagactagaagctattcaattggacttaagtgggaatttaaaacaaaattatgatatttattatcgcgctcacgtccaagataaaggttggatggcttggcaaaaaaataatagtgtagcaggtacagtcggagaatcgaaacgtttagaggctttggaggtaaaactagtagctaaagcttcagattttagttcccaaacaaatcattcattcttagaaatgaagcatcctggattaagttatcaaacttatcttcaaaaagatggttggaaaccaacggttttggaaggccaattaggaggtagtattggactttcaaaatctataaaagccatcaaacttaacttaggtagtacagctctaggaaatatagaatatagaacttttcttaatggttcaggttggcaaactgttgttaattcagggagagaaagtaatgtaccaaatgaatctcaacaagtagaagctattcagatgcgattgacaggtctgctatcgaaaacctatagtgtgatgtatcgagttcacatgcaagattatggttggcaggattggacttataacaatgacatcgctggtagtactaaccaaggaaaacgaattgaagcaatcgaaattaaattagttgagactgctaaaataccggtaactgtccaaacgacttataagggaactggaaactataatgtacgagtgacaaatgttattagtcctggggatttaaaaattgctatttggtcagataaaaacaatcaggatgaccttaagtggtataccgtcgcacccaaaaatcatgaagctacattgacatttaatgttacaaatcatagagacaatggtaaatactttatccatgtttatcaggaaaatgcttctaatcaaaaacaattattggtaaaaacttctctacaagtcgcacattcaaattataatactccttactttagccaacgtgatggaaggtgggcaagtcgaagatatggtatggcaactttaggagaaactggttgtgtaccaacttctctagctatgattttgtcttctttgaaaggagaaactgttttaccaacgcaaattgcagattacctttaccataagacagttgaatttaatcgtggtgttcaaggaacaacttctagaggaattttaaaagcagccaaagaatggggtgtaactgcaactgcattaggaactcaagctaaccttgtacaagcgttgaaggatggttatcatgtcctagcggcagtacaaaataatgtttttgttcttcatggaagtcatgaaatcgttctcaaaggatataataacggactgacacatgtctctgacccttacacaccgtccttgtctggttggtatccaatttcacaactttggaaagaacagagctattatagtgaggatagaattgatattggagcaccttttgtcaaggtaacagatgcc

SEQ ID NO: 2636 - protein, 854 aa, Streptococcus agalactiae
MRPIVRKKMYKKGKFWVVAGIVTILGGSAILGQDVKAEQAEAVTSTISEKTDSSQTISDTSKLTLPVNSSEAMKNSAEPLIKTAFATSVSSNPREIAATPVKTFDASSKVVVKASTAEHSANQTNSNVNQVANDSEVITQQNSTKQLPTVTYSAHVQDIGWQKSVDNATVSGTVGQEKQVEAIKLSIKAPEGITGKLSYKTYVKGQGWQPSVESGQVSGTVGQSRPIEALSINLTDNLQKLYDVYYRVHVQDIGWMAWAKNGAYAGTLGMSKRLEAYEVKFTLKGQSVLTPTIPKEERPVLNYQVKVGQNGWQSNKLEGQMAGTLGESKALDGVKFTLSTLKYGDILYRTHVQDKGWGEILGSQTSKDYQGKRLEAIQLDLSGNLKQNYDIYYRAHVQDKGWMAWQKNNSVAGTVGESKRLEALEVKLVAKASDFSSQTNHSFLEMKHPGLSYQTYLQKDGWKPTVLEGQLGGSIGLSKSIKAIKLNLGSTALGNIEYRTFLNGSGWQTVVNSGRESNVPNESQQVEAIQMRLTGLLSKTYSVMYRVHMQDYGWQDWTYNNDIAGSTNQGKRIEAIEIKLVETAKIPVTVQTTYKGTGNYNVRVTNVISPGDLKIAIWSDKNNQDDLKWYTVAPKNHEATLTFNVTNHRDNGKYFIHVYQENASNQKQLLVKTSLQVAHSNYNTPYFSQRDGRWASRRYGMATLGETGCVPTSLAMILSSLKGETVLPTQIADYLYHKTVEFNRGVQGTTSRGILKAAKEWGVTATALGTQANLVQALKDGYHVLAAVQNNVFVLHGSHEIVLKGYNNGLTHVSDPYTPSLSGWYPISQLWKEQSYYSEDRIDIGAPFVKVTDA

SEQ ID NO: 2637 - DNA, 516 bp, Streptococcus agalactiae
atggatttaaataattacatcgcttcaattgaaaactatcctcaagaaggaattactttccgtgatatctccccattaatggctgatggtaaagcatacagctatgctgttcgtgaaattgtacaatatgctgctgataaagatattgatatgattgttggaccagaagctcgtggctttattgttggttgcccagttgcttatgctcttggtattggttttgctccagtccgtaaaccaggtaaattaccacgcgaagttatttcagctgactatgaaaaagaatatggtcttgatacattgacaatgcacgcagatgctattaaaccaggccaacgtgttttaattgttgatgaccttttagctactggtggaacagtaaaagcgacaattgaaatgattgaaaaacttggtggcgttgtcgcaggctgtgctttcctagttgaacttgatggattaaatggtcgtaaagctattgaaggttatgatactaaggtattgatgaactttccagga

SEQ ID NO: 2638 - protein, 172 aa, Streptococcus agalactiae
MDLNNYIASIENYPQEGITFRDISPLMADGKAYSYAVREIVQYAADKDIDMIVGPEARGFIVGCPVAYALGIGFAPVRKPGKLPREVISADYEKEYGLDTLTMHADAIKPGQRVLIVDDLLATGGTVKATIEMIEKLGGVVAGCAFLVELDGLNGRKAIEGYDTKVLMNFPG

SEQ ID NO: 2639 - DNA, 516 bp, Streptococcus pyogenes
atggatttaacaaattacattgcatcgatcaaagattaccctaaagctggtattacgtttcgagatatctcacctttaatggctgacggtaaagcatatagctatgctattcgtgaaatagcacagtacgcttgtgataaagatattgatatggttgttggacctgaagcgcgtggttttatcattggttgtcctgttgcagttgagttaggaattggttttgctcccgttcgtaaaccaggaaaactgccaagagatgttgtctctgccgattacgaaaaagaatatggtcttgatactttaactatgcatgcagatgctattaagcctggacaacgtgttttgattgtcgatgatttactagcgactggcggtacagtaaaagcaactattgaaatgattgaaaaacttggtggtattgtagctggttgtgccttccttattgaattagaaggtttaaatggacgccatgctattaggaactatgactataaagtcttaatgcagtttcctggg

SEQ ID NO: 2640 - protein, 172 aa, Streptococcus pyogenes
MDLTNYIASIKDYPKAGITFRDISPLMADGKAYSYAIREIAQYACDKDIDMVVGPEARGFIIGCPVAVELGIGFAPVRKPGKLPRDVVSADYEKEYGLDTLTMHADAIKPGQRVLIVDDLLATGGTVKATIEMIEKLGGIVAGCAFLIELEGLNGRHAIRNYDYKVLMQFPG

SEQ ID NO: 2641 - DNA, 678 bp, Streptococcus agalactiae
atgacttatttggaacaatatcagtcagggcaattgactctaccaagtgctttattttttcactttaaatctatttttaagacagcagacgattttttagtttggcaatttttctatttacaaaatacaactaatttatccgatctaacaccgagccgtattgcgacatcacttgataaaacagtggcagatatcaatcgttctatatcgaatttaacaagtcaaggtttactagatgtcaaaacaattgagttgaatcatgaaatcgagattatctttgatacaagccctgtgtttgctaaattagataaacttttcgaagaggataatcaagtaataatagacaataaaacctctgattcgaatcgtctgaaagatttagtaggagacttcgaacgtgaattaggtcgcttattaagtccttttgaattagaagatttacaaaagacactgcaagaagatcagacagatcctgatattgttagggcagctcttagagaagcggttttcaatgggaaaacaagttggaattatatcaatgctatccttcgcaactggcggcgtgaaggattgacgacacttcgacaaattgaagagagaaaacaagcacgtgaagataaccaaatgaaagatttagcgatttcggatgattttaaaaatgcaatgaatttatgggaa

SEQ ID NO: 2642 - protein, 226 aa, Streptococcus agalactiae
MTYLEQYQSGQLTLPSALFFHFKSIFKTADDFLVWQFFYLQNTTNLSDLTPSRIATSLDKTVADINRSISNLTSQGLLDVKTIELNHEIEIIFDTSPVFAKLDKLFEEDNQVIIDNKTSDSNRLKDLVGDFERELGRLLSPFELEDLQKTLQEDQTDPDIVRAALREAVFNGKTSWNYINAILRNWRREGLTTLRQIEERKQAREDNQMKDLAISDDFKNAMNLWE

SEQ ID NO: 2643 - DNA, 681 bp, Streptococcus pyogenes
atgagttttttagaacattataagtcaggtaatttggttatcccaagtgccttgctttttcattacaaagatctttttaagagctcagatgattttttggtctggcagtttttctatcttcaaaatacgacaaagcgagacgacttagcacccagtcaaattgctcatgcgcttggaaaatcagttgctgatattaataaaatcatttcatctttgactaatcaagggcttttagatatgcggacaattgaacttactggagaaattgaaattatttttgatgcgagtcctgtgttagccaagttagatcaattgtttgtcagtcaaacggcaactgaaattgacaaacaagaaacaccaaatcatttcaaacgattagttgatgaatttgaacgtgaactaggacgattcttgagtccttttgagttagaagatcttgaaaaaacgcttcgtgatgataaaacagatcctgatttgatacgagaagctttaaaagaagctgtcttcaacggcaaaacaaattggaaatatatccaggctatcttacgtaattggcgaaaagaaggtattgttaatcttcgacaagtagaagaacgtagacgtgttagagaaggcgaagatctttctcaagtgacgatatcagaggattttctatctgcgatgaatttatggagtgattca

SEQ ID NO: 2644 - protein, 227 aa, Streptococcus pyogenes
MSFLEHYKSGNLVIPSALLFHYKDLFKSSDDFLVWQFFYLQNTTKRDDLAPSQIAHALGKSVADINKIISSLTNQGLLDMRTIELTGEIEIIFDASPVLAKLDQLFVSQTATEIDKQETPNHFKRLVDEFERELGRFLSPFELEDLEKTLRDDKTDPDLIREALKEAVFNGKTNWKYIQAILRNWRKEGIVNLRQVEERRRVREGEDLSQVTISEDFLSAMNLWSDS

SEQ ID NO: 2645 - DNA, 681 bp, Streptococcus agalactiae
atggatttacaattatcaaaacgattacaaaaagttgcaaactacgttccaaaaggagctcggttattagatgtaggaagtgatcatgcttacttacctatttttttgttgcagatgggatactgtgattttgccattgctggtgaagtggtgaatggaccgtatcagtctgcgttgaaaaacgtttcagaacatggtctcacttcaaagatagatgttcgcttagcaaatggtttgtcagcttttgaagaagcagataatattgatacgataactatctgtggaatgggtggtcgtttgattgctgatattttgaataacgatatagacaaacttcagcacgttaaaacactagtcttacaacctaataatcgggaagatgatttaagaaaatggttagctgcaaatgattttgaaatagtagcagaagatatcttgactgaaaatgacaaacgctatgaaattttagttgttaagcatggtcatatgaatttaactgctaaagaattgcgatttggtccatttttattatccaataacacaacggtttttaaagaaaaatggcaaaatgagcttaataaattaacttttgctttaaactctattcccaatagtaaaatggaagaacgcgctattttggaagataaaatacaggatataaaggaggttcttgatgaaagc

SEQ ID NO: 2646 - protein, 227 aa, Streptococcus agalactiae
MDLQLSKRLQKVANYVPKGARLLDVGSDHAYLPIFLLQMGYCDFAIAGEVVNGPYQSALKNVSEHGLTSKIDVRLANGLSAFEEADNIDTITICGMGGRLIADILNNDIDKLQHVKTLVLQPNNREDDLRKWLAANDFEIVAEDILTENDKRYEILVVKHGHMNLTAKELRFGPFLLSNNTTVFKEKWQNELNKLTFALNSIPNSKMEERAILEDKIQDIKEVLDES

SEQ ID NO: 2647 - DNA, 684 bp, Streptococcus pyogenes
atggatagtcaattatcaaaccgtttggcccaagttgcggcctatgttccaaaaggtgtcaaattattagatgttggcagtgatcatgcctaccttcccatatttttggtagaaactaatcagatttcagcagccattgctggcgaagtggttaggggtccctacgaatctgctcttaaaaatgtcacacagtctggccttgccgagcatattcaggtgcgcttagccaatggccttgcagcctttgaagaagctgatgatgtgacagccattaccatttgtggcatgggtggccgtttgattgctgatattttagaggcaggtaaggaaaaattgcagggcattgaacgtctggttttacaacccaacaatcgtgaggatgatttacgggcttggttatcggttaacgcttttaaaattgttgcagaaaccatcatggctgaaaatgacaaatattatgaaatcatcgttgctgagcatggtgaaaaggccttatccgcgacagaattgcgttttggtccatacctttctcaggaaaaatcagtcgtttttaaagagaagtggcaacgagaaatggataagttagcttatgccttgtcctgcatcccagaagaaaaaactcaagagcgtcagcttctcttgacaaaaatacaacaaataaaagaggtgattgttcatgaaagc

SEQ ID NO: 2648 - protein, 228 aa, Streptococcus pyogenes
MDSQLSNRLAQVAAYVPKGVKLLDVGSDHAYLPIFLVETNQISAAIAGEVVRGPYESALKNVTQSGLAEHIQVRLANGLAAFEEADDVTAITICGMGGRLIADILEAGKEKLQGIERLVLQPNNREDDLRAWLSVNAFKIVAETIMAENDKYYEIIVAEHGEKALSATELRFGPYLSQEKSVVFKEKWQREMDKLAYALSCIPEEKTQERQLLLTKIQQIKEVIVHES

SEQ ID NO: 2649 - DNA, 789 bp, Streptococcus agalactiae
ttgatgaaagctagagaacttattgatgtatatgaaacttattgtccacaggaattatctatggaaggagatatttcaggtcttcaaattggatctttagataaagaaataaagacagtcatggtagctttagatgttcgagagactacagtagctgaagcaattgaacgtcaagtagatcttcttattgtaaagcatgctcctatttttcgtccattaaaggatttggtagcaacgccgcaaaataagatttatatagaccttcttaaatcagacattgctgtttatgtgagccatactaatatagatatcgttcctaatggacttaacgactggttttgtgaattattagatattcaatatcccgatatattatctgagacaagtaatggttatggtattggtcgcattggtgatattagaccccagagttttgaattttttgcatggaaaattaaagatgtgtttggtttagatagcgttcgtttagtttcatatgataaatctaatcctgaaattcaacgagttgctatttgtgggggtagtgggcaaagtttctacaaagaagctattgcaaaaggagcagatgtttttgtaacgggagatatttattatcatactgcacaagaaatgatcacaaatggtttgcttgcgattgacccaggtcatcatattgaggttttatttgtttctaaaatagctactatgattgagcagtggaaacttgaaaaaggctgggatatttcagttttagagagtaaagctccaacaaatcccttttaccatatg

SEQ ID NO: 2650 - protein, 263 aa, Streptococcus agalactiae
MMKARELIDVYETYCPQELSMEGDISGLQIGSLDKEIKTVMVALDVRETTVAEAIERQVDLLIVKHAPIFRPLKDLVATPQNKIYIDLLKSDIAVYVSHTNIDIVPNGLNDWFCELLDIQYPDILSETSNGYGIGRIGDIRPQSFEFFAWKIKDVFGLDSVRLVSYDKSNPEIQRVAICGGSGQSFYKEAIAKGADVFVTGDIYYHTAQEMITNGLLAIDPGHHIEVLFVSKIATMIEQWKLEKGWDISVLESKAPTNPFYHM

SEQ ID NO: 2651 - DNA, 792 bp, Streptococcus pyogenes
ttgttcatgaaagctaaaaccctaattgatgcctatgaagccttttgcccacttgatttatctatggaaggagacgttaaaggtcttcaaatgggttcattggataaagacattcgtaaggttatgattactttagatatccgagagtcaacagtagcagaagccatcaaaaatgaagttgatctcattataactaagcatgctcccatctttaaaccgcttaaagatctggtttcatcccctcagcgtgatatccttctagatttggtcaagcatgacatttctgtctatgtgagccataccaatattgacattgtaccaggtgggctaaatgattggttttgtgacctgctagaaatcaaggaagcaacttacttgtctgaaaccaaagaaggctttggcattggtcgtattggaacagttaaagaacaagcgttagaagagttagcaagtaaggtcaaaagggtgtttgatttagataccgtgcgacttatccgttacgataaggaaaaccctttgatttcaaagattgctatctgtggcggaagtggtggtgaattttatcaggatgctgtgcaaaaaggcgcagacgtttatattacaggggatatctattaccatacagcacaggagatgctgacagaaggactatttgcggttgacccggggcatcatattgaggtgctttttacggagaaattaaaggagaaactccaagggtggaaagaagagaacggttgggatgtcagcattatttcaagcaaagcctcgaccaatccatttagccattta

SEQ ID NO: 2652 - protein, 264 aa, Streptococcus pyogenes
LFMKAKTLIDAYEAFCPLDLSMEGDVKGLQMGSLDKDIRKVMITLDIRESTVAEAIKNEVDLIITKHAPIFKPLKDLVSSPQRDILLDLVKHDISVYVSHTNIDIVPGGLNDWFCDLLEIKEATYLSETKEGFGIGRIGTVKEQALEELASKVKRVFDLDTVRLIRYDKENPLISKIAICGGSGGEFYQDAVQKGADVYITGDIYYHTAQEMLTEGLFAVDPGHHIEVLFTEKLKEKLQGWKEENGWDVSIISSKASTNPFSHL

SEQ ID NO: 2653 - DNA, 1101 bp, Streptococcus agalactiae
atgaaaaagatagcaattattggtgcaggagcagtcggagcgacactagcctattacttatcaaaagaaaaggatattcaggttactgtttttgattatggagttggacaagcaactaaggctgctgcggggattattagcccatggttttcaaaacgtcgtaataaagcctggtatcgtatggcgaggttgggggctgatttttattcaaagctagtcacggatttacaaaaagatggttttgaaacaaaattttatcagcaaactggtgttttcttattaaaaaaggacgagagtcagttagagtcattgtttgcactagcagataaacgtcgactagaatctcctctaataggtgatttacaaatactaaataaaagtgaagcaaatactcactttcctgagttagatggctatgaacagttactttatgcgagcggaggagcacgagtagaaggggcggacttaacacgaatattgttagaagcaagtggtgttaatgtcatcaaggatgaagttcactttacgataactgataatggctttcgtgttcaaggaattgattttgataaacttgttttagcgagtggagcctggctagctaagatattagatgagcacaactatcaggtagatgttcgccctcaaaaagggcaattgcgagactattattttagcaatattaatacaggaaaatatcctgttgtaatgccagaaggtgagctagatattatcccatttgataatggtaaagtctctgtaggtgcaagtcacgaaaatgatatggcttttgatttaaacattgattttaaagtcttagacaagtttgaagagcaagctattggctattttccgcaattaaaaaaagcagatacgacttctgaacgtgttggaattcgtgcctatacaagtgatttttctccattttttggccctgtcccttgtatggagggtgcatatgctgcaagtggattaggatcaactggcttaacagtgggcccattaattggttatgaattatgtcaattaatcttaaataaagaaaatcagctaaatttagaggattacgatattacaaaatacgtgaaaaagattagtaga

SEQ ID NO: 2654 - protein, 367 aa, Streptococcus agalactiae
MKKIAIIGAGAVGATLAYYLSKEKDIQVTVFDYGVGQATKAAAGIISPWFSKRRNKAWYRMARLGADFYSKLVTDLQKDGFETKFYQQTGVFLLKKDESQLESLFALADKRRLESPLIGDLQILNKSEANTHFPELDGYEQLLYASGGARVEGADLTRILLEASGVNVIKDEVHFTITDNGFRVQGIDFDKLVLASGAWLAKILDEHNYQVDVRPQKGQLRDYYFSNINTGKYPVVMPEGELDIIPFDNGKVSVGASHENDMAFDLNIDFKVLDKFEEQAIGYFPQLKKADTTSERVGIRAYTSDFSPFFGPVPCMEGAYAASGLGSTGLTVGPLIGYELCQLILNKENQLNLEDYDITKYVKKISR

SEQ ID NO: 2655 - DNA, 1104 bp, Streptococcus pyogenes
atgaaaatagccattattggggcggggattgtaggatcaaccgccgcttattatttacaacaaagtggtcaaaaagaagttaccatttttgaccatggtcaaggacaagccactaaggcagctgctggtattattagtccttggttttcaaagcgtcgcaataaagtttggtaccgcatggctcgtttaggagcggacttttatcagcaattaatcaatgacctcaaagaagatggttttgcaacagatttttatcagcaaaatggcatctatgttttaaaaaagcaggaagaaaaactaagagatctttatgaattagcgttagcaagaaaggtagaatcaccgattattggtgagttagccattaaaaatcgtaaagaactggggaatgattttaaaggattgattggctttgataactgtctgtacgcttcaggagctgctagagtggagggagccgctttatgtgagacattactcaaggctagtggttatccagttattcgccaaaaagtcactctgaaacagcaaggaagtggttatgagattgctggtcattattttgatcaggtcattctggcagcaggagcatggctacctgacttattgaggcctttaggctatcaggttgatgtgcgaccacaaaagggacaactcttggattatgacgttcatcacatcatcagcgacacttatccagttgttatgccagaaggtgaaatagatcttattccttttaaccaaggtaagatttctgttggtacgagtcacgaaaatgataaaggttatgatttggagcctgattggcaggttttaaaaaaacttgaaatgcaagctcttacttatttgccgttattaaaagaagctactcaaaaaacgtgtcgtgtaggaataagagcttataccagtgattattctcctttttatggtcaggtttcaggattgaagaacctttatacagctagtggtttagggtcatcgggattaacagttggacctttgattggctatgaattagctcaattattgctaggacacgaaggacttttgacgcctagcgactattctcctgagccttaccttttgcggtctactggtaaagcg

SEQ ID NO: 2656 - protein, 368 aa, Streptococcus pyogenes
MKIAIIGAGIVGSTAAYYLQQSGQKEVTIFDHGQGQATKAAAGIISPWFSKRRNKVWYRMARLGADFYQQLINDLKEDGFATDFYQQNGIYVLKKQEEKLRDLYELALARKVESPIIGELAIKNRKELGNDFKGLIGFDNCLYASGAARVEGAALCETLLKASGYPVIRQKVTLKQQGSGYEIAGHYFDQVILAAGAWLPDLLRPLGYQVDVRPQKGQLLDYDVHHIISDTYPVVMPEGEIDLIPFNQGKISVGTSHENDKGYDLEPDWQVLKKLEMQALTYLPLLKEATQKTCRVGIRAYTSDYSPFYGQVSGLKNLYTASGLGSSGLTVGPLIGYELAQLLLGHEGLLTPSDYSPEPYLLRSTGKA

SEQ ID NO: 2657 - DNA, 867 bp, Streptococcus agalactiae
atgaaaggtattattttagcgggaggttcaggtactcgcttgtacccattaactcgtgctgcatcaaaacaattgatgccaatttatgataaaccaatgatttattatccattgtcagttttgatgttagcaggaataaaagaaatactgattatttctactccacaagatttgcctcgctttgaagatatgcttggagatggttcagaactaggaatctctctttcttatgctgaacaaccaagcccagatgggttagcacaggccttcattatcggtgaagattttattggtgatgatcacgttgctttagtattaggtgataatatttaccatggaccaggtttatctgcaatgctacaacgtgcagctagtaaagaaagtggagcaaccgtctttggctatcaagtaaaagatccagaacgttttggtgttgtcgagtttgatactgatatgaatgccatttctattgaagaaaaaccagcgcaacctaagtctaattatgctgtcacaggtctttatttctatgataacgatgtggttgaaatcgctaaaaatattaagccaagccctcgtggagaacttgaaattactgatgttaacaaagcctaccttgatagaggtgacttatcagttgagttaatgggacgtggatttgcgtggttagacactggaactcacgaaagtcttcttgaagcagcacaatatattgaaacagtacaacgcatgcaaaacgttcaagttgctaaccttgaggaaattgcttaccgcatgggctacatcactcgtgaacaagtccttgagttggcacaaccacttaagaaaaatgagtatggtcaatacctacttcgtttgattggagaagcc

SEQ ID NO: 2658 - protein, 289 aa, Streptococcus agalactiae
MKGIILAGGSGTRLYPLTRAASKQLMPIYDKPMIYYPLSVLMLAGIKEILIISTPQDLPRFEDMLGDGSELGISLSYAEQPSPDGLAQAFIIGEDFIGDDHVALVLGDNIYHGPGLSAMLQRAASKESGATVFGYQVKDPERFGVVEFDTDMNAISIEEKPAQPKSNYAVTGLYFYDNDVVEIAKNIKPSPRGELEITDVNKAYLDRGDLSVELMGRGFAWLDTGTHESLLEAAQYIETVQRMQNVQVANLEEIAYRMGYITREQVLELAQPLKKNEYGQYLLRLIGEA

SEQ ID NO: 2659 - DNA, 867 bp, Streptococcus pyogenes
atgaaaggtattattcttgcaggaggttcagggacacgcttgtatccactgacccgtgccgcatctaaacagttgatgcccatttatgacaaaccaatgatttattacccattgtcaaccttgatgttggcagggattaaagatgttttaatcatttcaactccccaagatcttcctcgtttcgaagaattgctaggagacgggtcagaatttggcattagcttatcctataaggaacaaccaagcccagatggtttagcacaagctttcattattggagaggagtttatcggtgatgaccgtgttgctcttattttaggagataatatttaccacggtaatggcctcactaaaatgcttcaaaaggcagctgccaaagaaaaaggagccaccgtttttggttatcaagtgaaagaccctgagcgctttggagtggtggaatttgatgagaacatgaatgctatctctatcgaagaaaaaccagaagtgcctaagtctcactttgcagtgactggactttatttctatgacaatgacgtggtagagattgctaaaaacattaaaccaagcgcgcgtggtgagttggaaattacagacgtcaacaaggcttacttggaacgtggtgacctctccgttgaattgatggggcgtggttttgcatggttagacactggaacgcatgaaagtctacttgaagcggctcaatatattgaaactgttcaacgcttgcaaaacgctcaagtggcaaatctggaagaaattgcctatcgcatgggctatatcagtaaagaagatgtccataaattggcgcaatctttaaagaaaaacgaatacgggcaatacttgcttcgtttgattggagaagct

SEQ ID NO: 2660 - protein, 289 aa, Streptococcus pyogenes
MKGIILAGGSGTRLYPLTRAASKQLMPIYDKPMIYYPLSTLMLAGIKDVLIISTPQDLPRFEELLGDGSEFGISLSYKEQPSPDGLAQAFIIGEEFIGDDRVALILGDNIYHGNGLTKMLQKAAAKEKGATVFGYQVKDPERFGVVEFDENMNAISIEEKPEVPKSHFAVTGLYFYDNDVVEIAKNIKPSARGELEITDVNKAYLERGDLSVELMGRGFAWLDTGTHESLLEAAQYIETVQRLQNAQVANLEEIAYRMGYISKEDVHKLAQSLKKNEYGQYLLRLIGEA

SEQ ID NO: 2661 - DNA, 90 bp, Streptococcus agalactiae
ttgaagctattcctggattgttggaattcgatattcccgttcgtggagacaaccgaggatggttcaaagagaactttcaaaaagaaaaaa

SEQ ID NO: 2662 - protein, 30 aa, Streptococcus agalactiae
MKLFLDCWNSIFPFVETTEDGSKRTFKKKK

SEQ ID NO: 2663 - DNA, 591 bp, Streptococcus agalactiae
atgactgaacaattttttgataaagaattaacttgtcgcccaattgaagctattcctggattgttggaattcgatattcccgttcgtggagacaaccgaggatggttcaaagagaactttcaaaaagaaaaaatgataccgcttggtttcccagaaagcttctttgaggcagacaaactacaaaataatatttcgtttaacaagaaaaatactttgcgaggtctccatgcagagccttgggataaatatgtttcgatcgctgatgaaggacgtgtgatcggtacttgggttgacctccgtgaaggtgacagttttggtaacgtttaccaaacgattatcgatgcctcaaaaggtatctttgttccacgcggtgttgctaatggtttccaagttctttcagataaagcagcttatacttatctcgttaacgattattgggcacttgaactcaaaccaaaatatgctttcgttaattatgcagatccaaatctaggcattcagtgggaaaaccttgaagaagcagaagtctcagaagcagataagaatcacccacttctcaaagatgtaaaacctttgaagaaggaagatttg

SEQ ID NO: 2664 - protein, 197 aa, Streptococcus agalactiae
MTEQFFDKELTCRPIEAIPGLLEFDIPVRGDNRGWFKENFQKEKMIPLGFPESFFEADKLQNNISFNKKNTLRGLHAEPWDKYVSIADEGRVIGTWVDLREGDSFGNVYQTIIDASKGIFVPRGVANGFQVLSDKAAYTYLVNDYWALELKPKYAFVNYADPNLGIQWENLEEAEVSEADKNHPLLKDVKPLKKEDL

SEQ ID NO: 2665 - DNA, 591 bp, Streptococcus pyogenes
atgacagaaactttttttgacaaaccattggcttgccgagaaatcaaagaaatcccaggcttactagagtttgatattcctgttcgtggggataatcgtggctggtttaaagaaaatttccaaaaagaaaaaatgttgccaattggctttccagaacgtttttttgaggaaggaaaactacaaaacaacgtttctttttcacgtcagcatgtgctgcgtggacttcatgctgaaccttgggataaatacatctcagttgctgatgatggcaaggttttaggagcttgggttgatcttcgtgagggagagacttttggaaacgtctaccagacagtgattgatgcttcaaaaggaatgtttgttcctagaggggttgctaatggctttcaagttctttcagagactgtctcttacagttatcttgtcaatgactactgggctcttgacttgaaacctaagtatgcttttgtaaactatgctgacccaagtcttgggattacttgggaaaatctagcagctgcagaagtttctgaagcagataaaaaccatcctcttcttagtgatgtcaaaccactgaaaccaaaagaccta

SEQ ID NO: 2666 - protein, 197 aa, Streptococcus pyogenes
MTETFFDKPLACREIKEIPGLLEFDIPVRGDNRGWFKENFQKEKMLPIGFPERFFEEGKLQNNVSFSRQHVLRGLHAEPWDKYISVADDGKVLGAWVDLREGETFGNVYQTVIDASKGMFVPRGVANGFQVLSETVSYSYLVNDYWALDLKPKYAFVNYADPSLGITWENLAAAEVSEADKNHPLLSDVKPLKPKDL

SEQ ID NO: 2667 - DNA, 102 bp, Streptococcus agalactiae
ttgcgtcaaacaacattgctaattcgtttttacttgctaaggttaatgccttttaagaagttgaaaattacaaatcttccttcttcaaaggttttacatctt

SEQ ID NO: 2668 - protein, 34 aa, Streptococcus agalactiae
MRQTTLLIRFYLLRLMPFKKLKITNLPSSKVLHL

SEQ ID NO: 2669 - DNA, 126 bp, Streptococcus agalactiae
atgaaaccagctccaccagttacgataatgtttttaaattcagtcattttttctccgaaaaattttttctttttgctatttgaaggatactgttctgttagaagtagttctatggaatgtcatgcc

SEQ ID NO: 2670 - protein, 42 aa, Streptococcus agalactiae
MKPAPPVTIMFLNSVIFSPKNFFFLLFEGYCSVRSSSMECHA

SEQ ID NO: 2671 - DNA, 930 bp, Streptococcus agalactiae
ttgacatatgcaggtaaccgtgctaacattgaagccattcttggtgatcgtgttgagttagttgttggtgacatcgctgacgctgaattggtagacaagttggctgccaaagcagatgctattgttcactatgcggctgagagccacaatgacaactcacttaacgatccaagtccatttatccatacaaactttatcggaacttacactttgcttgaagcagctcgtaaatacgatatccgtttccaccacgtgtcaactgatgaagtttatggagatctgccacttcgtgaagaccttccaggaaatggtgaaggaccaggtgaaaaattcactgctgaaacaaaatacaatccatcatcaccttactcatcaactaaggcagcttctgaccttatcgttaaggcatgggtacgttccttcggcgtaaaagcgaccatttcgaactgttcaaataactatggaccataccaacacatcgaaaaattcattccacgtcaaattacaaatatcttggcaggaatcaaaccgaaactttatggtgaaggtaaaaacgtccgtgactggatccacacaaatgatcattcaacaggtgtctgggctattttgactaagggtcgtattggtgaaacataccttattggtgccgacggtgagaaaaacaacaaggaagttcttgaacttatccttgagaaaatgggtcaaccaaaagacgcttacgatcacgtaactgaccgtgctggacacgaccttcgttacgctatcgattctacaaaattgcgtgaagaacttggttgggaaccacaattcacaaacttctcagaaggtttggaagaaacaatcaactggtacactgaaaaccaagattggtggaaagcagagaaagaagcagttgaagctaactacgctaaaacgcaagaagtcattaac

SEQ ID NO: 2672 - protein, 310 aa, Streptococcus agalactiae
MTYAGNRANIEAILGDRVELVVGDIADAELVDKLAAKADAIVHYAAESHNDNSLNDPSPFIHTNFIGTYTLLEAARKYDIRFHHVSTDEVYGDLPLREDLPGNGEGPGEKFTAETKYNPSSPYSSTKAASDLIVKAWVRSFGVKATISNCSNNYGPYQHIEKFIPRQITNILAGIKPKLYGEGKNVRDWIHTNDHSTGVWAILTKGRIGETYLIGADGEKNNKEVLELILEKMGQPKDAYDHVTDRAGHDLRYAIDSTKLREELGWEPQFTNFSEGLEETINWYTENQDWWKAEKEAVEANYAKTQEVIN

SEQ ID NO: 2673 - DNA, 1038 bp, Streptococcus pyogenes
atgtataaaaatattatcgtaactggtggagctggtttcatcggatctaactttgtgcactatgtctacaataaccacccagatgttcatgtaactgtccttgataaattgacatatgcaggtaaccgtgctaacattgaagctattcttggtgatcgtgttgagttagttgttggtgatatcgctgacgctgaattggtagataaattggctgccaaaacggatgctattgttcactatgcggctgagagccacaacgataactcattggaagatccaagtccatttatccatacaaactttatcggaacttacactttgcttgaagcagctcgtaaatacgatatccgtttccaccacgtgtcaactgatgaagtttatggagatcttccacttcgtgaagaccttccaggacagggtgaaggaccaggtgaaaaattcactgctgaaacaaaatacaatccatcatcaccttactcatcaactaaggcagcttctgaccttatcgttaaggcatgggtacgttccttcggtgtgaaagcgaccatttcgaactgttcaaataactatggaccataccaacacatcgaaaaattcattccacgtcaaattacaaatatcttggcaggaatcaaaccaaaactttatggtgaaggtaaaaacgtccgtgactggattcatactaatgatcattctacaggagtatgggctattttgactaagggtcgtatcggtgaaacataccttattggtgccgacggcgagaaaaacaacaaggaagttcttgagcttatccttgagaaaatgggtcaaccaaaagacgcttatgatcacgtaactgaccgtgctggtcacgatcttcgttacgctattgattctacaaaattgcgtgaagaactcggctgggaaccacaatttacaaacttttcagaaggtttggaagaaactattaagtggtacacagaaaatgagacatggtggaaagcagaaaaagatgctgtagaagccaagtatgctaaaactcaagaagtgattaaa

SEQ ID NO: 2674 - protein, 346 aa, Streptococcus pyogenes
MYKNIIVTGGAGFIGSNFVHYVYNNHPDVHVTVLDKLTYAGNRANIEAILGDRVELVVGDIADAELVDKLAAKTDAIVHYAAESHNDNSLEDPSPFIHTNFIGTYTLLEAARKYDIRFHHVSTDEVYGDLPLREDLPGQGEGPGEKFTAETKYNPSSPYSSTKAASDLIVKAWVRSFGVKATISNCSNNYGPYQHIEKFIPRQITNILAGIKPKLYGEGKNVRDWIHTNDHSTGVWAILTKGRIGETYLIGADGEKNNKEVLELILEKMGQPKDAYDHVTDRAGHDLRYAIDSTKLREELGWEPQFTNFSEGLEETIKWYTENETWWKAEKDAVEAKYAKTQEVIK

SEQ ID NO: 2675 - DNA, 123 bp, Streptococcus agalactiae
ttggttatatcttctttaaaaatagcactattgatattgaacgcaaagagcaaacaggtacttggaacagcattaatcgtacttctaaaaatacctcaatcgttagcaatccttttatcacta

SEQ ID NO: 2676 - protein, 41 aa, Streptococcus agalactiae
MVISSLKIALLILNAKSKQVLGTALIVLLKIPQSLAILLSL

SEQ ID NO: 2677 - DNA, 165 bp, Streptococcus agalactiae
atgatgaaaatacacgtggttggtataccggagatggtatgttctatctttataatagtgatcaatctcattatagtaatcatttttggccaaccgtcaatccttataaaatggctggaacaactgaaaaagatgctaagcgtgaagatacgactaaggatttca

SEQ ID NO: 2678 - protein, 55 aa, Streptococcus agalactiae
MMKIHVVGIPEMVCSIFIIVINLIIVIIFGQPSILIKWLEQLKKMLSVKIRLRIS

SEQ ID NO: 2679 - DNA, 120 bp, Streptococcus agalactiae
ttgatcccactaaaaaatatgaggtcaagtttgatattgaaacaagtaacaaggctggacaagctttccttcgtattatggagaaaaaagataacaatacgcgactttggctttctgaga

SEQ ID NO: 2680 - protein, 40 aa, Streptococcus agalactiae
MIPLKNMRSSLILKQVTRLDKLSFVLWRKKITIRDFGFLR

SEQ ID NO: 2681 - DNA, 3216 bp, Streptococcus agalactiae
atggaaatcaaaaagaaacatcgtattatgctttattcagcccttattttaggaacaatattggttaacaatagttaccaagctaaagctgaagagcttaccaaaactacctcaacgtcacaaataagagatactcaaactaataatgttgaagctccccagactgaaagtaccactgtcaaagagactagcaccacaaccacacaacaagatttgtctaactccacagcttcaaccgcaactgcaacagccactcctagcacaatgaaacaagtagtagataatcaaactcaaaataaggagctggtgaaaaacggagattttaatcaaactaaccctgtatctggaagctggtcacatacaggcgctagggaatggtctgcttggattgataaagaaaatactgctgataaatcacctattatccaacgtaccgaacaaggccaagtaagtctatccagcgacaaaggctttagaggtgctgtaacacaaaaagtgaacattgatcccactaaaaaatatgaggtcaagtttgatattgaaacaagtaacaaggctggacaagctttccttcgtattatggagaaaaaagataacaatacgcgactttggctttctgagatgaccagcggtactactaacaaacataccttaacaaagatatataacccaaagttagatgtctccgaggtgacacttgaactttattatgaaaaaggaacaggttctgttacttttgataatatatcaatgaaagcaaaaggccctaaagactcagagcatccacaacccgtcacaacacaaattgaaaaaagcgttaatacggctttaaacaaaaattacgtttttaataaagctgactaccaatacactctaaccaatccgtctcttgggaaaattgttggtggaatattgtatccaaacgctactggttcaacaactgttaaaatatctgataaatctggcaaaataattaaagaagtaccgttatcagttacagcttcaacagaagataactttacaaaactcctcgacaaatggaacgacgtgactattggtaatcatgtttacgatactaatgattcgaacatgcaaaagcttaatcagaaattagatgaaactaacgccaaaaacatcgaagctatcaaactggattctaatcgcactttcctttggaaagatttagataatctcaataattcagcacagttaaccgctacttatcgtcgtttggaagatttagctaaacaaatcaccaatccacactctactatttacaaaaatgaaaaagctattcgtactgtaaaagagagtctggcttggcttcatcaaaacttctacaatgttaataaagatatagaaggctctgccaattggtgggattttgaaatcggtgttcctcgctcaattacaggtaccctagctctcatgtataactacttcactgacgctgaaataaaaacttataccgacccaattgaacattttgttcctgatgcaggatttttccgtaaaacgcttgtcaatccatttaaagcccttggtggtaatctagtcgatatggggcgcgttaaaatcattgaaggtttacttcgtaaagacaatactattatcgaaaaaacttctcattctctaaaaaatctttttactactgctactaaagctgaaggcttctatgctgacggttcttacatcgaccatacgaatgttgcttatactggcgcctatggtaatgttctgatagatggtttgacacaattgctgcctatcattcaagaaactgactataaaatctctaatcaagaacttgatatggtttataaatggattaatcaatcatttttacctttaattgtaaaaggtgagttaatggatatgagtcgtggacgctcaattagtagagaggctgcttcttctcatgcggctgcagttgaagttctcagaggtttcctcagattggctaacatgtctaatgaagagcgaaacttagacctcaaatcaactattaaaacgattatcacttcaaataaattctacaacgtcttcaataacctcaaatcgtattccgatattgccaacatgaataagctgcttaatgacagtacagtcgctactaaacctttaaaaagtaatttatcaacctttaatagcatggaccgcttagcttattataatgccgagaaagactttggtttcgcactttcattacattctaaacgtaccctcaactatgaaggaatgaatgatgaaaatacacgtggttggtataccggagatggtatgttctatctttataatagtgatcaatctcattatagtaatcatttttggccaaccgtcaatccttataaaatggctggaacaactgaaaaagatgctaagcgtgaagatacgactaaggatttcatgagcaaacatagcaaagacgctaaagaaaaaaccggtcaagttacaggagcatctgactttgttggttccgtcaaacttaatgatcactttgctcttgccgctatggactttactaactgggatcgcaccttaacagcacaaaaaggttgggttatcttaaatgataagattgtctttttaggtagcaacatcaagaatactaacggcattggaaatgtttctacaacaattgatcaacgaaaagacgattctaaaacaccttatactacatacgtcaatggaaaaactgttgatttaaagcaagcaagttctcaacaatttacagatacaaagagtgtctttttagaatcaaaagaacctggtcgcaatattggttatatcttctttaaaaatagcactattgatattgaacgcaaagagcaaacaggtacttggaacagcattaatcgtacttctaaaaatacctcaatcgttagcaatccttttatcactataagccaaaagcatgacaacaaaggtgatagctatgattacatgatggttccaaacattgatcgcacaagttttgataaattagccaatagcaaagaagtagaattactagaaaacagttcaaaacaacaagttatctatgataaaaacagtcaaacttgggctgttatcaaacacgataatcaagagagtctcattaacaatcaattcaaaatgaataaagcgggactttacctagtacaaaaagttggtaatgactatcaaaatgtctattaccaacctcaaagcatgacaaaaacagaccaattagctatc

SEQ ID NO: 2682 - protein, 1072 aa, Streptococcus agalactiae
MEIKKKHRIMLYSALILGTILVNNSYQAKAEELTKTTSTSQIRDTQTNNVEAPQTESTTVKETSTTTTQQDLSNSTASTATATATPSTMKQVVDNQTQNKELVKNGDFNQTNPVSGSWSHTGAREWSAWIDKENTADKSPIIQRTEQGQVSLSSDKGFRGAVTQKVNIDPTKKYEVKFDIETSNKAGQAFLRIMEKKDNNTRLWLSEMTSGTTNKHTLTKIYNPKLDVSEVTLELYYEKGTGSVTFDNISMKAKGPKDSEHPQPVTTQIEKSVNTALNKNYVFNKADYQYTLTNPSLGKIVGGILYPNATGSTTVKISDKSGKIIKEVPLSVTASTEDNFTKLLDKWNDVTIGNHVYDTNDSNMQKLNQKLDETNAKNIEAIKLDSNRTFLWKDLDNLNNSAQLTATYRRLEDLAKQITNPHSTIYKNEKAIRTVKESLAWLHQNFYNVNKDIEGSANWWDFEIGVPRSITGTLALMYNYFTDAEIKTYTDPIEHFVPDAGFFRKTLVNPFKALGGNLVDMGRVKIIEGLLRKDNTIIEKTSHSLKNLFTTATKAEGFYADGSYIDHTNVAYTGAYGNVLIDGLTQLLPIIQETDYKISNQELDMVYKWINQSFLPLIVKGELMDMSRGRSISREAASSHAAAVEVLRGFLRLANMSNEERNLDLKSTIKTIITSNKFYNVFNNLKSYSDIANMNKLLNDSTVATKPLKSNLSTFNSMDRLAYYNAEKDFGFALSLHSKRTLNYEGMNDENTRGWYTGDGMFYLYNSDQSHYSNHFWPTVNPYKMAGTTEKDAKREDTTKDFMSKHSKDAKEKTGQVTGASDFVGSVKLNDHFALAAMDFTNWDRTLTAQKGWVILNDKIVFLGSNIKNTNGIGNVSTTIDQRKDDSKTPYTTYVNGKTVDLKQASSQQFTDTKSVFLESKEPGRNIGYIFFKNSTIDIERKEQTGTWNSINRTSKNTSIVSNPFITISQKHDNKGDSYDYMMVPNIDRTSFDKLANSKEVELLENSSKQQVIYDKNSQTWAVIKHDNQESLINNQFKMNKAGLYLVQKVGNDYQNVYYQPQSMTKTDQLAI

SEQ ID NO: 2683 - DNA, 2484 bp, Streptococcus pyogenes
gtggtatatttttacttagtaaatcaatttacttttattatctcatttttatattggaggaatttatcagtgaatacttatttttgcacacaccataaacaattactactttattcaaacctattccttagctttgctatgatgggccaaggaactgccatttatgccgatacactgacttcaaattcagaacctaataatacttactttcaaacgcaaacgctcactactacagatagcgaaaaaaaggtagtacagccacaacaaaaagactactatactgaattgttagaccaatggaacagtattatcgcaggcaacgatgcttatgataaaaccaatcctgacatggtcacttttcataataaagctgaaaaggatgctcaaaacattattaaaagctatcaagggcctgaccacgaaaatagaacttacctttgggaacatgcaaaggattattccgcttctgctaatatcacgaaaacttaccgcaatattgaaaaaatagcaaaacagatcactaatcctgaatcatgctattatcaagatagtaaagctattgctattgtaaaagacggtatggccttcatgtatgaacacgcttataatctagatcgtgaaaatcatcaaacaactggaaaagaaaacaaagaaaattggtgggtttatgaaattggaactcctcgtgctattaataataccttatccttgatgtatccttattttactcaagaagaaattcttaaatacacagctccaatcgaaaaatttgtgcctgaccctactcgttttagggttcgcgctgccaatttttcaccttttgaagccaatagcggaaatttaattgatatggggcgtgttaaactcatttccggtattcttcgtaaagatgatctcgaaattagtgatacaatcaaagcaattgagaaagttttcacgctagttgatgaaggaaatggtttttaccaagacggttctttaattgatcacgtggttactaacgctcaaagtccactttataaaaaaggcattgcttacactggagcttacggtaatgtgcttatagatggcttatcgcaattaattcctattattcaaaaaacaaagtctcctataaaagcggataaaatggctactatctatcattggattaaccattcttttttccctatcatcgttcgtggagaaatgatggatatgactcgagggcgttctatcagtcgttttaatgcccaatctcatgttgctggcattgaagcacttcgtgctattttacgtattgctgacatgtctgaagagcctcaccgtttggcacttaaaacacgtataaaaacactcgtcacacaagggaatgctttttacaatgtctatgataatttgaaaacctatcacgatatcaaacttatgaaagaactactaagtgatacttctgttccagtccaaaaacttgatagttacgtagctagtttcaatagtatggataaattggcactatataataataaacacgattttgcttttggcctatcaatgttttcgaatcgaactcaaaattatgaagctatgaataatgaaaatcttcatggctggtttacttctgatggaatgttttacctatacaataacgatttaggacactacagtgaaaactattgggcaacggtaaatccctaccgcttacctggaaccacagaaactgagcaaaaaccactagagggaactcctgagaatattaaaacgaactatcaacaagttggcatgactggtctctctgatgacgcttttgttgcaagtaaaaaacttaataacacaagtgctctagctgctatgaccttcactaattggaataaaagcctcaccctcaataaagggtggtttatcttaggaaacaaaataatctttgttggtagcaatatcaaaaaccaatcatctcacaaggcgtatacaactattgaacaacgaaaagaaaatcaaaagtacccttactgttcttatgttaacaatcaacccgttgacttgaataatcagctagttgattttacaaacactaaaagtattttccttgaaagtgatgatcccgctcaaaatattggttactacttcttcaagccaacaacacttagcataagtaaggcacttcaaacagggaaatggcaaaacataaaagctgatgacaaatcaccagaagccatcaaagaagtttcaaatacctttatcactatcatgcaaaaccatactcaagatggcgatcgttatgcctatatgatgcttccaaatatgactcgtcaagaatttgaaacctatattagcaagcttgatatcgacttattagaaaacaatgacaaactggccgctgtctacgatcatgatagtcaacagatgcacgtcattcactatggaaaaaaagcaacgatgttttcaaatcataatctttctcatcaaggcttttatagttttcctcatcctgtcaggcaaaatcaacaa

SEQ ID NO: 2684 - protein, 828 aa, Streptococcus pyogenes
VVYFYLVNQFTFIISFLYWRNLSVNTYFCTHHKQLLLYSNLFLSFAMMGQGTAIYADTLTSNSEPNNTYFQTQTLTTTDSEKKVVQPQQKDYYTELLDQWNSIIAGNDAYDKTNPDMVTFHNKAEKDAQNIIKSYQGPDHENRTYLWEHAKDYSASANITKTYRNIEKIAKQITNPESCYYQDSKAIAIVKDGMAFMYEHAYNLDRENHQTTGKENKENWWVYEIGTPRAINNTLSLMYPYFTQEEILKYTAPIEKFVPDPTRFRVRAANFSPFEANSGNLIDMGRVKLISGILRKDDLEISDTIKAIEKVFTLVDEGNGFYQDGSLIDHVVTNAQSPLYKKGIAYTGAYGNVLIDGLSQLIPIIQKTKSPIKADKMATIYHWINHSFFPIIVRGEMMDMTRGRSISRFNAQSHVAGIEALRAILRIADMSEEPHRLALKTRIKTLVTQGNAFYNVYDNLKTYHDIKLMKELLSDTSVPVQKLDSYVASFNSMDKLALYNNKHDFAFGLSMFSNRTQNYEAMNNENLHGWFTSDGMFYLYNNDLGHYSENYWATVNPYRLPGTTETEQKPLEGTPENIKTNYQQVGMTGLSDDAFVASKKLNNTSALAAMTFTNWNKSLTLNKGWFILGNKIIFVGSNIKNQSSHKAYTTIEQRKENQKYPYCSYVNNQPVDLNNQLVDFTNTKSIFLESDDPAQNIGYYFFKPTTLSISKALQTGKWQNIKADDKSPEAIKEVSNTFITIMQNHTQDGDRYAYMMLPNMTRQEFETYISKLDIDLLENNDKLAAVYDHDSQQMHVIHYGKKATMFSNHNLSHQGFYSFPHPVRQNQQ

SEQ ID NO: 2685 - DNA, 480 bp, Streptococcus agalactiae
atgactaaattagcaacaatttgttacattgacaatggcaaggaattacttctattgcaccgcaacaaaaaagagaatgatgttcatgagggaaagtggatctcggtaggtggtaaactggaggcaggtgaaactcctgatgaatgtgctaagcgtgaaattctagaagaaacccatttaacggtaaaaaaaatggattttaaaggagtcatcacttttcctgaatttacgccaggtcatgattggtatacctatgtctttaaagtaacagattatgaaggagagttaatttcagatgatgaatcacgagaaggaactttagaatgggtaccatatgatcaagttctttctaagccaacgtggcaaggagattacgaaatttttaaatggattttagaagatgttcctttcttttctgctaagtttgtttatgatgaacaccaaaatttaattgaaaagacggttaatttttatgaaaaa

SEQ ID NO: 2686 - protein, 160 aa, Streptococcus agalactiae
MTKLATICYIDNGKELLLLHRNKKENDVHEGKWISVGGKLEAGETPDECAKREILEETHLTVKKMDFKGVITFPEFTPGHDWYTYVFKVTDYEGELISDDESREGTLEWVPYDQVLSKPTWQGDYEIFKWILEDVPFFSAKFVYDEHQNLIEKTVNFYEK

SEQ ID NO: 2687 - DNA, 474 bp, Streptococcus pyogenes
atgactcaattagcaaccatttgttacattgataatggcgattctttgctattattacaccgcaataaaaaagaaaatgatgtccacaaaggcaagtggatttcagttgggggtaagctcgaggctggtgagaccccagatgagtgtgcccgtcgtgagattttagaggaaacccatttgactgttacagagatggcctttaaaggaatcattacttttccagaatttacccctggtcatgactggtatacctatgtttttaaagtaacaggatttgaaggagacctcatttcagatgaagagtcacgagaaggaaccttggaatgggtaccttacgatcaagtgttggaaaagccaacttgggaaggtgattatgacatttttaaatggattttagaagaccgttcttttttctctgccaaatttacctatgaccaaaacaaccaactcatggataaatctgtgaccttttat

SEQ ID NO: 2688 - protein, 158 aa, Streptococcus pyogenes
MTQLATICYIDNGDSLLLLHRNKKENDVHKGKWISVGGKLEAGETPDECARREILEETHLTVTEMAFKGIITFPEFTPGHDWYTYVFKVTGFEGDLISDEESREGTLEWVPYDQVLEKPTWEGDYDIFKWILEDRSFFSAKFTYDQNNQLMDKSVTFY

SEQ ID NO: 2689 - DNA, 480 bp, Streptococcus agalactiae
ttgaaaagacggttaatttttatgaaaaatagagattttagggttagagaacagctcgaaacattcggagtcagagtttctgctttaatcatagaaaatcaaaaactgctattaatatatgctcctcatctcgataaatactatttgccaggtggggcgcttcaagttggagaagatagcaataaggctgttgcgagagaagtacttgaggaaataggtcttcacagccaagttggtgatttagcctatattattgagaatcagtttaatattaagagacatcattatcactcagttgaatttttatattttgttaatctcttgggtcaggcgccagaatctatcaaagaaggaacgcataagcgacattttgtatggcttccaataaaagaattaacaaaaattgattgtaatcctaattttttagcacaggatttgatagaatggccaggtcatgttgtgcataaaattgttcaaaat

SEQ ID NO: 2690 - protein, 160 aa, Streptococcus agalactiae
MKRRLIFMKNRDFRVREQLETFGVRVSALIIENQKLLLIYAPHLDKYYLPGGALQVGEDSNKAVAREVLEEIGLHSQVGDLAYIIENQFNIKRHHYHSVEFLYFVNLLGQAPESIKEGTHKRHFVWLPIKELTKIDCNPNFLAQDLIEWPGHVVHKIVQN

SEQ ID NO: 2691 - DNA, 315 bp, Streptococcus pyogenes
ttgattgttagaaatggtaagaattttttaactagagatgcagatgaccaatattacaccattggtggtacaagtttggtaggtgaaaaaacgcatgaaactgttttacgtgaaaccttagaggaagttggtattcgagctaaggttaatcaactggcttttatggttgagaatcattttgatatcgatgatgttttctggcataatattgaatttcattatttggtaagccccttagaagaccctaaactagaaatgatagagaatgcaagcgacaggtttgtgaatggattccaatcaatcaactggatcaaa

SEQ ID NO: 2692 - protein, 105 aa, Streptococcus pyogenes
LIVRNGKNFLTRDADDQYYTIGGTSLVGEKTHETVLRETLEEVGIRAKVNQLAFMVENHFDIDDVFWHNIEFHYLVSPLEDPKLEMIENASDRFVNGFQSINWIK

SEQ ID NO: 2693 - DNA, 1188 bp, Streptococcus agalactiae
atgaatcgaccatcagaaaaagaatttaaaaatagtttgttttttaaatggatcttaaataatcaagcagttattgctctcatgattacctttttggtatttttaacgatttttatttttaccaaaatctcttttatgtttaaacctgtgtttgattttcttgctgtgctgatattgccgcttgtaatttctggcttgctttattacctattaaaacctatggttacatttttagagaagcggggaattaagcgtgtaacagcgatattatcagtttttactattataatccttctgttaatttgggcaatgtctagttttattcccatgatgagtaatcaattacgccattttatggaagatctcccttcatatgtgaataaagtgcaaatggaaacaagttcgtttatagatcacaacccttggttaaaatcttataaaggggaaatatcgagcatgttatctaatatcagtagccaagcggtctcttatgctgaaaaattttcaaagaatattttagattgggcaggaaatttagctagtacagttgcacgtgtgacagtagcaacaatcatggctccctttattttgttttatcttttaagagatagtcgcaacatgaagaatggtttcttaatggttttaccaaccaaactacgccaaccaactgatcgtattttgcgagaaatgaatagtcaaatgtcagggtatgtgcaaggacaaatcattgttgctattactgttggtgttattttttcaataatgtatagtattataggccttagatatggcgtgacattagggattattgccggtgtgttaaatatggttccctatttgggaagttttgtcgcccaaattccagtgtttatcttagcgcttgtcgcaggacctgttatggttgttaaagttgcgattgtttttgttattgagcaaactctagaaggacgctttgtctcacccttggttttaggtaataaacttagcattcatccaattacaattatgtttattttattaacctctggagcgatgtttggtgtttggggagtattcctcagtattccgatttatgcatctatcaaagttgttgttaaagaattgtttgattggtacaaagctgtcagtgggctatatacagtagatgttgttactgaagaaagaagtgaagaagttaaaaatgttgaa

SEQ ID NO: 2694 - protein, 396 aa, Streptococcus agalactiae
MNRPSEKEFKNSLFFKWILNNQAVIALMITFLVFLTIFIFTKISFMFKPVFDFLAVLILPLVISGLLYYLLKPMVTFLEKRGIKRVTAILSVFTIIILLLIWAMSSFIPMMSNQLRHFMEDLPSYVNKVQMETSSFIDHNPWLKSYKGEISSMLSNISSQAVSYAEKFSKNILDWAGNLASTVARVTVATIMAPFILFYLLRDSRNMKNGFLMVLPTKLRQPTDRILREMNSQMSGYVQGQIIVAITVGVIFSIMYSIIGLRYGVTLGIIAGVLNMVPYLGSFVAQIPVFILALVAGPVMVVKVAIVFVIEQTLEGRFVSPLVLGNKLSIHPITIMFILLTSGAMFGVWGVFLSIPIYASIKVVVKELFDWYKAVSGLYTVDVVTEERSEEVKNVE

SEQ ID NO: 2695 - DNA, 1179 bp, Streptococcus pyogenes
atgcccttaatacctgaaaagtctagaacagatagcttattttacaaatggtttttaaataatcaagctaccatggctttagtaataacacttttagcctttttaacgatttttgtttttactaaaatctcttttttatttatgccagtgatttctttttttgcggtcatcatgttgcccttggttatttcgaccattctgtattatctgaccaaacccttagttgaccttattaatcacttgggcccgaatcgtaccacctctatttttattgtttttggtttgattaccttactttttgtctgggcgatttcaggctttgttcccatggtacagacccaacttaccagttttattgaggatctgcccaaatacgtgggcaaggtcaatgaagaagccaataaacttcttgaaaatgaatggttagtcagctataagccccaactccaagacatgcttacccatacaagtcaaaaggctttggattacgcgcaaagtttttcaaaaaatgctattgactgggctggtaattttgctggtgccattgctcggattaccgtggctattattatttcgccctttattctcttttattttttacgagacagtagccacatgaaaaatggccttgtgaatgtcttacctctcaaattacgggtgcctatggttcgagtcttgggagatattaacaagcaattatcaggctatgtgcaagggcaggttacggttgcaattgttgtcggctttatgttttctatcatgtttagccttgtgggactgaaatatgccatcacttttgggattattgctggctttcttaacatgataccttacttaggaagtttccttgccatgatacctgttgtgattatggctatggtacaaggcccatttatgttggttaaggtgcttgttatctttatgattgagcaaaccatcgaagggcgttttgtagcaccgcttgttttgggaaataagctgagcattcatcctattaccattatgttcttgttattgactgcaggctctatgtttggtgtctggggtgttttccttgtcatcccaatctacgcttctgtcaaagttgtgattaaagaattatttgactggtacaaaaaagttagcggtttgtatgacgaagaagtattggtgattgaggaggttaaggaccatgttaaa

SEQ ID NO: 2696 - protein, 393 aa, Streptococcus pyogenes
MPLIPEKSRTDSLFYKWFLNNQATMALVITLLAFLTIFVFTKISFLFMPVISFFAVIMLPLVISTILYYLTKPLVDLINHLGPNRTTSIFIVFGLITLLFVWAISGFVPMVQTQLTSFIEDLPKYVGKVNEEANKLLENEWLVSYKPQLQDMLTHTSQKALDYAQSFSKNAIDWAGNFAGAIARITVAIIISPFILFYFLRDSSHMKNGLVNVLPLKLRVPMVRVLGDINKQLSGYVQGQVTVAIVVGFMFSIMFSLVGLKYAITFGIIAGFLNMIPYLGSFLAMIPVVIMAMVQGPFMLVKVLVIFMIEQTIEGRFVAPLVLGNKLSIHPITIMFLLLTAGSMFGVWGVFLVIPIYASVKVVIKELFDWYKKVSGLYDEEVLVIEEVKDHVK

SEQ ID NO: 2697 - DNA, 1260 bp, Streptococcus agalactiae
atgttgttactgaagaaagaagtgaagaagttaaaaatgttgaatagtgaaaaaatgattgtttctatccaaaatcaggatttagaacatgctaacaagtatttcgaaaaagcgttgaaaaatgatcctgaggaagtcttgttggaactaggagcttatttggagagtattggttttttaccccaagcaaaacgtctctatgatcaaatccgaccaaattatccagaagttgctatcaatttagctcaaattgttgccgaagatggagatattgaacaagcattcttatacttagattatatctcagaagatagtcaagagtatgtttcagccctccttgttatggctgacttatatgatatggaaggcttgactgatgttgcgcgtgaaaagcttttgctagccagcaaacttagcgatgacccattggttacatttggtttagctgaaatgaaccttagtttggaacattatcaagaagcgatagaaggatatgcctcacttgacaatcgagaaatcttagaaacgactggagtttcaacttatcagcgtattggtaaatcctacgctattatggggaaatttgatgcagctatcgaatttttagaaaaagccgttgacattgagtatgatgatttaacagtttttgagttagcaacaatcctttatgatcaagaagaatatcaaaaagctaacctttattttaaacagttggatactattaatccagactttgctggctatgaatatatctatggtttatctcttcgtgaggagcataaatctgaagaagctttacgtctagttcagcaaggtattcgtaaaaatagttttgatggtcaacttctcttactagcctcacaattatcgtatgaattacatgatgttcattcgtcggagtcttatttgaaacaagctgaaaaagtttctgaaaatcaagatgaaattgttatgagattgtcaaatttgtatcttgaagaagagcggtttgaggaagtcttggaattagacaatgataatttagaaaatatccttgcaaaatggaatatcgctaaagcacacaaggctttagaaatggatgatagtgtagactattatcaatctttgtataatgatttaaaagataatccagaatttttacaagattatgcttacattttgagagaatttggttaccttgataaggcacaagaagtaggaaaggcttatttaaaattagttccagatgatatagagatgtcagaatgggtgaataacatt

SEQ ID NO: 2698 - protein, 420 aa, Streptococcus agalactiae
MLLLKKEVKKLKMLNSEKMIVSIQNQDLEHANKYFEKALKNDPEEVLLELGAYLESIGFLPQAKRLYDQIRPNYPEVAINLAQIVAEDGDIEQAFLYLDYISEDSQEYVSALLVMADLYDMEGLTDVAREKLLLASKLSDDPLVTFGLAEMNLSLEHYQEAIEGYASLDNREILETTGVSTYQRIGKSYAIMGKFDAAIEFLEKAVDIEYDDLTVFELATILYDQEEYQKANLYFKQLDTINPDFAGYEYIYGLSLREEHKSEEALRLVQQGIRKNSFDGQLLLLASQLSYELHDVHSSESYLKQAEKVSENQDEIVMRLSNLYLEEERFEEVLELDNDNLENILAKWNIAKAHKALEMDDSVDYYQSLYNDLKDNPEFLQDYAYILREFGYLDKAQEVGKAYLKLVPDDIEMSEWVNNI

SEQ ID NO: 2699 - DNA, 1263 bp, Streptococcus pyogenes
ttgaggaggttaaggaccatgttaaatagtgaaaaaatgattgcttccttggatcagcaagacctagcgcacgctgaaaaatatttccaaaaagctttaaaagaagatgatgcagatagtttaatcgccttaggagaatacttagaaagtataggttttttgccacatgccaagcgtatttatttgcagttagctgatgattacccagaactcaatataaatttagctcagattgcagcagaagacgacgccattgaagaagctttcttgtatttggataaggtttcaaaagatagccccaattatttgtcagctctcttagtaatggctgacctctatgacatggaaggactgacagaggtggcgcgtgaaaaattgcttcaagcagtgggcatcagcccagagccattggtcatttttggtttggcagaaattgacatgtccttgcagcattttaaagaagctattgattactatgcacagttagacaatcgtcaaatccttgaattgacaggtatttccacttatcaacgcattggacgagcctatgctagcttagggaaatttgaggcagccatcgaattcttggaaaaggccgtggccattgaatacgaagatgaaactgtttttgaattggcgaccctcatgtatgaccaagaaaattatcaaaaagccaatctttactttaaacagttggaaaccatcaatccagattatccaggttatgaatatggttatgctttgagtcttcatgaagagcataagacgtcagaagctttgcgcttggttcaacagggcctacgtaaaaatgcatttgacagtcaattattattactagcatcgcagctttcttatgaattacacgataggcagaatgctgaaaattacctgcttcaagcaaaggaagtagctgttgatgacgaagagattctcatgcgtttagtgaccctttattttgatgccgagcgttttgaggaggttattgctcttaatcgtgagacgattgataatgtcttaaccaaatggaccattgcaaaggcttaccacgccttggaacaagaagaagttgccttggctctttataatgagatttcggctgatttggcagaaaatccagagtttttacaggattatgcctatttattaagggagtttggccagtttcacaaggctatccaaatggctaccgcttacctcagacaagtgcctgatgatgtgaatatgcaagactttcttgaccatatcaagcaccaacaatcagaa

SEQ ID NO: 2700 - protein, 421 aa, Streptococcus pyogenes
LRRLRTMLNSEKMIASLDQQDLAHAEKYFQKALKEDDADSLIALGEYLESIGFLPHAKRIYLQLADDYPELNINLAQIAAEDDAIEEAFLYLDKVSKDSPNYLSALLVMADLYDMEGLTEVAREKLLQAVGISPEPLVIFGLAEIDMSLQHFKEAIDYYAQLDNRQILELTGISTYQRIGRAYASLGKFEAAIEFLEKAVAIEYEDETVFELATLMYDQENYQKANLYFKQLETINPDYPGYEYGYALSLHEEHKTSEALRLVQQGLRKNAFDSQLLLLASQLSYELHDRQNAENYLLQAKEVAVDDEEILMRLVTLYFDAERFEEVIALNRETIDNVLTKWTIAKAYHALEQEEVALALYNEISADLAENPEFLQDYAYLLREFGQFHKAIQMATAYLRQVPDDVNMQDFLDHIKHQQSE

SEQ ID NO: 2701 - DNA, 1680 bp, Streptococcus agalactiae
atgacagaatcacataatcaatatggggctgacttaattgtcgatagcctcattaatcatgatgtcaaatatgtttttggtatcccaggagctaagattgaccgcgtatttgacactctagaagataaaggtccagagttaattgttgctcgtcatgagcagaacgcgacttttatggctcaggctgtcgggcgtattacgggagaaccaggagttgttattgcaactagtggacctgggatctcgaacttggcaacagggttagttactgcgacagatgaaggtgatgctgttctagcaattggtggacaggttaagcgaggagatttattgaaacgtgctcatcaatcaatgaataacgttgctatgctggaacctattacaaaatattctgctgaggttcatgaccctaatactttgtcagaaactgttgcaaacgcctatcgtcttgctaaatctggtaaaccaggagcaagttttatctctattcctcaagacgttacagacagtccagtctcagtaaaagcaatcaaacctcttagtgcacctaaattgggttcggcatctgttttagatattaattatttagcgcaagctattaacaatgctgttttaccggtactgttattaggaaatggcgcatcttcagagggagtaactgctgccgtacgtcgacttcttgatgctgttaaactaccagtagtagaaactttccaaggtgcgggtattgtgtcacgtgagctcgaggatgaaacattctttggtcgtgtaggcctcttccgtaatcaacctggagatatgcttttgaagcgtgcagacctagttattgctatcgggtatgaccctattgaatatgaggcgcgtaactggaatgctgaaatttctgctcgtattattgttattgacgttgaacaagcagaaattgatacgtatttccaacccgagcgagaactgattggagacatggcacatacacttgatttacttttaccagctattaaaggatatgaattgccagaaggttcaaaagagtatttgaaaggtcttcgtaataatattgaaaacgttagcgatgttaaatttgatcgtgactcagctcatggacttgttcatcctcttgatctcattgatgtactccaagaaaataccaccgatgacatgactgttacagttgatgtgggaagccattatatttggatggctcgctactttaaatcatatgaagcgcgtcacttgcttttctcaaacggaatgcaaacattaggagttgctctaccttgggcaatttctgcggctcttttgcgtcccaacacaaaagttatttcagtttctggtgatggtggcttcttattctcagctcaagagttagaaactgcagttcgtcttcatctaccaattgttcacattatttggaacgatggaaaatataacatggttgaattccaagaagaaatgaagtatgggcgttcttcaggtgttgactttggaccagttgattttgtaaaatacgctgaaagtttcggtgctaaaggttaccgtgtagacagcaaagacagttttgaagaaacactcaaacaagctctaatcgatgctgaaaatggaccagtgttgattgatgtgcctattgactataaagataacgtgacactaggtgaaacaatcttacctgacgagttctac

SEQ ID NO: 2702 - protein, 560 aa, Streptococcus agalactiae
MTESHNQYGADLIVDSLINHDVKYVFGIPGAKIDRVFDTLEDKGPELIVARHEQNATFMAQAVGRITGEPGVVIATSGPGISNLATGLVTATDEGDAVLAIGGQVKRGDLLKRAHQSMNNVAMLEPITKYSAEVHDPNTLSETVANAYRLAKSGKPGASFISIPQDVTDSPVSVKAIKPLSAPKLGSASVLDINYLAQAINNAVLPVLLLGNGASSEGVTAAVRRLLDAVKLPVVETFQGAGIVSRELEDETFFGRVGLFRNQPGDMLLKRADLVIAIGYDPIEYEARNWNAEISARIIVIDVEQAEIDTYFQPERELIGDMAHTLDLLLPAIKGYELPEGSKEYLKGLRNNIENVSDVKFDRDSAHGLVHPLDLIDVLQENTTDDMTVTVDVGSHYIWMARYFKSYEARHLLFSNGMQTLGVALPWAISAALLRPNTKVISVSGDGGFLFSAQELETAVRLHLPIVHIIWNDGKYNMVEFQEEMKYGRSSGVDFGPVDFVKYAESFGAKGYRVDSKDSFEETLKQALIDAENGPVLIDVPIDYKDNVTLGETILPDEFY

SEQ ID NO: 2703 - DNA, 762 bp, Streptococcus agalactiae
gtgaaacaatcttacctgacgagttctactaagacgaggtctaatatgtcagaaacagttaaattatttcaatacagtaccttgagttcactgatggcaggattgtacaaaggcagtctaactatcggagaattattaactcacggtgacttaggaatcggtactgttcatatgattgatggtgaattgattgtattggatgggaaagcttatcaagctattggtacagatggtaaagcagagattatccaattatcagatgatgtgacagtaccctatgcagcggttttaccacaccatatccaaaaacaatttgatatcaatgctgagatagataataaggatttggaagagatgattctaaaaaactttgaaggtcaaaatctctttaagtctttaaaaatcaaaggaacgttttcaagaatgcacgttcgtatgattccaaaatctccacaacataaacgttttgcagatattgcatctaatcagccagaatttaccagagagaatgtatctggtacgttggttgggatttggacgccggaattatttcatggtgtgggggtaaaagggttccatgtccactttatttcagacgatttaactttcggtgggcatgttatggattactcgctcacacaaggaaaagttgaaattggaaaggttgaccaacttgaccaatgtttcccaactcaagatcaagaatttttgaaagctaactttgacctacaaaagcttagagaagatattgatttaagtgaa

SEQ ID NO: 2704 - protein, 254 aa, Streptococcus agalactiae
MKQSYLTSSTKTRSNMSETVKLFQYSTLSSLMAGLYKGSLTIGELLTHGDLGIGTVHMIDGELIVLDGKAYQAIGTDGKAEIIQLSDDVTVPYAAVLPHHIQKQFDINAEIDNKDLEEMILKNFEGQNLFKSLKIKGTFSRMHVRMIPKSPQHKRFADIASNQPEFTRENVSGTLVGIWTPELFHGVGVKGFHVHFISDDLTFGGHVMDYSLTQGKVEIGKVDQLDQCFPTQDQEFLKANFDLQKLREDIDLSE

SEQ ID NO: 2705 - DNA, 1653 bp, Streptococcus agalactiae
atgtcttttgatggattttttttacatcacctcacaaatgaattacaagaacagattgaaaaaggacgtatccaaaaagttaaccaaccttttgaccatgaattggtattaacaatacgcaacaatcgtcgcaactataaactactcctatctgctcatcctgtatttggacgtatccaaactaccgaagcaaatttccaaaatcctcaaaatccaaatacttttacaatgatcatgagaaagtatttgcaaggtgcagtgattgaaaccattcaacaaattgaaaatgaccgtatattagaaatcgtcgtgtctaataaaaacgaaatcggtgatcacattaaagcaacacttgttgttgaaatcatgggaaaacacagtaacattatcttgattgataaaaatgaacataaaattattgaatcaattaagcatgttggtttctcacaaaactcctatcgtactatccttcctggttcgacttacattgccccacccaaaacaaaagcaatcaatccttttgatatttctgatcaaaccctatttgagctgcttcaaaccaatgatctaagccctaaaaacctccaacagctcctccaaggtttaggacgcgatactgcgctagaattatctcactgtttgaaagacaataaacttaacgattttcgtcaattcttttcgagagaatattatcccagcctaacagaaaaatccttttccgctgtccaattctcaagcagtcacgaaacatttcagtctcttggacaattgttagattattactaccaagagaaggctgaaaaagatcgcatagcacagcaagctagtgacctcatccaccgtgttcaaagtgagttagagaaaaatatcaaaaaactagctaagcaacaagacgaacttctagctactgaaaatgcagaggagtttcgccaaaaaggagagcttctaactacctatctctctatggtaccaaataatcaagatgtcgttgtgcttgataattattacaccaaccaaaccattgagatttcacttgatcgagctttaacacccaaccaaaatgcccaacgctactttaaaaaatatcaaaaattaaaagaagctgtaaaacatttaaaaggaattatttcagatacggaaaatacaatcacctaccttgaatctgttgaaacatcgctaaatcatgcttctatggaagatatcaatgatattcgtgaagaacttgttgaaactggatttattaagcgacgcgcacatgataaacaacataagcgtaaaaaacctgaacaatatttagcatccgatggcaagactattattatggtgggacgtaataatctccaaaatgacgagttaacatttaaaatggctcgtaaaggggagttgtggtttcatgccaaggatatccccggaagccatgtgttaattcgggataacctcaatccaagtgacgaggttaagacagatgccgccgagttagctgcttattactctaaagctcgtctctccaatcttgttcaagtagacatgattgaagcaaaaaaactcaataaaccaagtggtactaagccaggttttgtaacttacactggtcaaaaaaccttacgagtcactcccacacaagaaaaaatagatagccttaaactaaaaaaa

SEQ ID NO: 2706 - protein, 551 aa, Streptococcus agalactiae
MSFDGFFLHHLTNELQEQIEKGRIQKVNQPFDHELVLTIRNNRRNYKLLLSAHPVFGRIQTTEANFQNPQNPNTFTMIMRKYLQGAVIETIQQIENDRILEIVVSNKNEIGDHIKATLVVEIMGKHSNIILIDKNEHKIIESIKHVGFSQNSYRTILPGSTYIAPPKTKAINPFDISDQTLFELLQTNDLSPKNLQQLLQGLGRDTALELSHCLKDNKLNDFRQFFSREYYPSLTEKSFSAVQFSSSHETFQSLGQLLDYYYQEKAEKDRIAQQASDLIHRVQSELEKNIKKLAKQQDELLATENAEEFRQKGELLTTYLSMVPNNQDVVVLDNYYTNQTIEISLDRALTPNQNAQRYFKKYQKLKEAVKHLKGIISDTENTITYLESVETSLNHASMEDINDIREELVETGFIKRRAHDKQHKRKKPEQYLASDGKTIIMVGRNNLQNDELTFKMARKGELWFHAKDIPGSHVLIRDNLNPSDEVKTDAAELAAYYSKARLSNLVQVDMIEAKKLNKPSGTKPGFVTYTGQKTLRVTPTQEKIDSLKLKK

SEQ ID NO: 2707 - DNA, 1728 bp, Streptococcus pyogenes
ttgcaagctctttcgtccatatttttagtcaagtatttgtggtataatgaagagattagaattcagaaaggagaaaccatgtcttttgacggctttttcttacaccatttaaccaacgaattaaaagagaacttgctttacggtcgtatccaaaaggtcaatcaaccctttgaacgggaacttgtcttaaccattcgtaaccatcgcaagaattataaattgctattgtctgcccatcctgtttttggaagggtacaaatcacccaagcagactttcaaaatcctcaggtacctaatacctttaccatgattatgcgtaaatacctccagggtgcagtcattgagcagttagaacagattgataatgaccgcattatcgaaatcaaggtatctaataaaaatgaaatcggagatgctattcaggcaaccctaatcattgaaatcatggggaagcacagtaatatcatcttggtggaccgtgcagaaaataaaatcatcgaatccattaaacatgttggtttttcacaaaactcttaccgcaccattttacctggctctacctacattgagcctcctaaaacagctgctgttaatccttttacaattacagatgtgcctctatttgaaatcctccaaacacaagaactaacagttaaaagcttgcaacagcattttcaaggtttggggcgagacaccgcaaaagagttggccgagcttctgaccacagacaaattaaaacggttccgtgagttttttgctagacctactcaggcaaatctgaccacagcttcttttgcgcctgttcttttctcagatagtcatgcgacgtttgagactttgtctgacatgcttgaccacttttatcaagacaaggctgagcgtgaccgtatcaatcagcaagccagtgatttgatccaccgtgtgcaaactgaactggacaaaaatcgcaacaagctaagtaagcaagaagctgagctgctagccactgaaaatgctgagttgttccgtcaaaaaggagaattattgaccacctacctcagtctggtcccaaacaaccaagactctgtgattttagacaattattatacaggggaaaaaattgagattgccttagacaaggctctgacaccaaatcaaaatgctcaacgttattttaaaaaataccaaaagctaaaagaagctgtcaaacacttatctggattgattgccgataccaagcaaagtattacttactttgagagcgtagactacaatttatctcaagcaagtatcgacgacatcgaagatattcgcgaagaattatatcaggctggctttttgaaaagtcgccaaagagacaaacgccataaacgtaaaaagcctgagcagtacctggcttcagatggaacaaccattctcatggtgggacgcaataacttgcaaaatgaagaactcacctttaaaatggctaaaaaaggagaactctggttccatgctaaggatatccctggaagtcatgtcatcatcaaagacaatcttgacccaagtgacgaggttaaaactgatgctgccgaactagctgcttattattcgaaagctaggttatcaaatctcgttcaggtcgatatgattgaagctaaaaaattacacaaacctagtggcgccaagccaggatttgtgacttatactggtcaaaaaactttacgggttactcctgaccaagccaaaattctctctatgaaattatcc

SEQ ID NO: 2708 - protein, 576 aa, Streptococcus pyogenes
LQALSSIFLVKYLWYNEEIRIQKGETMSFDGFFLHHLTNELKENLLYGRIQKVNQPFERELVLTIRNHRKNYKLLLSAHPVFGRVQITQADFQNPQVPNTFTMIMRKYLQGAVIEQLEQIDNDRIIEIKVSNKNEIGDAIQATLIIEIMGKHSNIILVDRAENKIIESIKHVGFSQNSYRTILPGSTYIEPPKTAAVNPFTITDVPLFEILQTQELTVKSLQQHFQGLGRDTAKELAELLTTDKLKRFREFFARPTQANLTTASFAPVLFSDSHATFETLSDMLDHFYQDKAERDRINQQASDLIHRVQTELDKNRNKLSKQEAELLATENAELFRQKGELLTTYLSLVPNNQDSVILDNYYTGEKIEIALDKALTPNQNAQRYFKKYQKLKEAVKHLSGLIADTKQSITYFESVDYNLSQASIDDIEDIREELYQAGFLKSRQRDKRHKRKKPEQYLASDGTTILMVGRNNLQNEELTFKMAKKGELWFHAKDIPGSHVIIKDNLDPSDEVKTDAAELAAYYSKARLSNLVQVDMIEAKKLHKPSGAKPGFVTYTGQKTLRVTPDQAKILSMKLS

SEQ ID NO: 2709 - DNA, 1002 bp, Streptococcus agalactiae
atgaaaaataaagggctgatagctacgctaattctattgactatattagtggttggagaattattttataacaaatcagaaaaacgtcttaatttatcagaaaagcaagttgttaaaattggtattttacagtatgtaacccatgatgctttggatgctattgaaaagggagttgaagatggtctagctcaagaaggatataaagggaaaaaagttaaattaaccgttttaaacgccgaagctgatcaaagtaaaattcaagcgatgagtaaacaattagttaatcatcacaatgatattttgattggaattgcgacaccatcagcacaaggtttagcagcttcgactaaggacactcctataatcatgggagctgtttctgatcctttaggggccaagttagtaacgaatatgaagaaaccaacaactaatgttacaggattatcaaacgttgttccgaccaagcaaactgtgcaattaatcaaggatataactcccaatattaaacgtataggaattctttatgctagtagcgaagataattctgtatcacaagtaactgagtttacaaaatatgctcaaaaagcagggctagaagttcttaaatattctgtaccatctacaaatgaaattaagacaagtatgtcagtcatgaccaaaaaagtagacgctgtctttgttccacaagataatactattgcgagtgcttttagaacagttatcgtagcagcaaaccaagctaatatacctgtgtattccagtgttgataccatggttgaacaaggaagtatagcatcagtagcgcagagtcaatatggcttagggttagaaactgcaaaacaggccattaaagtcctaagagggaagccggttaaagatgtaccagtcaaagttattgatacagggaagccaagcctcaatttgaaagcagccaaacacttaggaattaaaattcctaagaagattatgaaacaggcagaaattaccgttaaggttgacgat

SEQ ID NO: 2710 - protein, 334 aa, Streptococcus agalactiae
MKNKGLIATLILLTILVVGELFYNKSEKRLNLSEKQVVKIGILQYVTHDALDAIEKGVEDGLAQEGYKGKKVKLTVLNAEADQSKIQAMSKQLVNHHNDILIGIATPSAQGLAASTKDTPIIMGAVSDPLGAKLVTNMKKPTTNVTGLSNVVPTKQTVQLIKDITPNIKRIGILYASSEDNSVSQVTEFTKYAQKAGLEVLKYSVPSTNEIKTSMSVMTKKVDAVFVPQDNTIASAFRTVIVAANQANIPVYSSVDTMVEQGSIASVAQSQYGLGLETAKQAIKVLRGKPVKDVPVKVIDTGKPSLNLKAAKHLGIKIPKKIMKQAEITVKVDD

SEQ ID NO: 2711 - DNA, 996 bp, Streptococcus pyogenes
atgaaaaacaagagtttaatagctaccctccttgttttaactgtaatagtgataggctctctattatcaaaaggagtatcaaaggaaaaccgtgatttggctaaccaacaaaacattacaattggcatcttacaattcgttactcatgaggctcttgatgatattaagcgaggtattgaagatcaactcaaaaagcagatgcctcaaaaacaaaatgtagtgattaaggttatgaatgctgagggggatcagagtaaaatccaaacaatgagtaggcaattagtgcaatcaggaagtgatatcgtgattggtatcgcaaccccggcggcgcaaggcttagcagccaccagcaaggatatcccagttgtcatgtcagcagtatctgatccagtaggatctagattagtgatgcaattggatcaacctgaagctaatgtaactggtctatctaataaagtgcctgttaaacagacaattgatttaatgaaaaagctgacaccacatgtcaaaacagttggaattttatatgcaagtaatgaggataattccttatctcaagttaaagagtttaggcggttagctcgcaaaaagggctaccaagttatttcatacgcggttccttctactaatgaagttcctgccacgatgtcagttatgttaggtaaagtagacgcggtatttatcccccaagacaatactatagcaagtgcattttcatcagtcatgacaaccagcaaggctgcaaagattcctgtctacactagcgttgatcgaatggttgaaaaaggtggtttggcagctatttctcaaaatcagtacgatttgggagttcaaacagctaatcaggtgttaaaattaatcaaaggaaagcgtgttgtagatgttcctgtcaaagttgtggatattggtcaaccgctaattaataagaatgtagcagcagaattaggtattgctattaaaaaagaagattttccttcagcttcttttattgagaat

SEQ ID NO: 2712 - protein, 332 aa, Streptococcus pyogenes
MKNKSLIATLLVLTVIVIGSLLSKGVSKENRDLANQQNITIGILQFVTHEALDDIKRGIEDQLKKQMPQKQNVVIKVMNAEGDQSKIQTMSRQLVQSGSDIVIGIATPAAQGLAATSKDIPVVMSAVSDPVGSRLVMQLDQPEANVTGLSNKVPVKQTIDLMKKLTPHVKTVGILYASNEDNSLSQVKEFRRLARKKGYQVISYAVPSTNEVPATMSVMLGKVDAVFIPQDNTIASAFSSVMTTSKAAKIPVYTSVDRMVEKGGLAAISQNQYDLGVQTANQVLKLIKGKRVVDVPVKVVDIGQPLINKNVAAELGIAIKKEDFPSASFIEN

SEQ ID NO: 2713 - DNA, 861 bp, Streptococcus agalactiae
atgattatttcatcagtttcacaaggtttattatgggggatattaggattagggatatacttaacctttagaatcttaaaatttccagacatgacaacagagggctccttccctctagggggagcggtttgtgttaccttaatgaatcaaggggttaatcctattttggcgacgattctaggcatgctatcagggatgttagcgggatttgttactggtttactttatactaaaggaaagataccgacgattttagcagggattttagtaatgacctcatgccactctattatgctaatggttatgaaaagagcaaatctaggtttaaatgagattcaaacattgaaagattttcttccgttttcaaatgatttaaatcttctcgtattaggcttgatagctattctcttggtgatttctgccttaatttattttctctatacacgcttggggcaagcttatattgcaacaggagataaccctgatatggcaaagagcttcggcattgataccgacaaaatggaaatgcttggcttaattgtatcaaatggcttaattgctttatcaggagctttagtaagtcaacaagatggatatgctgatgtatcaaaaggtataggtgttattgttattgggttagctagtattattattggagaggtactttactctactggtttaactctctttgaacgtttaattgctatagtggtgggttctattctttatcaatttttaataacggcagtaatcgccttaggatttaatacgaattacctaaaattatttagtgcaatagtgcttggaatttgtttaatggttcctgtcctaaaaacgaagattttgaaaggagtacgctta

SEQ ID NO: 2714 - protein, 287 aa, Streptococcus agalactiae
MIISSVSQGLLWGILGLGIYLTFRILKFPDMTTEGSFPLGGAVCVTLMNQGVNPILATILGMLSGMLAGFVTGLLYTKGKIPTILAGILVMTSCHSIMLMVMKRANLGLNEIQTLKDFLPFSNDLNLLVLGLIAILLVISALIYFLYTRLGQAYIATGDNPDMAKSFGIDTDKMEMLGLIVSNGLIALSGALVSQQDGYADVSKGIGVIVIGLASIIIGEVLYSTGLTLFERLIAIVVGSILYQFLITAVIALGFNTNYLKLFSAIVLGICLMVPVLKTKILKGVRL

SEQ ID NO: 2715 - DNA, 879 bp, Streptococcus pyogenes
atgaggaaaaatatgattatttcatcagtttcacaaggccttatatggggagttttaggattaggaatctacctgacctttaggattttaaacttccctgacatgactacagaaggttcttttcctttaggaggagctgttgcggtcaccgctattagcttagggtggaatccatttctatcaaccttacttggtatgttatcaggtgctttagcaggttttttaacagggctgttatatacgaaaggaaaaatgccaacacttttagcgggaattttggtgatgacgtcatgtaactccattatgctaatggtaatgggaagagcaaacttgggtttacatgatcataaacgtattcaggattgtttacctttttcaattgatttaaatagccttttaacaggtctgataactgttgtgattgttattagcgttttgatctatttcctttacactaatctaggtcaagcttatatcgctacgggagacaataaagatatggctaagagttttggtattaacacggattggatggaagttatgggacttgtggtttctaatagtttaatagctttatcaggtgctctagtgagccaacaagatggctatgcagatgtctcaaaagggattggagttattgttattggtttggcgagcataattgttggtgaagtactatactcaactggactgactcttttagaacgtttgattgctattgtaataggctcgattctttatcaatttttaatttcagtagttattacgctaggttttaatacaagttatttgaaattaattagtgctcttgttttagcactgtgcctcatgataccagtggtaaaagagcgcttctttaagggagtgaggttaacacga

SEQ ID NO: 2716 - protein, 293 aa, Streptococcus pyogenes
MRKNMIISSVSQGLIWGVLGLGIYLTFRILNFPDMTTEGSFPLGGAVAVTAISLGWNPFLSTLLGMLSGALAGFLTGLLYTKGKMPTLLAGILVMTSCNSIMLMVMGRANLGLHDHKRIQDCLPFSIDLNSLLTGLITVVIVISVLIYFLYTNLGQAYIATGDNKDMAKSFGINTDWMEVMGLVVSNSLIALSGALVSQQDGYADVSKGIGVIVIGLASIIVGEVLYSTGLTLLERLIAIVIGSILYQFLISVVITLGFNTSYLKLISALVLALCLMIPVVKERFFKGVRLTR

SEQ ID NO: 2717 - DNA, 813 bp, Streptococcus agalactiae
ttgtttaatggttcctgtcctaaaaacgaagattttgaaaggagtacgcttataatggtgatgaaaatcatagagttaaaagaagcaaccgtacaagtcagtaatggtttagcagaaatgaaaacgatattagatcatgttaatttgagtatttatgaacatgacttcattacaatattgggtggaaatggagctggaaaatcaacgctttttaatgtaattgcaggtaccttgatgttaagcagtggaaatatttacatcatgggacaagatgttactaatttatcagcagaaaaacgagctaaatatttatcacgggtatttcaagatccgaaaatgggaacagcacctaggatgacagttgctgaaaatttattagttgctaaatttcgaggtgaaaagagaccgctagttcctagaaagattattaactatacggaagaatttcaaaaattgattgctagaactggtaatggacttgatcgccatttagagacacctacaggtttattatcaggtggacaaagacaagcgcttagtttattaatggcaactttgaaaaaaccaaatctgttattattggacgaacacacagcagcgcttgatcctagaacaagtgtttcgcttatgggcttgactgatgagtttatcaaacaagattcgttgactgccttaatgattacacatcatatggaagatgctctcaaatatggaaatcgtgtattagtaatgaaagatggcaagattgtcagagatttaaatcaggcacaaaaaaacaagatggctatagctgactattatcaattatttgat

SEQ ID NO: 2718 - protein, 271 aa, Streptococcus agalactiae
MFNGSCPKNEDFERSTLIMVMKIIELKEATVQVSNGLAEMKTILDHVNLSIYEHDFITILGGNGAGKSTLFNVIAGTLMLSSGNIYIMGQDVTNLSAEKRAKYLSRVFQDPKMGTAPRMTVAENLLVAKFRGEKRPLVPRKIINYTEEFQKLIARTGNGLDRHLETPTGLLSGGQRQALSLLMATLKKPNLLLLDEHTAALDPRTSVSLMGLTDEFIKQDSLTALMITHHMEDALKYGNRVLVMKDGKIVRDLNQAQKNKMAIADYYQLFD

SEQ ID NO: 2719 - DNA, 756 bp, Streptococcus pyogenes
atgacaaaaattattgaattgatcaatgcaacagttgacgtagataatggttttgaagatgctaaaacaatattggacaatgtgacactaactatctatgaacatgattttttaactattttaggaggaaatggagctggaaaatcaaccctttttaatgtaattgcaggaacgctaagtttgacacgggggcaaattaggattcttggtcaggatgtgacgcattggccagcagaaaaaagagctctttacctatcgcgagtctttcaagattccaaaatgggaacagcccctcggatgacagtggctgaaaatctcttaatcgcacgtcaaagaggaggaaaacgctccttggcttctcgaaaaataacagagcacttagctagttttgaggatttggttaaacgaacaggaaatggcctagaaaagcatttagaaacaccagcaggtcttttgtctggtggacaaagacaagctttaagtttattaatggcaacgttgaaaaagccagctctcttattattagatgaacatacggctgctcttgaccctaagacgagtcaatctttaatgcaattgacagatgagtttgtgacaaaagatggcttaacagctttgatgattacccaccatatggaagatgcattaacttatgggaatcgtctgattgtaatgaaagatggaaacattattaaagatttaaatcaaatggaaaaagaacaactgacgattactgactattaccaactatttgat

SEQ ID NO: 2720 - protein, 252 aa, Streptococcus pyogenes
MTKIIELINATVDVDNGFEDAKTILDNVTLTIYEHDFLTILGGNGAGKSTLFNVIAGTLSLTRGQIRILGQDVTHWPAEKRALYLSRVFQDSKMGTAPRMTVAENLLIARQRGGKRSLASRKITEHLASFEDLVKRTGNGLEKHLETPAGLLSGGQRQALSLLMATLKKPALLLLDEHTAALDPKTSQSLMQLTDEFVTKDGLTALMITHHMEDALTYGNRLIVMKDGNIIKDLNQMEKEQLTITDYYQLFD

SEQ ID NO: 2721 - DNA, 1659 bp, Streptococcus agalactiae
atgagcgacataaaaatcatggctcttggaggtgttcgtgaaaacggaaaaaacctatatgtagtagaagtcaatgattctatctttgttttggatgctggactcaaatatcctgaaaatgaacaactgggtgttgatgttgttattccaaatcttgattacttaattgaaaataaaaaacgtgttcaggggattttcttaacccatggacatgcggatgctattggtgcattgccttatattatcgccgaagtcaaagcacctgtgtttggctcacctctcacaattgaattagctaagttattcgttaaaaatagtacagcagtcaagaaattcaataatttccatgtgattgatagtgaaacggaaattgaatttcaagatgcggtgatttcgttctttaaaacgactcattcaattccagagtcaatgggaattgttattgggacaaaagagggaaatatcgtttacacaggtgactttaaatttgatcaagctgcaaggaaatattaccaaacagatctggcgcgtttagctgaaattggtcgtgatggtgttttagcacttttatcagattctgcaaatgctacaagcaatgagcaagttgctagcgaatatgaggtcggtgatgaaattaagagcgttattgaagacgcagaaggtagagtcatcgtagcggcagttgcaagtaatctcattcgtattcaacaagtctttgatgcagcggcagaaaacggtcgtcgagtagttttaacgggttttgatattgaaaatattgttcgtacggccattcgtatgaaacgcattcatattgctgatgaaaatatgattatcaaacctaaagatatgacacgttacgaagataacgaattattaatccttgaaactggacgtatgggagagccgataaatggtctccaaaaaatggcgatcggacgtcatcgttatgttcaaattaaagatggtgatttagtatttatcgtaacaacaccaagtattgcaaaagaggcagttgtagcgcgtgttgaaaatctgatttataaagctggtggctcagttaaattgataacacagaatttgcgcgtatcaggtcatgcaaatggtcgcgaattacaattattaatgaatctattgaaacctaaataccttttcccaattcaaggagagtatagggatttgtcagcacatgcgggcttagctcaagaggtaggaatgtcagcagatgatatttatattgtgaagcgtggtgacatcatggttcttgaaaaagatggcttcttccatagtggatctgttcctgctggagatgttatgattgatggaaatgctattggtgacgttggtaatattgtacttcgtgaccgcaaggtattatctgaagatggaatttttattgttgttataactgtcagcaaaaaagaaaagaaaattatttctaaagctcgtgttaatacgcgtggttttgtgtatgtgaaaaaaagcagagatattttgcgtgagagcgcagaattagttaatacaacggtagaagattacttaagtaaagatacatttgactggggtgaacttaaagggaaagtgcgtgatgaggtcagcaagttcttatttgaccaaacgaaacgtcgcccagcaatccttcctgtggttatggaagttcgt

SEQ ID NO: 2722 - protein, 553 aa, Streptococcus agalactiae
MSDIKIMALGGVRENGKNLYVVEVNDSIFVLDAGLKYPENEQLGVDVVIPNLDYLIENKKRVQGIFLTHGHADAIGALPYIIAEVKAPVFGSPLTIELAKLFVKNSTAVKKFNNFHVIDSETEIEFQDAVISFFKTTHSIPESMGIVIGTKEGNIVYTGDFKFDQAARKYYQTDLARLAEIGRDGVLALLSDSANATSNEQVASEYEVGDEIKSVIEDAEGRVIVAAVASNLIRIQQVFDAAAENGRRVVLTGFDIENIVRTAIRMKRIHIADENMIIKPKDMTRYEDNELLILETGRMGEPINGLQKMAIGRHRYVQIKDGDLVFIVTTPSIAKEAVVARVENLIYKAGGSVKLITQNLRVSGHANGRELQLLMNLLKPKYLFPIQGEYRDLSAHAGLAQEVGMSADDIYIVKRGDIMVLEKDGFFHSGSVPAGDVMIDGNAIGDVGNIVLRDRKVLSEDGIFIVVITVSKKEKKIISKARVNTRGFVYVKKSRDILRESAELVNTTVEDYLSKDTFDWGELKGKVRDEVSKFLFDQTKRRPAILPVVMEVR

SEQ ID NO: 2723 - DNA, 1659 bp, Streptococcus pyogenes
atgactgatattaaaatgattgccttgggaggggtccgtgaatacggaaaaaacttctatttggtagaaattaacgattctatgtttattttagacgcagggctcaagtaccctgaaaatgagcaacttggggtagatttagtcatccccaatttagattatgtaattgaaaacaaaggtaaagtacaagggattttcttgagtcatggccatgctgacgccattggagcccttccttatttgttagctgaagtatcagctcctgtatttggatctgaattgactattgaattagccaagctatttgtgaaaagtaataacagcactaagaaatttaataattttcatgtggtagacagtgatactgaaattgaatttaaagatggcctagtttcgttctttagaacaacgcattcaatcccagaaagtatgggtattgttattggaacagataaaggaaacattatttataccggtgacttcaaatttgatcaagcagcaagagaaggttatcagacggatttgctacgtttagctgagattgggaaagaaggggttctagctcttttatcagattcagtcaatgcgacaagcaacgatcagattgccagcgaatctgaagttggtgaagaaatggacagtgttatctctgatgctgatggccgtgtcattgtagctgcagtagcctcaaatcttgttcggattcagcaagtatttgattccgccactgcccatgggcgtcgtgttgttttaaccggaacagatgcagaaaatattgtcagaacagctttacgtctagaaaaattaatgattacggatgagcgtcttttaattaaacctaaggatatgtctaaattcgaagaccatgaattaatcatccttgaagctggtcgtatgggtgagccaattaatagcttacaaaaaatggcagcgggacgtcaccgttatgttcaaatcaaagaaggagaccttgtttatattgtaacaacaccaagtacggctaaagaagctatggtggcgcgtgttgaaaacttgatttacaaggccggtggttctgttaaattaatcactcaaaacttacgtgtttcaggccatgctaatgggcgtgatttgcaactattgatgaatttgttaaaaccccagtatctttttccagtacaaggagaatatcgtgatttagctgcccatgcaaagctagctgaagaagttggtatttttccagagaatattcatattctgaagcgtggcgatatcatggtgcttaatgacgaaggttttctccatgaaggaggtgtacctgccagtgatgtcatgattgacggtaatgctatcggtgatgtgggtaatatcgttttacgagaccgtaaagtcttgtcagaagatggtattttcattgttgctattactgtttctaaaaaagaaaaacgcattatttctaaggctaaagttaatacgcgtggatttgtgtatgtcaagaaaagtcatgatattttaagagaaagtgcagaattagttaatacaactgttggcaattacttaaaaaaagatacctttgactggggcgaattaaaagggaatgtcagagatgatttgtctaaattcttatttgaacaaaccaaaaggcgcccagcgattctgccggttgtgatggaagttcgt

SEQ ID NO: 2724 - protein, 553 aa, Streptococcus pyogenes
MTDIKMIALGGVREYGKNFYLVEINDSMFILDAGLKYPENEQLGVDLVIPNLDYVIENKGKVQGIFLSHGHADAIGALPYLLAEVSAPVFGSELTIELAKLFVKSNNSTKKFNNFHVVDSDTEIEFKDGLVSFFRTTHSIPESMGIVIGTDKGNIIYTGDFKFDQAAREGYQTDLLRLAEIGKEGVLALLSDSVNATSNDQIASESEVGEEMDSVISDADGRVIVAAVASNLVRIQQVFDSATAHGRRVVLTGTDAENIVRTALRLEKLMITDERLLIKPKDMSKFEDHELIILEAGRMGEPINSLQKMAAGRHRYVQIKEGDLVYIVTTPSTAKEAMVARVENLIYKAGGSVKLITQNLRVSGHANGRDLQLLMNLLKPQYLFPVQGEYRDLAAHAKLAEEVGIFPENIHILKRGDIMVLNDEGFLHEGGVPASDVMIDGNAIGDVGNIVLRDRKVLSEDGIFIVAITVSKKEKRIISKAKVNTRGFVYVKKSHDILRESAELVNTTVGNYLKKDTFDWGELKGNVRDDLSKFLFEQTKRRPAILPVVMEVR

SEQ ID NO: 2725 - DNA, 846 bp, Streptococcus agalactiae
ttgatagtgttaagaggttaccaaattttggtagcctttcttgctagaatggaggtttttatggcattttttaatattgaatatcactctaaggtactaggaacggaacgtcaagtcaatgttatttacccagatgcttttgagatgtctgatgataaaattgatgattgtgacattcctgttttgtatcttctccatggaatggggggaaatgagaattcttggcaaaaacgcacaaatatagagcgtcttttacgtcatactaatcttatcgtcgtgatgccatcaacagacttagcatggtataccaacacaaagtatgggttggattattttgatgcaatagctatcgagttaccaaaagttttgaaacgtttctttcctaatatgtctgataagagagagaaaaatttcattgccggattatctatggggggatatggagcatataaaatagctctactgactaatcgtttttctcatgctgcctctttgtcaggtgcactttcttttgactttgatttattattcaataatggcaacaataacattaactattggtcgggaatttttggcgatttgaataacactgataacatagagcgtcattcactaaggcgttacgttgagtcttttgatatgaagactaaattttatgcatggtgtggttatgaagattttctttttgaagctaatgaagtcgcaattgatgaacttcgtcaattaggtttaactattgactatttcaatgatcatggtaaacatgaatggtattactggaatcaacaattagaaaaagtcttagaatggctccctgttgattatgtcaaagaagagcgcctttct

SEQ ID NO: 2726 - protein, 282 aa, Streptococcus agalactiae
MIVLRGYQILVAFLARMEVFMAFFNIEYHSKVLGTERQVNVIYPDAFEMSDDKIDDCDIPVLYLLHGMGGNENSWQKRTNIERLLRHTNLIVVMPSTDLAWYTNTKYGLDYFDAIAIELPKVLKRFFPNMSDKREKNFIAGLSMGGYGAYKIALLTNRFSHAASLSGALSFDFDLLFNNGNNNINYWSGIFGDLNNTDNIERHSLRRYVESFDMKTKFYAWCGYEDFLFEANEVAIDELRQLGLTIDYFNDHGKHEWYYWNQQLEKVLEWLPVDYVKEERLS

SEQ ID NO: 2727 - DNA, 783 bp, Streptococcus pyogenes
atggcaagtattgcaattgaataccattcggtagttttaggaatggagcgtaaggtaaatgtgatttatcctgaccagtctgaaatccctaaaaaagatcaaggggataaggatattcctgttttatatttgttacatggtatgggaggcaatgaaaactcttggcaaaaacgaacagctattgaacgcttgttgcggcataccaatttgatagtcgttatgccttcgacagacctaggttggtatacagacacggcttatggacttaactattatcgggcgttgtcacaagagttaccgcaggtcttagcagctttctttcctaatatgacccagaaacgagaaaaaacctttgttgctgggctctctatgggtggctatggtgcctttaagtgggcactcaaaagcaatcggttttcttatgcggcatcgttttcaggcgctttggatttttctcctgagaccttgcttgagggaaaactgggagaattagcctattggcagggcgtttttggccagtttgatgaccctgaccttgacaagcattaccttaaaaatatggtggcagaaagtgatggaaaaaccaaattttatgcttggtgtggctatgaggattttctttttgccactaatgaaaaagctattgctgattttcaggctcaaggtcttgacattgattatcataaaggtcatggtaaacatgagtggtactattggaaccagcaattagaagtcctgttagagtggttaccgataaactaccaaaaagaagaaaggttgtct

SEQ ID NO: 2728 - protein, 261 aa, Streptococcus pyogenes
MASIAIEYHSVVLGMERKVNVIYPDQSEIPKKDQGDKDIPVLYLLHGMGGNENSWQKRTAIERLLRHTNLIVVMPSTDLGWYTDTAYGLNYYRALSQELPQVLAAFFPNMTQKREKTFVAGLSMGGYGAFKWALKSNRFSYAASFSGALDFSPETLLEGKLGELAYWQGVFGQFDDPDLDKHYLKNMVAESDGKTKFYAWCGYEDFLFATNEKAIADFQAQGLDIDYHKGHGKHEWYYWNQQLEVLLEWLPINYQKEERLS

SEQ ID NO: 2729 - DNA, 708 bp, Streptococcus agalactiae
atgagaacactatttagaatgatatttgctattccaaagtttatctttagattgatttggaatatcatttggggaatattcaagacagttcttgttattgcgattattttatttggcttgtattactatgcgaatcacagtcaatcagaatttgctaatcaacttagtgacattattcagacaggaaaaacatttttaaattttgctgacactaatcagctcaaaaattcctttactaatctagctacggataatgttcatcattcagaaaataccagatgggataaaaatcaggcaactatctatatagcaactagagattctgagttggtctctgcttacaagcaagcaatctccaattggaatgcaacaggtgcttttgtgttacaaacaacagataatcctaatgctgatattattgctaaggattactcagatgctaaaacacaagctgcgggtgtagctgaaaccgagaaaaatgctttaactaatcgtatttcaaaggtaacagttgaattaaacacattttaccttaagaataaacagtttggttatgaccatactaggattgttaatacggccgaacatgaattaggacatgcgttaggtctaggacataatgatcaacaacattccgttatgcagtcaaaaggttcgcattatggcattcaagaagttgatattcaaacgctaaaaaacttatatgca

SEQ ID NO: 2730 - protein, 236 aa, Streptococcus agalactiae
MRTLFRMIFAIPKFIFRLIWNIIWGIFKTVLVIAIILFGLYYYANHSQSEFANQLSDIIQTGKTFLNFADTNQLKNSFTNLATDNVHHSENTRWDKNQATIYIATRDSELVSAYKQAISNWNATGAFVLQTTDNPNADIIAKDYSDAKTQAAGVAETEKNALTNRISKVTVELNTFYLKNKQFGYDHTRIVNTAEHELGHALGLGHNDQQHSVMQSKGSHYGIQEVDIQTLKNLYA

SEQ ID NO: 2731 - DNA, 324 bp, Streptococcus pyogenes
atgaaacaattactggcgatcattttgtggctgcctaagctaatagtgaaaatgttttggcaccttatcaaagggtttttacaaactatcttattagtaacgattattattatagggctgatgtactattctaatcacagtgattccgttttagccaataagatctcgatagttactgagcaagtggtgcaaatttttgatatcttaacacaaaagccatctgcaaagacgcgtcatgggagtggtaatagtcattccactttccttgttagcgctaaagaaggtaatcaacgacttaaaaagagttcgatttcttttggaaac

SEQ ID NO: 2732 - protein, 108 aa, Streptococcus pyogenes
MKQLLAIILWLPKLIVKMFWHLIKGFLQTILLVTIIIIGLMYYSNHSDSVLANKISIVTEQVVQIFDILTQKPSAKTRHGSGNSHSTFLVSAKEGNQRLKKSSISFGN

SEQ ID NO: 2733 - DNA, 669 bp, Streptococcus agalactiae
atggacgaactaaaaaaacttgctggagtgaccgctgcaaaatacgttaaaaacggtatgattgtaggtttagggacaggttctacagcatatttttttgttgaagaaattggacgccgtgtcaaagaagagggattgcaagtcgtaggcgttacaacgtcaaaccgtacgactgagcaggcaagaggattaggtattccgttgaaatcagcagatgatattgatgtcattgatgtcactgtggatggagcagatgaagtagaccctgattttaatggtatcaagggtggcggtggtgcgctgctcatggaaaaaatagtagctactccaactaaagaatatatctgggttgtcgatgagagcaaacttgttgaaacgttaggtgcatttaaattgcctgttgaggttgttagatatggttctgagcgtctttttcgggtttttaaatcaaaaggttattgtccttctttccgtgaaacagaaggtgaccgctttatcactgatatggggaactacattatcgacctagatttgaaaaaaatagaggatccaaagcagttagcgaatgaacttgaccatacagttggtgttgttgaacatggtttatttaatggtatggttaataaagttatagtagcaggcaaaaacggtcttgacatacttgaaaaa

SEQ ID NO: 2734 - protein, 223 aa, Streptococcus agalactiae
MDELKKLAGVTAAKYVKNGMIVGLGTGSTAYFFVEEIGRRVKEEGLQVVGVTTSNRTTEQARGLGIPLKSADDIDVIDVTVDGADEVDPDFNGIKGGGGALLMEKIVATPTKEYIWVVDESKLVETLGAFKLPVEVVRYGSERLFRVFKSKGYCPSFRETEGDRFITDMGNYIIDLDLKKIEDPKQLANELDHTVGVVEHGLFNGMVNKVIVAGKNGLDILEK

SEQ ID NO: 2735 - DNA, 681 bp, Streptococcus pyogenes
atggaagcactcaaaaaaattgccggtgttaccgctgcgcaatatgtgactgatggcatgaccattgggcttggaactgggtcaacggcttactattttgttgaggaaattggccgtcgcgtaaagcaagaaggactgcaagtggttggtgtgactacgtcaagtgtgactagcaagcaagcagaagtcttgggcattcctttaaaatcgatagatgatattgatagcattgacctcaccgtagatggtgctgatgaagtggataagaatttcaatggaatcaagggtggcggcgcagccttactaatggaaaaaattgttgcaacaccaacaaaagaatacatctgggttgttgatgcttctaaaatggtagagcatctgggtgcctttaagttaccagtcgaagtcgttcaatatggtgctgatcgtttgttccgtgtctttgaaaaagctggttacaaaccgtcttttcgtatgaaaggtgatagtcgtttggtgacagacatgcaaaactatattattgatcttgatttgggttgtattaaagatcctgttgcttttggtcacctgctagatggaacagttggtgttgtggaacacggtctctttaatggtatggttgataaggtgattgttgctagtaaagacggcgttactgttttagaagcgcctacagcaggc

SEQ ID NO: 2736 - protein, 227 aa, Streptococcus pyogenes
MEALKKIAGVTAAQYVTDGMTIGLGTGSTAYYFVEEIGRRVKQEGLQVVGVTTSSVTSKQAEVLGIPLKSIDDIDSIDLTVDGADEVDKNFNGIKGGGAALLMEKIVATPTKEYIWVVDASKMVEHLGAFKLPVEVVQYGADRLFRVFEKAGYKPSFRMKGDSRLVTDMQNYIIDLDLGCIKDPVAFGHLLDGTVGVVEHGLFNGMVDKVIVASKDGVTVLEAPTAG

SEQ ID NO: 2737 - DNA, 1209 bp, Streptococcus agalactiae
atgtcacaatttgatcgcattcacttagttgtcttagattcagtggggattggagcggcaccagatgccaatgattttgtcaatgcaggagttcctgatggtgcttcagacacgcttggccacatttcaaaaacagttggacttgcggtgccaaacatggctaaaatcggacttggtaatattcctcgtccccaagcgcttaagaccgtccctgcagaagaaaatccaagtggctacgcgacgaagttacaagaagtatcacttggtaaagatacaatgacagggcattgggagatcatgggcttaaatattacagagccatttgatactttctggaatggttttccagaagatattattacaaagattgaggatttttcaggacgtaaagttattcgtgaagcgaataaaccttattcagggacagctgttattgatgacttcggaccacgccaaatggaaactggtgagctcatcatctatacctcagctgatccagtcctacaaattgcagctcatgaggatatcattcctctagaagaactctaccgtatttgtgaatatgctcgtagtatcacaatggagcgtccagctctccttggtcgtattatcgctcgtccatatgtaggtgaaccaggcaactttacgcgtacagccaaccgtcacgactatgcagtatcaccatttgaagataccgtattaaataaactagatcaagctggcatcgatacttatgctgttggtaaaatcaatgatattttcaatggttcaggcattaatcatgatatgggacataacaaatcaaatagtcatggtattgatactttgataaaaacaatggggttatcagagtttgaaaaaggcttctcctttactaatttggttgactttgatgctctctatggtcaccgtcgtgatcctcatggttatcgtgattgtcttcatgagtttgatgagcgtcttccagagatcatttcagcgatgcgtgacaaagacttacttttgatcactgccgatcatggtaatgacccaacttatgcaggtacagaccatacaagagaatacattcctctcttagcctatagcccatctttcacaggaaacggccttatcccagtagggcatttcgcagatatttcagcaacagttgcggataactttggtgttgatactgcgatgattggagagagcttcttgcaggacttggta

SEQ ID NO: 2738 - protein, 403 aa, Streptococcus agalactiae
MSQFDRIHLVVLDSVGIGAAPDANDFVNAGVPDGASDTLGHISKTVGLAVPNMAKIGLGNIPRPQALKTVPAEENPSGYATKLQEVSLGKDTMTGHWEIMGLNITEPFDTFWNGFPEDIITKIEDFSGRKVIREANKPYSGTAVIDDFGPRQMETGELIIYTSADPVLQIAAHEDIIPLEELYRICEYARSITMERPALLGRIIARPYVGEPGNFTRTANRHDYAVSPFEDTVLNKLDQAGIDTYAVGKINDIFNGSGINHDMGHNKSNSHGIDTLIKTMGLSEFEKGFSFTNLVDFDALYGHRRDPHGYRDCLHEFDERLPEIISAMRDKDLLLITADHGNDPTYAGTDHTREYIPLLAYSPSFTGNGLIPVGHFADISATVADNFGVDTAMIGESFLQDLV

SEQ ID NO: 2739 - DNA, 1209 bp, Streptococcus pyogenes
atgtcaaaatttaatcgtattcacttggttgttttagactctgtcggtattggtgcagcaccagatgctgacaaattctttaatgctggtgtagctgatacagattctgacaccctcggtcatatttcagaagcagcaggcttatcggttccaaatatggcaaaaattggacttggaaacatttctcgtccaataccactaaaaactgttccaacagaagacaatcctactggttacgtgaccaaattggaagaagtatctcttggaaaagataccatgacaggccattgggaaattatgggcttgaacattacggaaccttttgacactttctggaatggtttcccagaagagattttaactaagattgaagaattctcaggccgcaaaatcattcgcgaggccaacaaaccttattcaggaactgcggttattgatgattttggtccgcgtcaaatggaaacaggtgagttgattgtttacacctcagcagacccagtgcttcaaattgcagcccatgaagacattattcctgtggaagagctttacaagatttgtgaatatgctcgctccatcacgcttgaacgccctgcccttttaggccgtattattgcgcgtccttatgtaggcgacccaggaaactttacacgtacggctaaccgtcatgactatgcagtgtctcctttccaagataccgttttgaacaaactggctgacgcaggtgtcccaacttatgccgttggtaagattaatgacatctttaatggttcaggtattacaaacgacatgggacataataagtcgaacagccatggtattgacacgcttattaagactcttcaattacctgagtttactaagggattctcctttactaacctcgttgattttgatgccaactttggtcatcgtcgtgacccagagggttatcgcgactgcttgcatgaatttgacaatcgcctacctgaaatcatcgcaaatatgaaagaagacgatttgcttctcatcactgctgaccatggtaatgacccaacctatgcaggcaccgaccacactcgtgaatacattccattgcttgcctactctgtatcctttactggaaatggtcttattccacaagggcattttgcggatatttcagcaactgttgcagaaaattttggagttgatacagccatgattggggagtcattccttagtcacttaaaa

SEQ ID NO: 2740 - protein, 403 aa, Streptococcus pyogenes
MSKFNRIHLVVLDSVGIGAAPDADKFFNAGVADTDSDTLGHISEAAGLSVPNMAKIGLGNISRPIPLKTVPTEDNPTGYVTKLEEVSLGKDTMTGHWEIMGLNITEPFDTFWNGFPEEILTKIEEFSGRKIIREANKPYSGTAVIDDFGPRQMETGELIVYTSADPVLQIAAHEDIIPVEELYKICEYARSITLERPALLGRIIARPYVGDPGNFTRTANRHDYAVSPFQDTVLNKLADAGVPTYAVGKINDIFNGSGITNDMGHNKSNSHGIDTLIKTLQLPEFTKGFSFTNLVDFDANFGHRRDPEGYRDCLHEFDNRLPEIIANMKEDDLLLITADHGNDPTYAGTDHTREYIPLLAYSVSFTGNGLIPQGHFADISATVAENFGVDTAMIGESFLSHLK

SEQ ID NO: 2741 - DNA, 807 bp, Streptococcus agalactiae
atgacattattagaaaaaattaatgagactagagactttttgcaagcaaaaggcgtcacagcaccagaatttggccttattttaggctctggtttaggagaattagctgaagaaatcgaaaatcccattgttgtggattatgcagacatcccaaattggggacagtcaacagtagttggtcatgctggaaaattagtgtatggggatttatcaggccgtaaggtattagcacttcaaggtcgttttcacttttatgaaggaaatacaatggaagtcgttactttcccagtacgtatcatgagagcattggcttgccacagtgtgcttgtgactaatgcagcgggtgggattggatacggaccaggaactttaatgctgatcaaagaccacatcaatatgattgggactaaccctctcataggtgagaaccttgaagaatttggaccacgtttcccagacatgtcggatgcttatacagcaacatatcgacaaaaagctcaccaaattgctgaaaaacagaatatcaaactcgaagaaggtgtgtacttgggtgtatcaggacccacttatgaaacacctgcagaaattcgtgcattccaaacaatgggcgcacaggcggtaggtatgtccacggttccagaggtgatcgttgcagctcactcagggcttaaagtgttaggaatttcagcaattactaactttgccgctggcttccaatctgagctcaatcatgaggaggtcgttgaagttactcagcgtattaaagaagatttcaagggattagttaaatcattagttgctgaactt

SEQ ID NO: 2742 - protein, 269 aa, Streptococcus agalactiae
MTLLEKINETRDFLQAKGVTAPEFGLILGSGLGELAEEIENPIVVDYADIPNWGQSTVVGHAGKLVYGDLSGRKVLALQGRFHFYEGNTMEVVTFPVRIMRALACHSVLVTNAAGGIGYGPGTLMLIKDHINMIGTNPLIGENLEEFGPRFPDMSDAYTATYRQKAHQIAEKQNIKLEEGVYLGVSGPTYETPAEIRAFQTMGAQAVGMSTVPEVIVAAHSGLKVLGISAITNFAAGFQSELNHEEVVEVTQRIKEDFKGLVKSLVAEL

SEQ ID NO: 2743 - DNA, 807 bp, Streptococcus pyogenes
atgtcattgatgactaaaattaacgaaacaaaagactttttagttactaaaggaattgaaactccagaatttggattaattctgggttcaggccttggtgaacttgctgaagaagtagaaaatgctattgttattgattatgcagatattccaaactggggcaagtcaacggttgttggccatgctggaaagttagtttacggagatttagctggccgtaaagtgctcgccttacaaggacgtttccatttttacgaaggaaatccgcttgaagtggtgactttccctgttcgtgtcatgaaagctctgggatgtgaaggcgttcttgtcacaaatgcagctggtggtatcggctacggcccaggtaccttgatggcaatcacagaccatatcaatatgaccggaaataacccactaatcggtgaaaacttggacgagtttggtccacgctttcctgatatgtctgatgcctatactaaggtttatcgcaataaggcacatgaagtggctgaaaaaatgaacatcaaactagaagatggtgtttatatgggcttgactggtccaacttatgaaacaccagcagaaatccgtgctttcaaagtattaggagcagatgctgttggcatgtcaactgtaccggaagttattgtggctgctcattctggacttaaagtgcttggtatttcagctattacaaactttgcagctggtttccaatcagaattgaaccatgaagaagttgtggaagtgacccaacatatcaaagaagatttcaaaggtcttgttaaagctattttagcggagttg

SEQ ID NO: 2744 - protein, 269 aa, Streptococcus pyogenes
MSLMTKINETKDFLVTKGIETPEFGLILGSGLGELAEEVENAIVIDYADIPNWGKSTVVGHAGKLVYGDLAGRKVLALQGRFHFYEGNPLEVVTFPVRVMKALGCEGVLVTNAAGGIGYGPGTLMAITDHINMTGNNPLIGENLDEFGPRFPDMSDAYTKVYRNKAHEVAEKMNIKLEDGVYMGLTGPTYETPAEIRAFKVLGADAVGMSTVPEVIVAAHSGLKVLGISAITNFAAGFQSELNHEEVVEVTQHIKEDFKGLVKAILAEL

SEQ ID NO: 2745 - DNA, 1269 bp, Streptococcus agalactiae
ttgctgaactttaaaatggtttctcgattatactatgctgtcaagtttatgatagccgttctatttatgacagttatggcaggagttggagctatcttaatgcactatgtattaatgtttacagagtggttagcatttggtgatagtagagaaaatactctgtctttgttaaatagtgtcacaccaattaaaagagtgttatcacttactttagtctcctttttagcatcccttagttggtattacttacaaatcaaaccaaagcaaataactagtattaaacaacaggttgtttttaaggatttttctgtaaaaaaatcaccttactggctacatataggtcacgcatttttgcaattgatttatgtaggaactggtggccctattggaaaagaaggagcgccacgagagtttggagccataaatgctgggaaaatatcggatttattagcacttaaagtgctggataaacgtttattaatcattagtggtgcagctgcaggtttgtcagcagtttatcaagtccccctagctagtgtattctttgcttttgaaactttagctttaggaatctcactgaaaaatattgtgacattgctagcctctacttttggtgcagctagtattgctcaattagttatttcgacagcccctctttatcatatttcaaagatgagtctgaattcacagtcattagcttttatgttcttgatcgttttatgtgtaactccgattgcgattagctttagatatttaaatcaaaaagtgacagagagacgtattaaaaatataaaaatattgttaagtttgccagtagtgtcattgatagtatctgttttatcaatcgtctatccccagattttaggaaatggtaatgccctagttcaagaagtctttaaagggaccacagttagcttaatcgctattttagttgttctcaagatgatagcaacattatccactctttacgctggtgcttatggcggtatactgacaccatctttttccattggtgcttgtttaggttttttgttagctagtatttctattcctttacttccccacatatcgatagtaaccagtatgttggttggtgcagctatttttttagctattacaatgagagcgccactgacagctgtcggtttagtcatatcttttactggtcaatctgttataactattgttcccctaactatagcagtactttttgctactgcctatgattattttataagaaaaatgaggagtttatatgtcaatccatat

SEQ ID NO: 2746 - protein, 423 aa, Streptococcus agalactiae
MLNFKMVSRLYYAVKFMIAVLFMTVMAGVGAILMHYVLMFTEWLAFGDSRENTLSLLNSVTPIKRVLSLTLVSFLASLSWYYLQIKPKQITSIKQQVVFKDFSVKKSPYWLHIGHAFLQLIYVGTGGPIGKEGAPREFGAINAGKISDLLALKVLDKRLLIISGAAAGLSAVYQVPLASVFFAFETLALGISLKNIVTLLASTFGAASIAQLVISTAPLYHISKMSLNSQSLAFMFLIVLCVTPIAISFRYLNQKVTERRIKNIKILLSLPVVSLIVSVLSIVYPQILGNGNALVQEVFKGTTVSLIAILVVLKMIATLSTLYAGAYGGILTPSFSIGACLGFLLASISIPLLPHISIVTSMLVGAAIFLAITMRAPLTAVGLVISFTGQSVITIVPLTIAVLFATAYDYFIRKMRSLYVNPY

SEQ ID NO: 2747 - DNA, 1311 bp, Streptococcus pyogenes
atgacgattataattatggactctaatagtgctcacgagactgataatctatcagtctcttttcttaacttttgttataatagtcttatgaaacgacactttttactcttgaccttttacctctttttaacaggtttaacagctggccttgttgcttttatcttaacaaaagccattcacctgattcagtccctcagttttggattcagtcaaggttcttttagcactatgattgctagtgttccaccacaaagacgagctctttcactcctctttgctggacttcttgcaggtcttgggtggcacctattggctaaaaaaggaaaggacattcaatctattcagcaaatcattcaagatgacatctcatttagtccctggacacagttttggcatggttggctccaattaacgaccgtatctatgggagctcctgtcggccgagaaggagcttcacgggaagtcgctgttaccttgacgtctctttggagccaaagatgcaacttgtcaaaagccgatcaaaaacttttattagcctgcgcttctggcgctgcccttggtgctgtctacaatgctcccttagccactattttatttatcttagaagctattcttaaccgttggtcccttaaaaatatatacgctgcctgcctaacgagctatgtggctgtggaaacagttgctttattacaaggccgacatgagattcaatacctaatgcctcagcaacattggacgctaggaacccttattgggtccgtcctggctggtcttatcctttccctctttgctcacgcttacaaacatcttttgaaacaccttcctaaggctgatgccaaaagtcagtggtttattccgaaagttctcatcgcttttagccttatcgcaggactcagcattttcttcccagagattttaggaaatggcaaagctggattactcttttttctccatgaagaaccacatctgagctatattagctggctacttgttgccaaagctgtcgctatctctttagtttttgcttctggagcaaaagggggtaaaattgctccttctatgatgcttggaggtgctagtggcttactactagctatccttagtcagtaccttattcccttgtctctatcaaatacgttagccattatggttggtgcaacaatctttttaggtgtgatcaataagatacccttggcggcaccagtttttctggttgaaattacaggccaatcgttactaatgattatccctttagcattagctaacctcattttttattttagctatcagttttatcgtttcatccttaaa

SEQ ID NO: 2748 - protein, 437 aa, Streptococcus pyogenes
MTIIIMDSNSAHETDNLSVSFLNFCYNSLMKRHFLLLTFYLFLTGLTAGLVAFILTKAIHLIQSLSFGFSQGSFSTMIASVPPQRRALSLLFAGLLAGLGWHLLAKKGKDIQSIQQIIQDDISFSPWTQFWHGWLQLTTVSMGAPVGREGASREVAVTLTSLWSQRCNLSKADQKLLLACASGAALGAVYNAPLATILFILEAILNRWSLKNIYAACLTSYVAVETVALLQGRHEIQYLMPQQHWTLGTLIGSVLAGLILSLFAHAYKHLLKHLPKADAKSQWFIPKVLIAFSLIAGLSIFFPEILGNGKAGLLFFLHEEPHLSYISWLLVAKAVAISLVFASGAKGGKIAPSMMLGGASGLLLAILSQYLIPLSLSNTLAIMVGATIFLGVINKIPLAAPVFLVEITGQSLLMIIPLALANLIFYFSYQFYRFILK

SEQ ID NO: 2749 - DNA, 708 bp, Streptococcus agalactiae
atgtcaatccatattgaagcaaaacaaggtgaaattgcagataaaattttacttccaggagatccactccgtgcgaaatttattgccgagaattttttagaagatgcggtgtgttttaacacagttcgcaatatgtttggttatacaggtacctataaaggacatcgtgtttctgttatgggaactggtatgggtatgccttcaatttcaatttatgctcgcgaactaattgttgattatggggttaaaacattgattcgcgtaggaacagcaggtgctattaatcctgatatccatgttcgtgaacttgttttggcacaagcagcagcaacaaattctaatattatccgtaatgattggcctgaatttgattttccgcaaattgctgattttaaacttttggataaagcttatcacatcgcaaaggaaatggatattacaactcatgtaggcagtgtattatcttcagacgtgttttattcaaaccaaccagatcgtaatatggccttgggtaaactaggtgttcatgctattgagatggaagcagcagctctctactatcttgcagctcaacacaatgttaatgctcttgctatgatgacgatttcagataacttgaataatccagaagaagatacaagtgcagaagagcgtcaaacaacatttactgatatgatgaaagttgggctcgaaacacttatttctgaa

SEQ ID NO: 2750 - protein, 236 aa, Streptococcus agalactiae
MSIHIEAKQGEIADKILLPGDPLRAKFIAENFLEDAVCFNTVRNMFGYTGTYKGHRVSVMGTGMGMPSISIYARELIVDYGVKTLIRVGTAGAINPDIHVRELVLAQAAATNSNIIRNDWPEFDFPQIADFKLLDKAYHIAKEMDITTHVGSVLSSDVFYSNQPDRNMALGKLGVHAIEMEAAALYYLAAQHNVNALAMMTISDNLNNPEEDTSAEERQTTFTDMMKVGLETLISE

SEQ ID NO: 2751 - DNA, 711 bp, Streptococcus pyogenes
atgtctatccatatttctgccaaaaaaggcgatattgctgataaaattcttctacctggagatcctttgcgcgcgaaatttatcgctgaaaatttcctagaagatgcagtgtgttttaacgaagtgcgtaacatgtttggctacacaggaacttacaaagggcaccgcgtttctgtcatgggaactggtatggggatgccttcgatctctatctatgctcgtgaattaatcgttgattacggtgtcaaaacattgatccgtgttggtactgcgggtgcgattgacccagaagttcatgtgcgtgaattggtgcttgcccaagcagcagcaaccaactcaaatattatccgtaatgacttcccagaatttgatttcccacaaattgctgattttggtttacttgacaaggcttaccatatcgccagagaaatgggagtaacaactcacgttgggaatgtgctttcttctgatgtcttttacactaacatgcctgagcgtaatatggctcttggtaaattgggtgttaaagccatcgaaatggaagcagcagctctttactatttagctgctcagcaccatgtcaaagcccttggaatcatgacgatctcagataacttgaatgatccaaccgaagatactacagctgaagagcgccaaacaactttcactgatatgatgaaggtcggcttggaaaccttaattgccaatgac

SEQ ID NO: 2752 - protein, 237 aa, Streptococcus pyogenes
MSIHISAKKGDIADKILLPGDPLRAKFIAENFLEDAVCFNEVRNMFGYTGTYKGHRVSVMGTGMGMPSISIYARELIVDYGVKTLIRVGTAGAIDPEVHVRELVLAQAAATNSNIIRNDFPEFDFPQIADFGLLDKAYHIAREMGVTTHVGNVLSSDVFYTNMPERNMALGKLGVKAIEMEAAALYYLAAQHHVKALGIMTISDNLNDPTEDTTAEERQTTFTDMMKVGLETLIAND

SEQ ID NO: 2753 - DNA, 777 bp, Streptococcus agalactiae
atgaggatagaaatgacagatttttcaactgctcttaaagtattagtggatcagtattcttatcataatgctttcttattattacaaaaacatggtcctttaaactcagatttattatttttattggaaatgatgaaagagcgtcgagagttaaacattgattttctttttgctcatcaagaacaagttgttatattacaagaaaaatacaatataaagcttttgcataacccgtatgatttagagttgctggcaaattacatcatggatttagaagcaaaagtaaaaaacggattaatcatagattttgtccgtagtgttagtcctattttatatcgtctatttatgattttacttgcacaagaagtacctcacttgcatgattacatccataatgcaagagatgatcactacgatacttggaagtttaaagaattaaaggagtcaaaccacccagtccttttggcattctctgaaaggtggcacgatagtcgcttgacttctaaaagcctggcagaatgtttacaattaaccgaccttgatgaagaagtgaaatcgaccatcattcaattaagacagttcgaaaaatcagtcagaaatcctttggctcacctgattaaaccttttgatgagcaagaactatatcgtacaactcaattttcttctcaagcatttttagaccagattatcttcttggcaaaggtaattggtgttgagtatgatactgttaattttcactacgatacggttaacaagcttattataaatatacttgag

SEQ ID NO: 2754 - protein, 259 aa, Streptococcus agalactiae
MRIEMTDFSTALKVLVDQYSYHNAFLLLQKHGPLNSDLLFLLEMMKERRELNIDFLFAHQEQVVILQEKYNIKLLHNPYDLELLANYIMDLEAKVKNGLIIDFVRSVSPILYRLFMILLAQEVPHLHDYIHNARDDHYDTWKFKELKESNHPVLLAFSERWHDSRLTSKSLAECLQLTDLDEEVKSTIIQLRQFEKSVRNPLAHLIKPFDEQELYRTTQFSSQAFLDQIIFLAKVIGVEYDTVNFHYDTVNKLIINILE

SEQ ID NO: 2755 - DNA, 792 bp, Streptococcus pyogenes
ttgccaatgactaataatcaaacactagacatccttttggatgtctatgcttataatcacgcctttagaattgctaaagccttgccaaatatccctaaaactgccctctatttactagagatgttaaaagagcgcagagaattgaaccttgcctttctagcggaacatgcagcagagaatcggaccattgaagaccagtatcactgttcattatggcttaaccaatcgcttgaagatgagcagattgccaattacattttggatttagaagttaaagtaaaaaacggtgctattattgatttcgtcaggtcagtgtcgcctattctttaccgactttttctcagactaatcacgtcagaaattccaaacttcaaggcttatatttttgatacaaagaatgaccaatatgatacctggcattttcaggccatgttggaatctgatcacgaggttttcaaggcttacctgtctcaaaagcagtctcgcaatgtgacgaccaaaagcttagcagacatgttgacgttgacctccttacctcaggaaatcaaggacttggtttttttgttacgacattttgaaaaggctgtccgtaatcctctggctcatttgattaagccttttgatgaagaggaactgcatcgcaccactcatttttcttctcaggcttttttggaaaacattatcaccttggcgactttttctggtgtaatctaccgacgtgagcctttttactttgatgacatgaatgccattattaaaaaggagttgagcctttggagacaatctattgtc

SEQ ID NO: 2756 - protein, 264 aa, Streptococcus pyogenes
LPMTNNQTLDILLDVYAYNHAFRIAKALPNIPKTALYLLEMLKERRELNLAFLAEHAAENRTIEDQYHCSLWLNQSLEDEQIANYILDLEVKVKNGAIIDFVRSVSPILYRLFLRLITSEIPNFKAYIFDTKNDQYDTWHFQAMLESDHEVFKAYLSQKQSRNVTTKSLADMLTLTSLPQEIKDLVFLLRHFEKAVRNPLAHLIKPFDEEELHRTTHFSSQAFLENIITLATFSGVIYRREPFYFDDMNAIIKKELSLWRQSIV

SEQ ID NO: 2757 - DNA, 921 bp, Streptococcus agalactiae
atgagaattcaacaattacaatatgttattaagattgtagaaactggtagcatgaatgaagccgctaaacaactctacattacccaaccttcactttcaaacgctgttaggaaccttgagactgagatgggtatccaaatttttattcgaaatccaaaaggaataacgttaacaaaagatggtatggaatttctgtcatatgcgcgacaaattctagaacaaacagcacttcttgaagagcgttataagggtgataatacaagtcgtgagctgttcagcgtttcttcacaacactatgcatttgtggttaacgcttttgtagctctctttaatggcacagacatgacccaatacgaactttttttacgtgaaactaggacttgggaaattattgatgatgttaaaaatttccgttcagagattggtgttctgtttcttaatagctataatagagatgtattaaccaaattattcgacgataattccttaattgccacaactctttttactactacacctcatattttcgtgagcaaatccaatcccttagctaatagaaaaaaattaaatatgaaagatttagaagattatccttatctgagttatgatcaaggcctgcataattctttctacttttctgaggaaatgatgtctcaaattcctcacccaaaatccattgttgtcagtgatagagcaactctgtttaatttaatgattggattagatggttatacagtggcaactggtatcctcaactcaaaattgaacggtgacgaaattgtcgcaatccctcttgacgtggatgatgttattgatattgtctatatccgacacgacaaagcaaacctttcaaaaatgggacaaaaatttattgactatttattagaggaagtttcgtttaatcataaaaataaacagtcc

SEQ ID NO: 2758 - protein, 307 aa, Streptococcus agalactiae
MRIQQLQYVIKIVETGSMNEAAKQLYITQPSLSNAVRNLETEMGIQIFIRNPKGITLTKDGMEFLSYARQILEQTALLEERYKGDNTSRELFSVSSQHYAFVVNAFVALFNGTDMTQYELFLRETRTWEIIDDVKNFRSEIGVLFLNSYNRDVLTKLFDDNSLIATTLFTTTPHIFVSKSNPLANRKKLNMKDLEDYPYLSYDQGLHNSFYFSEEMMSQIPHPKSIVVSDRATLFNLMIGLDGYTVATGILNSKLNGDEIVAIPLDVDDVIDIVYIRHDKANLSKMGQKFIDYLLEEVSFNHKNKQS

SEQ ID NO: 2759 - DNA, 903 bp, Streptococcus pyogenes
atgagaattcaacaactgcattatattatcaaaattgttgagtgcggctctatgaatgaagctgctaagcaattatttatcacacaaccaagtctatccaatgcggtcaaggatttggaaatggagatgggcattaccattttcaaccgaaatcctaaagggatcaccttgacaaaagatggggtggaatttttatcttatgctcgccaaattatagagcaaacatcactgttagaagaccgctataaaaaccacaatactggccgagagctctttagcgtttcatctcaacattatgccttcgtagtcaatgcatttgtctcactcctcaagcggaccgacatgactcggtatgaactctttttgcgcgagacaagaacttgggaaatcattgatgatgtcaaaaactttcgatctgaaattggtgttctctttatcaacgactataaccgagatgtcttgaccaaattatttgatgacaatcatttgaccgcctctccattatttaaggcacagcctcatatttttgtcagcaaatcaaatcctctagcaactaaaagcctattaagcatggacgacttgagagattttccttacctgagctatgaccaagggattcacaactccttttatttttcagaagagatgatgtcccagatgccccacaacaaatcaattgtggtcagtgaccgtgccaccctctttaacttaatgattggtttagatggctacaccgttgccagtggtattctaaatagcaatctaaatggtgaccagattgtggctatcccgctagatgtccctgacgaaattgacattgtttttatcaagcatgaaaaagccaacttgtccaaaatgggggaacgttttatcgaataccttctcgaagaagtaacctttgat

SEQ ID NO: 2760 - protein, 301 aa, Streptococcus pyogenes
MRIQQLHYIIKIVECGSMNEAAKQLFITQPSLSNAVKDLEMEMGITIFNRNPKGITLTKDGVEFLSYARQIIEQTSLLEDRYKNHNTGRELFSVSSQHYAFVVNAFVSLLKRTDMTRYELFLRETRTWEIIDDVKNFRSEIGVLFINDYNRDVLTKLFDDNHLTASPLFKAQPHIFVSKSNPLATKSLLSMDDLRDFPYLSYDQGIHNSFYFSEEMMSQMPHNKSIVVSDRATLFNLMIGLDGYTVASGILNSNLNGDQIVAIPLDVPDEIDIVFIKHEKANLSKMGERFIEYLLEEVTFD

SEQ ID NO: 2761 - DNA, 1455 bp, Streptococcus agalactiae
atgtctaatcattcgcgccgtcaccaaaagaaacactcacatacacctctacgggtgattaatttatttcttttggtgatttttattttgttaagtgtagtctcattatttcttatgtatcgtcaccattttttggcatttagacacctgaacgtcatttatggagttgtaattgttttaatcattttagtaagtttatttctttgtattaagaataaagctagaatttttacaactataattttagtattagcttctattttcgttgctactactttatatggatttaagtcaaccattgatttgacaaataatctaaataaaactgcttcatactctgaaattgagatgagtgtagttgtaccaaaagattctaaaataaccaatatagaagctgtcagcaaattagccgcaccagttaaaaacgatacttcaaatattactgatttgatagaacatataaaatcagaaaaaggaatctctattacaccacaaaaaacagattcttaccaggatgcatacaatagaattaaaagtggtgatagtcaggctatggttttaaataatgcttatgttagcttaattgaacttagcacccctgattttaaatcgcagataaaaacgatttatacttacaaaattaagaaaaaaattaatcgtaaaaatactaatcataaagaaggggtatttaatatctatattagcggtattgatacttttggctctatatcaacagtatcaagatctgatgtaaatattattatgacggttaataccaatacccacaaagtattgttaacgacaacaccacgagatgcctatgtaaaaattccagatggtgggggcaatcaatatgataaattaacccatgcaggtttgtatggcgttgagacatcaatgaaaacacttgaaaacctttacgacatcaaccttgattattatgctagaattaatttttcatcatttttaaaattaatagacctcttgggaggagtgacagtttataacgatcaagcttttacaagtaaacatggtaattttgacttccctgttggtcaagtaacattgaattctgagcaggctttgggctttgttagagaacgttattctctacaaggaggcgataacgatagaggtagaaatcaagaaaaagtgattgcagctattataaataagttagcttctagtcagtcagtaacaaaattaaatagcattacctcacagctccaaacgtccgttcaaactaatatgactattgataacattaatgatttgattaacaatcaattgtcaactggacaacgcttcactgtcgagtcacaagcattaactggtcatggttcaacgggtgaactcccttcatatgcaatgccaggagctcaactttatatgatgtcaattgatcaatctagcttatctaatgcaaaatcaaaaattaagaacacaatggaggaa

SEQ ID NO: 2762 - protein, 485 aa, Streptococcus agalactiae
MSNHSRRHQKKHSHTPLRVINLFLLVIFILLSVVSLFLMYRHHFLAFRHLNVIYGVVIVLIILVSLFLCIKNKARIFTTIILVLASIFVATTLYGFKSTIDLTNNLNKTASYSEIEMSVVVPKDSKITNIEAVSKLAAPVKNDTSNITDLIEHIKSEKGISITPQKTDSYQDAYNRIKSGDSQAMVLNNAYVSLIELSTPDFKSQIKTIYTYKIKKKINRKNTNHKEGVFNIYISGIDTFGSISTVSRSDVNIIMTVNTNTHKVLLTTTPRDAYVKIPDGGGNQYDKLTHAGLYGVETSMKTLENLYDINLDYYARINFSSFLKLIDLLGGVTVYNDQAFTSKHGNFDFPVGQVTLNSEQALGFVRERYSLQGGDNDRGRNQEKVIAAIINKLASSQSVTKLNSITSQLQTSVQTNMTIDNINDLINNQLSTGQRFTVESQALTGHGSTGELPSYAMPGAQLYMMSIDQSSLSNAKSKIKNTMEE

SEQ ID NO: 2763 - DNA, 1272 bp, Streptococcus pyogenes
atgaaaattggaaaaaaaatagttttaatgttcacagctattgtgttaacaactgtcttggcattaggtgtctatctaactagtgcttataccttctcaacaggagaattatcaaagacctttaaagatttttcgacatcttcaaacaaaagtgatgccattaaacaaacaagagctttttctatcttgttgatgggtgttgatacaggctcttcagagcgtgcctccaagtgggaaggaaacagtgattcgatgattttggttacggttaatccaaagaccaagaaaacaactatgactagtttagaacgagataccttaaccacgttatctggacccaaaaataatgaaatgaatggtgttgaagctaagcttaacgctgcttatgcagcaggtggcgctcagatggctattatgaccgtgcaagatcttttgaatatcaccattgataactatgttcaaattaatatgcaaggccttattgatcttgtgaatgcagttggagggattacagttacaaatgagtttgattttcctatctcgattgctgaaaacgaacctgaatatcaagctactgttgcgcctggaacacacaaaattaacggtgaacaagctttggtttatgctcgtatgcgttatgatgatcctgagggagattatggtcgacaaaagcgtcaacgtgaagtcattcaaaaggtattgaaaaaaatccttgctcttgatagcattagctcttatcggaagattttatctgctgtaagtagtaatatgcaaacgaatatcgaaatctcttctcgcactatccctagtctattaggttatcgtgacgcacttagaactattaagacttatcaactaaaaggagaagatgccactttatcagatggtggatcataccaaattgttacctctaatcatttgttagaaatccaaaatcgtatccgaacagaattaggacttcataaggttaatcaattaaaaacaaatgctactgtttatgaaaatttgtatgggtcaactaagtctcagacagtaaacaacaactatgactcttcaggccaggctccatcttattctgatagtcatagctcttacgctaattattcaagtggagtagataccggccagagtgctagtacagaccaggactctactgcttcaagccataggccagctacgccgtcttcttcatcagatgctttagcagctgatgagtctagctcatcagggtctggatcattagttcctcctgctaatatcaaccctcagacc

SEQ ID NO: 2764 - protein, 424 aa, Streptococcus pyogenes
MKIGKKIVLMFTAIVLTTVLALGVYLTSAYTFSTGELSKTFKDFSTSSNKSDAIKQTRAFSILLMGVDTGSSERASKWEGNSDSMILVTVNPKTKKTTMTSLERDTLTTLSGPKNNEMNGVEAKLNAAYAAGGAQMAIMTVQDLLNITIDNYVQINMQGLIDLVNAVGGITVTNEFDFPISIAENEPEYQATVAPGTHKINGEQALVYARMRYDDPEGDYGRQKRQREVIQKVLKKILALDSISSYRKILSAVSSNMQTNIEISSRTIPSLLGYRDALRTIKTYQLKGEDATLSDGGSYQIVTSNHLLEIQNRIRTELGLHKVNQLKTNATVYENLYGSTKSQTVNNNYDSSGQAPSYSDSHSSYANYSSGVDTGQSASTDQDSTASSHRPATPSSSSDALAADESSSSGSGSLVPPANINPQT

SEQ ID NO: 2765 - DNA, 729 bp, Streptococcus agalactiae
atgattgatattcattctcatatcgtttttgatgtagatgatgggcctaaaacgcttgaagagagtttatctttaatagaagaaagttatcgacaaggtgttagaataattgtttcgacatcacatagaagaaaaggtatgtttgaaacacctgaagatattatcttcaaaaacttttctatagttaaacacgaagcggaaaaaagatttgaacatcttcaaatcttatatggtggagaattgtactatacaagtgatatgttagaaaaactgaagttaaagcaaattccaactttaaacaatacgaaatttgctttaattgaattttctatgcaaacttcttggaaagatattcatacagctttgtcaaatgttttaatgcttggtattacaccagtcgttgcgcatatagagaggtataacgctttagagaatcaaaaagaacgggtgaaggaaattattaatatggggtgttacacacaaataaatagttcccatattttgaaacaaaaactttttaatgataagcataaacgctttaagaaaagagcccgttattttttagaggaaaatttagtgcattttgtagcgagtgatatgcataaccttgatgttagaccgccatttttagcagaagcttataagattatctgtagagatttcggtaaagaacgtgctaaccaactttttattgaaaatgctcaatctatattaaaaaaccattacatt

SEQ ID NO: 2766 - protein, 243 aa, Streptococcus agalactiae
MIDIHSHIVFDVDDGPKTLEESLSLIEESYRQGVRIIVSTSHRRKGMFETPEDIIFKNFSIVKHEAEKRFEHLQILYGGELYYTSDMLEKLKLKQIPTLNNTKFALIEFSMQTSWKDIHTALSNVLMLGITPVVAHIERYNALENQKERVKEIINMGCYTQINSSHILKQKLFNDKHKRFKKRARYFLEENLVHFVASDMHNLDVRPPFLAEAYKIICRDFGKERANQLFIENAQSILKNHYI

SEQ ID NO: 2767 - DNA, 690 bp, Streptococcus agalactiae
atgaataaaatagctaatacagaagttgaaataaatatattcaaccttttaaaaaaattgtggaaaaagaaatttttaatcacatttgttgccattgcatttgcaacagctggacttttctatagtctttttattgttacgccacaatatacttcttcaacaaggatatatgtcattaaccctaatacccctaataatagtattactgcacaagatctacaagcggggagttttcttgcaaatgactataaggagattattacgtctactgacgttctagaaaaagttatttcttctgaaaaattgaattatccttcgtctcagttgttgcaaaaaataacagtttctattttaaaagatacacgtgttatttcaatatcggtcgaagatgctaatccaaaaatgtctcaaaaattagcaaattcagttagagaagcagcagtttcaaaaatcaaggcagttactcaagtagaggatatcactactcttgagaagggaaatttacctaaagcaccatcttctcctaatattaaaaagaatgtactaatcgggtttattgttggtgcaggattatcaactattgttttagttattatgggtattttggatgatcgtgttaatactgaagaagatattgaaaaggtcctaggacttacttctttaggtatagtaccagatttgaataaactt

SEQ ID NO: 2768 - protein, 230 aa, Streptococcus agalactiae
MNKIANTEVEINIFNLLKKLWKKKFLITFVAIAFATAGLFYSLFIVTPQYTSSTRIYVINPNTPNNSITAQDLQAGSFLANDYKEIITSTDVLEKVISSEKLNYPSSQLLQKITVSILKDTRVISISVEDANPKMSQKLANSVREAAVSKIKAVTQVEDITTLEKGNLPKAPSSPNIKKNVLIGFIVGAGLSTIVLVIMGILDDRVNTEEDIEKVLGLTSLGIVPDLNKL

SEQ ID NO: 2769 - DNA, 687 bp, Streptococcus agalactiae
atgactcgtttagaaatagttgatagcaagttaagacaagcaaaaaaaacagaagaatacttcaatgcgatccgtacaaacatacagtttagtggaaaggaaaataaaattcttgcaattacctctgttagggaaggggaaggaaaatccactgcttcaacaagtttagctttatctttagctcaagcaggatttaaaacattattaattgatgcggatactaggaactctgttatgtctggaacctttaaagcaactggaactattaaaggcttgacgaattatttatcaggtaatgcagatcttggagatattatctgtgaaaccaatgttcctagactgatggtcgttccttcagggaaagtaccaccaaatccaacagcattacttcagaacgcttattttaataagatgattgaagctattaaaaatatatttgattatattatcatcgatactccacctattggtttagttgttgatgccgcaataatcgctaatgcttgcgatggttttattttagtaacccaagcaggcagaataaaacgtaattatgttgaaaaagcaaaagaacagatggaacaaagtggttcaaagttcttaggtattattcttaataaagttaatgaatctgttgctacttacggcgattatggaaattacggaaaaagggatagaaaaaggaag

SEQ ID NO: 2770 - protein, 229 aa, Streptococcus agalactiae
MTRLEIVDSKLRQAKKTEEYFNAIRTNIQFSGKENKILAITSVREGEGKSTASTSLALSLAQAGFKTLLIDADTRNSVMSGTFKATGTIKGLTNYLSGNADLGDIICETNVPRLMVVPSGKVPPNPTALLQNAYFNKMIEAIKNIFDYIIIDTPPIGLVVDAAIIANACDGFILVTQAGRIKRNYVEKAKEQMEQSGSKFLGIILNKVNESVATYGDYGNYGKRDRKRK

SEQ ID NO: 2771 - DNA, 1386 bp, Streptococcus agalactiae
ttgaaagaaaaagaaaatatacaaaagattattatagcgatgattcaaacagttgtggtttatttttctgcaagtttgacattaacattaattactcccaattttaaaagcaataaagatttattgtttgttctattgatacattatattgtcttttatctttctgatttttacagagacttttggagtcgtggctatcttgaagagtttaaaatggtattgaaatacagcttttactatattttcatatcaagttcattattttttatttttaaaaactcttttacaacgacacgactttccttttttacttttattgctatgaattcgattttattatatctattgaattcatttttaaaatattatcgaaaatattcttacgctaagttttcacgagataccaaagttgttttgataacgaataaggattctttatcaaaaatgacctttaggaataaatacgaccataattatatcgctgtctgtatcttggattcctctgaaaaggattgttatgatttgaaacataactcgttaaggataataaacaaagatgctcttacttcagagttaacctgcttaactgttgatcaagcttttattaacatacccattgaattatttggtaaataccaaatacaagatattattaatgacattgaagcaatgggagtgattgtcaatgttaatgtagaggcacttagctttgataatataggagaaaagcgaatccaaacttttgaaggatatagtgttattacatattctatgaaattctataaatatagtcaccttatagcaaaacgatttttggatatcacgggtgctattataggtttgctcatatgtggcattgtggcaatttttctagttccacaaatcagaaaagatggtggaccggctatcttttctcaaaatagagtaggtcgtaatggtaggatttttagattctataaattcagatcaatgcgagtagatgcagaacaaattaagaaagatttattagttcacaatcaaatgacagggctaatgtttaagttagacgatgatcctagaattactaaaataggaaaatttattcgaaaaacaagcatagatgagttgcctcaattctataatgttttaaagggtgatatgagtttagtaggaacacgccctcccacagttgatgaatatgaaaagtataattcaacgcagaagcgacgccttagttttaagccaggaatcactggtttgtggcaaatatctggtagaaataatattactgattttgatgaaatcgtaaagttagatgttcaatatatcaatgaatggtctatttggtcagatattaagattattctcctaacactaaaggtagttttactcgggacaggagctaag

SEQ ID NO: 2772 - protein, 462 aa, Streptococcus agalactiae
MKEKENIQKIIIAMIQTVVVYFSASLTLTLITPNFKSNKDLLFVLLIHYIVFYLSDFYRDFWSRGYLEEFKMVLKYSFYYIFISSSLFFIFKNSFTTTRLSFFTFIAMNSILLYLLNSFLKYYRKYSYAKFSRDTKVVLITNKDSLSKMTFRNKYDHNYIAVCILDSSEKDCYDLKHNSLRIINKDALTSELTCLTVDQAFINIPIELFGKYQIQDIINDIEAMGVIVNVNVEALSFDNIGEKRIQTFEGYSVITYSMKFYKYSHLIAKRFLDITGAIIGLLICGIVAIFLVPQIRKDGGPAIFSQNRVGRNGRIFRFYKFRSMRVDAEQIKKDLLVHNQMTGLMFKLDDDPRITKIGKFIRKTSIDELPQFYNVLKGDMSLVGTRPPTVDEYEKYNSTQKRRLSFKPGITGLWQISGRNNITDFDEIVKLDVQYINEWSIWSDIKIILLTLKVVLLGTGAK

SEQ ID NO: 2773 - DNA, 447 bp, Streptococcus agalactiae
atgaaaatttgtctggttggttcaagtggtggtcatctagcacacttgaaccttttgaaacccatttgggaaaaagaagataggttttgggtaacctttgataaagaagatgctaggagtattctaagagaagagattgtatatcattgcttctttccaacaaaccgtaatgtcaaaaacttggtaaaaaatactattctagcttttaaggtccttagaaaagaaagaccagatgttatcatatcatctggtgccgctgtagcagtaccattcttttatattggtaagttatttggttgtaagaccgtttacatagaggttttcgacaggatggataaaccaactttgacaggaaaattagtgtatcctgtaacagataaatttattgttcagtgggaagaaatgaaaaaagtttatcctaaggcaattaatttaggaggaattttt

SEQ ID NO: 2774 - protein, 149 aa, Streptococcus agalactiae
MKICLVGSSGGHLAHLNLLKPIWEKEDRFWVTFDKEDARSILREEIVYHCFFPTNRNVKNLVKNTILAFKVLRKERPDVIISSGAAVAVPFFYIGKLFGCKTVYIEVFDRMDKPTLTGKLVYPVTDKFIVQWEEMKKVYPKAINLGGIF

SEQ ID NO: 2775 - DNA, 489 bp, Streptococcus agalactiae
atgatttttgtcacagtggggacacatgaacagcagttcaaccgtcttattaaagaagttgatagattaaaagggacaggtgctattgatcaagaagtgttcattcaaacgggttactcagactttgaacctcagaattgtcagtggtcaaaatttctctcatatgatgatatgaactcttacatgaaagaagctgagattgttatcacacatggcggcccagcgacgtttatgaatgcagtttctaaaggaaaaaaaactattgtggttcctagacaagaacagtttggagagcatgtgaataatcatcaggtggactttgttaataaggtaaaaacaatgtataattttgatatcgttgtagatattgaaaggttacaaaatgtagtctatgagggaatgatgaatcgtccgtttttagaaactaatagtagtaattttattgaagaatttaaggtaatattaaaggagttgtgcgatgaaaatcaa

SEQ ID NO: 2776 - protein, 163 aa, Streptococcus agalactiae
MIFVTVGTHEQQFNRLIKEVDRLKGTGAIDQEVFIQTGYSDFEPQNCQWSKFLSYDDMNSYMKEAEIVITHGGPATFMNAVSKGKKTIVVPRQEQFGEHVNNHQVDFVNKVKTMYNFDIVVDIERLQNVVYEGMMNRPFLETNSSNFIEEFKVILKELCDENQ

SEQ ID NO: 2777 - DNA, 1092 bp, Streptococcus agalactiae
atgaaaatcaataaaaactctttattttatattgcaatatttttagttaatttttttaaatcactgggtttaggcgagggaaactcagcttacaaaatagtgatgttagttgcaattttactgtgtggaataaaatttttattagatagcctttattttgaaagaagaaaactcgtgatcatctttttattatttatcgcgaccattttgaatttattctttgttcataaggttacttttatattaactttaattttttttctagcattaaaggacatctctctaaaaaaagctttctctataataataggatcgcgtattttgggagttctattaaatcaaatttttgtgaaattagatttaatagaaattaagtatgtcaatttttatagggatggacaatttattctgagaagtgacttaggttttggtcatcctaactttattcataatttttttgctctaactattttcttgtatattgtactcaattataaacgactaaagcctgttgtgatggttttatttttaacattaaattatttattgtaccaatatactttttcaaggacagggtattatatcgtaattttatttattgtactcatttatgtgacaaagaatagcttaataaaaagagtatttatgaaattagcaccctatgtacaattttttttattagtatttacctttttgagttctacaattttttttaattcaaattttgttcaaaaattagatgttcttttaacaggtagattacactatgctcatttacaacttgtagatggtttaactccttttggaaatagttttaaggaaacaagtgtcctatttgataatagctactctatgttattgagtatgtatggtgtagtacttaccatgttttgtatgataatctattatatctatagtaaaaagataatcataattgaacttcaactactcctatttataatgtctataatattatttactgaaagtttttatcccagtgtggtaatgaatattagttggctagtttttggtaaaatattttgtgatggtatcgaacctataaaaaaggaatttactattgtgaataatata

SEQ ID NO: 2778 - protein, 364 aa, Streptococcus agalactiae
MKINKNSLFYIAIFLVNFFKSLGLGEGNSAYKIVMLVAILLCGIKFLLDSLYFERRKLVIIFLLFIATILNLFFVHKVTFILTLIFFLALKDISLKKAFSIIIGSRILGVLLNQIFVKLDLIEIKYVNFYRDGQFILRSDLGFGHPNFIHNFFALTIFLYIVLNYKRLKPVVMVLFLTLNYLLYQYTFSRTGYYIVILFIVLIYVTKNSLIKRVFMKLAPYVQFFLLVFTFLSSTIFFNSNFVQKLDVLLTGRLHYAHLQLVDGLTPFGNSFKETSVLFDNSYSMLLSMYGVVLTMFCMIIYYIYSKKIIIIELQLLLFIMSIILFTESFYPSVVMNISWLVFGKIFCDGIEPIKKEFTIVNNI

SEQ ID NO: 2779 - DNA, 723 bp, Streptococcus agalactiae
atgatacctaaagttatacattattgttggtttggaggaaatcccttaccagataatttaaagaaatatataaaaacttggagagaacaatgtccggattatgaaattattgaatggaatgagcataattatgatgttagtaaaaatgtttttatgagagaagcatatactaagaagaattttgcttatgtttctgactatgcaagattggatattatttatacttatggggggttctatctagatactgatgtggagcttttaaaaagtttagatcctttgaggattcatgagtgttttctagcaagggagattagttgtgatgtgaatacaggattaataattggcgctgttaaaggacatcactttttaaaatcaaatatgtctatatatgacaaaagtgatttaacttctcttaataagacatgtgtagaggttacaactaatttattgataaacagagggcttaagaataagaatattattcaaaagattgatgatataacaatatatccgagaaattattttaatccaaagaatttattaacaggtaaggttgattgtctgactagtgttacctattctatacatcattacgaaggaagttggaaaagttcttcatttatttcagattctctaaagattagagtaaggctcataattgattttttatttggatatggtacttatagaatgcttctaaggtttctaaagttaaagaaa

SEQ ID NO: 2780 - protein, 241 aa, Streptococcus agalactiae
MIPKVIHYCWFGGNPLPDNLKKYIKTWREQCPDYEIIEWNEHNYDVSKNVFMREAYTKKNFAYVSDYARLDIIYTYGGFYLDTDVELLKSLDPLRIHECFLAREISCDVNTGLIIGAVKGHHFLKSNMSIYDKSDLTSLNKTCVEVTTNLLINRGLKNKNIIQKIDDITIYPRNYFNPKNLLTGKVDCLTSVTYSIHHYEGSWKSSSFISDSLKIRVRLIIDFLFGYGTYRMLLRFLKLKK

SEQ ID NO: 2781 - DNA, 885 bp, Streptococcus agalactiae
atgttatatatttttactcctacatttaacagaggctaccgattatcctatctgtatgattctctatgtaatcagacaaataaaaattttatatggttgattgttgatgatggttctgaggacagtactaaggaaattgtaagtaattatataaaagagaataaagttagtattgtatatctgtataaacgtaatggcggtaagcattcagcctataatctagcaatgagatatatgcaaccaagtgattatcatgtatgtgtagatagtgatgattggttattagaagatgcagttgaaattatttttaaagatttagagagcctaacgttgtctaatagatatgtaggccttgtttatcctcgatattcattaaaccaaggtaataattggttgaatcccaaaatattagaagttaatattcctgatttaaaatataaatatcacttaaaaattgaaacttgtattgttattaataatgcttatttagtagatttcgaatttccttgtttcgaaggggagaatttcttatcagaagaaataatgtatatatatttatcaaaaaagggatacttttgtccccaaaataggaaaatctattgttttgactacttagaagatggtttgacttctaatatttttaaattatggagaaaaaatttcaaagggactattttttcattagaaaattcatatatgtatgtaatgtcttttcctaatatatttgatcgctggtggtcagctataaagataaaaatgaacatacaggctttgaaaatgactactttaggggtaatacctacactaaagagtgaagaggctgggtggaaaattttgttgggttttagctatctttggaaggtagcaaggtttaaaaagagcgag

SEQ ID NO: 2782 - protein, 295 aa, Streptococcus agalactiae
MLYIFTPTFNRGYRLSYLYDSLCNQTNKNFIWLIVDDGSEDSTKEIVSNYIKENKVSIVYLYKRNGGKHSAYNLAMRYMQPSDYHVCVDSDDWLLEDAVEIIFKDLESLTLSNRYVGLVYPRYSLNQGNNWLNPKILEVNIPDLKYKYHLKIETCIVINNAYLVDFEFPCFEGENFLSEEIMYIYLSKKGYFCPQNRKIYCFDYLEDGLTSNIFKLWRKNFKGTIFSLENSYMYVMSFPNIFDRWWSAIKIKMNIQALKMTTLGVIPTLKSEEAGWKILLGFSYLWKVARFKKSE

SEQ ID NO: 2783 - DNA, 981 bp, Streptococcus agalactiae
atggaattaatttcaataatagtgcctgtatataatggagaaatatatattgggagatgtctagatagtattcttgagcaaacttatcagaatttagagattatcataattgatgatggctctagtgatcgcacaggggatatttgcgaaaagtattttttggaagacaggcgaataaaatatttctatcaagaaaacagaggccaatcagttgcacgtaacaacggagtacttaggtgtacaggagattggattgcttttttagacagtgatgatgtttatcttccttattcaattgaggttatgtacaacatacagaaagctaccaatgccgatattgttttaactagtattggtaacttcaacaatacttacaatactagtattaattcacagtatttaaaagagattaaactttatactttagaggtggcgttggaagaaatgtattatgggaaaacttatggagtttccccgttagcaaaattatatccgagaagtaatttattgagtaatccatatccagaaggaaaaattcatgaagatatggatacaacttttaagcttatatcttgcgcttcaaaaatagcagtttgtgatattgtcactgcagtggtgtattttagcgataatagtactactaggacaaaattcaatgagagaatgttgtatttttttgaggcaattcaaaataatattgtatttataaatctaaattttccacataatacatctttaatctctgctgtaatatataatgaagtatttggtggaatagatatatgtgggaagatgattgattttaaattatatgatacagttgattattacagaaaaaaatatagaaaatattttaagactattctctttaataataggattagtgtgaaggagaaggttaaatatatattatttatttcctctataagatatttcactattgtaagaaaaatatataatttgaggttatcaaggaatgga

SEQ ID NO: 2784 - protein, 327 aa, Streptococcus agalactiae
MELISIIVPVYNGEIYIGRCLDSILEQTYQNLEIIIIDDGSSDRTGDICEKYFLEDRRIKYFYQENRGQSVARNNGVLRCTGDWIAFLDSDDVYLPYSIEVMYNIQKATNADIVLTSIGNFNNTYNTSINSQYLKEIKLYTLEVALEEMYYGKTYGVSPLAKLYPRSNLLSNPYPEGKIHEDMDTTFKLISCASKIAVCDIVTAVVYFSDNSTTRTKFNERMLYFFEAIQNNIVFINLNFPHNTSLISAVIYNEVFGGIDICGKMIDFKLYDTVDYYRKKYRKYFKTILFNNRISVKEKVKYILFISSIRYFTIVRKIYNLRLSRNG

SEQ ID NO: 2785 - DNA, 963 bp, Streptococcus agalactiae
atggataaagttagtatcattatcccagtttataacgttcaatctttcctaaacgagtgtatagaaagtgttttagctcaaacttattcaaatttagaaattattctagttaacgatggctctacagataattccggggatatctgtgattattattcagaaatagatgggcgtatattcgtttttcacaaaaataatggtggtttatcagatgctcgtaattatggaattagtagagctactggcgattatatttatttacttgattcggatgattatctatataaagaagatgcaatcgagagaatggttgaatttagcgagaaatataattcagaaattgttttagggtgttatgttgaaaaaagagaacaacatattataaatatcgttttagaagatgaaatgatagaaactattagtccagtacaagcaatacaaaatatttataattatgatgcctatagagctatttttactgtagcacataataaattatataagagagaattattttctacgctgtgctatccagtagggaagttacacgaagatgaatttttaacctataaattatatttgaaagccaaaaatataattttctttagatataatacttatgcatatcgtattagagaaaatagcataatgactggttcctacaatattaaaaggctacatgctgtagaagcacttaaggaaagaatttatttattagaaaagtatccagacttagtatttcaaagtgagagagctttaattaaaactatggaagtaaatttgatagagttatataaaaataatttttataaggaatttcatactctgaaaactgaatataaaaaaactatttttgattttataaaaaaacaacgtatgctactaaaaataaagtattatttaaagtattgtgtagtgcattttaaaatattaaattgtaaaagaaagaaaaagataaataaa

SEQ ID NO: 2786 - protein, 321 aa, Streptococcus agalactiae
MDKVSIIIPVYNVQSFLNECIESVLAQTYSNLEIILVNDGSTDNSGDICDYYSEIDGRIFVFHKNNGGLSDARNYGISRATGDYIYLLDSDDYLYKEDAIERMVEFSEKYNSEIVLGCYVEKREQHIINIVLEDEMIETISPVQAIQNIYNYDAYRAIFTVAHNKLYKRELFSTLCYPVGKLHEDEFLTYKLYLKAKNIIFFRYNTYAYRIRENSIMTGSYNIKRLHAVEALKERIYLLEKYPDLVFQSERALIKTMEVNLIELYKNNFYKEFHTLKTEYKKTIFDFIKKQRMLLKIKYYLKYCVVHFKILNCKRKKKINK

SEQ ID NO: 2787 - DNA, 1005 bp, Streptococcus agalactiae
atgtataaagtttcaattatttgcaccaattataacaaagctccttggatatctgatgcacttgacagttttttaagccaagtgacagattttgaggttgaaattattgttattgatgatgcttctacagatgactcacgagagattttaaagagttatcaaaaaaagtcttcaggaaaaattaaattactctttaacgaaactaatattggaataacaaagacttggataaaagcatgcctttatgcaaaaggcaaatatattgctagatgtgatggtgatgattactggacggatagttttaaactccaaaaacaagttgatgtcttagaagcttccaaacggtcacgatggtgtaatactgattttgactttgtaaatagtcaaggcgacttattatatgctaatgctttttcatctggtcatacacctttgacagatacttacgaaaaagttttagccttaaaagggatgacgatggcatcgacatggttagttgatgctgatttaatgagacaagtaaaccaaaaaatcaatgtagatacaccagacgatacttttgatattcaactagagttatttcaactgactcaactgacctatattaaagactcaacgacgatttatcgcatgacaaccgattctgattcaagacctactgatacaccaaaaatgatttatcgtattcaaaaactacttgatactcagttaaattacttaaaaaagtataatcaggtagatacaaaagaagtgtctgaactattattacaacaagatgctaagcaagaaatacgaattcatgagttgagttgctttattcaagaattacaacaaactatcgtagataaaacaaagcagcaagaaacacgtgaagtggagttgcaaaatgtcatagaagaacaaaaaaatcaactatctgaattaagacaacaataccatgccattattaattcacgtcaatggaaatacacgtctaagctcattgcttttattaggagaaaaaaa

SEQ ID NO: 2788 - protein, 335 aa, Streptococcus agalactiae
MYKVSIICTNYNKAPWISDALDSFLSQVTDFEVEIIVIDDASTDDSREILKSYQKKSSGKIKLLFNETNIGITKTWIKACLYAKGKYIARCDGDDYWTDSFKLQKQVDVLEASKRSRWCNTDFDFVNSQGDLLYANAFSSGHTPLTDTYEKVLALKGMTMASTWLVDADLMRQVNQKINVDTPDDTFDIQLELFQLTQLTYIKDSTTIYRMTTDSDSRPTDTPKMIYRIQKLLDTQLNYLKKYNQVDTKEVSELLLQQDAKQEIRIHELSCFIQELQQTIVDKTKQQETREVELQNVIEEQKNQLSELRQQYHAIINSRQWKYTSKLIAFIRRKK

SEQ ID NO: 2789 - DNA, 954 bp, Streptococcus pyogenes
atgaataattttgtgtgtcatactttataccatttactgattactataataaagttaaaagataaagaaaatactagaatatttatttgtgacactatcacgaattatgaaacttgggtaaaaacattaaatgaacagggaataaggacggaagcagttaaagagtttgcttatcgggagcagttacaaagtaaaaatattgaagaagtgatggagcttgtagattcagacttaaatcactactttgagagagtagatacacaagtctatctatttaatgatgatactttaataggtcgctatatggtgtatttgggtaaaaattatcatctaattgaagatggttataactgttttcaagccaagttattcttgggtggttctgtcgtaaaacgagtaattaaaacttacttatttaaaaagtatgttccgtatggtttttcaaaatattgtctctcaattgaggttaattctttagtggggctacctcatgacataaggagtaagaaatataaagaactaccgagaaaaaaattatttgatagtcttaacaaagagcaaaaatcactgattttcaaaatatttaaaacaaaaccattaactataactccaaagtcagtattattgttgacacagccacttgcacaagataaatgttataaaacacctacagagaggtttcaaagtattcaagagcaatacgattattttgacgatattgtccaggaatatagaacgttagggtacaatgtttatttaaaagttcatcctagagatgtagtagattattccaaattgccggtagagctattaccatcaaatatccctatggaaattatagagttgatgttaacaggacggttcgaatttgggataacacattcgtccaccgcgctggattttttaacttgtgttgataaaaaaataactttagtagatctgaaggatattaaa

SEQ ID NO: 2790 - protein, 318 aa, Streptococcus pyogenes
MNNFVCHTLYHLLITIIKLKDKENTRIFICDTITNYETWVKTLNEQGIRTEAVKEFAYREQLQSKNIEEVMELVDSDLNHYFERVDTQVYLFNDDTLIGRYMVYLGKNYHLIEDGYNCFQAKLFLGGSVVKRVIKTYLFKKYVPYGFSKYCLSIEVNSLVGLPHDIRSKKYKELPRKKLFDSLNKEQKSLIFKIFKTKPLTITPKSVLLLTQPLAQDKCYKTPTERFQSIQEQYDYFDDIVQEYRTLGYNVYLKVHPRDVVDYSKLPVELLPSNIPMEIIELMLTGRFEFGITHSSTALDFLTCVDKKITLVDLKDIK

SEQ ID NO: 2791 - DNA, 141 bp, Streptococcus agalactiae
atgaaaaatcaaaggaatagacacagtgacaatgaaccgaaaatacttaggattgtaaaaagatttgctatgataataaatataagcaaaggcaactattccagttattatagtaggaacaaaagctccaaaaaccctaga

SEQ ID NO: 2792 - protein, 47 aa, Streptococcus agalactiae
MKNQRNRHSDNEPKILRIVKRFAMIINISKGNYSSYYSRNKSSKNPR

SEQ ID NO: 2793 - DNA, 1398 bp, Streptococcus agalactiae
atgaatactaagaaattacttcaatctggttttatttatacactcgggaatttattggtgcaaggattagcctttatcacacttcccatctacactcgagtcatctcaacagaagtttatggccaatatagtttatatgttgcttggatgggaattattactctgtttattggtcttcagacgagcggttctttaagttcggctcgagtcaaatatggagaagagtttaaaagctactctgggagtgccttttctgtaggtaatatatggtttcttattgtacttttgatagcttttctatttagaagttttcttgcaccattagttggtttttctgaatctatttttttattaatggtgtgtcaaagttacgctaactatgtggtgactttctttggtcagtattttatacaacaacagaggagcttggctaatttaatactatccttagccaatgcagtttcatctgttgcactatctctatttttaatttttcattggtccgatgactttttatctagggtttttggagcttttgttcctactataataactggaatagttgcctttgcttatatttattatcatagcaaatctttttacaatcctaagtattttcggttcattgtcactgtgtctattcctttgatttttcatttgttaggacatcagttattaaatcaattagataggattatgctagctcgcttatatagtactaaagaagttgcaatgtatagtttcggttattcgcttggaatgattattcagattgttttgaatagtattaatatggcttggattccatggttttttgatgctagaaaagaaaaattactgcaactttcaacttatattagccgttatctctatttaggagttttcttaacattaggttatttgactgtttttcctgagttagctcaaataatgggaggagacaagtatagtagtagtgttcaatttatttctttaattattgtcagctattttttagtctttctctatacatttcctgtaaatatccaattcttctatgctaatacgacatggattcctattgggacattattagctgctggtgtaaattggttactaaaccttgtattaattcctcattatgcagcctatggcgctgctatggctacaataatatcttatttagccttgttgatttttcatcatattgtttcgaaagttaaataccattattcagatgtctcagttaggcagtacattattttaagtggtatagtatttagttatgctatgttaatgaacatgttcctaggtaatatcgttattagatggagtttaggaataattattcttatagtatatagcattgtttttcaaaaagtcattttagacttattgggtaaaaaaagaaggagaaga

SEQ ID NO: 2794 - protein, 466 aa, Streptococcus agalactiae
MNTKKLLQSGFIYTLGNLLVQGLAFITLPIYTRVISTEVYGQYSLYVAWMGIITLFIGLQTSGSLSSARVKYGEEFKSYSGSAFSVGNIWFLIVLLIAFLFRSFLAPLVGFSESIFLLMVCQSYANYVVTFFGQYFIQQQRSLANLILSLANAVSSVALSLFLIFHWSDDFLSRVFGAFVPTIITGIVAFAYIYYHSKSFYNPKYFRFIVTVSIPLIFHLLGHQLLNQLDRIMLARLYSTKEVAMYSFGYSLGMIIQIVLNSINMAWIPWFFDARKEKLLQLSTYISRYLYLGVFLTLGYLTVFPELAQIMGGDKYSSSVQFISLIIVSYFLVFLYTFPVNIQFFYANTTWIPIGTLLAAGVNWLLNLVLIPHYAAYGAAMATIISYLALLIFHHIVSKVKYHYSDVSVRQYIILSGIVFSYAMLMNMFLGNIVIRWSLGIIILIVYSIVFQKVILDLLGKKRRRR

SEQ ID NO: 2795 - DNA, 1023 bp, Streptococcus agalactiae
atggtttatattattgcagagattggttgcaatcataatggagatattaatcttgcgaaaaaaatggtagatgttgccgtgtcttgtggtgttgatgctgttaaatttcagacttttaaagctgagaaacttatttctaaatttgctcccaaagctgaatatcaaaaagcaactacaggaacagcagacagtcaacttgagatgacgaaacgtttagagttaagctttgaagaatacttagaaatgcgtgattatgcaatttcaaaaggtgtggagaccttttcaacaccttttgatgaagagtcattagagttcttaatttctacagatatgccaatttacaaaattccatcaggagaaatcactaatttaccttacttagaaaagattggcaagcaacaaaagaaagttattctttcgacgggtatggcggtaatggaagagatccatcaagcggtgaatattttacgtcagaatggtacaaccgacatttctattttacattgtacaacagagtacccaacaccttacccctctctaaatttaaacgttattcatactttgaaagatgaatttaaagatttaacgataggttattcggatcattcaattggatcagaagtacctatcgcagcagcagcaatgggtgcagaagttattgaaaaacactttactttagatactaatatggaaggtccggatcataaagccagtgcaacacctgatattttagctgctttagttaaaggggttcgcattgttgaacaagccttaggtagatttgaaaaaatcccagatccagtagaagaaaaaaataagattgttgctcgtaaatcagtcgttgctttaaaaccaattaaaaaaggcgatatttattcaatagaaaatattacggtgaagcgcccaggtaatggtatttctcctatgaactggtatgacatcttgggacaagaagcgcaagatgatttcgaagaggatgaagttattcgtgattcacgctttgaaaatcaattgcccgagtta

SEQ ID NO: 2796 - protein, 341 aa, Streptococcus agalactiae
MVYIIAEIGCNHNGDINLAKKMVDVAVSCGVDAVKFQTFKAEKLISKFAPKAEYQKATTGTADSQLEMTKRLELSFEEYLEMRDYAISKGVETFSTPFDEESLEFLISTDMPIYKIPSGEITNLPYLEKIGKQQKKVILSTGMAVMEEIHQAVNILRQNGTTDISILHCTTEYPTPYPSLNLNVIHTLKDEFKDLTIGYSDHSIGSEVPIAAAAMGAEVIEKHFTLDTNMEGPDHKASATPDILAALVKGVRIVEQALGRFEKIPDPVEEKNKIVARKSVVALKPIKKGDIYSIENITVKRPGNGISPMNWYDILGQEAQDDFEEDEVIRDSRFENQLPEL

SEQ ID NO: 2797 - DNA, 1152 bp, Streptococcus agalactiae
atgaaaaaaatttgtttagtaaccggatcgcgtgctgaatacggaataatgaagccattgattcaaagattgtcaaaagataaagaagtcaacttacaaattattgcaacagcaatgcatctggaagaaaagtacggctatacttatcgtcaaattgaagaagacggttttgatattgcttataaagttcccttacatctttatgatactgacagaagaactgtatctactgcaatggcgcatttacaactaggattgaccaaaatttttgacaaggaagactatgatctagtcatcattttaggggatcgttatgaaatgttaccagttgtgaatgtagcgttgatttataatgtcccagtatgccaccttcatggaggggagacctcattaggcaattttgatgagtatattcgccatgcaattactaagatgagtcacctacacttagtctctacagaggactttcgtcaacgtgtgattcagatgggagaacaacctcaatttgtaattaacacaggagctctcggagtggaaaatgctctatcaatcccttctctaaccaaagaagcaatagaaaagcaattaggtattgcactagaggaatcctattttgttgttctctatcatcctgttacttttgaacaaggaaaaagtgctggagagcagatgaaagcggtactatcagccctttctaagtttggtgtccagtgtctatttataggatccaattcagatactggttctgatgatattgcaaaggctatcaatacttatttgacaaatcatgaaaatagtcattgctttgcttctttatcaacccaactttatcattccttaattcgtcattcactaggactgattggtaattcgtcttctggtttaatagaagttccttctttgatgaaacctactcttaatattggtgatcgccaaaaaggtaggctacatggagaaagtgtagtaagtgtaccagtcgaaacctcctctgtattggagggattatcaaaattgaatgaagtgaccaactttgacaatccctactacaaagagaatgcttcatctattgcatatgaagcaataaagctgtatttgaaagatgaaccttcaatttcccaaccattttatgatttaaaggagaataatctaaaa

SEQ ID NO: 2798 - protein, 384 aa, Streptococcus agalactiae
MKKICLVTGSRAEYGIMKPLIQRLSKDKEVNLQIIATAMHLEEKYGYTYRQIEEDGFDIAYKVPLHLYDTDRRTVSTAMAHLQLGLTKIFDKEDYDLVIILGDRYEMLPVVNVALIYNVPVCHLHGGETSLGNFDEYIRHAITKMSHLHLVSTEDFRQRVIQMGEQPQFVINTGALGVENALSIPSLTKEAIEKQLGIALEESYFVVLYHPVTFEQGKSAGEQMKAVLSALSKFGVQCLFIGSNSDTGSDDIAKAINTYLTNHENSHCFASLSTQLYHSLIRHSLGLIGNSSSGLIEVPSLMKPTLNIGDRQKGRLHGESVVSVPVETSSVLEGLSKLNEVTNFDNPYYKENASSIAYEAIKLYLKDEPSISQPFYDLKENNLK

SEQ ID NO: 2799 - DNA, 627 bp, Streptococcus agalactiae
atgaaaaaaaagttggcatttttaggcgcaggaagtcatgctgatgcgattgctccggttattgatcctcttgtgtatgatttcgtaggtttttttgatgataaagatattacggagcatgatggttatcctgttcttggaaaactttatgatgtgctaccttaccttgaagatggctcaatagatgcagtatttattacaataggtgataatgctaaaaggaaagaactatttgaatatgtagcaaaggattattatgactttattattaacatcattagtcccaatgctttagtattgacaccagatagtatttgtggacgtggtatctttattggttttggggcttttataggttctaaagtgaagctgtttgataacaatgttgttaatacaggagcgctcattgaacatcatactgttgtagaatcacactgtaatatagcacctaatgctaccataaatggtctttgttatattagagaagaagtttatgtaggtagtgccagtgttattattcaaaccttggatatttcatcatgtacgacaattggagcaggagctgttgttgtaaaagatattatagaacctggaacctatgtaggggttccagccaaaaaaataaaa

SEQ ID NO: 2800 - protein, 209 aa, Streptococcus agalactiae
MKKKLAFLGAGSHADAIAPVIDPLVYDFVGFFDDKDITEHDGYPVLGKLYDVLPYLEDGSIDAVFITIGDNAKRKELFEYVAKDYYDFIINIISPNALVLTPDSICGRGIFIGFGAFIGSKVKLFDNNVVNTGALIEHHTVVESHCNIAPNATINGLCYIREEVYVGSASVIIQTLDISSCTTIGAGAVVVKDIIEPGTYVGVPAKKIK

SEQ ID NO: 2801 - DNA, 1239 bp, Streptococcus agalactiae
atgaagccaatttgtattattcctgcgcgatcagggtcaaaaggattaccagataagaatatgttattcctatctggtaaacccatgattttccatactatagatgctgcaattgaatctggaatgtttgataagaaagatatttttgttagtacagattcagaattgtacagagagatttgtttagaacgcggtatttcagtggtgatgagaaaaccggaactttcaactgatcaggcaacttcgtatgatatgttaaaagattttttatctgactatgaagataatcaggagtttgtgttacttcaagtaacttctccactaagaaaatcatggcatataaaggaagcaatggagtattattcttcacatgatgttgacaatgttgtaagtttttctgaagttgagaaacaccctagtctgtttacaacattatctgatgaaggctatgctatagatatggtgggagcagataaaggttatcgtcgccaagatttacaacctttatactatccgaacggcgctatttttatttctaataaagaaacttacttaagggaaaaaagctttttcacctctaggacatatgcttatcaaatggcaaaggaattttcattagatgttgatacgagagatgattttatccacgtcatcggtcacctctttttcgattatgccattagggaaaaagagaataaagttttttataaagaaggctatagtcgtttgttcaatagagaagcttcaaagataattttaggtgattcaaaaacgatatctacctcactagaaagttaccataattattcccaaggtggtgtaacattagcaacgatgttggaaaacttacctaactttttgacagctaatgtaacagaggcttttgtttctataggggtaaatgatctcattacaggttatagtgtggaagaaatattcagcaatttccaaaaactctactcattattagctgagaataaaataaagatgagattgacaactattgcttacaccctttttagagaaactgtcaataatgcagatattgagaaaatcaatcaatggctaacagaattttgttatcaaaatcagattccactgttagatattaatagatttttatcaaaggatggtaatctaaattatcatttaactagtgatggattgcattttactcaagaggctaatgatttgttacaaagtcaatatcaattatttgtagacgaagttaaaacctta

SEQ ID NO: 2802 - protein, 413 aa, Streptococcus agalactiae
MKPICIIPARSGSKGLPDKNMLFLSGKPMIFHTIDAAIESGMFDKKDIFVSTDSELYREICLERGISVVMRKPELSTDQATSYDMLKDFLSDYEDNQEFVLLQVTSPLRKSWHIKEAMEYYSSHDVDNVVSFSEVEKHPSLFTTLSDEGYAIDMVGADKGYRRQDLQPLYYPNGAIFISNKETYLREKSFFTSRTYAYQMAKEFSLDVDTRDDFIHVIGHLFFDYAIREKENKVFYKEGYSRLFNREASKIILGDSKTISTSLESYHNYSQGGVTLATMLENLPNFLTANVTEAFVSIGVNDLITGYSVEEIFSNFQKLYSLLAENKIKMRLTTIAYTLFRETVNNADIEKINQWLTEFCYQNQIPLLDINRFLSKDGNLNYHLTSDGLHFTQEANDLLQSQYQLFVDEVKTL

SEQ ID NO: 2803 - DNA, 489 bp, Streptococcus agalactiae
ttgagtatgagagaaactgaaacacacgatcaccaagcgctaattcaaaaattgttagtcagtattcattatttaaccttgtttcgtgatgaaattatattagtagaaaaaaccccatctttactggggaaacatttttctattgctattgtgcagaatgaactaggtgagatactttctaaaatagaagctttgagtaagcaaaaaaaactgattcgttctatttattggtatgatgaatcgtcatttaaagttatgaataaggctctggctattgtagaagaatggattaagggcttagataatcttttagaattctgtcaatcacagacggtttttcaagcaattttaggtgatgaacgtgcacatgtatttggaatccttattgatgtttatacttctttaaacattataaatacttctttgaaagaagaaaattctagaccagtgtccttatctgatttggctctaggtcttaaggacgaagat

SEQ ID NO: 2804 - protein, 163 aa, Streptococcus agalactiae
MSMRETETHDHQALIQKLLVSIHYLTLFRDEIILVEKTPSLLGKHFSIAIVQNELGEILSKIEALSKQKKLIRSIYWYDESSFKVMNKALAIVEEWIKGLDNLLEFCQSQTVFQAILGDERAHVFGILIDVYTSLNIINTSLKEENSRPVSLSDLALGLKDED

SEQ ID NO: 2805 - DNA, 534 bp, Streptococcus pyogenes
gtgaatgttactgaacaaaatagtcatcaaatcttaatccaaaagttattggtcagtatccactatttgactctttttcgagatgaactgaagcttgtagaacgaactccttctatacttggaggggaatttccagctcatttagtacagtctgagttgggagatattgttgcggccattgataccttggatatgcagcaacgcttgattgagtctaccttttggtatgaagaatcagcttttaagttgatgaacaaaactttggatattgtcgataattggattaaaggagtggatcatctgatagatttatgccagtccaaagaagtctttcaaattattattggagataaacgcattcgagtttttggggtcttaagtgatgttttttcatctttaaaagtgagtgctttgtcacttaaggaagctcctattccggatgtgctctatgaacatatccagagggttaatcttgaagaagaagcttttataaaatattaccaaagccctaaggtacccacaggtgagtttgaa

SEQ ID NO: 2806 - protein, 178 aa, Streptococcus pyogenes
VNVTEQNSHQILIQKLLVSIHYLTLFRDELKLVERTPSILGGEFPAHLVQSELGDIVAAIDTLDMQQRLIESTFWYEESAFKLMNKTLDIVDNWIKGVDHLIDLCQSKEVFQIIIGDKRIRVFGVLSDVFSSLKVSALSLKEAPIPDVLYEHIQRVNLEEEAFIKYYQSPKVPTGEFE

SEQ ID NO: 2807 - DNA, 651 bp, Streptococcus agalactiae
atgaaacattctagttggcatgatttaataaaaagagaactacccaatcattactacaataaaattaatacatttatggatgcagtttacgaaagcggaatcgtttatcctccaagagataaggtgttcaatgccatacagataacaccactagaaaacgtaaaagtagtgattattggccaagatccttaccatggacctcaacaagctcaaggactctcattttctgttccagacaatttaccagctcctccttcacttcaaaatattctaaaagaattagcagaagatatcgggtcacgttcacatcatgacttaacatcatgggcgcaacaaggagtgctgctattaaatgcttgtttaacagttccagaacaccaagctaatggtcatgctgggcttatatgggaaccttttactgatgctgtcatcaaagtggttaaccaaaaggaaacaccagtagtctttattctgtggggtggctatgctcgaaagaaaaagtcgctaattgataatcctattcatcatattattgagagtcctcatccgagtcccttatctgcttatcgtggcttctttggtagcagacctttttctagaacaaatcatttcttagaagaagaaggaataaatgagattgattggttaaat

SEQ ID NO: 2808 - protein, 217 aa, Streptococcus agalactiae
MKHSSWHDLIKRELPNHYYNKINTFMDAVYESGIVYPPRDKVFNAIQITPLENVKVVIIGQDPYHGPQQAQGLSFSVPDNLPAPPSLQNILKELAEDIGSRSHHDLTSWAQQGVLLLNACLTVPEHQANGHAGLIWEPFTDAVIKVVNQKETPVVFILWGGYARKKKSLIDNPIHHIIESPHPSPLSAYRGFFGSRPFSRTNHFLEEEGINEIDWLN

SEQ ID NO: 2809 - DNA, 651 bp, Streptococcus pyogenes
atggctcattcaatttggcatgagaaaatcaaatcatttttgccggagcattactacggtcgcatcaatcactttttagatgaagcctatgcttccggtcttgtctatcctccacgagaaaatgtctttaaagccttacaagtcactcctttggaagaaaccaaagtgttgattttaggacaagacccttatcatggccccaaacaggcccagggcttatcattttcagttccagaagagatttctgctccgccatcccttattaatattttaaaagaattagcagatgacattggtcctcgtgaccatcatgatttaagcacttgggctagtcaaggggttctgcttttgaatgcttgcttaacagtgccagcaggccaggctaatgggcatgcaggcttaatatgggagccatttacagatgctgttattaaagtgctgaatgagaaagacagccctgtagttttcattttgtggggagcttatgcaaggaagaaaaaagccttcattactaatccaaagcaccacatcatcgagagccctcatccaagccctttgtcatcttatcgtggcttttttggcagcaaacccttttcaagaaccaatgctattttagaaaaagagggcatgactggcgtagattggctaaaa

SEQ ID NO: 2810 - protein, 217 aa, Streptococcus pyogenes
MAHSIWHEKIKSFLPEHYYGRINHFLDEAYASGLVYPPRENVFKALQVTPLEETKVLILGQDPYHGPKQAQGLSFSVPEEISAPPSLINILKELADDIGPRDHHDLSTWASQGVLLLNACLTVPAGQANGHAGLIWEPFTDAVIKVLNEKDSPVVFILWGAYARKKKAFITNPKHHIIESPHPSPLSSYRGFFGSKPFSRTNAILEKEGMTGVDWLK

SEQ ID NO: 2811 - DNA, 636 bp, Streptococcus agalactiae
atgaatattataattatgattatcattgcctatctgttaggctctatccaaactggactttggattggtaaatatttttaccaagtcaatcttcgtcaacacggtagtggtaatactggcaccacgaataccttccgtattttaggtgtaaaagctggcattgtcactttgactattgacattttaaaagggactctagcaacacttattcctatcatattaggtataacgacagtatctccattttttatcggtttttttgctattataggtcacactttccctatttttgcacaattcaaaggtgggaaagccgttgctacaagcgctggggttttgctaggatttgcaccttcttttttcctttacttattagttatctttttattaacgctttatctttttagcatgatttccctatccagtattacagtagctgttgtaggtattcttagtgtcttaatttttccattagtaggctttatattaacggactacgactggatatttaccactgtggttatcttaatggccctaacgattattatccgacatcaggataatatcaaacgtattcgaaaaaggcaagaaaatttggttccgtttggcttaaacctaagtaaacaaaaaaataaa

SEQ ID NO: 2812 - protein, 212 aa, Streptococcus agalactiae
MNIIIMIIIAYLLGSIQTGLWIGKYFYQVNLRQHGSGNTGTTNTFRILGVKAGIVTLTIDILKGTLATLIPIILGITTVSPFFIGFFAIIGHTFPIFAQFKGGKAVATSAGVLLGFAPSFFLYLLVIFLLTLYLFSMISLSSITVAVVGILSVLIFPLVGFILTDYDWIFTTVVILMALTIIIRHQDNIKRIRKRQENLVPFGLNLSKQKNK

SEQ ID NO: 2813 - DNA, 720 bp, Streptococcus pyogenes
ttgcaaaataatttgctaattttttccgaattcttttccagatctagttctccaatctatgaatatgttataataaggattatgaaattactactttttattaccattgcctatttacttggttctattccaactggactatggattggacagtacttttaccacatcaacttacgagagcatggatcaggaaatactggaaccacaaatacttttcggattttaggtgtcaaggcaggaacagctaccttagctattgatatgtttaaagggacactttcaatattgttaccaattatttttggtatgacttcaatttcatccattgctatcggctttttcgcagttttagggcatacttttcctatttttgccaactttaaaggtggtaaggccgtagcaacaagtgctggtgtattgctaggctttgctccgttatatctcttttttttagcatctatctttgttttagttctctatttatttagtatgatatctttagctagtgtggtttcagctatcgttggtgtgttatctgttttaacatttcctgccattcattttcttttaccaaattatgactactttttaacttttattgtgatattacttgcgttcattattattataagacacaaagataacattagtcgtatcaaacatcatactgaaaatctaataccttgggggctaaatttaagcaaacaagtgcctaaaaaa

SEQ ID NO: 2814 - protein, 240 aa, Streptococcus pyogenes
LQNNLLIFSEFFSRSSSPIYEYVIIRIMKLLLFITIAYLLGSIPTGLWIGQYFYHINLREHGSGNTGTTNTFRILGVKAGTATLAIDMFKGTLSILLPIIFGMTSISSIAIGFFAVLGHTFPIFANFKGGKAVATSAGVLLGFAPLYLFFLASIFVLVLYLFSMISLASVVSAIVGVLSVLTFPAIHFLLPNYDYFLTFIVILLAFIIIIRHKDNISRIKHHTENLIPWGLNLSKQVPKK

SEQ ID NO: 2815 - DNA, 102 bp, Streptococcus agalactiae
gtgacctccaaattttttcatcttttttatattacaagttttttgctgtttttgcaaaattatttttttaaaaatagcaaaaagacttttatgcttatgtta

SEQ ID NO: 2816 - protein, 34 aa, Streptococcus agalactiae
MTSKFFHLFYITSFLLFLQNYFFKNSKKTFMLML

SEQ ID NO: 2817 - DNA, 1959 bp, Streptococcus agalactiae
ttggaggtcactttggctaaacaagatataacagtgacgaattatggcgacgatgctattcaagtcttagaaggattagatgctgttcgtaagcgtccagggatgtatatcggttccacagatggaactggtttacatcatttagtgtgggaaattgtagataatgcagttgatgaagctctatcaggttttggaaatcgcattgatgttattattaacaaagatgggagtataactgttacagaccatggacgcggtatgccaactggaatgcatgctatgggaaaacctactgttgaagtcatcttcacggtgcttcatgcaggtggaaaatttggacaaggtggttataaaacatcaggtggtctccatggtgttggatcatctgtagttaatgctttgtcttcttggttagaagttgaaatcattcgcgacggagctatttacagacaacgttttgaaaatggtggtaagcccgttacaactctgaaaaaaattggcacggcaccaaaatcaaaatctggaacttctgtcagctttatgccagatcaatcagtattttcaacgatagattttaagtttaatacaattgcagagcgcttaaaggaatctgcttttctcttaaaaaatgttactttaaccttaacagataatcgttcagaagaagcagagcatctagaatttcattatgaaaacggtgttcaagattttgtagagtatttaaatgaagataaagaaacgttgacaccaatcatgtttttcgaaggtgaagaacaagaatttcatatcgaagttgctttgcagtataatgatggtttttcagataatatcctttcttttgtcaataatgttcgtactaaagatggtggaacacatgaaactggcttgaaatcagctattacaaagtctatgaatgactatgcacgtaaaacaggacttcttaaagaaaaagataaaaaccttgaaggttctgattatcgtgaggggctatcagccattttatctattcttgtacctgaggagcacttgcaatttgaaggtcaaactaaagataaactaggaagtcccttagcacgaccaattgttgatggtattgtttctgaaaagttaacttactttcttatggaaaatggagatttagcatctaatttaatccgtaaggcaataaaagcacgtgatgcgcgtgaagctgcacgtaaagcacgtgatgaaagtaggaatgggaaaaagtcgaaaaaagataaaggtctactttctggaaaattaacccctgcacaatcaaaaaatgctaagaaaaatgaactctatttagtcgaaggagactctgcaggtggctctgctaagcaaggtcgtgatagaaagtttcaagctattttaccgttgcgaggaaaagtattgaatacagctaaggcaaagatggctgatattataaaaaacgaagaaattaatacaatgatccataccattggtgcaggtgttggtcctgattttaatcttgacgatattaattatgataaaattatcattatgaccgatgctgatactgacggagctcatattcagacactattattaactttcttttatcgctatatgagacctcttgttgaagagggacatgtctatattgctttgccacctttgtataaaatgtcaaaaggaaaaggtaagaaagaaattgttgagtatgcttggacggatatagagttagaagaattacgacaaaaatttggtaaaggctcactattacaacgatataaagggcttggggaaatgaatgccgatcaattgtgggaaaccactatgaaccctgagacaaggacattaattcgtgtaacaattgaagatttagcaagagcagaacgtcgagttaatgtcttgatgggtgataaagttcctccaagacgccaatggattgaagataatgtcaagtttactttagaagagaatacagtattt

SEQ ID NO: 2818 - protein, 653 aa, Streptococcus agalactiae
MEVTLAKQDITVTNYGDDAIQVLEGLDAVRKRPGMYIGSTDGTGLHHLVWEIVDNAVDEALSGFGNRIDVIINKDGSITVTDHGRGMPTGMHAMGKPTVEVIFTVLHAGGKFGQGGYKTSGGLHGVGSSVVNALSSWLEVEIIRDGAIYRQRFENGGKPVTTLKKIGTAPKSKSGTSVSFMPDQSVFSTIDFKFNTIAERLKESAFLLKNVTLTLTDNRSEEAEHLEFHYENGVQDFVEYLNEDKETLTPIMFFEGEEQEFHIEVALQYNDGFSDNILSFVNNVRTKDGGTHETGLKSAITKSMNDYARKTGLLKEKDKNLEGSDYREGLSAILSILVPEEHLQFEGQTKDKLGSPLARPIVDGIVSEKLTYFLMENGDLASNLIRKAIKARDAREAARKARDESRNGKKSKKDKGLLSGKLTPAQSKNAKKNELYLVEGDSAGGSAKQGRDRKFQAILPLRGKVLNTAKAKMADIIKNEEINTMIHTIGAGVGPDFNLDDINYDKIIIMTDADTDGAHIQTLLLTFFYRYMRPLVEEGHVYIALPPLYKMSKGKGKKEIVEYAWTDIELEELRQKFGKGSLLQRYKGLGEMNADQLWETTMNPETRTLIRVTIEDLARAERRVNVLMGDKVPPRRQWIEDNVKFTLEENTVF

SEQ ID NO: 2819 - DNA, 1950 bp, Streptococcus pyogenes
gtgttgactaagaaagaaattacaattaataattataatgacgatgctatccaagtcctagaagggttagatgctgttcgcaagcgtccagggatgtatatcggttcaacagatgctacgggattgcaccacctgatttgggaaattgttgataatgctgtcgatgaggccttgtctggttttggagatgatattaaggttgttatcaataaagatggctcggtcagtgtggcagatagcggacgtggaatgccaacaggccagcatgccatggggattcccaccgttcaagttatttttacgattcttcatgcaggtggtaaatttggtcagggtggctacaaaacgtcaggtggtttgcacggtgttggctcctctgttgtcaatgctttgtctgcctggttagaagtcgaaatcacaagagacgggtcagtgtatcgtcagcgctttgaaaatggtgggaaacctgttacaacccttaaaaaagttggcacagctcctaagtctaaatcaggaacggttgtaacctttatgcctgatgataagattttttcaactattgactttaagttcaataccatttcagaacgattgaaagaatctgcttttcttttgaaaaatgtcaagatgagcttgacagatcttcgtggagatgacccgattattgaagagtttcattatgaaaatggggttcaagatttcgtcgaatacctcaatgaagataaggaaaccttgacacctgttatttacatggaaggtcaagaccaagactttcaagtcgaggttgctttgcagtataacgatggtttctccgacaatatcttatcctttgtaaacaatgtgcgcaccaaagatggtggaagccatgaaacgggactaaagtcagctattaccaaagcgatgaatgactatgctcgtaaaaccaatctcttaaaagaaaaggataaaaatctagagggctcagattatcgagaaggactctcagcagtattatctatcttagttcctgagcagcacttgcaatttgaaggacagaccaaagacaaattgggaagtcccttagctagacctattgtagagagcattgtttctgaaaaattaaccttctttttactcgaaaatggagaagtagcttctcatctagttcgcaaagccattaaagctagagatgctcgcgaagctgctcgaaaagcgcgtgatgactcacgtaatggtaagaaaaacaaaaaagacaaaggcttgttgtcgggaaaactaaccccagctcagtccaaaaatgccaagaaaaatgaattgtatctggtcgaaggagattctgcgggaggttcagccaaacaaggacgagaccgcaaatttcaggctattttaccattacgtggcaaagttttaaataccgaaaaagctaagatggctgacatcttgaaaaatgaagaaattaacactatggtttataccattggagctggagtgggagctgactttaacctcgaggatatcaactatgataagattattatcatgaccgatgctgataccgatggggctcatattcagactcttttgctgactttcttttaccgttatatgcgaccgttggtggaagcaggtcacgtttatattgcgcttcccccgctttacaaaatgtcaaaaggtaaaggcaaaactgaaaaaattgcttatgcttggactgatggtgaattggaagatctgcgcagagaatttggcaagggggctattcttcaacgctataaaggactgggtgaaatgaatgctaaccaattatgggaaaccactatggaccctgaaaccagaacccttattcgtgttactattgacgacttggcaagagcagagcgacgtgtttctgtgttgatgggtgacaaagcagccccacgccgtcagtggatcgaggataacgtcaagtttaccttagaagaaaatacggtgttt

SEQ ID NO: 2820 - protein, 650 aa, Streptococcus pyogenes
VLTKKEITINNYNDDAIQVLEGLDAVRKRPGMYIGSTDATGLHHLIWEIVDNAVDEALSGFGDDIKVVINKDGSVSVADSGRGMPTGQHAMGIPTVQVIFTILHAGGKFGQGGYKTSGGLHGVGSSVVNALSAWLEVEITRDGSVYRQRFENGGKPVTTLKKVGTAPKSKSGTVVTFMPDDKIFSTIDFKFNTISERLKESAFLLKNVKMSLTDLRGDDPIIEEFHYENGVQDFVEYLNEDKETLTPVIYMEGQDQDFQVEVALQYNDGFSDNILSFVNNVRTKDGGSHETGLKSAITKAMNDYARKTNLLKEKDKNLEGSDYREGLSAVLSILVPEQHLQFEGQTKDKLGSPLARPIVESIVSEKLTFFLLENGEVASHLVRKAIKARDAREAARKARDDSRNGKKNKKDKGLLSGKLTPAQSKNAKKNELYLVEGDSAGGSAKQGRDRKFQAILPLRGKVLNTEKAKMADILKNEEINTMVYTIGAGVGADFNLEDINYDKIIIMTDADTDGAHIQTLLLTFFYRYMRPLVEAGHVYIALPPLYKMSKGKGKTEKIAYAWTDGELEDLRREFGKGAILQRYKGLGEMNANQLWETTMDPETRTLIRVTIDDLARAERRVSVLMGDKAAPRRQWIEDNVKFTLEENTVF

SEQ ID NO: 2821 - DNA, 2457 bp, Streptococcus agalactiae
atgtctaatattcaaaatatgtcccttgaggacattatgggagagcgttttgggcgctattctaagtatatcattcaagaacgggcgttgccggatattcgtgatggcttaaaacctgttcaacgtcgaatcctttattcaatgaataaagatggtaatacttttgaaaagggatttcgcaaatctgcaaaatcagtcggtaatgttatggggaatttccatcctcatggggattcctctatctatgacgcgatggttcgtatgtctcaagattggaaaaatcgtgagacattgattgaaatgcacggaaataatggttctatggatggagatcctgcggcggctatgcgttatacggaagcccgtctatcagaaattgctggttatcttcttcaagatattgataagaataccgtaccctttgcgtggaattttgatgatacagagaaagaaccaactgttttaccagctgcctttcccaatcttttagtcaacggagcaacaggaatatctgcaggctatgcgacagatattccaccacataatctagcagaagtcattgatgctgtcgtgtacatgattgatcaccctaaagctaaattagataaattaatggaatttctacctggtccagattttccaactggcgctatcattcaaggaaaagatgaaattcgtaaggcatatgagactggtaaggggagagtagcggttcgctcgcgaactgctattgaaaccttaaaaggtggtaagaaacaaattattgttactgaaattccttatgaagttaataagtcagttttagtaaaacgaatcgatgatgttcgtgttaataataaagttccaggaatagcagaggtgcgtgatgagtctgatagagatggtcttcgtatcgctattgagctcaaaaaagaagccgatgaaacaattgtcttaaattatctttttaaatatacagacctacaagttaattataatttcaatatggttgctattgatgactacacccctaagcaggtgggtctatcaagaatattaactagctatatcgctcaccgaagagaaattattattgctcgttcaaaatttgataaagaaaaagccgaaaaacgtctccatattgttgagggactgattagggttctttctattttggatgaagtgattgcattaattcgtgcttctgagaataaagctgatgcgaaagagaatttgaaggtcagctatgagttttcagaagctcaagcagaggctatcgtcacattgcaattatatcgtctcacaaatactgatattgtgacgttgagagaagaagaagaagaacttcgtcaacaaatcacaatgcttaaggcaattattagtgatgaacgtacgatgtataacgtaatgaaacgtgagttacgtgaggtcaaaaagaaatttgccaatactagacgttctgaacttcaagaattagctgaaactattgaaatcgatactgcaagtttaattatcgaagaggacacatacgtcagtgttactagaggcggatatgtaaaacgcaccagccctcgctctttcaatgcatcaactgttgatgaacttggtaagcgagaagatgacgaattgatatttgtgagcaatgcaaagactacccaacatttattgatgtttactaaccttggtaatcttgcttatcgtccagttcatgaattagctgatattcgatggaaagacgttggtgaacatttatcacaaaatcttgttaactttgcttcaaatgaagaaattatttatgctgaattagtagatgattttactaaagaaacttattttgctgtcactagcttagggcaaataaagcgttttgaacgtcaagaaatcagtccatggcggacatataagtcaaaaacagctaaatatgctaagttaaaaagtgtagaggattatgttgtgactgttgcccctatccaattagaggatgttatacttgtcacttataatggttatgcgttgagatttagtataaatgatgtaccagtcgtcggtagtaaagccgcaggtgtaaaagcgatgaatttaaaagatcgtgatcacatcgtatctgcatttatagctaacaccacaagtttatatttattaactcatagaggaagtcttaaacgaatggccattgatgttatccccacaactagtcgtgctaatcgaggacttcaagttcttcgtgaattgaaatccaaaccgcatcgcgtttttaaagcaggacctgtatatttagaggattcatcttttgaatttgatttatttagttcagtatcgaatcatgaaggagatactttcgtacttgagattatgtctaaaacaggaaaagtttacgatgttgatttaagtcaatggagtttttctgaacgtacaagtaatggctcttttgtatctgataagatttctgacgaagaagtattctcagttaaaattaag

SEQ ID NO: 2822 - protein, 819 aa, Streptococcus agalactiae
MSNIQNMSLEDIMGERFGRYSKYIIQERALPDIRDGLKPVQRRILYSMNKDGNTFEKGFRKSAKSVGNVMGNFHPHGDSSIYDAMVRMSQDWKNRETLIEMHGNNGSMDGDPAAAMRYTEARLSEIAGYLLQDIDKNTVPFAWNFDDTEKEPTVLPAAFPNLLVNGATGISAGYATDIPPHNLAEVIDAVVYMIDHPKAKLDKLMEFLPGPDFPTGAIIQGKDEIRKAYETGKGRVAVRSRTAIETLKGGKKQIIVTEIPYEVNKSVLVKRIDDVRVNNKVPGIAEVRDESDRDGLRIAIELKKEADETIVLNYLFKYTDLQVNYNFNMVAIDDYTPKQVGLSRILTSYIAHRREIIIARSKFDKEKAEKRLHIVEGLIRVLSILDEVIALIRASENKADAKENLKVSYEFSEAQAEAIVTLQLYRLTNTDIVTLREEEEELRQQITMLKAIISDERTMYNVMKRELREVKKKFANTRRSELQELAETIEIDTASLIIEEDTYVSVTRGGYVKRTSPRSFNASTVDELGKREDDELIFVSNAKTTQHLLMFTNLGNLAYRPVHELADIRWKDVGEHLSQNLVNFASNEEIIYAELVDDFTKETYFAVTSLGQIKRFERQEISPWRTYKSKTAKYAKLKSVEDYVVTVAPIQLEDVILVTYNGYALRFSINDVPVVGSKAAGVKAMNLKDRDHIVSAFIANTTSLYLLTHRGSLKRMAIDVIPTTSRANRGLQVLRELKSKPHRVFKAGPVYLEDSSFEFDLFSSVSNHEGDTFVLEIMSKTGKVYDVDLSQWSFSERTSNGSFVSDKISDEEVFSVKIK

SEQ ID NO: 2823 - DNA, 2463 bp, Streptococcus pyogenes
ttgaatatgtcaaacattcaaaacatgtcccttgaggatattatgggagaacgcttcggccgttattccaagtatattattcaggaacgggcacttcctgatattcgagatggattgaaacccgttcagcgtcggattctttattcgatgaataaggatggcaatacttttgaaaaaggttaccgtaaatcagccaaatcagttggtaatattatggggaatttccacccacatggggattcctctatttatgatgccatggtacggatgagtcaagattggaagaaccgtgaaatccttgttgaaatgcacggaaataatggttcaatggatggtgatccgcctgcggctatgcgttatacagaagctcgcttgtctgaaattgcgggttatcttcttcaagacattgagaaaaatacggtctcttttgcttggaactttgatgacacagaaaaagaacccaccgttttaccagcagcttttcctaacttacttgtcaatgggtcttctggtatttccgcaggctatgcgacagatattccaccgcacaatttgtcagaagtgattgatgctgttgtgtatatgattgatcatcccaaagctagtttagagaaattaatggagtttttaccaggaccagatttcccgacaggaggcattatccaaggagctgacgaaatcaaaaaagcctacgaaacaggtaagggacgtgtcgttgttcgctctaggacagaaatcgaggaacttaaaggtggtaaacaacaaattattgtcactgagattccttatgaagttaacaaagcagtcttggtcaaaaagattgacgatgtgcgtgttaacaataaagtcccaggcatcgtagaagtacgcgatgaatctgatcgcacaggtcttcgcatagctattgagttgaaaaaagaggctgatagccaaaccattctaaattatttgttgaaatacacagaccttcaagttaattataattttaacatggttgctattgaccacttcacaccacgtcaagtaggacttcaaaaaatactatcaagctatatcagtcaccgtaaagatattattattgagcggtctaaattcgataaagccaaagctgaaaaacgcctccacattgttgaaggattgattcgtgtcttgtccatcttagatgagattattgctttgattagatcgtctgacaataaggctgatgctaaagaaaatctgaaagtcagctatgatttctctgaggaacaagcagaagcgattgtaaccttgcagctttatcgtttaactaataccgatattgttactctccaaaatgaagaaaatgatttaagagacttaatcacgaccctttccgctattatcggtgacgaagcaaccatgtataacgtcatgaaacgtgaattaagagaggtgaaaaagaaattcgccaatcctcgtttatcagagttacaagcagaaagtcaaatcattgagattgacactgccagcttgattgcagaggaagaaacttttgttagtgtgacacggggcggatacctcaaaagaaccagcccacgatccttcaatgcgtctagtttggaagaagttggcaagagagatgatgacgaactcatcttcgttaaacaggccaaaacaacagaacaccttttgttatttacaactttaggcaatgtcatttaccggccaatccatgaattgaccgatttacgttggaaggatatcggtgaacatttatcacaaaccatttcaaacttcgcgacagaagaagagattctctacgctgatattgtgacttcctttgaccagggcttgtatgtggctgtcacacaaaatggttttatcaaacgctttgatcgtaaagaactaagtccttggcgaacttataaatctaaatcaaccaaatatgtgaagctaaaggatgacaaagaccgcgtggttaccttgtcaccagttattatggaagacctcctattagtgactaaaaatggttatgctttgcgattctccagtcaggaagtgcctattcaagggttgaaatctgctggtgttaaaggcattaacttgaaaaacgatgacagccttgcctcagcctttgctgtgacaagtaactctttctttgtcttaactcagaggggttctctcaaacggatggctgtcgatgatattcctcagacaagtcgtgccaatcgtggactattggtcctacgagagttaaaaaccaaacctcatagagtttttctggccggaggcgttcaatcagatacttcagctgagcagtttgatttgttcactgatatacctgaagaagaaactaatcaacaaatgcttgaagtcattagtaagactggtcaaacctacgagattgctttagaaacgctttcgttatcggaaagaatcagcaacggctcctttatttcagacactatttcggatcaagaagtactggtagctagaacacgt

SEQ ID NO: 2824 - protein, 821 aa, Streptococcus pyogenes
LNMSNIQNMSLEDIMGERFGRYSKYIIQERALPDIRDGLKPVQRRILYSMNKDGNTFEKGYRKSAKSVGNIMGNFHPHGDSSIYDAMVRMSQDWKNREILVEMHGNNGSMDGDPPAAMRYTEARLSEIAGYLLQDIEKNTVSFAWNFDDTEKEPTVLPAAFPNLLVNGSSGISAGYATDIPPHNLSEVIDAVVYMIDHPKASLEKLMEFLPGPDFPTGGIIQGADEIKKAYETGKGRVVVRSRTEIEELKGGKQQIIVTEIPYEVNKAVLVKKIDDVRVNNKVPGIVEVRDESDRTGLRIAIELKKEADSQTILNYLLKYTDLQVNYNFNMVAIDHFTPRQVGLQKILSSYISHRKDIIIERSKFDKAKAEKRLHIVEGLIRVLSILDEIIALIRSSDNKADAKENLKVSYDFSEEQAEAIVTLQLYRLTNTDIVTLQNEENDLRDLITTLSAIIGDEATMYNVMKRELREVKKKFANPRLSELQAESQIIEIDTASLIAEEETFVSVTRGGYLKRTSPRSFNASSLEEVGKRDDDELIFVKQAKTTEHLLLFTTLGNVIYRPIHELTDLRWKDIGEHLSQTISNFATEEEILYADIVTSFDQGLYVAVTQNGFIKRFDRKELSPWRTYKSKSTKYVKLKDDKDRVVTLSPVIMEDLLLVTKNGYALRFSSQEVPIQGLKSAGVKGINLKNDDSLASAFAVTSNSFFVLTQRGSLKRMAVDDIPQTSRANRGLLVLRELKTKPHRVFLAGGVQSDTSAEQFDLFTDIPEEETNQQMLEVISKTGQTYEIALETLSLSERISNGSFISDTISDQEVLVARTR

SEQ ID NO: 2825 - DNA, 1020 bp, Streptococcus agalactiae
atgacagtaaatttagattgggataatttaggttttgcttacagaaaattaccattccgatacatttcgcattttaaagatgggaaatgggatgatggcaagttgacagatgatgcaacgctacatatttcagaaagttcacctgctctccattatgggcaacaagcttttgaaggattgaaagcttatagaactaaagatggctctattcagttatttcgtccagatcaaaatgcagaacgacttcaaagaacagcagatcgtcttttaatgccacatgttccgacagacaaatttattgcagcggttaaatctgttgtacgcgctaatgaggagtttgttccaccgtatggtacaggggcaacattatacattcgtcccttattaattggtgtgggagatattattggagttaaacctgctgaagaatatatttttacggtatttgcaatgccagtaggtagttattttaaaggtggtttaacaccaactaactttattgtttccaaagaatatgatagagcagcaccgaatggtacaggagctgcaaaagttggtggtaactatgctgctagtcttcttcctgggaaatatgctcatgagaaacaattttcagatgttatctatcttgatccagcgacacatactaaaattgaagaggttggagcagctaatttctttggaattactaaagataatcagtttatcacccctttgagtccttcaattttaccttcaattactaaatattcattgctttaccttgctaaagaaaggtttggtatggaagcgattgaaggagatgtctttgtcgacgaattagataaattcacagaagctggcgcatgtggtacagccgcagttatttcaccaattggaggaattcaaaacggagatgacttccatgtcttctacagtgagacagaagttggtccagcgacacgcaaactatatgatgagttagtagggatccagtttggtgatgttgaagcaccagaagggtggatttataaagtagat

SEQ ID NO: 2826 - protein, 340 aa, Streptococcus agalactiae
MTVNLDWDNLGFAYRKLPFRYISHFKDGKWDDGKLTDDATLHISESSPALHYGQQAFEGLKAYRTKDGSIQLFRPDQNAERLQRTADRLLMPHVPTDKFIAAVKSVVRANEEFVPPYGTGATLYIRPLLIGVGDIIGVKPAEEYIFTVFAMPVGSYFKGGLTPTNFIVSKEYDRAAPNGTGAAKVGGNYAASLLPGKYAHEKQFSDVIYLDPATHTKIEEVGAANFFGITKDNQFITPLSPSILPSITKYSLLYLAKERFGMEAIEGDVFVDELDKFTEAGACGTAAVISPIGGIQNGDDFHVFYSETEVGPATRKLYDELVGIQFGDVEAPEGWIYKVD

SEQ ID NO: 2827 - DNA, 1065 bp, Streptococcus pyogenes
ttgaaaaaaagttacaatagaaaaaagcagaaaagaggtacgatgatgacaatagcaattgattgggacaacctaggatttgaatatcataagttgccatttcgttacatttcttattacaaaaatggtcaatgggataaaggtcaattaacagaagatgccaccttacatatctcagaaagcgctccagcgcttcattatggacaacaagcttttgaaggcttaaaggcttatcgcaccaaagatggctctattcaactatttagaccagaccgtaatgcagtgcgtttacaagccacagcagaccgcttgttgatgccacaagtatcaacagagcaatttattgatgcagctaagcaagtggttaaagccaatgaagactttgtaccaccttacggaacaggtgcaacgctttacctgagaccgttattaattggagttggagatattattggggttaaaccagccgaagaatatattttcaccatttttgccatgccagtaggaaactatttcaaaggtggacttgctccaactaattttattgtttctgaagcgtttgaccgcgccgctccttacggaacaggtgctgctaaggtgggaggaaactatgcaggaagtttgctaccaggtaaggccgctaaatcagcaggcttttctgatgtgatttacttagatccagcaacccatactaaaattgaagaagtcggagctgcaaacttttttggcattactgcaaataatgaatttgttacgccacttagtccatccatcttgccatctattacgaagtattcactcttacaactagctgaagaaagacttggtatgacagtaattgagggtgatgttccaattaatgaattggataaatttgtggaagcaggagcttgtggaacagcagctgttatctctccaattggcggtatccagtacaaggataacttacatgtcttttacagtgaaacagaagttggtcctgtgacacgccgtttatacgatgagttggtcggcattcaatttggggatattgaagcaccagaaggttggattgtaaaagtagat

SEQ ID NO: 2828 - protein, 355 aa, Streptococcus pyogenes
LKKSYNRKKQKRGTMMTIAIDWDNLGFEYHKLPFRYISYYKNGQWDKGQLTEDATLHISESAPALHYGQQAFEGLKAYRTKDGSIQLFRPDRNAVRLQATADRLLMPQVSTEQFIDAAKQVVKANEDFVPPYGTGATLYLRPLLIGVGDIIGVKPAEEYIFTIFAMPVGNYFKGGLAPTNFIVSEAFDRAAPYGTGAAKVGGNYAGSLLPGKAAKSAGFSDVIYLDPATHTKIEEVGAANFFGITANNEFVTPLSPSILPSITKYSLLQLAEERLGMTVIEGDVPINELDKFVEAGACGTAAVISPIGGIQYKDNLHVFYSETEVGPVTRRLYDELVGIQFGDIEAPEGWIVKVD

SEQ ID NO: 2829 - DNA, 117 bp, Streptococcus agalactiae
ttggagttaatagtgagtaaaaaagataagaaaattgaaattcaaatttcagacgctcaagtaacagttaatggaactaaggttgatggataccaactcgttatggaaaaaaaattg

SEQ ID NO: 2830 - protein, 39 aa, Streptococcus agalactiae
MELIVSKKDKKIEIQISDAQVTVNGTKVDGYQLVMEKKL

SEQ ID NO: 2831 - DNA, 231 bp, Streptococcus pyogenes
gtgatgagtaaaaaagataaaaaaattgaaatccaactgattgatcacaaagttatggttaatgagactaagattgatggctatcaattacaaattggtaaacgtgtggttggagaaattgcagaacttgatgagaaatttgctgtcttaaaaaatgatggagtagattgcttcttcaaaacgctcgaacaagcggttgaaaatatcattgaaaactacaatttgaaccat

SEQ ID NO: 2832 - protein, 77 aa, Streptococcus pyogenes
VMSKKDKKIEIQLIDHKVMVNETKIDGYQLQIGKRVVGEIAELDEKFAVLKNDGVDCFFKTLEQAVENIIENYNLNH

SEQ ID NO: 2833 - DNA, 300 bp, Streptococcus agalactiae
ttgtcacgtgcatttaatttagctgaaaaagttactcattctgtattggtggactcttcattgtttgaaaataatcaagagaaggcgctatatcaagctattttgtcacttgaactgactgaggatatgcatgacaacttagataagcttttcgcacttagtccaattattaatgatttctttgataatacaatggtaatgacagatgatgaaaaaatgaaacaaaatcgtctggctatactcaatagccttgttgcaaaggcaagaacagtcgctgcttttaacttattaaacacaaaa

SEQ ID NO: 2834 - protein, 100 aa, Streptococcus agalactiae
MSRAFNLAEKVTHSVLVDSSLFENNQEKALYQAILSLELTEDMHDNLDKLFALSPIINDFFDNTMVMTDDEKMKQNRLAILNSLVAKARTVAAFNLLNTK

SEQ ID NO: 2835 - DNA, 2037 bp, Streptococcus pyogenes
atgagtaaaaatctactaatcgaacttggtctggaagaacttccagcctacgtggtcacaccaagtgaaaaacaactgggagagcgcttggcgactttcttaacagaaaatcgtctctcttttgaagatatacaaaccttttcaactccacgccgtttggcagtgcgtgtgtctggattagctgatcagcaaacggatttgactgaggactttaaagggcctgctaagaaaattgcccttgatgctgatgggaatttctcaaaagctgctcaaggatttgttcgtggcaaaggcttgaccacagatgctatcgaattccgcgaagtcaaaggagaagaatacgtttatgtgaccaaacacgaagctggaaaacctgctaaggaagtgcttctaggcgttactgaagtgttatcagcaatgaccttcccagtcagcatgcactgggctaacaatagttttgaatacattcgtcctgttcacaccttgacagttctgttgaatgatgaggccttggaacttgacttcttggatattcattctggacgcgtcagccgtggtcaccgttttttaggtactgaaaccactatcacaagtgctgattcttatgaggctgatttacgcagccagtttgttatcgctgatgctaaagagcgtcaagagatgattgtggagcaaatcaagacgcttgaagtggagcagggtgtgcaagttgacattgacgaagacttgcttaatgaagttttgaacttggtcgagtttccaacagctttcatgggaagttttgaggctaaataccttgatgtcccagaagaagtattggtaacatcaatgaaaaaccaccaacgttattttgtagtacgtgatcaggctggtcacttgatgccaaactttgtatcagttcgtaatgggaatgatcaagccattgaaaatgttattaaagggaacgaaaaagttttggtagctcgcttagaagatggtgaattcttctggcgtgaggatcagaaattgcaaattgctgatttggttgccaaattgaccaatgtgaccttccatgaaaaaatcggctctcttgctgaacacatggatcgtacgcgtgtcattgccgcatcacttgctaaggaagccaacctatctgctgaggaagtcacagctgttgaccgtgctgcccaaatttacaaatttgacctgttaacaggtatggtgggtgaatttgatgagctgcaagggattatgggtgaaaaatatgcccttctagctggtgaagatgctgctgtggcaacagcaatccgtgaacactacttacctgatgctgcaggaggtgcgctacctgaaaccaaagttggcgctgtcctggccttggcagctaaattggatactctcttgtcattcttttctgttggcttgattccatctggctctaatgatccttatgctctacgtcgtgcaacccaagggattgtccgtattcttgatcattttggatggcgcatcccaatggataagctggtagatagcttatatgacttgtcctttgatagtttgacctatgccaataaggcggatgtgatgaactttatccgtgctcgtgtggataagatgatgggcaaagccgcaccaaaagacattcgggaagctattctagcaagttcaacctttgtggttccagaaatgttggccgcagctgaagctcttgtcaaagccagtcatacggaaaattacaaaccagcagttgaatctttgtcacgtgcttttaatttggcagaaaaagcggacgcttctgttcaggtggaccctagcctctttgaaaatgagcaagaaaacactttgtttgcagctattcaaggcttgactctagcaggcagtgctgcccagcagttagaacaggtctttgcccttagcccagtgattaatgatttctttgataacacaatggttatggcaggagatcaagcccttaaaaacaaccgtttagctattttatcagatttagtaagcaaagctaagaccattgttgcttttaaccaactaaacaccaag

SEQ ID NO: 2836 - protein, 679 aa, Streptococcus pyogenes
MSKNLLIELGLEELPAYVVTPSEKQLGERLATFLTENRLSFEDIQTFSTPRRLAVRVSGLADQQTDLTEDFKGPAKKIALDADGNFSKAAQGFVRGKGLTTDAIEFREVKGEEYVYVTKHEAGKPAKEVLLGVTEVLSAMTFPVSMHWANNSFEYIRPVHTLTVLLNDEALELDFLDIHSGRVSRGHRFLGTETTITSADSYEADLRSQFVIADAKERQEMIVEQIKTLEVEQGVQVDIDEDLLNEVLNLVEFPTAFMGSFEAKYLDVPEEVLVTSMKNHQRYFVVRDQAGHLMPNFVSVRNGNDQAIENVIKGNEKVLVARLEDGEFFWREDQKLQIADLVAKLTNVTFHEKIGSLAEHMDRTRVIAASLAKEANLSAEEVTAVDRAAQIYKFDLLTGMVGEFDELQGIMGEKYALLAGEDAAVATAIREHYLPDAAGGALPETKVGAVLALAAKLDTLLSFFSVGLIPSGSNDPYALRRATQGIVRILDHFGWRIPMDKLVDSLYDLSFDSLTYANKADVMNFIRARVDKMMGKAAPKDIREAILASSTFVVPEMLAAAEALVKASHTENYKPAVESLSRAFNLAEKADASVQVDPSLFENEQENTLFAAIQGLTLAGSAAQQLEQVFALSPVINDFFDNTMVMAGDQALKNNRLAILSDLVSKAKTIVAFNQLNTK

SEQ ID NO: 2837 - DNA, 255 bp, Streptococcus agalactiae
atggatcctaaaaaaattgctcgtattaacgagctttcaaaaaagaaaaaaacagttggattgaccggagaagagaaggttgaacaagcaaagctccgtgaagagtatattgaaggtttccgccgatcagtccgtcaccacgttgaaggaattaaattagtggatgatgagggcaatgatgttaccccggaaaaacttcgtcaagtccagagagaaaaaggactacatggtcgtagtttggatgatccaaattct

SEQ ID NO: 2838 - protein, 85 aa, Streptococcus agalactiae
MDPKKIARINELSKKKKTVGLTGEEKVEQAKLREEYIEGFRRSVRHHVEGIKLVDDEGNDVTPEKLRQVQREKGLHGRSLDDPNS

SEQ ID NO: 2839 - DNA, 255 bp, Streptococcus pyogenes
atggatcctaaaaaaattgctcgtatcaatgagctggctaaaaagaaaaaaacggtaggcttgactggacctgaaaaagtggaacaggcaaaactccgtgaagaatacattgaaggctatcgtcgctctgtcagacaccatatcgaaggcatcaaattggtggacgaagaaggaaacgacgtgacccctgaaaaattaagacaggtgcaacgtgaaaaaggcttgcacggccgttcattagatgacccaaaatca

SEQ ID NO: 2840 - protein, 85 aa, Streptococcus pyogenes
MDPKKIARINELAKKKKTVGLTGPEKVEQAKLREEYIEGYRRSVRHHIEGIKLVDEEGNDVTPEKLRQVQREKGLHGRSLDDPKS

SEQ ID NO: 2841 - DNA, 1506 bp, Streptococcus agalactiae
atgtcttcagaagaaaaatacattatggcgattgaccagggaacaacaagctctcgagcaattatttttaataaaaaaggtgaaaaaattgcgagtagccaaaaagaatttccccaaatttttcctcaagcaggctgggtagagcataatgctaatcagatttggaattctgttcaatctgtcattgctggagcttttattgaatcaagcatcaaacctggacagatagaggctattgggattaccaatcaacgtgaaacaactgttgtttgggataaaaaaacaggtcttccaatttataatgctattgtatggcaatcgcgacaaacagccccgattgctgatcaattgaagcaagaaggtcatactaacatgattcatgaaaaaactggtcttgtcattgatgcttacttctcagcaacaaaagttcgttggattttagaccacgttcctggagcacaggaacgtgctgaaaaaggagagttgctttttggaacaattgatacttggttagtttggaagttaactgatggtctcgtccatgttacagactattcaaatgctgctcgtacgatgctttataatattaaagaacttaaatgggatgatgaaattttagagttactaaatattcctaaagcaatgttaccagaagtaaaatctaattctgaagtttatgggaaaactactccattccatttttacggtggagaggtgccaatttctggtatggctggtgaccaacaggcagcattatttggacagttggcctttgaacctggtatggtaaaaaacacttatggtacaggttccttcattatcatgaatacgggcgaagagatgcaactgtctcaaaataatctattaacaacgattggttacggcattaatggtaaggttcattatgcacttgaaggatcaatcttcattgcaggaagcgctattcaatggttacgtgatggtcttagaatgattgaaacgtcaagtgagtcagaaggccttgctcaatcatcaacaagtgacgatgaggtttatgtggttccagcttttacaggtttgggtgcaccgtattgggattcaaatgctagagggtcagtatttggattaactcgtgggacaagtaaagaagattttgttaaagctacacttcagtcaattgcttatcaagtacgagacgttattgacactatgcaagttgattcaggaattgatatccaacaacttcgtgtagatggtggagctgcaatgaataatttattaatgcaattccaagcggatattttagggattgatattgctcgtgcgaagaaccttgaaactactgccttgggtgcagctttcttagccggactttcagttggctattgggaaagtatggatgaactaaaagaactgaacgcaacaggacaacttttccaagcaacaatgaatgagtctcgaaaagaaaaactgtataaagggtggagaaaagctgtcaaagcgacacaagtatttgctcaagaggat

SEQ ID NO: 2842 - protein, 502 aa, Streptococcus agalactiae
MSSEEKYIMAIDQGTTSSRAIIFNKKGEKIASSQKEFPQIFPQAGWVEHNANQIWNSVQSVIAGAFIESSIKPGQIEAIGITNQRETTVVWDKKTGLPIYNAIVWQSRQTAPIADQLKQEGHTNMIHEKTGLVIDAYFSATKVRWILDHVPGAQERAEKGELLFGTIDTWLVWKLTDGLVHVTDYSNAARTMLYNIKELKWDDEILELLNIPKAMLPEVKSNSEVYGKTTPFHFYGGEVPISGMAGDQQAALFGQLAFEPGMVKNTYGTGSFIIMNTGEEMQLSQNNLLTTIGYGINGKVHYALEGSIFIAGSAIQWLRDGLRMIETSSESEGLAQSSTSDDEVYVVPAFTGLGAPYWDSNARGSVFGLTRGTSKEDFVKATLQSIAYQVRDVIDTMQVDSGIDIQQLRVDGGAAMNNLLMQFQADILGIDIARAKNLETTALGAAFLAGLSVGYWESMDELKELNATGQLFQATMNESRKEKLYKGWRKAVKATQVFAQED

SEQ ID NO: 2843 - DNA, 1524 bp, Streptococcus pyogenes
atgtcgcaagaaaagtatatcatggctattgatcagggaacaacaagttcacgagcgattattttcaatcaaaaaggggaaaaggttagcagtagccaaaaagaattccctcagattttcccacacgctggttgggtagagcacaatgctaatcagatttggaattcggttcagtctgttattgcgggtgcttttattgagtctagcatcaaaccaagccaaattgaagcaatcggaattaccaaccaacgtgagaccacagtggtttgggacaaaaaaacgggtgtacctatttataatgctattgtgtggcaatcacggcagacggcaccaattgctgagcaactcaaacaagatggccatacaaaaatgatccatgaaaagacaggccttgttattgatgcttacttttctgcaaccaagatccgttggattttggaccatgttcctggtgctcaagaacgagctgaaaaaggcgagttactttttggaaccattgatacttggctggtttggaaattgacagatggtgctgttcatgtgacggattattccaatgcggctcgtaccatgctctataatattaaagacttaacatgggatgatgagattttagagcttttaaatattccaaaagatatgcttccagaggttaaatccaattctgaaatttatggcaaaacagctgcctttcatttttatgggggcgaagtgcctatttcaggtatggcgggtgaccaacaggcagctttgtttggccaactagcttttgagcctggtatggtgaaaaacacttatggcacaggttctttcattatcatgaatactggtgatgagatgcagttatcgagtaataatcttttgaccaccattggttacgggattaatgggaaggttcactatgccttggaaggttccatctttattgcaggctctgccattcaatggttgcgagatggtcttaaaatgattgagacttcaccagaatctgaacagttcgctctagcatcaactagtgacgatgaagtttatgttgtgcctgcttttaccggtttaggagctccttactgggattctaatgcgcgtggatctgtctttggcttgacacgtggtaccagcaaagaagactttgtcaaagcaaccttacaatctatcgcctatcaagtgcgagatgttattgataccatgcaggtggattcaggtattgacattcaacagctccgtgtggatggcggtgcagccatgaataatatgctcatgcaatttcaggctgatattttaggaattgatattgcccgtgctaaaaatttagaaacaacagctctaggagcagctttcttagcagggcttgctgtggggtattgggaagatatggatgctttgaaagaattaaatgccacaggccagctctttaaggctagcatgaatgaatcgcgcaaagaaaaattatacaagggttggaagcgcgctgttaaagcaactcaagttttcacccaagaagaagatgcagatgacgatgcaaaa

SEQ ID NO: 2844 - protein, 508 aa, Streptococcus pyogenes
MSQEKYIMAIDQGTTSSRAIIFNQKGEKVSSSQKEFPQIFPHAGWVEHNANQIWNSVQSVIAGAFIESSIKPSQIEAIGITNQRETTVVWDKKTGVPIYNAIVWQSRQTAPIAEQLKQDGHTKMIHEKTGLVIDAYFSATKIRWILDHVPGAQERAEKGELLFGTIDTWLVWKLTDGAVHVTDYSNAARTMLYNIKDLTWDDEILELLNIPKDMLPEVKSNSEIYGKTAAFHFYGGEVPISGMAGDQQAALFGQLAFEPGMVKNTYGTGSFIIMNTGDEMQLSSNNLLTTIGYGINGKVHYALEGSIFIAGSAIQWLRDGLKMIETSPESEQFALASTSDDEVYVVPAFTGLGAPYWDSNARGSVFGLTRGTSKEDFVKATLQSIAYQVRDVIDTMQVDSGIDIQQLRVDGGAAMNNMLMQFQADILGIDIARAKNLETTALGAAFLAGLAVGYWEDMDALKELNATGQLFKASMNESRKEKLYKGWKRAVKATQVFTQEEDADDDAK

SEQ ID NO: 2845 - DNA, 153 bp, Streptococcus agalactiae
ttgatgaatttgtttaccttcattggagaagttgcgaacggtgtcactccaaggtccagttgtattaataacaagcctagcttttatatcgataacttggtcagtcaacaaatcacgcgcacgtactcctataatttgattgttgtcatcaaa

SEQ ID NO: 2846 - protein, 51 aa, Streptococcus agalactiae
MMNLFTFIGEVANGVTPRSSCINNKPSFYIDNLVSQQITRTYSYNLIVVIK

SEQ ID NO: 2847 - DNA, 1827 bp, Streptococcus agalactiae
atggaattttcacgagaaacacgacgtttagccttacaaagaatgcaagatcgtactctggatttacttatcataggtgggggtatcacaggcgctggtgtcgctttacaagcagcagctagtggattagatactggacttattgaaatgcaagattttgcagaagggacaagtagtcgctcaacaaaattggtccatggtggtcttcgttacttgaagcaatttgatgtagaagttgtttctgatacagtatcagagcgtgcagtcgtgcagcaaattgcaccacacattcctaagccagatccaatgcttttaccggtttacgatgagccgggttctacttttagtatgtttcgccttaaagtggctatggatttatatgatttattagcaggtgtgacaaacacacccgcagccaataaagttttaagcgcagaagatgttcttaagcgtgagcctgatttacaaaaagaaggtttgctaggcggaggggtctatttagatttccgtaataacgatgcacgcctagtgattgaaaatattaaacgcgctaatagggatggagcttatattgccagtcatgtcaaagctgaggacttcttatttgatgacaacaatcaaattataggagtacgtgcgcgtgatttgttgactgaccaagttatcgatataaaagctaggcttgttattaatacaactggaccttggagtgacaccgttcgcaacttctccaatgaaggtaaacaaattcatcaattacgtccaactaagggagttcacttagttgtagatcgccaaaaattaaatatttctcaacctgtttatgttgatacaggcctgaatgatggtcgtatgatttttgttttgccacgtgaagataagacttattttggaactacagatactgattaccatggagacttagaacatcctacggtaactaaagaagatgttgactacctccttaatattgtaaacaaacgcttcccagaagcagagcttactattgatgatattgagagttcatgggcaggtttgcgtccactactatcagggaatagtgcctctgactataatggaggcaatagtggaaaactaagcgatgaaagttttgaagaattaattgattccgttaaagattatattgcacataaaaatcatcgtgaggatgttgaaaaagctatttctcatgtagaatctagtacttctgaaaaagaattggacccatcagctgtttctcgaggatcaagttttgagcgtgatgataatggcctattaacacttgctggtggtaaaattactgattatcgaaaaatggcagaaggtgccatggaaactattattaacattttggataaagaatataatcgcaagtttaaactaatcaattctaaaacctatcctgtttcaggaggagagattaacccatctaatgttgattctgaaattgaagcttatgctcaattgggcacactaagtggtttaagtattgaggatgcacgttatattgctaacctttatgggtcaaatgcaccaaaattatttgcattgacacgccaaattacagaagcagaaggtctgagcttggtagaaacgttgtcacttcactatgctatggattatgaaatggcgcttagcccaacggatttcttcttaagacgtacgaaccatatgcttttcatgagagataatttagattctttgattcagcctgttattgatgagatggctaaacattatcaatggtctgatcaagacaaaactttctatgaagaagaattacatgagactctaaaagacaatgacttggcagctttgaaggataat

SEQ ID NO: 2848 - protein, 609 aa, Streptococcus agalactiae
MEFSRETRRLALQRMQDRTLDLLIIGGGITGAGVALQAAASGLDTGLIEMQDFAEGTSSRSTKLVHGGLRYLKQFDVEVVSDTVSERAVVQQIAPHIPKPDPMLLPVYDEPGSTFSMFRLKVAMDLYDLLAGVTNTPAANKVLSAEDVLKREPDLQKEGLLGGGVYLDFRNNDARLVIENIKRANRDGAYIASHVKAEDFLFDDNNQIIGVRARDLLTDQVIDIKARLVINTTGPWSDTVRNFSNEGKQIHQLRPTKGVHLVVDRQKLNISQPVYVDTGLNDGRMIFVLPREDKTYFGTTDTDYHGDLEHPTVTKEDVDYLLNIVNKRFPEAELTIDDIESSWAGLRPLLSGNSASDYNGGNSGKLSDESFEELIDSVKDYIAHKNHREDVEKAISHVESSTSEKELDPSAVSRGSSFERDDNGLLTLAGGKITDYRKMAEGAMETIINILDKEYNRKFKLINSKTYPVSGGEINPSNVDSEIEAYAQLGTLSGLSIEDARYIANLYGSNAPKLFALTRQITEAEGLSLVETLSLHYAMDYEMALSPTDFFLRRTNHMLFMRDNLDSLIQPVIDEMAKHYQWSDQDKTFYEEELHETLKDNDLAALKDN

SEQ ID NO: 2849 - DNA, 123 bp, Streptococcus agalactiae
ttgatcgcaaaagctaatgacacagctggattcaagtgggcagggctaatattgccagataccaacgctgcaatagctacagcaagtccccatccaaatgtgataacaatccatccagaatta

SEQ ID NO: 2850 - protein, 41 aa, Streptococcus agalactiae
MIAKANDTAGFKWAGLILPDTNAAIATASPHPNVITIHPEL

SEQ ID NO: 2851 - DNA, 711 bp, Streptococcus agalactiae
ttgaaggagataataatggatatttttggagaattcttaggaacagctctcttagtcttacttggtaatggtgttgtagcaggtgttgttttgcctaaaacgaagaatcataattctggatggattgttatcacatttggatggggacttgctgtagctattgcagcgttggtatctggcaatattagccctgcccacttgaatccagctgtgtcattagcttttgcgatcaaaggtgatttagcttggggaacagctattctttatatgattgcacagattattggtgcaatgctaggttcacttcttgtttatttgcaatttagaccccattatgaggctgcagaaaatagagcagacatccttggaacttttgcaactggtccggctttgaaggataatttttccaattttttaagtgaagtattgggaacacttgttcttgtacttactatttttgccatcggaaaatacaatatgcctccaggagttggtacgatgagtgttggtatgttagtggttgggattggtctatcgctcggtggaacaacaggttatgctattaatcctgcacgtgattttggtcctcgtttattgcatgccttgttaccgatgaagaacaaaggtgattctgattggacttattcatggattccgatagtaggacctatggtaggagctattttagcagccttaatatttgctatgatg

SEQ ID NO: 2852 - protein, 237 aa, Streptococcus agalactiae
MKEIIMDIFGEFLGTALLVLLGNGVVAGVVLPKTKNHNSGWIVITFGWGLAVAIAALVSGNISPAHLNPAVSLAFAIKGDLAWGTAILYMIAQIIGAMLGSLLVYLQFRPHYEAAENRADILGTFATGPALKDNFSNFLSEVLGTLVLVLTIFAIGKYNMPPGVGTMSVGMLVVGIGLSLGGTTGYAINPARDFGPRLLHALLPMKNKGDSDWTYSWIPIVGPMVGAILAALIFAMM

SEQ ID NO: 2853 - DNA, 699 bp, Streptococcus pyogenes
atggatatctttggcgaatttttgggtacagccttattggttttactaggaaatggtgtggtagcaggggttgtcttgcccaaaacgaaaacccatgcttctggctggatcgtgattgcgactggctggggaattgcagttgctgtggcagtctttatcagtggcaaagttgcccctgcccacctcaatccagctgttagccttgcttttgccatgagtggaaccattgcctggtcaacagccattgcctatagccttgcccaactattgggagctatggttggttcaactctggtattccttcagttcaggccacattatctggctgctgagagtcaggctgatattttagggacatttgcgacaggtcctgctattcgagatactagctcaaacctattgagtgaaatctttgggacctttgtcttgatgcttggtattttggcatttggcttatatgatatgccagcaggactaggaaccctctgtgtaggtaccttggttattgggattgggttatccttaggaggaacgacaggttacgccattaacccagcacgtgatttaggacctcgtctagttcatgctattctaccactcaacaacaagggagattctgattggtcttatgcttggatacctgttgtaggaccaattattggagcggtcttagcagttttgcttttccaagtcatgtcc

SEQ ID NO: 2854 - protein, 233 aa, Streptococcus pyogenes
MDIFGEFLGTALLVLLGNGVVAGVVLPKTKTHASGWIVIATGWGIAVAVAVFISGKVAPAHLNPAVSLAFAMSGTIAWSTAIAYSLAQLLGAMVGSTLVFLQFRPHYLAAESQADILGTFATGPAIRDTSSNLLSEIFGTFVLMLGILAFGLYDMPAGLGTLCVGTLVIGIGLSLGGTTGYAINPARDLGPRLVHAILPLNNKGDSDWSYAWIPVVGPIIGAVLAVLLFQVMS

SEQ ID NO: 2855 - DNA, 1335 bp, Streptococcus agalactiae
atgacagaaaaatatgtaaataaagtaattgtcattttaggagcttcttttgctggtatgacttgtgcgcagaaattacgccaattaaatcctaattgggatatcgttttgattgataaagaaattcatccagattatgttccaaatggcttaaattggtattatcgtcacgaaattagtggtttaaatcaggccatgtggcagacagaagaagagcaacggttgcagaatatacgctgtctatttggtctaaaagttgagaaaattaataaagaagatagggaattaatgttatcagatggttcttctgtctattatgatcaattgatttgtgccatgggctcccaagcagaatcaacttatattgatggggctgatgcgcaaggtgttttaacaacaaaaacttatgcaactagtcaaaatgctaagcaggtattagataaaagtcataaggtagcagttgttggggcaggtatcatcggtttagatattgcttatagtttacatgaatcagggaaggcggtcactttgttagaagctcaagaaagaccagacttcaggcatacagatcctgatatgtcccttcctttacttgatgcgatggctgaatcaaaactacattttttccaaaatcaaaaggttgagaaaattactgtaacccgagaagaaaaactttgtttgcgaacgctaacaggagacacctttacagttgatgctgtcatattagctgttaattttcgtccggatagtcgtcttttaactgggttggttgatttaagtgttgataatagtgttgttgtaaatgattatttccaaacgagtgaccctaatatctatgctattggcgatttgatttggtcgtattttaaaggtcttaatagtgcttattatatgcccttaattaaccaagcaatccgttcggcacaaatgttggcataccatttatcgggacatgctgttccaaaattaaaaataacacgcgctacaggatctaaacactttggctattatagagctaacattggattaactgaattggaagctggtttttacgaggataccgttagtgttacttatttccctaaagaacagtatgatttaaggataaaattgattgctaaccaaaaaacgggccatttattgggggctcaattaatctcaaaggaaaattgtttggctactgccaatcagcttgttcaagctatatcgtgtgatatgacagattttgatctggcttttcaagatttcatttatacagctagagaatctgagatggcttatatgttgcatcaagcagctatcaacctttatgaaaagaggattgggctatgcgaa

SEQ ID NO: 2856 - protein, 445 aa, Streptococcus agalactiae
MTEKYVNKVIVILGASFAGMTCAQKLRQLNPNWDIVLIDKEIHPDYVPNGLNWYYRHEISGLNQAMWQTEEEQRLQNIRCLFGLKVEKINKEDRELMLSDGSSVYYDQLICAMGSQAESTYIDGADAQGVLTTKTYATSQNAKQVLDKSHKVAVVGAGIIGLDIAYSLHESGKAVTLLEAQERPDFRHTDPDMSLPLLDAMAESKLHFFQNQKVEKITVTREEKLCLRTLTGDTFTVDAVILAVNFRPDSRLLTGLVDLSVDNSVVVNDYFQTSDPNIYAIGDLIWSYFKGLNSAYYMPLINQAIRSAQMLAYHLSGHAVPKLKITRATGSKHFGYYRANIGLTELEAGFYEDTVSVTYFPKEQYDLRIKLIANQKTGHLLGAQLISKENCLATANQLVQAISCDMTDFDLAFQDFIYTARESEMAYMLHQAAINLYEKRIGLCE

SEQ ID NO: 2857 - DNA, 1344 bp, Streptococcus pyogenes
atgacattaacgacaaagaccatacatgttatcggggcatcctttgctggtctagcctttgttgataaatataaggacctcaatccagattcccaaatcattctcattgataaggaaagctgtcccaattatattccaaatggtatcaaccaattattcagaggagacattcaagacctgtctgatgctatgtggggaagagcctgcctagcagcacaaatagagtctaaccatcggtttattcaagcagaagtgttagctatcgaagctccctcaaacaccttgcttctcaaagacagtcaaggacgagtttttgaagaaggttatgaaacgcttgtttgtgccatgggtgctagcccccagtctcattatattgagacgtcacagaccaacaaagttttggtaaccaaatattatgaagaaagccaagctagtttaaaactgattgaggctagccaagaggtcttggttattggtgccggcttgattggcttagaccttgcctacagtttgtccttacaaggcaaacgggtcaaactgattgaagcagccgaacgtccagatttctatcagactgacgcagaactgatagcccctgtaatggcagaaatgtccactcaccatgtcacctttattaataataagcgtgttacggctattcatgagatagagggaaaagttgtcgctcataccgagcaaggggacaccttccaaggtgatttggctattttagccattaactttaggccaaatacacaccttttgcaaggacaagtggcttgtgctctggataagaccattttggttaatgaaaacttacagaccagccaggctaatatctatgccattggagacatggtttcattgcattttggtatattgggaatggattactatacacctttgattaaccaagcaatgaagacaggtcaggctctggctctgcatttagctggatatcctattcctccattacagacggtcaaggtattaggaagttctcactttgattattatcgcgcgagtgttggtgtgacagaagaagaagcagagctttatatggatacgtgtagctatttgtaccaaaatggggattctaaaaacctcttttggctgaaattaatagctagaaaaacggatgggattttaataggcgctcagctcctatccaaaaccaatgctcttgtcatcgccaatcaattaggtcaggctctggctctgaaagttacagacgctgacttagcatttcaagattttctctttttacaaggtcacagtgatttggcttatcatcttcatgaagcttgtctcaaattatttgaaaagaggctccgccatgaagat

SEQ ID NO: 2858 - protein, 448 aa, Streptococcus pyogenes
MTLTTKTIHVIGASFAGLAFVDKYKDLNPDSQIILIDKESCPNYIPNGINQLFRGDIQDLSDAMWGRACLAAQIESNHRFIQAEVLAIEAPSNTLLLKDSQGRVFEEGYETLVCAMGASPQSHYIETSQTNKVLVTKYYEESQASLKLIEASQEVLVIGAGLIGLDLAYSLSLQGKRVKLIEAAERPDFYQTDAELIAPVMAEMSTHHVTFINNKRVTAIHEIEGKVVAHTEQGDTFQGDLAILAINFRPNTHLLQGQVACALDKTILVNENLQTSQANIYAIGDMVSLHFGILGMDYYTPLINQAMKTGQALALHLAGYPIPPLQTVKVLGSSHFDYYRASVGVTEEEAELYMDTCSYLYQNGDSKNLFWLKLIARKTDGILIGAQLLSKTNALVIANQLGQALALKVTDADLAFQDFLFLQGHSDLAYHLHEACLKLFEKRLRHED

SEQ ID NO: 2859 - DNA, 111 bp, Streptococcus agalactiae
gtgccaaaatatgataaagaaattagacttagactcattaattctattaatagagcgcttggctcaacatactttaactcgagaagctcatcaaaatctgggactttggtt

SEQ ID NO: 2860 - protein, 37 aa, Streptococcus agalactiae
MPKYDKEIRLRLINSINRALGSTYFNSRSSSKSGTLV

SEQ ID NO: 2861 - DNA, 144 bp, Streptococcus agalactiae
ttggtaaaatattttgtgaatgtagaaaagcaaaagttgccagaacttctccttccctatactcaagagcaaaacgactcatatacaaaactaaggctgcgtctaaccgtttataaaaagcattacattgataatgtttcacaa

SEQ ID NO: 2862 - protein, 48 aa, Streptococcus agalactiae
MVKYFVNVEKQKLPELLLPYTQEQNDSYTKLRLRLTVYKKHYIDNVSQ

SEQ ID NO: 2863 - DNA, 1428 bp, Streptococcus agalactiae
atgcgaatagaagctctaatggaaaaagaaaggcgtgttcaatatcggctactttcttttttaagaggctctcctcaggcaatagcactgaagttagctttattagaaactggtttaagtcgagcaacttttcttaaatatatcaataatcttaatagctactttgaacaagaaaaagttaattgtcgaatcgtttattataaggataagttatttttagaagaggattataacttatccaatcaagaagtgttgaaagctctgatgaaagatagtattaaatacactatcttaatatctttatttaatcagcgtcagttcacaatcgttggtctttctcaagaattgatggttagtgaggctactttaaatcgtcatcttgctcatctcaatgaattgttagcggaatttgatattgctatttcacaaggaaaacagattggtgatgaattgcaatggcgttatttttattatgaattattcaagcaactatggtcttatgacaagtgccaaaatatgataaagaaattagacttagactcattaattctattaatagagcgcttggctcaacatactttaactcgagaagctcatcaaaatctgggactttggtttagtatttgtcatcatcgtctccttgctatggaaaaaatatctgataatctcaagcctattgtgaaacattatcaatgtaatgctttttataaacggttagacgcagccttagttttgtatatgagtcgttttgctcttgagtatagggaaggagaagttctggcaacttttgcttttctacattcacaaaatattttaccaatcaatacaatggaatacatcatgggatttggaggcccgattattgattgtgtaaccgaaacaatcatctactttaaaaaggagagtattttagctgacgagacatcagatcaggttatttaccaacttggtcagttatatagccattattatttctttaaaggtcatattttagttgaacaacctgatttagaacaaacgtatcgacttattgatcataatatgagggataagttgcatcatatttcaaagaagattattgcaaatgttaatcgaattagacctttaacagaagatggttgttctttgctgactttacatttgttggaattgcttattttctcgaaaaatagtcaaaaaatgccctttaggattggtctagatatgacaggtaatgctgtggaacagtcattgttggaatatcgcattcgacaacatttctctggtaataattctattcaagtcgaaccttatgacgaaggaaagggatttgatatggttatttatcagagtcactcaagaccttataaagccaaactaacctattgccttaataaaggtgcttcagagcgagaactacaggaaatagattcacttatttatgacaat

SEQ ID NO: 2864 - protein, 476 aa, Streptococcus agalactiae
MRIEALMEKERRVQYRLLSFLRGSPQAIALKLALLETGLSRATFLKYINNLNSYFEQEKVNCRIVYYKDKLFLEEDYNLSNQEVLKALMKDSIKYTILISLFNQRQFTIVGLSQELMVSEATLNRHLAHLNELLAEFDIAISQGKQIGDELQWRYFYYELFKQLWSYDKCQNMIKKLDLDSLILLIERLAQHTLTREAHQNLGLWFSICHHRLLAMEKISDNLKPIVKHYQCNAFYKRLDAALVLYMSRFALEYREGEVLATFAFLHSQNILPINTMEYIMGFGGPIIDCVTETIIYFKKESILADETSDQVIYQLGQLYSHYYFFKGHILVEQPDLEQTYRLIDHNMRDKLHHISKKIIANVNRIRPLTEDGCSLLTLHLLELLIFSKNSQKMPFRIGLDMTGNAVEQSLLEYRIRQHFSGNNSIQVEPYDEGKGFDMVIYQSHSRPYKAKLTYCLNKGASERELQEIDSLIYDN

SEQ ID NO: 2865 - DNA, 1557 bp, Streptococcus pyogenes
gtgatttggcttatcatcttcatgaagcttgtctcaaattatttgaaaagaggctccgccatgaagattgaagacttaatggataaggaacgaagggcccaatatcgtctcttggtgaccctttatcatgctaaagaaacgttaaggctaaaagacctaatgaggctatcaaacttgtctaaagtgaccctattaaaatacattgacaatctaaatcatttgtgtcgagaacaaggtttagcctgtcaattacttttagaaaaagacagtctgagcttaaaagaaaatggccagttccattgggaggatttggtagctctgcttctcaaagaatcggttgcctatcagatattgacctacatgtactgccatgaacactttaacatcaccaacttatccgttgaactgatggttagtgaagctactctaaacagacaattagctcacctcaaccagcttttatcagaatttgatctggcgctctcgcaaggcagacaactgggaagtgagcttcagtggcgttatttctattttgaattgttccgccataccttgaccagacaaggcatagacgccttggtcaatcagttagacgcttcgcatttggctaccttaattgagcggctgattggccagtcattatcggcagaagccttagaacaattattgatttggttggcgatttcgcaagcgcgaatgtcctttcaaaaaagctacaatgatcattttttaagagatagtgactttatgacatctaatattttctttaagcgcttagaaagcatgcttttacattacttaagacgctatgcccttgaatttgatgcttttgaagctaagagcctctttgtctttttgcatgcttatcctctacttcctattgccagcatgaagtatagtttgggttttggaggtcctattgctgatcacatttcagaagccttatggcttttaaagaaggctcatgtgattatccatcagacaaaggaggaaatcatttatggcttggggatatttttttccaaagcttacttttttaaaggagctatccttagtcaaccaaccaatagccaatacctttatcaattagtaggcgaagataaaagagcgcttttaagggttatcataaaccatttagtgctgcaaatggatcaggaaacggatttcagtcagcagttgagtgacgacattttagcattgttgattttttccattgagcgccaccatgagcctcttttagtagggcttgccttggggcaaaataaggtggaagcagccattgcggaattggccattagacgtcatttggggcatcgtagggattttcaattaatgccctatgatcatcagaaagtttatgattgtctgattacctatcagactgtctgtttaccgagacaagatttaccctattaccggttaaaacagtatagctccccctatgaactcactgctttagaagcttttctcaaagaccttttccagcaaaaaaatacacgagaagaggaactctcactcagcccagcagctaagtctagttttgcacacaaaactgtg

SEQ ID NO: 2866 - protein, 519 aa, Streptococcus pyogenes
VIWLIIFMKLVSNYLKRGSAMKIEDLMDKERRAQYRLLVTLYHAKETLRLKDLMRLSNLSKVTLLKYIDNLNHLCREQGLACQLLLEKDSLSLKENGQFHWEDLVALLLKESVAYQILTYMYCHEHFNITNLSVELMVSEATLNRQLAHLNQLLSEFDLALSQGRQLGSELQWRYFYFELFRHTLTRQGIDALVNQLDASHLATLIERLIGQSLSAEALEQLLIWLAISQARMSFQKSYNDHFLRDSDFMTSNIFFKRLESMLLHYLRRYALEFDAFEAKSLFVFLHAYPLLPIASMKYSLGFGGPIADHISEALWLLKKAHVIIHQTKEEIIYGLGIFFSKAYFFKGAILSQPTNSQYLYQLVGEDKRALLRVIINHLVLQMDQETDFSQQLSDDILALLIFSIERHHEPLLVGLALGQNKVEAAIAELAIRRHLGHRRDFQLMPYDHQKVYDCLITYQTVCLPRQDLPYYRLKQYSSPYELTALEAFLKDLFQQKNTREEELSLSPAAKSSFAHKTV

SEQ ID NO: 2867 - DNA, 1983 bp, Streptococcus agalactiae
atgacatttgacaccattgatcaattagcggttaatacagtccgcacgctttctattgatgctatccaagcagcaaattctgggcacccaggtcttcctatgggagctgcgcctatggcttatgtgctttggaataaattcttaaatgtaaacccaaaaacaagtcgcaattggacaaaccgtgaccgttttgtgctatcagctgggcatggttcagctcttctttatagcctacttcatttagctggctatgatttatcaattgatgatttaaaacaatttcgccaatggggatcaaaaacacctggacatccagaagttaaccatactgatggtgtagaagcaacaactggacctttagggcaaggtattgctaatgctgttggtatggcaatggctgaagctcatttggctgctaaatttaataaaccaggctttgatttagttgatcattacacttatacacttcatggtgatggttgtttgatggagggtgttagccaagaagctgccagtcttgctggacacttaaaacttggtaaattggtccttctttatgattcaaatgatatctcacttgatggtccaacatctcaatcatttacagaagatgttaaaggacgttttgaatcatatggttggcaacatatcttagttaaagatggtaatgatttagaagcgattgctgcagcaattgaagctgctaaagctgaaactgataaaccaaccattattgaagttaaaactattattggatttggcgcagagaaacagggaacatcttcagttcatggagcgccacttggtgcagaaggtattacttttgccaagaaggcttatgtatgggaatatccagactttactgttcctgctgaagttgcagatcgatttgcctcagatcttcaagcgcgtggtgcgaaggcagaagaggcatggaatgatctttttgctaaatatgaagttgagtatccagaattagcaactgaatacaaagaagcttttgctggccaagctgagacagttgaactgaaagctcatgacctaggttcatcagtggctagtcgtgtttcaagccaacaagctattcaacaattatcgactcaattaccgaacctctggggagggtcagcagacctctcagcttctaataacacaatggtagcagcagaaacagatttccaagcaagtaactacgctgggcgtaatatttggtttggtgtacgtgaatttgcaatggctgctgcaatgaatggaattgcgcttcacggtgggactcgtgtttatgggggtacgttctttgtcttctcaaactacttgttaccagcagtacgtatggctgcacttcaaaacttgccaactgtctatgttatgacacatgattctattgctgttggagaagatgggccaactcatgagccaatagaacaattagcatcagtgcgctcaatgcctaatttgaacgttatccgtcccgcagacggtaatgaaacaaacgctgcatggcaacgagctgtatcagagacagatcgaccaacgatgcttgttttaacacgtcaaaacttaccagttcttgaaggaacatcagaattagcccaagaaggggttaataaaggtgcttatattttatcagaagctaaaggtgaacttgatggtatcatcattgcaacaggttcagaagttaaattagctttagatactcaagacaaacttgagtcagagggcatccatgttcgcgtcgtatctatgccagcacaaaacatttttgatgaacaagaggcttcatatcaagagcaagtgcttccatcagctgttacaaaacgtcttgctattgaggcaggatcaagcttcggttggggtaaatatgttggtttaaatgggctaacacttactattgatacttggggagcatcagcaccaggtaacagaattttcgaagagtatggctttacagttgagaatgctgtatcgctatataaagaactt

SEQ ID NO: 2868 - protein, 661 aa, Streptococcus agalactiae
MTFDTIDQLAVNTVRTLSIDAIQAANSGHPGLPMGAAPMAYVLWNKFLNVNPKTSRNWTNRDRFVLSAGHGSALLYSLLHLAGYDLSIDDLKQFRQWGSKTPGHPEVNHTDGVEATTGPLGQGIANAVGMAMAEAHLAAKFNKPGFDLVDHYTYTLHGDGCLMEGVSQEAASLAGHLKLGKLVLLYDSNDISLDGPTSQSFTEDVKGRFESYGWQHILVKDGNDLEAIAAAIEAAKAETDKPTIIEVKTIIGFGAEKQGTSSVHGAPLGAEGITFAKKAYVWEYPDFTVPAEVADRFASDLQARGAKAEEAWNDLFAKYEVEYPELATEYKEAFAGQAETVELKAHDLGSSVASRVSSQQAIQQLSTQLPNLWGGSADLSASNNTMVAAETDFQASNYAGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWQRAVSETDRPTMLVLTRQNLPVLEGTSELAQEGVNKGAYILSEAKGELDGIIIATGSEVKLALDTQDKLESEGIHVRVVSMPAQNIFDEQEASYQEQVLPSAVTKRLAIEAGSSFGWGKYVGLNGLTLTIDTWGASAPGNRIFEEYGFTVENAVSLYKEL

SEQ ID NO: 2869 - DNA, 309 bp, Streptococcus agalactiae
ttgtttatgaagaaggagtgtcgtgatttttatcggcagatacagcatacttacaatgatatatctgtccgtgaagatgcagtgctatcatcaatactattatcagcatcgaatggtttgataaaaactagcgatgtacctcgtgttgcttatgagttaactcagcaattggaaaataatgagatagaaaaatctttcgagtcattagctacagttaaggaattgaaaaaatctgctaaaaaattgtctgagagatatgagcaaaataaggtaacaacgggattgctttctaaagtatttggaaatcat

SEQ ID NO: 2870 - protein, 103 aa, Streptococcus agalactiae
MFMKKECRDFYRQIQHTYNDISVREDAVLSSILLSASNGLIKTSDVPRVAYELTQQLENNEIEKSFESLATVKELKKSAKKLSERYEQNKVTTGLLSKVFGNH

SEQ ID NO: 2871 - DNA, 264 bp, Streptococcus pyogenes
atggaaaagaaacgacagcgcttatacgatgtgattagacaggcttatgattatccagaaaatcgtgaaaatgtggccttgtcgcagctacttttagcagcttctaatagattaattaaacacagtaacccacttcttgttgcctaccaactaaaccaagatgtggataattacttacttgataatgacattttacttccaaaatcgctttgccgttttaagcagtcattggaaaagtatattttagaggaagcctcatcagtc

SEQ ID NO: 2872 - protein, 88 aa, Streptococcus pyogenes
MEKKRQRLYDVIRQAYDYPENRENVALSQLLLAASNRLIKHSNPLLVAYQLNQDVDNYLLDNDILLPKSLCRFKQSLEKYILEEASSV

SEQ ID NO: 2873 - DNA, 732 bp, Streptococcus agalactiae
atgattaagtttgaacatgtttcgaaagtatacggagaaaaagaagctctcagtgatttaaccctctctgttaaagatggtgagatttttggattaataggtcacaatggagcaggaaaaacaacgacaattagtattctaacatctattattgatgcaacttatggccaagtctatattgatgacctacttttgacagaacatcgtgaccaaattaagaaaaaaataggttatgtaccggactcgccagatattttcttaaatttaaccgcagaggaatactggtactttttagctaaaatttatgacgttgccccagaagatattgaagcacgtatcacaaaattggtagacatatttgaactagaggagcaacgctataatcctattgaaagtttttcacatggtatgcgtcaaaaagtcattgttataggtgcccttcttccaaatcctgacatttggattctagatgagccgttaactggtttagaccctcaagcttcttttgatttgaaagaaatgatgaaagaacatgctaaaaatggaaaaacagttattttttcaacacatgtcttagcagttgcagaacagttatgcgacagaataggtattttgaaacaagggaaattaatctttgtcggtagcttaggtgagttaaaaatgaaatatccagataaagatttggaaactatctatttggaattagcaggacgtcaagctagtagggaggga

SEQ ID NO: 2874 - protein, 244 aa, Streptococcus agalactiae
MIKFEHVSKVYGEKEALSDLTLSVKDGEIFGLIGHNGAGKTTTISILTSIIDATYGQVYIDDLLLTEHRDQIKKKIGYVPDSPDIFLNLTAEEYWYFLAKIYDVAPEDIEARITKLVDIFELEEQRYNPIESFSHGMRQKVIVIGALLPNPDIWILDEPLTGLDPQASFDLKEMMKEHAKNGKTVIFSTHVLAVAEQLCDRIGILKQGKLIFVGSLGELKMKYPDKDLETIYLELAGRQASREG

SEQ ID NO: 2875 - DNA, 732 bp, Streptococcus pyogenes
atgatagaatttaaacatgtttcaaagttgtatggcgacaaagaagctctcagcgatttaaacgtcaccatcaatgacggtgaaatttttggccttatcggacataatggtgcaggtaaaaccacgaccatcagcattttgacttctattatcgaagcgagttatggcgaagtatttgtggatggtcaacttctgacagaaaatagagaagctatcaaaaaacaaattgcttatgtgccagattctcctgatattttcttgaatctaactccaaatgagtattggcagtttttagctaaaatttatggggtgtcagatgaggacagagaagaacggttagcacagctgacaacactttttgaactgaaggaagaagttaatcaaaccattgatagtttctcacatgggatgcgccaaaaagtgattgtgattggtgctcttgtatcaaatcctaacatctggattttggatgaaccattaacaggtttggatcctcaggcttcttttgaccttaaagaaatgatgaaagctcatgcagcttctggacatacagtcttattttcgactcacgtgctatcagtcgctgagcagttatgtgatcgtatcgggattctaaaaaaagggaaattgatttttgttggaacgattgatgagttgaaagaacaccatcctgacaaagacttggagagcatctaccttgaactcgctgggcgtaaggcgcaagaagagggg

SEQ ID NO: 2876 - protein, 244 aa, Streptococcus pyogenes
MIEFKHVSKLYGDKEALSDLNVTINDGEIFGLIGHNGAGKTTTISILTSIIEASYGEVFVDGQLLTENREAIKKQIAYVPDSPDIFLNLTPNEYWQFLAKIYGVSDEDREERLAQLTTLFELKEEVNQTIDSFSHGMRQKVIVIGALVSNPNIWILDEPLTGLDPQASFDLKEMMKAHAASGHTVLFSTHVLSVAEQLCDRIGILKKGKLIFVGTIDELKEHHPDKDLESIYLELAGRKAQEEG

SEQ ID NO: 2877 - DNA, 1602 bp, Streptococcus agalactiae
atgaattggtcacgtatctgggaactcgtaaaaattaatatcctttattcaaaccctcagactctatcggcactaagaaaaaagcaagaaaaacatcctaaaaaagaattttcagcttataaatccatgtttagaaatcagttatttcagattttgctcttttcaataatttatgtatttctctttgtatcacttgattttaaagaatatccgggctacttcacgttctacattggtatctttacactagtatccattatctactcttttattgcgatgtacagtgttttctatgagagtgacgatgttaaacaatatgcttatttgcctattaaatctgaagagctctatgttgctaaaatttttgcaacatttgggatgtctgtaacttttctaatgccaatcctaaccttaatgattgtggcttattggcgtataataggtggcccacttgcggtcctcctagcaatcataaattttgctattttatttttatcggtaacggtgatttcattgtatattaatagtttaataggccgtgccattattcgaagtgctaatcggaaacttatttctactatattaatttcactagctacatttggagcaatagttcccttattatttgtgaatatgacgagtcaaaagatggtacaagggaaattacaagatatcgctccaatcccttatgtcagaggttattatgatattgttacagcgccatttagtatggagagtctcctcaactattatctcccgctcttaatcattttattcttgataggtgctatttataaatgggttatgccacgctactatcaggagttgttgtatggacaggtcaagcagagaaaagtccatcgtcaaatcgattttagtaaacgtgagtcaattaataaaactcttgttaaacaccatttatcaagtttacaaaatgcgacattattgacaaatacatttttaatgccactattatatctagcaatgttcattgttccaattttgaataatggtaaagagattggtcgattttttaatgaaaattattttgggatagcttttctagcaggaatattaataggtagtttatgtgtgatgccagctagcattgtaggggtaggtatttctttagaaaaaagtaatttctactttataaaaagtttgcctatatcattttcgtatttcttgaagcataaatttgtaactttgataaccttacaacttgcagttcctacttttatttatttcttggtaggattctttctacttaaactatcaatcctcgttttattgagcttcattttaggtctagtcttcatgggacttatcgaaggccagtttatttatagacgtgactataaacatttgttcttgaattggcaagaggttacgcaactatttaatagagggttaggccaatggctgttagttggttcattgtttggaatgatgataataggtagttttcttattggaataagtattttttggtcaatggtatggaatactgtagctgtcaatatcataatccttatcattgggttgctcatattatcaatttgccaatacttactgctaaaaaatttttggaagaagcttgtt

SEQ ID NO: 2878 - protein, 534 aa, Streptococcus agalactiae
MNWSRIWELVKINILYSNPQTLSALRKKQEKHPKKEFSAYKSMFRNQLFQILLFSIIYVFLFVSLDFKEYPGYFTFYIGIFTLVSIIYSFIAMYSVFYESDDVKQYAYLPIKSEELYVAKIFATFGMSVTFLMPILTLMIVAYWRIIGGPLAVLLAIINFAILFLSVTVISLYINSLIGRAIIRSANRKLISTILISLATFGAIVPLLFVNMTSQKMVQGKLQDIAPIPYVRGYYDIVTAPFSMESLLNYYLPLLIILFLIGAIYKWVMPRYYQELLYGQVKQRKVHRQIDFSKRESINKTLVKHHLSSLQNATLLTNTFLMPLLYLAMFIVPILNNGKEIGRFFNENYFGIAFLAGILIGSLCVMPASIVGVGISLEKSNFYFIKSLPISFSYFLKHKFVTLITLQLAVPTFIYFLVGFFLLKLSILVLLSFILGLVFMGLIEGQFIYRRDYKHLFLNWQEVTQLFNRGLGQWLLVGSLFGMMIIGSFLIGISIFWSMVWNTVAVNIIILIIGLLILSICQYLLLKNFWKKLV

SEQ ID NO: 2879 - DNA, 1668 bp, Streptococcus pyogenes
ttgaactcgctgggcgtaaggcgcaagaagaggggtgatggcatgaattggtctactatttgggaacttatcaagataaacattctttattccaatccacaaagtttagctaacctcaaaaagcgtcaggaaaaacacccgaaagaaaacttcaaagcctataaaagcatgatgaggcaacaggccttaatgattgccatgtttttggtgatttacctttttatgtttattggtgtcgatttcagtcattatccaggacttttctcctttgacgttgctatgttttttatcatgtcaaccttgacagcctttagctctctttacaccattttttatgaaagtaatgacctaaaactttatattcacttaccagtaacgtcagaagaactctatattgcaaaaattgtctcgtcgctagggatgggtgctgtctttttgatgcctcttatctctcttctcttaattgcctattggcaactcttgggaaatcctttgtctattttagtagctatcgtgctctttttagtgttactagtgagttctatggtattagctatttatatcaatgcttgggtaggcaaaatcattgtaagaagtcgcaaacgaaaactcatttcaactatcatgatgtttgtctcaacttttggcgctttcgtcttaatttttgcgattaatattagtaacaacaagcgtacgatgacggatggcgtatttactgattacccaactattccctatttcaaaggattctatgatgttgttcaggcaccgttttctactgcggccctccttaacttttggttgccattgttacttatcctagctatggtatatggtattgtcacaaaagtgatgccaacttattatcgtgaggctttttatattagtaacgagaacaaagtcaagcaaactaaaaaaccagttaatcgtcctcatcagaatcaatcactggcgcagttgttgcgaaaacatcacctattaacgttacaaaatgcaactttactgacacaaacctatctcatgcccctgatgtatgtgatgctttttatcggtccaagtttgtcacgtggcacaggtttctttaagcatatttccccagattactttggggtagccttattatttggggttagtttgggtgtcatgtgtgcaacaccaaccagctttattggagtaggtatttcacttgaaaaggataactttacctttattaaaagcttaccaataacgttaaaaaaattcttgatggataaattttgcttgcttgtaggtctgcagctgattgtgcctatggtgatttatcttgtgtttggtctctttgtgttgcacctgcatcctcttctaacgattgctttttgtcttggctacgccctatcactgattgtgcaaggggaattgatgtatcgtcgtgactaccggcttctggatttaaaatggcaagacatgacgcaactctttaccagaggagatgggcaatggttaacaatgggacttatctttggtaatttaatagttgcaggtgtgctaggttttggagctgttatcattgccaatattatccaacaacctctgttgattagtattctattgagttgtctaatactaatggttttaggtcttgcgcaattatggattcaaaaaaccttctggaaaagcttagagaggctt

SEQ ID NO: 2880 - protein, 556 aa, Streptococcus pyogenes
LNSLGVRRKKRGDGMNWSTIWELIKINILYSNPQSLANLKKRQEKHPKENFKAYKSMMRQQALMIAMFLVIYLFMFIGVDFSHYPGLFSFDVAMFFIMSTLTAFSSLYTIFYESNDLKLYIHLPVTSEELYIAKIVSSLGMGAVFLMPLISLLLIAYWQLLGNPLSILVAIVLFLVLLVSSMVLAIYINAWVGKIIVRSRKRKLISTIMMFVSTFGAFVLIFAINISNNKRTMTDGVFTDYPTIPYFKGFYDVVQAPFSTAALLNFWLPLLLILAMVYGIVTKVMPTYYREAFYISNENKVKQTKKPVNRPHQNQSLAQLLRKHHLLTLQNATLLTQTYLMPLMYVMLFIGPSLSRGTGFFKHISPDYFGVALLFGVSLGVMCATPTSFIGVGISLEKDNFTFIKSLPITLKKFLMDKFCLLVGLQLIVPMVIYLVFGLFVLHLHPLLTIAFCLGYALSLIVQGELMYRRDYRLLDLKWQDMTQLFTRGDGQWLTMGLIFGNLIVAGVLGFGAVIIANIIQQPLLISILLSCLILMVLGLAQLWIQKTFWKSLERL

SEQ ID NO: 2881 - DNA, 1383 bp, Streptococcus agalactiae
atgtctagagaatacatcaccttgtcaaaaaatatcatcaaacaccttggtggacaaaataatattaacaatgtttaccattgtcaaacacgccttcgctttagtctcaatgatccgacgaaagtaaaccttgagcaattaaaaactttaaaagaggtaaaaactgtcgttatcagcggagggcaacatcagatagtgatagggactcatgtcgcaaaagtgtttgaagaaattaactccctcattgaaactaactcaacgactaaaatagaacaaaccaaaaaagccaaagcagttagtcgaattattgattttgtttctgggactttccaaccgattttacctgctttatcaggcgctggtatgattaaggcattgctagctttattactagtattcaaaatcttgacaccgtcatctcaaacatatatattactaaatctttttgcagatggtgttttctattttttacctatcttaatcgccatcacagctgctcaaaaattgaaagctaatcctattttagctttgggaactgttgtcatgctccttcaccctaattgggctaatttagtagcttctggtaaaccagtatccttattccatacgatcccattcacacttactaactatgcatcaagtgtcattcccattattctaattatttgtgttcaggcttatatagaaaaatatttaaagcaaattattcctaaatcactgcgtttagtgcttgttcctatgttaatatttctcagcatgggaattttgtcgttctctatattgggaccaatgggtactatcgctggccaatatttagctgttatttttacttttttatccaaatacgccagttgggcacctgcttttctagtaggagcatttgctcctatcctaatcatgtttggtgttcatagtggaattgctgcattaggaatcacacaactagcgaaattaggggttgattctatttttggaccaggcatgctctgctcaaatatcgcacaagcaactgcaggtacagtggtgactcttataacaaaagaaaaaaaacttaaagaaattgctggacctgctgccataacagcttatatgggaatcaccgaacctatcttatatggtgtcaaccttccgaaacgttatcctctaatagcctcacttattggtggtggtcttggaggactctatgccggtataatgaacgctcaccgcttcgctgtaggctcttctggtctaccaggtctgtttctttatatcagtcatacttcaacacatctttttattaccatgcttattgcagttatcattactgtaagcacaactgctatattgacattcattctagcacaatattacgaaaaacaagttagcatcagacaaagagac

SEQ ID NO: 2882 - protein, 461 aa, Streptococcus agalactiae
MSREYITLSKNIIKHLGGQNNINNVYHCQTRLRFSLNDPTKVNLEQLKTLKEVKTVVISGGQHQIVIGTHVAKVFEEINSLIETNSTTKIEQTKKAKAVSRIIDFVSGTFQPILPALSGAGMIKALLALLLVFKILTPSSQTYILLNLFADGVFYFLPILIAITAAQKLKANPILALGTVVMLLHPNWANLVASGKPVSLFHTIPFTLTNYASSVIPIILIICVQAYIEKYLKQIIPKSLRLVLVPMLIFLSMGILSFSILGPMGTIAGQYLAVIFTFLSKYASWAPAFLVGAFAPILIMFGVHSGIAALGITQLAKLGVDSIFGPGMLCSNIAQATAGTVVTLITKEKKLKEIAGPAAITAYMGITEPILYGVNLPKRYPLIASLIGGGLGGLYAGIMNAHRFAVGSSGLPGLFLYISHTSTHLFITMLIAVIITVSTTAILTFILAQYYEKQVSIRQRD

SEQ ID NO: 2883 - DNA, 1860 bp, Streptococcus pyogenes
atgacgtatcaagaaactgccaaggctattttagcggcggttggtggcaaaacaaatattcaacgtgtgacacactgtgtaacacgtctacgcttagtactgaaaaatgatgagaaagttaaagatcagcaagtcaaagccatttcaaatgtgattggcgtgatgcgcaaaaacggccagtaccaaattatcttgggcaatgatgtcaataattattaccaagcctttttaagcctagggcattttgacaatcaagatgaagatcattcttcaaaagcgaaaggaagtatccttgagcgcttgattgaaaccattgctggcgtgattacaccgctgattccagcccttcttggtggtggaatgctcaaagtggtgggaatcttgcttcctatgcttggcttagcgagtgcggactctcaaaccgttgcctttattaacttctttggcgatgcggcttattattttatgcctgtcatgattgcctattcagcagcggcgcgctttaaggtgacacctgttttagcagcgacgatcgcagggattttattgcatcctgcctttgttgcaatggtagcagaaggtaaaccattgactttatttggagcaccagtcactcctgctagctatggctcatctgttattcccattttgatgatggtttacttgatgcaatacattgaaaaatgggtcaatcgcttggtgccaagcgtgatgaaaagcttcttacagccaaccttaatcattttgatttctggctttttggctttagtggttgtaggtcctcttggtgtgattattggtcaagggttatctaataccatgctcgctatttatcatgtggctccgtggctagcacttgctattttgggagcgattatgccgcttgttgtcatgacggggatgcactgggcttttgcaccaatctttttggccgcttcggtcgcaacaccagatgtcttgattttaccagcaatgttggcttctaatttggctcaaggagccgcatctttggctgttgcctttaaaacaaagcagaaacaaacacgtcaagttgcccttgccgcggggatttcagctttgctggcaggtatcacggaaccggcactttatggggtcacactgaaatttaaaaagccactctatgcagccatgatttcaggtggtctggttggagcctttattggttttgtcaatattgcttcttatacctttgtcgtaccttctattattggtttaccacagtacatcaacccatcaggcggagctaattttacaaatgctttgattgccggaactgcgacgattgtgttagccttcagtttgacttggttcatgggaattgatgaagagtccccaaagcaagtgagtgttgcagcagatatgtcacaagttaagagcggcttgtcaaccaaacaaacgttgtatgctccaatgacaggtgagatgctttttctatcagaagttcctgatgaaaccttttcttccaagttattaggagaaggatttgccatattaccaagcgaaggtgaggtctatgccccctttgatggtgaagtcatcactttctttccaaccaagcatgctgttgccttaaaaaacacacgtggtgtggaagtcttgattcatgtcggtattgatacggttgagttaaaagggcaaggtttcgagcagttagtgtctgttggcgatgtcgtgaaacgaggccaggcacttctaaaaatggatattgatttcattacttcaaaaggctattcactcatcagtcctgtggtcgtgaccaattcggctgagcagttggagattattattcaagatgacaaaaaaatggtgactaaagaggacgctttgttagtcatttta

SEQ ID NO: 2884 - protein, 620 aa, Streptococcus pyogenes
MTYQETAKAILAAVGGKTNIQRVTHCVTRLRLVLKNDEKVKDQQVKAISNVIGVMRKNGQYQIILGNDVNNYYQAFLSLGHFDNQDEDHSSKAKGSILERLIETIAGVITPLIPALLGGGMLKVVGILLPMLGLASADSQTVAFINFFGDAAYYFMPVMIAYSAAARFKVTPVLAATIAGILLHPAFVAMVAEGKPLTLFGAPVTPASYGSSVIPILMMVYLMQYIEKWVNRLVPSVMKSFLQPTLIILISGFLALVVVGPLGVIIGQGLSNTMLAIYHVAPWLALAILGAIMPLVVMTGMHWAFAPIFLAASVATPDVLILPAMLASNLAQGAASLAVAFKTKQKQTRQVALAAGISALLAGITEPALYGVTLKFKKPLYAAMISGGLVGAFIGFVNIASYTFVVPSIIGLPQYINPSGGANFTNALIAGTATIVLAFSLTWFMGIDEESPKQVSVAADMSQVKSGLSTKQTLYAPMTGEMLFLSEVPDETFSSKLLGEGFAILPSEGEVYAPFDGEVITFFPTKHAVALKNTRGVEVLIHVGIDTVELKGQGFEQLVSVGDVVKRGQALLKMDIDFITSKGYSLISPVVVTNSAEQLEIIIQDDKKMVTKEDALLVIL

SEQ ID NO: 2885 - DNA, 801 bp, Streptococcus agalactiae
atgaaaagacattttgagacaactagaagaattgttattaaagtaggaaccagttccctcgtacagacaagcgggaaaattaatttaagtaaaatagaccatttagcatttgttatttctagtcttatgaatagaggcatggaggtgattttagtatcatctggtgctatggggtttggtttagacattttgaaaatggataagcgtcctcaagaaatatcacaacaacaagcagtttctagcgtaggacaagtagccatgatgagtctttattctcagatattttcgcactatcaaactcatgtttcccaaattttattaacacgtgacgttgtggtttttccagagagtttgcaaaatgtaacaaactcttttgagagtctgctctctatgggaattttgccaatcgtcaatgagaatgatgctgtcagcgtggatgagatggatcataaaacgaagtttggggataatgaccgtctctctgctgtcgttgctaaaattactaaagcagatttattaattatgctgtcagatattgatggtctttttgataaaaatcctaatatttatgatgatgctgttttacgtagtcatgtttctgaaatcaccgatgacatcatcaagtcagctggaggagcaggaagtaaatttggtactgggggcatgcttagtaaaattaaaagtgcacaaatggtgtttgataacaatggacaaatgatattgatgaatggcgccaatcctcgtgatattttaaaggtgttagatgggcataatattggaacttattttgctcaaggaaag

SEQ ID NO: 2886 - protein, 267 aa, Streptococcus agalactiae
MKRHFETTRRIVIKVGTSSLVQTSGKINLSKIDHLAFVISSLMNRGMEVILVSSGAMGFGLDILKMDKRPQEISQQQAVSSVGQVAMMSLYSQIFSHYQTHVSQILLTRDVVVFPESLQNVTNSFESLLSMGILPIVNENDAVSVDEMDHKTKFGDNDRLSAVVAKITKADLLIMLSDIDGLFDKNPNIYDDAVLRSHVSEITDDIIKSAGGAGSKFGTGGMLSKIKSAQMVFDNNGQMILMNGANPRDILKVLDGHNIGTYFAQGK

SEQ ID NO: 2887 - DNA, 825 bp, Streptococcus pyogenes
ttgggtatgatgaaacgacaatttgaagatgtaacacgtatcgtaattaaaattggcactagttcattagtgctaccaacaggtaaaattaatttagaaaaaatcgaccaactggcttttgtgatttcaagtttgatgaataagggcaaggaagttattttagtatcatcgggagcgatgggatttggactagatattttgaaaatggaaaaacgtccgaccaatcttgctaaacaacaggcagtttccagtgttggtcaggtagccatgatgagtctttattcacaaatttttgcatactaccaaaccaacgtgtcacaaattttattgacgagagatgtggtggttttcccagaaagtctagccaatgttaccaatgcttttgaaagtctgattagtttgggcattgtgccgattgttaatgaaaacgatgcggttagtgtggatgaaatggatcatgcgactaaatttggagataatgaccgtttatctgctgttgttgctggtattacaaaagctgatttattaatcatgttgtctgatattgatggcctttttgataaaaaccctactatttatgaggatgcgcagctacgcagccatgttgctaatattacgcaagaaatcattgcgtcagcaggtggtgcgggcagtaagtttggcacaggtgggatgctaagtaaggtgcagtctgctcagatggtatttgaaaacaaaggacagatggtcttgatgaatggagctaatcccagagatattttaagagtgcttgaagggcaaccactaggcacctggttcaagcagatagaagaggtaaggcatgac

SEQ ID NO: 2888 - protein, 275 aa, Streptococcus pyogenes
LGMMKRQFEDVTRIVIKIGTSSLVLPTGKINLEKIDQLAFVISSLMNKGKEVILVSSGAMGFGLDILKMEKRPTNLAKQQAVSSVGQVAMMSLYSQIFAYYQTNVSQILLTRDVVVFPESLANVTNAFESLISLGIVPIVNENDAVSVDEMDHATKFGDNDRLSAVVAGITKADLLIMLSDIDGLFDKNPTIYEDAQLRSHVANITQEIIASAGGAGSKFGTGGMLSKVQSAQMVFENKGQMVLMNGANPRDILRVLEGQPLGTWFKQIEEVRHD

SEQ ID NO: 2889 - DNA, 1251 bp, Streptococcus agalactiae
atgacgtatattgaaatattagggcaaaatgctaaaaaagctagtcaatcagtagcacgattaagtacagctagtaaaaatgagatactcagggacttagcgagaaacatagtggctgatactgaaaccattttgactgagaatgctcgcgatgttgttaaggcaaaagataatggtatctcagaaattatggtggaccgtctacgactaaacaaagaccgcatacaggcgatagcaaacggtatttatcaggtagcagatttggcagatccgattggtcaagttgttagtggttatacaaatttagatggtttaaaaatccttaaaaaaagagtgcctttaggggttattgcaatgatatttgaaagtcgtcccaatgtatcggtggatgcctttagtttagcttttaaaacagggaacgctattattttgcgtggtggtaaagatgctattttttcaaatactgccttggttaattgtatgcgccaaacattgcaagatacaggccacaacccagatatagtacaattagttgaagatactagtcacgttgtagcagaggagttaatgcaggcaacagactacgtggacgtcttaattccaagaggtggtgcaaaattaattcaaacggtgaaggaaaagtcaaagattcctgttatcgaaacaggtgttggaaatgttcatatctatattgatgaatttgcagatttagatatggcagctaagattgttattaatgctaaaacccaacgccctagtgtctgtaatgctgccgaagggttagttgttcatcaagctattgctaagggatttttatctcaattggagaaaatgctcaaagaatcgaaccagtcagttgaatttcgtgccgatgaggaagctttgcaacttttagaaaatgctgttgctgcaagtgagtctgattatgctactgaatttttagactatattatgtcagtaaaagtagtagattcttttgaacaagcaattagctggattaataaatacagtagtcatcactcagaagctatcattactaataatatcagtagggcagaaatttttcaggatatggtagatgcagcggcagtttatgttaatgcttcaacacgttttacagatggtttcgtttttggactcggagcagagattggtatttcgactcaaaaattacacgcgcgtggaccgatgggattagaagctttaacaagtacaaaatactatattaatggaactggtcaagtaagggaa

SEQ ID NO: 2890 - protein, 417 aa, Streptococcus agalactiae
MTYIEILGQNAKKASQSVARLSTASKNEILRDLARNIVADTETILTENARDVVKAKDNGISEIMVDRLRLNKDRIQAIANGIYQVADLADPIGQVVSGYTNLDGLKILKKRVPLGVIAMIFESRPNVSVDAFSLAFKTGNAIILRGGKDAIFSNTALVNCMRQTLQDTGHNPDIVQLVEDTSHVVAEELMQATDYVDVLIPRGGAKLIQTVKEKSKIPVIETGVGNVHIYIDEFADLDMAAKIVINAKTQRPSVCNAAEGLVVHQAIAKGFLSQLEKMLKESNQSVEFRADEEALQLLENAVAASESDYATEFLDYIMSVKVVDSFEQAISWINKYSSHHSEAIITNNISRAEIFQDMVDAAAVYVNASTRFTDGFVFGLGAEIGISTQKLHARGPMGLEALTSTKYYINGTGQVRE

SEQ ID NO: 2891 - DNA, 1248 bp, Streptococcus pyogenes
atgactgatatgagaaggttagggcaaagggcaaaacaagctagtcttttaatagcacctttgtcgacgcaaattaaaaatcgctttttaagcaccttagcaaaggcattagttgacgatacacagactctcttagccgctaaccaaaaagatttagcgaatgctaaagaacatggtatttctgacatcatgatggatcgcttgcgcttaacttcagaacggattaaagcgatagcacagggagttcaacaggttgctgacttagctgatccaatcggacaagtcattaagggctatactaacctcgatggccttaaaatcctccaaaagagagttcctctaggggtgattgcgatgatttttgagagtcgtccgaatgtttcagtggatgcttttagtctggcgttcaaaaccaataatgcgatcatcctaaggggaggaaaagatgcccttcactcaaataaagctttggtgaagttgatccgacaaagtctggaaaaatcagggatcaccccagatgctgtccagctagttgaggatccctcacatgctgtcgctgaagaattgatgcaggcaacggattatgtagatgttttgattccacgtggtggtgctaaattaattcagaccgttaaggaaaaagcaaaagtgcctgtcatcgaaacaggtgtggggaatgtgcatatctatgtggatgctcaagctgacttagatatagctactaagattgttatcaacgctaaaacaaagcgcccaagtgtttgcaatgcagctgagggattggtaattcacgaagctgtagcagcaaggtttattcctatgcttgaaaaagcgatcaatcaagttcagccagtagaatggcgggcagatgacaaggctttgccgttatttgagcaggcagtgcctgcaaaagcagaggattttgagaccgaatttttagattatatcatgtctgttaaggttgtttcctctttggaagaagctatttcttggataaatcagtatactagtcaccattccgaagctatcatcacaagggatattaaggcagcagagacctttcaagatttagtggatgctgctgctgtttatgtcaacgcttcaacacgatttaccgatggttttgtttttgggcttggtgctgaaattgggatttctactcaaaaaatgcacgcccgtgggccaatgggcttagaagccttgaccagcactaaattttatattaatggggatggacatatcagagaa

SEQ ID NO: 2892 - protein, 416 aa, Streptococcus pyogenes
MTDMRRLGQRAKQASLLIAPLSTQIKNRFLSTLAKALVDDTQTLLAANQKDLANAKEHGISDIMMDRLRLTSERIKAIAQGVQQVADLADPIGQVIKGYTNLDGLKILQKRVPLGVIAMIFESRPNVSVDAFSLAFKTNNAIILRGGKDALHSNKALVKLIRQSLEKSGITPDAVQLVEDPSHAVAEELMQATDYVDVLIPRGGAKLIQTVKEKAKVPVIETGVGNVHIYVDAQADLDIATKIVINAKTKRPSVCNAAEGLVIHEAVAARFIPMLEKAINQVQPVEWRADDKALPLFEQAVPAKAEDFETEFLDYIMSVKVVSSLEEAISWINQYTSHHSEAIITRDIKAAETFQDLVDAAAVYVNASTRFTDGFVFGLGAEIGISTQKMHARGPMGLEALTSTKFYINGDGHIRE

SEQ ID NO: 2893 - DNA, 945 bp, Streptococcus agalactiae
atgacaaacgattttcatcatattactgtgcttttgcacgagactgtggatatgcttgatattaagccggatggtatctatgtagatgctactttaggtggggcaggacacagcgaatatcttctttcacaattaggcccagatgggcacctttacgcatttgaccaagaccagaaggctattgacaatgctcatatacgtttaaagaaatatgtggataccggtcaagtaacctttatcaaagataatttcagaaatctatcttctaacttaaaagcattaggagtgtcggaaattaatggtatttgttatgatttaggtgtatcaagcccacagctggacgagcgtgaacgcggtttctcatataaacaagacgccccccttgatatgcgaatgaatagagagcagagtcttacagcttatgacgttgtgaacacttatagttatcatgatttagtaaggattttctttaagtatggcgaagataaattttcaaaacaaattgctcgaaaaattgagcaagtacgagctgaaaaaacaatatctacaacaacagaattggctgagattatcaaatcgtctaaatctgccaaagaactgaagaaaaaaggtcatccagctaaacaaatttttcaagctattcgtattgaagtcaatgacgaactaggagctgcagatgaatctatacaacaagcaatggacttattagctgttgatggtcgtatatctgtcatcacttttcattctttagaagatcgtcttactaagcaactttttaaagaagcatcaacagtagaagtacctaaaggtcttccttttataccagatgatttacaacctaagatggagctcgttaatcgtaaacccatcttaccaagtcaagaagaactagaagcgaacaatcgtgcccattcagcgaaattgagagtagcgcgtcgtattcga

SEQ ID NO: 2894 - protein, 315 aa, Streptococcus agalactiae
MTNDFHHITVLLHETVDMLDIKPDGIYVDATLGGAGHSEYLLSQLGPDGHLYAFDQDQKAIDNAHIRLKKYVDTGQVTFIKDNFRNLSSNLKALGVSEINGICYDLGVSSPQLDERERGFSYKQDAPLDMRMNREQSLTAYDVVNTYSYHDLVRIFFKYGEDKFSKQIARKIEQVRAEKTISTTTELAEIIKSSKSAKELKKKGHPAKQIFQAIRIEVNDELGAADESIQQAMDLLAVDGRISVITFHSLEDRLTKQLFKEASTVEVPKGLPFIPDDLQPKMELVNRKPILPSQEELEANNRAHSAKLRVARRIR

SEQ ID NO: 2895 - DNA, 1011 bp, Streptococcus pyogenes
atgaaatccttttctcttactttttcatttctaaaccttttgaagtatggtacaattaaagttatgacaaaagaatttcatcacgtgaccgtactccttcacgaaacagtggacatgcttgacataaagcctgatgggatttatgttgatgcgacgctaggtggctcaggccactcagcttatttgttgtccaaacttggtgaagaagggcacctctattgttttgaccaagaccaaaaggctattgacaatgcacaagttaccctcaaatcttatattgacaaaggacaggtaacttttattaaagataattttagacacctcaaagcacgtttaacagcgcttggagttgatgaaattgatggtatcttatatgaccttggtgtttccagcccgcaattggatgaaagagaacgagggttttcttataaacaagatgctccattggatatgcgcatggatcgtcagtcgctcttaacagcttacgaagtggtgaatacctatccattcaatgatttggttaagatttttttcaaatatggtgaagataaattctccaagcagatcgctcgaaaaattgaacaagcaagagctattaagcctattgagacaacaacagagttggcagaattgattaaggcagcaaagccagctaaagagttgaagaaaaaaggccaccctgctaaacagatttttcaagctattcgcattgaagtcaatgatgaattgggagcggccgatgaatctattcaggacgctatggaattattagcccttgatggtcgtatctcagttattaccttccattctctggaagatcgcctaaccaagcagttgtttaaagaagctagtacggtggatgtgccaaaagggcttcctctaattcctgaagatatgaaacctaagtttgaacttgtttcacgtaagccgatcttacctagtcattcagagttaacagctaataaaagggcacactcagccaagctacgtgttgccaaaaaaattcggaaa

SEQ ID NO: 2896 - protein, 337 aa, Streptococcus pyogenes
MKSFSLTFSFLNLLKYGTIKVMTKEFHHVTVLLHETVDMLDIKPDGIYVDATLGGSGHSAYLLSKLGEEGHLYCFDQDQKAIDNAQVTLKSYIDKGQVTFIKDNFRHLKARLTALGVDEIDGILYDLGVSSPQLDERERGFSYKQDAPLDMRMDRQSLLTAYEVVNTYPFNDLVKIFFKYGEDKFSKQIARKIEQARAIKPIETTTELAELIKAAKPAKELKKKGHPAKQIFQAIRIEVNDELGAADESIQDAMELLALDGRISVITFHSLEDRLTKQLFKEASTVDVPKGLPLIPEDMKPKFELVSRKPILPSHSELTANKRAHSAKLRVAKKIRK

SEQ ID NO: 2897 - DNA, 324 bp, Streptococcus agalactiae
atgacaaatgaaaaacgaactgaagcagtaacacaaactttacaacgtcacatcaagactttctctcgtattgagaaagctttttatggtgctattgtaattactgctattatcatggcagtcggtattatttacttgcaaagtaatagtttacaagttaaacaagaagtaaatcaattaaatagtaaaatcaacgataaacagacagaatttgacaatgctaaacaagaagtaaatgagctttctaatcgtgatcgaattactaaaattgctaaagatgctggtttaacaattcaaaacgacaatatttatcggaaggtggac

SEQ ID NO: 2898 - protein, 108 aa, Streptococcus agalactiae
MTNEKRTEAVTQTLQRHIKTFSRIEKAFYGAIVITAIIMAVGIIYLQSNSLQVKQEVNQLNSKINDKQTEFDNAKQEVNELSNRDRITKIAKDAGLTIQNDNIYRKVD

SEQ ID NO: 2899 - DNA, 351 bp, Streptococcus pyogenes
gtgttgccaaaaaaattcggaaataagcctatgacaaatgaaaaaagaactcaggtagttacaaatgccttgcaaaaacgaataaaaactttctctagaattgagaaggctttttatactgctatcattgtaacagcgattacgatggcagtaagtattatttacctgcaaagtcgtaagttgcagctacaacaagaaatcactagtttaaatagtcatatttcggatcaaaaactagagcttaataatgccaagcaagaagtaaatgagttatctcgccgtgatcgtattatagatattgctggtaaagcaggcttaagcaaccgtaataataatatcaagaaagtcgag

SEQ ID NO: 2900 - protein, 117 aa, Streptococcus pyogenes
VLPKKFGNKPMTNEKRTQVVTNALQKRIKTFSRIEKAFYTAIIVTAITMAVSIIYLQSRKLQLQQEITSLNSHISDQKLELNNAKQEVNELSRRDRIIDIAGKAGLSNRNNNIKKVE

SEQ ID NO: 2901 - DNA, 108 bp, Streptococcus agalactiae
ttggcttccttggataaattaaccccaaatttactatctgtaccaacgatgatgacaaagttgatgataaaaatgaaaaataggaaaatggttaaaatcatcagattt

SEQ ID NO: 2902 - protein, 36 aa, Streptococcus agalactiae
MASLDKLTPNLLSVPTMMTKLMIKMKNRKMVKIIRF

SEQ ID NO: 2903 - DNA, 2256 bp, Streptococcus agalactiae
gtgactttttttaaaaagctaaaaaaaatcttccttgattatgtgatccatataagagataggcgttcgccgcagaaaaatagggaaagagtaggtcaaaatctgatgattttaaccattttcctatttttcatttttatcatcaactttgtcatcatcgttggtacagatagtaaatttggggttaatttatccaaggaagccaagaaagtctatcaacaaagtatgacagtacaggcgaagcgtgggacaatttacgaccgtaatggaaatcctatcgctgaggatgctacgacctatagtctctacgctattatctcaaagaactatacgacagctacaggtcaaaaactatatgtacaaccttctcagtatgaaaaagtagctagtatcttagagaataaattgggcatgaagaaaaatcttgtcctaaaacaactcaatcaaaagaaattgtttcaagtttcctttggaagttcaggttcaggattgtcttataccaagatggctgacatcaagaaaacgatggaaaagtcagatatcaaaggaattggtttttctaccagtccggggcgtatttatccaaatgggatatttgcttcacaatttataggatttactcttcctcaggatgatggagatggaaaaaaattagttggtaatacaggccttgaagcggcacttaacaaggtattatcaggtactgatggtaaagtaacatacgaaaaagaccgtagtgggaatgttcttttaggtactgcaacaacagaacgtagggcggttaatggtaaggatatctacacaactttatcagagcctattcagactgttttagagactcagatggatgttttcgcagaaaaaaccaaaggaaaatttgcgagtgctacagttgtcaacgctaaaacgggtgaaattctagcaacgagtcagcgtcctacttataatccttctacccttaaaggttacgataagaaaaatttgggtacctataacacactactatatgataacttttttgaacctggttcaacaatgaaggtaatgactctagcctctgcaattgattctaagcattttaactctactgaagtgtataacagtgcacaatataaaattgcagatgcgattattcgagattgggatgtcaatgaagggttatcatctggtagttatatgacttttccacaagggtttgcacattccagtaacgttggtatggtaaccttggaacaaaaaatgggacgagataaatggttaaactatctttctaagtttaaatttggttacccaacacgttttgggatgcttcatgaaagtggaggtttgttcccatctgacaatgaagtaactatcgctatgagctcatttggtcaaggtattggtgtaacgcaagttcaaatgttgcgcgcatttacgtctatctcgaatgatggtgttatgttacaaccacagtttattagcagtatttatgatccaaatacagggacttctcgtacagcacgaaaagaagtcgttggaaaaccagtttccaaagaagcagctagtaaaacacgtgattatatggttactgttgggacagatccttattatggtacattatacgcagcaggtgccccagttattcaggtggggaatcaatcagttgcagtaaaatctggtactgcccaaatcgcccaggaaggtggtggtggttatctgcaaggaaaaaatgatactattaactcagttgtggctatggtgccatcggaaaatcctgacttcatcatgtatgttaccatccaacaacccgaaaaatttagtatcacattctggaaagatgttgttaatcctgttttagaacaagcaacagcaatgaaagaaacgatattaaaaccgggattgaatgactcagaacatcagacaaaatataaactatcaaaaatagttggtgaaaatccaggtcatgtagcggaagaattacgtcgtaatctggttcagccaattattttaggaaatggtagtaaagtttctaaagtatctaaaagaccaggagctaatcttgctgagaatgaacagctactagtattaacaaataaactgactgaattacctgatatgtatggttggtctaaagcaaacgttgaacagtttgctaaatggacaggtataaaagtgacctataaaggttcaacctcaggtaaagtaagaaaacaaagtattgatgttggaaaatccatcaataaaattaaaaaaatcaaaattacaataggagat

SEQ ID NO: 2904 - protein, 752 aa, Streptococcus agalactiae
MTFFKKLKKIFLDYVIHIRDRRSPQKNRERVGQNLMILTIFLFFIFIINFVIIVGTDSKFGVNLSKEAKKVYQQSMTVQAKRGTIYDRNGNPIAEDATTYSLYAIISKNYTTATGQKLYVQPSQYEKVASILENKLGMKKNLVLKQLNQKKLFQVSFGSSGSGLSYTKMADIKKTMEKSDIKGIGFSTSPGRIYPNGIFASQFIGFTLPQDDGDGKKLVGNTGLEAALNKVLSGTDGKVTYEKDRSGNVLLGTATTERRAVNGKDIYTTLSEPIQTVLETQMDVFAEKTKGKFASATVVNAKTGEILATSQRPTYNPSTLKGYDKKNLGTYNTLLYDNFFEPGSTMKVMTLASAIDSKHFNSTEVYNSAQYKIADAIIRDWDVNEGLSSGSYMTFPQGFAHSSNVGMVTLEQKMGRDKWLNYLSKFKFGYPTRFGMLHESGGLFPSDNEVTIAMSSFGQGIGVTQVQMLRAFTSISNDGVMLQPQFISSIYDPNTGTSRTARKEVVGKPVSKEAASKTRDYMVTVGTDPYYGTLYAAGAPVIQVGNQSVAVKSGTAQIAQEGGGGYLQGKNDTINSVVAMVPSENPDFIMYVTIQQPEKFSITFWKDVVNPVLEQATAMKETILKPGLNDSEHQTKYKLSKIVGENPGHVAEELRRNLVQPIILGNGSKVSKVSKRPGANLAENEQLLVLTNKLTELPDMYGWSKANVEQFAKWTGIKVTYKGSTSGKVRKQSIDVGKSINKIKKIKITIGD

SEQ ID NO: 2905 - DNA, 2253 bp, Streptococcus pyogenes
atgaaaaaatggcaaaaatatgttttagattatgttgtgcgcgataggagaactccagtcgaaaatcgcgttcgagttggacaaaatatgatgctcttaactatctttattttctttattttcattattaatttcatgattattattggaacagatcaaaagtttggagttagtttgtcagaaggggcgaagaaggtttatcaagaaaccgttacgatccaagctaagcgtgggaccatttatgatcgaaatggtacagctattgcagtggattctacgacttatagcatatacgcaattttggataaatcatttgtctcggcttcagatgaaaagttatatgtacaaccttctcagtatgaaacagtagctgatattttaaaaaagcatctgggaatgaaaaaaacagatgtaattaaacagcttaagcgtaaaggacttttccaagtctcgtttggaccgtcagggtctggcatttcatatagtactatgtctactattcaaaaggctatggaagatgccaaaatcaagggaattgctttcacaactagtcctggtcgtatgtatccaaatgggacatttgcttcagaatttataggcctagcatctctaacagaagataaaaagacaggtgttaagagtttagttggaaaaacaggtctagaagcttcttttgataaaattttatcaggtcaagatggtgttattacttatcaaaaagatcgaaatgggaccacactcttgggtacaggtaagactgtcaagaaagctattgatggcaaagatatttacacaacgctatctgagcctatccagaccttcttagaaacccagatggatgtttttcaagccaaatcaaatggtcagttggccagtgcaacacttgttaatgctaaaactggtgaaattttggcaacaacacaacgccccacttataatgctgatactctgaaaggacttgaaaatacgaactacaaatggtacagtgcacttcatcaaggaaattttgaaccaggttcaaccatgaaagtgatgactctggcagcggctattgatgataaagttttcaacccaaacgaaacctttagcaatgctaatggtttgacaattgcagatgctactattcaagactggtctattaacgaaggcatttccacaggacagtacatgaattatgcacaagggtttgccttctcaagtaacgttgggatgactaaacttgaacaaaaaatgggtaatgcaaaatggatgaattatttgacgaagttccgctttggttttcctactcgttttggtttaaaagatgaagacgcaggtatatttccttctgataatatcgtgactcaagctatgagcgcttttggtcaagggatttctgtaacccagattcaaatgcttagagcctttactgctatttctaataatggtgagatgttagagccacaatttatcagtcaaatttatgatcctaacacagcaagttttagaacggcaaataaagaaattgttggaaaacctgtatcaaaaaaagccgctagtgaaacaagacaatacatgattggtgtaggaacagaccctgagtttggaacactctattcaaaaacatttggaccaattattaaagtgggtgatttacctgttgctgttaaatcaggaacagcacaaattggttcagaagatggaagtggttatcaagatggtggattgactaactatgtctattcggttgtggcaatggtgccagctgataaaccagactttttgatgtatgttactatgactaaaccacaacattttggtccccttttttggcaagatgtggttaacccagtattggaagaagcatacttaatgcaagatacactaactaagccagtagtatcagatgctaatcgtcaaacaacttataaattaccaaactttgtaggaaagaatcctggtgagacatcaagcgagttgcgtcgaaaccttgtccagccagttgtccttggtactggcagcaagatcaaaaaagtatcgcatcagcccggtcaaacgttaacagaaaaccaacaagttctcatattatcagaccgttttgtggaggtaccagacatgtatggctggacaaaatccaatgttaaaacctttgctaaatggactggaatagacatcagctttaaaggaacagattctggtcgtgttatgaaacaaagtgttgatgttggtaagtccttgaaaaaaataaaaaaaatgaccattactttaggagat

SEQ ID NO: 2906 - protein, 751 aa, Streptococcus pyogenes
MKKWQKYVLDYVVRDRRTPVENRVRVGQNMMLLTIFIFFIFIINFMIIIGTDQKFGVSLSEGAKKVYQETVTIQAKRGTIYDRNGTAIAVDSTTYSIYAILDKSFVSASDEKLYVQPSQYETVADILKKHLGMKKTDVIKQLKRKGLFQVSFGPSGSGISYSTMSTIQKAMEDAKIKGIAFTTSPGRMYPNGTFASEFIGLASLTEDKKTGVKSLVGKTGLEASFDKILSGQDGVITYQKDRNGTTLLGTGKTVKKAIDGKDIYTTLSEPIQTFLETQMDVFQAKSNGQLASATLVNAKTGEILATTQRPTYNADTLKGLENTNYKWYSALHQGNFEPGSTMKVMTLAAAIDDKVFNPNETFSNANGLTIADATIQDWSINEGISTGQYMNYAQGFAFSSNVGMTKLEQKMGNAKWMNYLTKFRFGFPTRFGLKDEDAGIFPSDNIVTQAMSAFGQGISVTQIQMLRAFTAISNNGEMLEPQFISQIYDPNTASFRTANKEIVGKPVSKKAASETRQYMIGVGTDPEFGTLYSKTFGPIIKVGDLPVAVKSGTAQIGSEDGSGYQDGGLTNYVYSVVAMVPADKPDFLMYVTMTKPQHFGPLFWQDVVNPVLEEAYLMQDTLTKPVVSDANRQTTYKLPNFVGKNPGETSSELRRNLVQPVVLGTGSKIKKVSHQPGQTLTENQQVLILSDRFVEVPDMYGWTKSNVKTFAKWTGIDISFKGTDSGRVMKQSVDVGKSLKKIKKMTITLGD

SEQ ID NO: 2907 - DNA, 174 bp, Streptococcus agalactiae
ttgaaaaaccaacaacccagaaaagaacaaaaaaagcgtataagtatcctacttcaaggtaaaaaccaaaaatatttatcgcagatgtgccacttggtaacacatggacaaaataaaaaattagacccgcaattagttggagcgacattttttgctttggagtcaagccctcat

SEQ ID NO: 2908 - protein, 58 aa, Streptococcus agalactiae
MKNQQPRKEQKKRISILLQGKNQKYLSQMCHLVTHGQNKKLDPQLVGATFFALESSPH

SEQ ID NO: 2909 - DNA, 1008 bp, Streptococcus agalactiae
atgtttttaagtataatggcaggtgtcatagcatttgtcctgacagttattgccattccgcgcttcattaagttttaccaattgaagaaaattggcgggcaacaaatgcatgaagatgtcaaacaacatctagccaaagcaggtacgccgacaatgggaggaacggtatttttgattgttgctcttcttgtctcacttatttttagtattattttatctaaagaaaatagtggtaatttaggtgcaacttttggtattttatctgttgttctcatctatggaattattggttttttagatgattttttgaaaatttttaaacaaatcaatgagggcttgactccaaagcaaaaaatgtcgctccaactaattgcgggtctaattttttattttgtccatgtgttaccaagtggcacatctgcgataaatatttttggtttttaccttgaagtaggatacttatacgctttttttgttcttttctgggttgttggtttttcaaatgctgtgaacctaacagatggaattgatggtctagcttctatttcggttgttatcagtttgattacttatggaatcattgcttataatcaaacgcaatttgatattttattgattatcgttatcatgattggtgctttacttggcttttttgtctttaatcataaaccagctaaagtctttatgggagatgttggttcacttgcattgggtgctatgttagcagccatttcaattgccttacgtcaggaatggaccttgctttttatcggctttgtctatgtttttgagacgtcttcagtgatgttgcaagtagcatactttaagtatactaagaagaaaactggtgttgggaaacgtatcttccgcatgacaccatttcatcaccatttagaattaggtggtgtgtctggcaaaggtaataaatggagcgaatggaaagtagatgcttttttatgggctattggtattttcatgagcgctattacacttgctattttatatctt

SEQ ID NO: 2910 - protein, 336 aa, Streptococcus agalactiae
MFLSIMAGVIAFVLTVIAIPRFIKFYQLKKIGGQQMHEDVKQHLAKAGTPTMGGTVFLIVALLVSLIFSIILSKENSGNLGATFGILSVVLIYGIIGFLDDFLKIFKQINEGLTPKQKMSLQLIAGLIFYFVHVLPSGTSAINIFGFYLEVGYLYAFFVLFWVVGFSNAVNLTDGIDGLASISVVISLITYGIIAYNQTQFDILLIIVIMIGALLGFFVFNHKPAKVFMGDVGSLALGAMLAAISIALRQEWTLLFIGFVYVFETSSVMLQVAYFKYTKKKTGVGKRIFRMTPFHHHLELGGVSGKGNKWSEWKVDAFLWAIGIFMSAITLAILYL

SEQ ID NO: 2911 - DNA, 927 bp, Streptococcus pyogenes
ttgaaaaaaattggtgggcaacaaatgcatgaagatgtcaagcaacatttagctaaagctggaacaccgactatggggggaactgtttttcttttagtagctacggcagtatcgttattggttagtctattttcgatcaaaaacactcaaagtttagctttgatttcaggcattttatcaattgttgtcatttacgggattatcggatttttggatgattttttaaaaatttttaagcaaatcaatgaaggattgacagccaaacaaaagttagccttgcagttggttggaggattgatgttctattttttacatgttagtccaagtggcatttcctctattaatgtgtttggttatcagctgccgctgggaattttctacctattctttgttttgttttgggtggttggtttttcaaatgccgttaatttgacagatggtatcgatggcttagcttctatctcagtggtgattagtctagtgacttacggcgttattgcctacgttcagagtcaatttgatgttttgttactgattggagcaatgattggagccttgcttggcttcttctgctttaatcacaaacctgctaaagtatttatgggagatgtaggtagtttagcccttggagctatgttggctgccatttctattgcgcttcgtcaagaatggactctcctgattattgggatcgtttatgttcttgaaacaagttctgtgatgttgcaagtgtcctatttcaagtacaccaagaaaaaatatggagaaggtcgtcgtatttttagaatgacgcctttccaccaccatttggaattgggaggcttgtctggtaaaggcaagaagtggtcagaatggcaggtagatgcttttttgtggggagtaggaagtctagctagtttactagttttagctatcttatacgtgttc

SEQ ID NO: 2912 - protein, 309 aa, Streptococcus pyogenes
LKKIGGQQMHEDVKQHLAKAGTPTMGGTVFLLVATAVSLLVSLFSIKNTQSLALISGILSIVVIYGIIGFLDDFLKIFKQINEGLTAKQKLALQLVGGLMFYFLHVSPSGISSINVFGYQLPLGIFYLFFVLFWVVGFSNAVNLTDGIDGLASISVVISLVTYGVIAYVQSQFDVLLLIGAMIGALLGFFCFNHKPAKVFMGDVGSLALGAMLAAISIALRQEWTLLIIGIVYVLETSSVMLQVSYFKYTKKKYGEGRRIFRMTPFHHHLELGGLSGKGKKWSEWQVDAFLWGVGSLASLLVLAILYVF

SEQ ID NO: 2913 - DNA, 1341 bp, Streptococcus agalactiae
atgtcatttaaagattttaattttaaaccatacattcagagggctctcgatgagttaaaattcgtcgatccaactgatgttcaagctaaattgattccagttgttcgttcaggccgcgatcttgtgggggaatcgaaaactggttctggtaaaacccacacctttttacttcctatttttgagaagctagatgaaagtagtgatgatgttcaagttgttattactgcaccaagtagagagttgggaacacaaatttatcaggcaactaaacaaattgctgagcattcagagcaagaaatacgggtggttaactatgttggtggtactgacaaattacgtcaaattgaaaagttgaaagtaagccaacctcatattgtcattggaaccccaggacgaatttatgatttggtgaagtcaggtgatttagctattcataaggcgcatacttttgttgttgatgaagcagatatgactctagatatgggatttcttgataccgttgataagattgcagggtctttacccaaggatgtccaaattttagtcttttcagcaacgattccacaaaaattacagccatttttaaagaaatatttgaccaatcctgtaatggaaaaaatcaaaacagcaacagttatcgctgataccatcgataactggcttttgtccactaaaggacgtgataaaaatgcacaaattttggaactctctaaactaatgcagccctatcttgcaatgatatttgttaatacgaaagagcgtgcagacgaattacattcgtacctttctagtaatggcttaaaagtagctaaaattcatggtgggattgcacctcgtgaacgtaaacgtattatgaatcaggttaaaaacctcgaatttgaatatatcgttgcaacagatttagcagcgcgtggtattgatattgaaggtgttagccatgttatcaatgatgccatacctcaagacctatctttctttgtccaccgtgtcggtcgcacaggccgtaatggcttatctggtactgctataactttatatcagccaagtgacgattctgatattcgtgaacttgaaaaactaggtattaattttattcctaaagtcattaaaaacggtgaatttcaagatacatacgaccgtgatcgtcgtaataaccgtgaaaagtcctatcaaaaattagatacagaaatgattggacttgtgaaaaagaaaaagaaaaaaataaaaccaggttacaagaaaaaaattcaatggaaagttgatgaaaagcgtcgcaaagagcgtagagcaagtaatcgtgctaaggggcgtgcggagcgcaaagctaaaaaacaaagtttt

SEQ ID NO: 2914 - protein, 447 aa, Streptococcus agalactiae
MSFKDFNFKPYIQRALDELKFVDPTDVQAKLIPVVRSGRDLVGESKTGSGKTHTFLLPIFEKLDESSDDVQVVITAPSRELGTQIYQATKQIAEHSEQEIRVVNYVGGTDKLRQIEKLKVSQPHIVIGTPGRIYDLVKSGDLAIHKAHTFVVDEADMTLDMGFLDTVDKIAGSLPKDVQILVFSATIPQKLQPFLKKYLTNPVMEKIKTATVIADTIDNWLLSTKGRDKNAQILELSKLMQPYLAMIFVNTKERADELHSYLSSNGLKVAKIHGGIAPRERKRIMNQVKNLEFEYIVATDLAARGIDIEGVSHVINDAIPQDLSFFVHRVGRTGRNGLSGTAITLYQPSDDSDIRELEKLGINFIPKVIKNGEFQDTYDRDRRNNREKSYQKLDTEMIGLVKKKKKKIKPGYKKKIQWKVDEKRRKERRASNRAKGRAERKAKKQSF

SEQ ID NO: 2915 - DNA, 1341 bp, Streptococcus pyogenes
atgtcatttaaagattatcattttaagcaatacgttcagcaagcgctggaagaaattggctttgtcaatccaacagaggtccagaagcggctgattcctattgttaactccggtcgtgacttagttggggaatcaaaaacaggttcagggaaaacccacacctttttgttgcccatttttgaaaaacttgatgaagctaaagcagaagtgcaagtcgttattacagcacctagccgtgaattagcaactcaaatttttgatgcttgtaaacagattgctaagcacttccaagaagagattcgtttggccaactatgttggaggcacagacaaactccgtcagattgaaaaactaaaagacagccagccgcatattgtcatcgggaccccaggtcgtatttatgacttggtcaagtctggtgatttagcgattcataaagcaacgacctttgttgtggatgaggccgatatgaccatggacatgggctttttggatacggtagataagattgcagcttcgcttccaaaatctgttcagattttggtgttctcagcaactattccacagaaattacaaccctttttgaaaaaatacttgaccaatcctgttattgaacaaatcaagacaaagaccgttatcgcagataccattgataactggcttgtgtcgacaaaagggcgtgataagaatggtcaactgttagagattctcaaaaccatgcagccttatatggctatgctttttgtcaataccaaggaacgcgcagatgatttgcatgcctttttaacagctaatggcttaaaagtggctaagattcatgggggcattcctccaagagaacgtaagcgcatcatgaaccaagtcaaaaaactggactttgaatacattgttgccacagacttagcagcgcgtgggattgacattgaaggggtcagccatgtgatcaatgacgccatcccacaagacttgtctttctttgtccatcgtgtaggccgaacaggtcgaaatggtatggcaggaactgccattacactttaccagccaagtgacgactcagatatcaaagagctggaaaaaatggggattgcctttacaccgaaggtgctcaaaaatggagaatttcaagatacctatgaccgtgatcgccgtcaaaaccgtgaaaaagcctatcaaaaattagacacagaaatgattggtttggtcaaaaagaaaaagaaaaaagtcaaaccaggttacaagaaaaaaattcagtgggcggttgatgaaaaacgtcgcaaagaacgtcgtgctgaaaatcgtgctaagggccgcgctgagcgtaaggccaaaaaacaacatttt

SEQ ID NO: 2916 - protein, 447 aa, Streptococcus pyogenes
MSFKDYHFKQYVQQALEEIGFVNPTEVQKRLIPIVNSGRDLVGESKTGSGKTHTFLLPIFEKLDEAKAEVQVVITAPSRELATQIFDACKQIAKHFQEEIRLANYVGGTDKLRQIEKLKDSQPHIVIGTPGRIYDLVKSGDLAIHKATTFVVDEADMTMDMGFLDTVDKIAASLPKSVQILVFSATIPQKLQPFLKKYLTNPVIEQIKTKTVIADTIDNWLVSTKGRDKNGQLLEILKTMQPYMAMLFVNTKERADDLHAFLTANGLKVAKIHGGIPPRERKRIMNQVKKLDFEYIVATDLAARGIDIEGVSHVINDAIPQDLSFFVHRVGRTGRNGMAGTAITLYQPSDDSDIKELEKMGIAFTPKVLKNGEFQDTYDRDRRQNREKAYQKLDTEMIGLVKKKKKKVKPGYKKKIQWAVDEKRRKERRAENRAKGRAERKAKKQHF

SEQ ID NO: 2917 - DNA, 810 bp, Streptococcus agalactiae
atgtttaaaaaaataatattatctattgcaactatagccgcaaccgccagcctagcagtatcagttcaggcgtcagagaaagtagaacttaaagtagctacagattctgacacggcaccatttacttatcaaaaagacgggaaattcaaaggttatgatgttgatgttgtcaaagctgtttttaaaggtagtaagtacaaagtaaccttcaagacagttccttttgatactatttcaacaggtattgatgcagggaaatttgatttatcagctaatgatttttcatacaataaagaaagagcagaaaaatatctcttctcagatcctatatcccgttcaaattatgccgtagtagggaagaaggggagccattacaaatcattaagtgacctctctggaaaatcaaccgaagttttatctggcgttaactatgcacaggttctagaaaattggaataaaaatcatcctaataaaaaaccaataaaaatcaaatatgtttctgggacaactggtgttactagcagattaaaaaatattgagagtgggaaaattgactttatcctatatgatgccatttcatccgactatattgtaaaagaccaatcattaaacttaagcgtttctcctttgaaaggtaaaattggtaataataaggatggactagaatacctccttttaccaaaagataaaaaaggtaaaactctacagaaatttataaataagcgtattaaagttttgaaagaaaatggtactttggcacgtttaagtaaacaatatttcggtggagattacgtttcaaacattgataaa

SEQ ID NO: 2918 - protein, 270 aa, Streptococcus agalactiae
MFKKIILSIATIAATASLAVSVQASEKVELKVATDSDTAPFTYQKDGKFKGYDVDVVKAVFKGSKYKVTFKTVPFDTISTGIDAGKFDLSANDFSYNKERAEKYLFSDPISRSNYAVVGKKGSHYKSLSDLSGKSTEVLSGVNYAQVLENWNKNHPNKKPIKIKYVSGTTGVTSRLKNIESGKIDFILYDAISSDYIVKDQSLNLSVSPLKGKIGNNKDGLEYLLLPKDKKGKTLQKFINKRIKVLKENGTLARLSKQYFGGDYVSNIDK

SEQ ID NO: 2919 - DNA, 840 bp, Streptococcus pyogenes
atgattaaaaaacagtatttaggaagggcaacaattgccctagcatcgacccttgtgctagcagcttgtgggtcatcaaaaacagctgagtcaggaaatcaggggagttctaaagaagtcttatttgcaacggttggaacaacagctcccttttcttatgaaaaaggtggtcaactaactggctacgatatcgaggtggctaaagcagtctttaaaggatcggatgattacaaggtgtcctttaaaaaaacagaatggtcttctatctttacaggtttggactcaggaaaataccaaatgggtggtaacaacatttcctttaccaaagagcgttcagctaagtaccttttttcttatccaatcggatcaacaccttctgttttagttgttccaaaagacagtgatatcaagagctttgatgatatccaagggcatacgacacaagttgttcaagggactacaagtgttgcacagttagaagactttaataagaaacacagtgacaacccggttactctaaaattcaccaatgagaacattactcaaatgttaaccaatttgagtgaaggcaaggcagatttcaagatttttgacgctccaacggttaacgccattattaaaaatcaagggttagataatctcaaaacaattgaactcacctcaacagagcaaccatttatttattttatctttagtcaagatcaagagaaattgcaaagctttgttaacaagcgtattaaagagttgactgctgatggaactcttagcaagcttgccaaagagcaccttggcggtgattacgtgccatcagataaagagttgaaacttcctacagctaac

SEQ ID NO: 2920 - protein, 280 aa, Streptococcus pyogenes
MIKKQYLGRATIALASTLVLAACGSSKTAESGNQGSSKEVLFATVGTTAPFSYEKGGQLTGYDIEVAKAVFKGSDDYKVSFKKTEWSSIFTGLDSGKYQMGGNNISFTKERSAKYLFSYPIGSTPSVLVVPKDSDIKSFDDIQGHTTQVVQGTTSVAQLEDFNKKHSDNPVTLKFTNENITQMLTNLSEGKADFKIFDAPTVNAIIKNQGLDNLKTIELTSTEQPFIYFIFSQDQEKLQSFVNKRIKELTADGTLSKLAKEHLGGDYVPSDKELKLPTAN

SEQ ID NO: 2921 - DNA, 159 bp, Streptococcus agalactiae
ttgacacggttaattttcactactgcaaaaatcaaagctaaaatgagtccaaataaggctcctgctactgtcaataatagtgttatgggtaatcgctctaaaattgagggtattgcatctaaaacagccttccaactaaataatttccccgctggaacc

SEQ ID NO: 2922 - protein, 53 aa, Streptococcus agalactiae
MTRLIFTTAKIKAKMSPNKAPATVNNSVMGNRSKIEGIASKTAFQLNNFPAGT

SEQ ID NO: 2923 - DNA, 801 bp, Streptococcus agalactiae
atgaatcaatttatcttgacgggtggatggtcttggtataataatttggttagtcaggttccagcggggaaattatttagttggaaggctgttttagatgcaataccctcaattttagagcgattacccataacactattattgacagtagcaggagccttatttggactcattttagctttgatttttgcagtagtgaaaattaaccgtgtcaaaattttatatccgattcaagctttatttgttagttttttacgtgggactccaatacttgttcaattaatgctgagttattatggaattccacttttcttgaaatttttaaaccaaaaatatggttttgattggaacattaatgctataccggcttctgtatttgctattactgcatttgcttttaatgaagcggcttatacaagtgaaactatacgagcggcgattttgtcggttgatcaaggtgaaattgaggcagcacgtagtttagggatgacctcagcgcaagtttatcgtcgtgttattattccaaacgcagcagtagtcgcaacacctactttgataaacacgttaattggtctaactaagggaacctctttagcttttaatgctggtattgttgaaatgtttgcccaagcacaaattatgggtggtagcgattatcgctattttgaacgttatatctctgtggcacttgtttactgggcggttagtttcttaattgaacaattgggaaatgctattgaacgaaaaatggcaattaaggctccacgccatttaactgatgagattccaggaggagtacgc

SEQ ID NO: 2924 - protein, 267 aa, Streptococcus agalactiae
MNQFILTGGWSWYNNLVSQVPAGKLFSWKAVLDAIPSILERLPITLLLTVAGALFGLILALIFAVVKINRVKILYPIQALFVSFLRGTPILVQLMLSYYGIPLFLKFLNQKYGFDWNINAIPASVFAITAFAFNEAAYTSETIRAAILSVDQGEIEAARSLGMTSAQVYRRVIIPNAAVVATPTLINTLIGLTKGTSLAFNAGIVEMFAQAQIMGGSDYRYFERYISVALVYWAVSFLIEQLGNAIERKMAIKAPRHLTDEIPGGVR

SEQ ID NO: 2925 - DNA, 891 bp, Streptococcus pyogenes
ttgcttattgctataatacgaatttactattttacatgtgggtctaagagtgttagaatattaagacaaacaaatacaaaggggaaatacatgacatcagtgtttttaaccagtggttgggctttttatgattacctcatctcaccgattccacatgggaaactttttagttggcatgctgtttttgatgccattccaaatattatccaacggcttccaattacgcttggtttgacactatcaggagcaacctttggcttggttttggctttgatttttgcccttgtcaaaattaataaagtgaagctactataccctattcaagctatttttgtgagtttcttgcgaggaactcctattttggtacagttgatgttgacctactacggtattcccctctttctaaaatttctcaatcagaagtatggctttgattggaatgttaatgcaattccggcttctatttttgccattacagcctttgcttttaatgaagcagcctacgctagtgaaactattcgggcagccattttatcagtagatacaggtgaaattgaagcagcaaaaagtctaggcatgacttctgtgcaggtttaccgtcgtgtcattattcctaatgcaactgttgtggctattccaaccttgattaatgggttaattggcttaactaaaggaacatcgcttgcctttaatgcagggattgtcgaaatgtttgcccaggctcaaattctaggcggatcagattaccgttattttgaacgttatatctctgttgctcttgtctattggtctatcagtattttgatggagcaagtaggtcgcttgattgaaaacaagatggccatcaaagcaccagaacaagctagaaatgaaaagttaggagaattgcgt

SEQ ID NO: 2926 - protein, 297 aa, Streptococcus pyogenes
LLIAIIRIYYFTCGSKSVRILRQTNTKGKYMTSVFLTSGWAFYDYLISPIPHGKLFSWHAVFDAIPNIIQRLPITLGLTLSGATFGLVLALIFALVKINKVKLLYPIQAIFVSFLRGTPILVQLMLTYYGIPLFLKFLNQKYGFDWNVNAIPASIFAITAFAFNEAAYASETIRAAILSVDTGEIEAAKSLGMTSVQVYRRVIIPNATVVAIPTLINGLIGLTKGTSLAFNAGIVEMFAQAQILGGSDYRYFERYISVALVYWSISILMEQVGRLIENKMAIKAPEQARNEKLGELR

SEQ ID NO: 2927 - DNA, 741 bp, Streptococcus agalactiae
atgataaaattgagacaattgactaaatcattttctggtcaaaaagtgttagacaaacttgatttagatattgaaaaaggtcaagttgttgctctagtaggtgcttcaggtgcaggaaaatcaacctttcttcgtagtatgaattatttagaagagcctgattatggaacaattgaaattgatgattttaaagttgattttaaatcaatcagtaaagatgacatactaacattacgccgtaagttagccatggtttttcaacaattcaatctatttgagcgtcgtacagctttggataatgtaaaagaaggtttgaaaattgtcaaaaagatgtcagatcaagaggcaacacggattgcaagagacgaactggcaaaggtcggacttgcagatcgtgaaaaatattatccaagacatttatcaggtggacagaaacaacgtgttgctttggcacgcgcattagccatgaaacctgatgttcttcttttagacgaaccgacatcagcacttgatccagaattagttggagaagttgaaaaatctattgcagatgctgctaagcaggggcaaaccatggtacttgttagtcatgatatgaattttgtttaccaagtagcagataaagttttatttttggaaaaaggtcgtattttagagtctgggacgcctgaacaattatttaaccatcctttagaagaacgtacaaaagaattcttcgctagttataacaaatcgtaccta

SEQ ID NO: 2928 - protein, 247 aa, Streptococcus agalactiae
MIKLRQLTKSFSGQKVLDKLDLDIEKGQVVALVGASGAGKSTFLRSMNYLEEPDYGTIEIDDFKVDFKSISKDDILTLRRKLAMVFQQFNLFERRTALDNVKEGLKIVKKMSDQEATRIARDELAKVGLADREKYYPRHLSGGQKQRVALARALAMKPDVLLLDEPTSALDPELVGEVEKSIADAAKQGQTMVLVSHDMNFVYQVADKVLFLEKGRILESGTPEQLFNHPLEERTKEFFASYNKSYL

SEQ ID NO: 2929 - DNA, 744 bp, Streptococcus pyogenes
ttgatgattacaattagaaatttgagcaagacattctcagggcaaaaagttttagatagtttggctcttgatattgaaaaaggtcaagtgattgctttagttggtgcttcaggagcagggaaatcgaccttccttcgtagcctaaactatttggaaaaaccagattcaggctccattagcattggtgactttacggttgattttgagaccattaccacagagcaagtccttattttacgtcggaaacttgccatggtttttcaacaatttaatctttttgagcgtcgtacagcccttgagaatgtcaaagaaggtcttaaggtggtcaaaaaactgtctgaccaagaagcgactaaactggcgcaagcagaattggctaaggttggtttagcagatcgaaaacatcattacccacgtcatttatcagggggacaaaaacaacgggtagctttagcaagagctctggctatgaaaccagatgttttattactagatgagccgacctcggctcttgacccggaattagttggcgaagtggaaaagtctattactgatgctgctaaatccggacagaccatggttttagtgagtcacgacatgaattttgtttaccaagtggcagatagagtactctttttagatcaagggaaaatcttggaacaaggaacacctgaagaagtctttagacatcctcaaaaagaacgaaccaaagaattttttgcaagctattcaaaaacatacatt

SEQ ID NO: 2930 - protein, 248 aa, Streptococcus pyogenes
LMITIRNLSKTFSGQKVLDSLALDIEKGQVIALVGASGAGKSTFLRSLNYLEKPDSGSISIGDFTVDFETITTEQVLILRRKLAMVFQQFNLFERRTALENVKEGLKVVKKLSDQEATKLAQAELAKVGLADRKHHYPRHLSGGQKQRVALARALAMKPDVLLLDEPTSALDPELVGEVEKSITDAAKSGQTMVLVSHDMNFVYQVADRVLFLDQGKILEQGTPEEVFRHPQKERTKEFFASYSKTYI

SEQ ID NO: 2931 - DNA, 912 bp, Streptococcus agalactiae
atgtatgatactttaataataggttcaggtcctggtggtatgacagcagcgctttacgctgcacgttcaaaccttaaagttgggttaattgaacaaggtgctccaggtggacagatgaataatactgctgaaattgagaactatccaggctacgatcatatctcaggtccagaattatcaatgaagatgtatgagccgttggaaaaatttgaagtagagcatatttatggtatagttcaaagagttgagaacgatggtgatgtaaagcgtgttatcaccgaagatgaatcgtatgaagccaaaacagtaatccttgctaccggagctaaaaacagccttttaggagttccgggtgaagaggaatatactagtcgtggcgtttcttactgtgcggtttgtgatggtgcatttttccgtgatcaggatcttttagttgtgggtggcggtgattctgctgttgaagaagctgtcttcttaactcaatttgctaaaagtgttactattattcaccgacgtgatcaattgagagctcaaaaagtacttcaagaccgagcttttgctaacgaaaaaataaaatttgtatgggattcagtggtcaaagagattaaaggaaatgagattaaagtatctggtgtaactgttgaaaatctaaagactggagaaatctcagagatgactttcggaggtgttttcatttacgttggtttgaaaccacattctagcatggtctcagaattaggtattacggacgagactggctgggtcttaactgatacaaatatgaaaacatcaattccaggactatatgctattggggatgttcgtcaaaaagatctacgtcagattgcgactgctgttggtgaaggtgctatcgctggacagggtgtctataactatataactgagcatttc

SEQ ID NO: 2932 - protein, 304 aa, Streptococcus agalactiae
MYDTLIIGSGPGGMTAALYAARSNLKVGLIEQGAPGGQMNNTAEIENYPGYDHISGPELSMKMYEPLEKFEVEHIYGIVQRVENDGDVKRVITEDESYEAKTVILATGAKNSLLGVPGEEEYTSRGVSYCAVCDGAFFRDQDLLVVGGGDSAVEEAVFLTQFAKSVTIIHRRDQLRAQKVLQDRAFANEKIKFVWDSVVKEIKGNEIKVSGVTVENLKTGEISEMTFGGVFIYVGLKPHSSMVSELGITDETGWVLTDTNMKTSIPGLYAIGDVRQKDLRQIATAVGEGAIAGQGVYNYITEHF

SEQ ID NO: 2933 - DNA, 915 bp, Streptococcus pyogenes
atgtacgatacattaattattggttcaggaccagcaggaatgactgccgctttatacgctgctagaagtaatttatctgttgccattattgaacaaggggcacctggtggtcagatgaacaacacttttgatatagagaattacccgggatatgatcatatatctggaccagaattagctatgaaaatgtacgaacctttagagaagtttaacgttgaaaacatttatggtattgttcaaaaaatagaaaattttggtgactataagtgtgtgttgactgaagatgctagttatgaagctaaaacggttattattgcaacgggagctaaataccgtgtactaggtgttccaggtgaagaatactatactagtcgaggagtttcttattgtgcagtatgtgatggtgcgtttttccgtgaccaggatcttttggtcgttggtggtggtgactcagcagttgaagaagctatttatcttactcagtttgctaaaaaggtaaccgttgttcatcgccgtgatcaactaagagctcagaaaatcttgcaggaccgtgccttcgctaatgacaaagttgactttatctgggattcagttgtcaaagaaattcaaggtaacgacattaaggtctccaatgtcctaatcgaaaatgtgaaaacaggccaagtcactgaccacgcttttggaggtgtgtttatctatgttggtatgaatcctgttacaggtatggtaaaggatctagaaattaccgattcagaaggttggattatcacagatgatcatatgaggacaagtattcctggtatttttgcgattggagatgttcgtcaaaaagaccttcgccaaatcacgacagctgttggagatggtgcaattgcagggcaaggtgtttatcactaccttgaaagtttctcttca

SEQ ID NO: 2934 - protein, 305 aa, Streptococcus pyogenes
MYDTLIIGSGPAGMTAALYAARSNLSVAIIEQGAPGGQMNNTFDIENYPGYDHISGPELAMKMYEPLEKFNVENIYGIVQKIENFGDYKCVLTEDASYEAKTVIIATGAKYRVLGVPGEEYYTSRGVSYCAVCDGAFFRDQDLLVVGGGDSAVEEAIYLTQFAKKVTVVHRRDQLRAQKILQDRAFANDKVDFIWDSVVKEIQGNDIKVSNVLIENVKTGQVTDHAFGGVFIYVGMNPVTGMVKDLEITDSEGWIITDDHMRTSIPGIFAIGDVRQKDLRQITTAVGDGAIAGQGVYHYLESFSS

SEQ ID NO: 2935 - DNA, 1458 bp, Streptococcus agalactiae
atgtataaagacgatagtttaacactacatactgatttatatcaaatcaatatgatgcaagtttattttaataaaggtattcacaataaaagagcggtgtttgaagcttactttcgcaaggttccatttgaaaatggttatgctgtttttgcaggtttagagcgtattgttcgttatttagaaaatctgagcttttctgatagtgatttatcctatttagaagagttaggttatcctgaagaatttttagattacttaaaaaatttaaaaatggaactgactgtcaaatcagccaaggaaggtgaccttgtatttgctaatgaaccattagttcaaattgaaggtcctttagcacaatgtcagttagtagagacagcgattttaaatatcatcaactaccagacacttgttgctacaaaagcagctcgtattcgttctgttattgaagatgaaccgctattagagtttgggacacgacgtgctcaagaaatggatgcagccatttggggtactagggcagcgattattggtggtgctaacgcaacgagcaatgttcgtgctggtaaaatctttaatattccagtatcaggaacgcatgcacatgctttagttcaaacttatggcgatgattaccaggcatttaaagcttacgcagaaactcataaagattgcgtctttttagtggatacttatgatacccttcgtgtaggtgtgcctaatgctattcgagttgcaaaagagatgggcgaaaagattaatttcttgggagttcgccttgattcaggtgatttagcttatttgtctaagaaagttcgtcagcagttagatgacgccggttttcctaatgcaaagatttatgcttcgaatgatctagatgaaaatacaatcctcaacctaaaaatgcaaaaagctaaaattgatgtttggggtgtcggaacaaaattaattacagcctatgatcagcctgcgctaggtgctgtttataaaattgtttctattgagactgacgccggtagtatgcgagatacaattaaactatcaaacaatgctgaaaaagtatcaacacctgggaaaaagcaagtttggcgtatcaccagtcgagctaaagggaaatctgagggtgattacatcacatttgcagacactgatgtgacacaattagatgaaattgaaatgtttcatccaacttatacttatatcaataaaacagtccgtgattttgacgcagtacccttactggtagatatctttgacaaagggaaattagtttatcaattaccaagtcttcaagaaattcaagagtacggacgcaaagaatttgatcagctttgggatgagtataaacgtgttctgaatccacaggattacccagttgatttggcacgcgatgtttggcaaaataaaatggacctgattgatcgtatccgtaaagaagctttggcaaaaggagaagtaaga

SEQ ID NO: 2936 - protein, 486 aa, Streptococcus agalactiae
MYKDDSLTLHTDLYQINMMQVYFNKGIHNKRAVFEAYFRKVPFENGYAVFAGLERIVRYLENLSFSDSDLSYLEELGYPEEFLDYLKNLKMELTVKSAKEGDLVFANEPLVQIEGPLAQCQLVETAILNIINYQTLVATKAARIRSVIEDEPLLEFGTRRAQEMDAAIWGTRAAIIGGANATSNVRAGKIFNIPVSGTHAHALVQTYGDDYQAFKAYAETHKDCVFLVDTYDTLRVGVPNAIRVAKEMGEKINFLGVRLDSGDLAYLSKKVRQQLDDAGFPNAKIYASNDLDENTILNLKMQKAKIDVWGVGTKLITAYDQPALGAVYKIVSIETDAGSMRDTIKLSNNAEKVSTPGKKQVWRITSRAKGKSEGDYITFADTDVTQLDEIEMFHPTYTYINKTVRDFDAVPLLVDIFDKGKLVYQLPSLQEIQEYGRKEFDQLWDEYKRVLNPQDYPVDLARDVWQNKMDLIDRIRKEALAKGEVR

SEQ ID NO: 2937 - DNA, 1452 bp, Streptococcus pyogenes
atgtataaagatgatagtttaactctccatactgatttgtatcagattaatatgatgcaagtttattttgagcagggcattcataatcgtcatgcggtgtttgaagtctatttccgcaaggaaccttttaacaatggttatgctgtttttgccggtttacagcgcatggtggagtacctagagcaatttcaattttcagaaacagatttggcttaccttgaagaactgggttatccagaaaactttttgacctaccttaaagagttacgattagaattgaccatccgttcagctaaagaaggagatttggtttttgctaatgagccgattgtgcaagtagaaggccctctaggtcagtgtcagttggtcgaaacagctcttttaaacattgttaacttccagaccttgattgctacaaaggctgctcgtattcgttctgtgattgaggatgaaccccttttggaatttggcacccgtcgtgcacaggaactagatgctgcgatttggggaacccgcgcagcgatgattggtggagcagatgcaacaagtaatgtgagagcaggtaaacgctttgatatccctgtttcaggtacgcatgctcatgctttagtgcaagcctatggtaatgattatgatgctttcatggcttatgctaagacccataaagattgtgtatttcttgttgacacctatgatacacttaaagtaggtgtgccaacagctatccgagtagccaaagaaatgggtgacaagattaattttctaggtgttcgattggactctggtgacttggcttacctctcaaaaacagtccgtcagcagttagacgacgctggttttaccgaggctaagatctatgcttctaatgacctcgatgaaaataccatcctcaacttaaaaatgcaaaaggccaaaattgatgtttggggtgttgggaccaaactgatcacagcctatgatcagcctgccttaggtgctgtttataagattgtctctattgagcaagaagatggcagcatgcgtgatacgatcaaattatcaaataatgcagaaaaagtatccacaccaggtaaaaaacaagtttggcgcatcaccagtcgtgaaaaaggcaaatcagaaggcgactatatcacgtttactgatattaatgttaatgaattaactgagattgagatgttccatccgacctatacctatattaagaaaaccgttaaagaatttgatgcaattcctctcttagttgatatttttgtcaagggagaattagtttaccagctaccgaccttagctgaaatcaaggcttatgctaaaaaagaatttgacaagctttgggatgaatacaagcgtgtcttaaatcctcaagactacccagtagacttagcccgtgatgtgtggcaaaacaagatggccttaattgataacattcgcaaagatgcttatggaaagagtgaa

SEQ ID NO: 2938 - protein, 484 aa, Streptococcus pyogenes
MYKDDSLTLHTDLYQINMMQVYFEQGIHNRHAVFEVYFRKEPFNNGYAVFAGLQRMVEYLEQFQFSETDLAYLEELGYPENFLTYLKELRLELTIRSAKEGDLVFANEPIVQVEGPLGQCQLVETALLNIVNFQTLIATKAARIRSVIEDEPLLEFGTRRAQELDAAIWGTRAAMIGGADATSNVRAGKRFDIPVSGTHAHALVQAYGNDYDAFMAYAKTHKDCVFLVDTYDTLKVGVPTAIRVAKEMGDKINFLGVRLDSGDLAYLSKTVRQQLDDAGFTEAKIYASNDLDENTILNLKMQKAKIDVWGVGTKLITAYDQPALGAVYKIVSIEQEDGSMRDTIKLSNNAEKVSTPGKKQVWRITSREKGKSEGDYITFTDINVNELTEIEMFHPTYTYIKKTVKEFDAIPLLVDIFVKGELVYQLPTLAEIKAYAKKEFDKLWDEYKRVLNPQDYPVDLARDVWQNKMALIDNIRKDAYGKSE

SEQ ID NO: 2939 - DNA, 819 bp, Streptococcus agalactiae
atgactttgcaagatcaaattatcaaagaactcggtgtaaaacctgttattaatccaagtcaagaaatccgtcgttccgtagaatttttaaaagactatctattaaaacatagttttctaaagacctatgtactgggtatttcaggggggcaagattcaactttagcaggacgtctagctcaactagcagttgaagagttgcgtgctgatacaggggaaaactatcaatttatagctattcgtttaccatatggtattcaggccgatgaagaagatgcacaaaaagcattagattttatcaagccagatattgctttgaccattaatattaaagaagctgttgatggccaagttagagctcttaatgcagcaggagtagagattacagactttaataaaggaaatattaaagctcgtcaaagaatgattagtcaatatgcagttgcaggtcaatatgctggagcggttattggtactgatcatgctgcagaaaatattacaggttttttcaccaaatttggtgatggaggtgctgacttattacctctctttagacttaataaaagtcaggggaaacagttattagctgaacttggtgctgataaagccttgtacgaaaagattccaaccgcagatttagaagaaaataaaccaggaatcgctgatgaaatagcccttggagtaacctaccaagaaattgatgcttatcttgaagggaaggtggtttcggacaagtctcgaggtatcattgaaaattggtggtataagggtcaacataaacgtcatcttccaatcacaatttttgatgatttctggaaa

SEQ ID NO: 2940 - protein, 273 aa, Streptococcus agalactiae
MTLQDQIIKELGVKPVINPSQEIRRSVEFLKDYLLKHSFLKTYVLGISGGQDSTLAGRLAQLAVEELRADTGENYQFIAIRLPYGIQADEEDAQKALDFIKPDIALTINIKEAVDGQVRALNAAGVEITDFNKGNIKARQRMISQYAVAGQYAGAVIGTDHAAENITGFFTKFGDGGADLLPLFRLNKSQGKQLLAELGADKALYEKIPTADLEENKPGIADEIALGVTYQEIDAYLEGKVVSDKSRGIIENWWYKGQHKRHLPITIFDDFWK

SEQ ID NO: 2941 - DNA, 864 bp, Streptococcus pyogenes
ttgataacattcgcaaagatgcttatggaaagagtgaatgacatgacactacaagaagagataattcgacaattaggcgtcaaggctagcattgacccacaagaagaaattcggaaagccgttgattttttaaaagcttatttgcgtaagcactcatttttaaaaacttatgtcttaggcatttcgggaggtcaggattctaccctcgcaggaaagctagcccaaatggccattgcagagttacgggaggaagcaagtgatcaagcttaccaatttatagctgttcgcttgccttatggggttcaggctgatgaagcagatgcgcaaaaagccttggcttttattgcaccagatcagacccttaccattaatatcaaggcagctgtggacggtcaagtagaggctctacaagcagcaggcgttgagatttctgatttcaataaaggtaatattaaagcacgtcagcgaatgatcagtcaatatgccattgctggccaaatggctggtgctgttattggaacggatcatgcggcagaaaacatcactggtttctttactaaatttggtgatggtggagcagatattcttcccctctttaggcttaacaaacgtcaaggaaaggctcttttgaaagttttaggagcagatgctgctttgtatgaaaaagttccaactgctgatttagaagatcaaaaaccaggcttggctgatgaggttgctctaggggtgacctatcaagacatcgacgactatttggaagggaagctgatttccaaagtagctcaagcaactattgaaaaatggtggcataaaggacaacacaagcgtcacctgccaatcaccatttttgatgatttttggaaa

SEQ ID NO: 2942 - protein, 288 aa, Streptococcus agalactiae
LITFAKMLMERVNDMTLQEEIIRQLGVKASIDPQEEIRKAVDFLKAYLRKHSFLKTYVLGISGGQDSTLAGKLAQMAIAELREEASDQAYQFIAVRLPYGVQADEADAQKALAFIAPDQTLTINIKAAVDGQVEALQAAGVEISDFNKGNIKARQRMISQYAIAGQMAGAVIGTDHAAENITGFFTKFGDGGADILPLFRLNKRQGKALLKVLGADAALYEKVPTADLEDQKPGLADEVALGVTYQDIDDYLEGKLISKVAQATIEKWWHKGQHKRHLPITIFDDFWK

SEQ ID NO: 2943 - DNA, 1332 bp, Streptococcus agalactiae
atgtcaaaattaactcaaacatttacagataagttatttgctgattaccaagcaaatacaaaatttagcgctattgaaaatgcagtaactcacaatggtttattgaagtctctagagactcgtcaaagtgagattgagaacgactatgtcttttcaattgatttgaccaaagatgaagtttctaatcagaaacaatcaggacgttgctggatgtttgctgcactgaatacatttcgtcataaactgatttcagattttaaacttgagaattttgaattatctcaggcacatacatttttctgggataagtatgaaaaatcaaattggtttatggaacaaattattgcgactgcaaatcaggaattgagtagtcgtaaggtgaaattcctattagatgtacctcaacaagatggaggacaatgggacatggtggttgctctgtttgagaaatatggtgtcgttcctaaaacagtttatcctgaatctgtttcatcaagtgctagtcgtgaactaaatcaatatttgaataaactcttacgccaagatgcacagattctacgagaattaatagcacagggagcagatggggcaactgttcaaaataaaaaggaagaattgcttcaagaaatttttaactttttagcaatgaaccttggcttgccaccgcaatcttttgattttgcttatcgtgataaagacaatcattatcagtctgataaaaatattacaccgaaagcattttatcaaaaatatgttaatcttgacctatcagattatgtttctattatcaatgctccaactgtagataagccttatggacaatcctatacagttgagatgcttggaaatgttgtcggagggccagctgttaaatatttaaaccttgatatgaaacggtttaaagagttagcgattgcgcaaatgaaatcaggagaaactgtgtggtttggttcagacgtaggtcaagtatcaaatcgtcaaaagggtatcctagcaactacgacttatgattttaattcatctatggatattaaacttagccaagacaaagcgggccgcctagattatagtgaaagtttaatgacacatgctatggtcttaacgggagtagaccttgatgaatctggacaacctttaaaatggaaagttgagaactcttggggagagaaagttggtaaggatggttattttgtagcttcagatgcttggatggatgaatatacttaccaaatagtcgttcgtaaagaattgcttactaaagaagaattagaggcttacaacgcagagccaattactttagcgccgtgggatccgatgggagcattagctaat

SEQ ID NO: 2944 - protein, 444 aa, Streptococcus agalactiae
MSKLTQTFTDKLFADYQANTKFSAIENAVTHNGLLKSLETRQSEIENDYVFSIDLTKDEVSNQKQSGRCWMFAALNTFRHKLISDFKLENFELSQAHTFFWDKYEKSNWFMEQIIATANQELSSRKVKFLLDVPQQDGGQWDMVVALFEKYGVVPKTVYPESVSSSASRELNQYLNKLLRQDAQILRELIAQGADGATVQNKKEELLQEIFNFLAMNLGLPPQSFDFAYRDKDNHYQSDKNITPKAFYQKYVNLDLSDYVSIINAPTVDKPYGQSYTVEMLGNVVGGPAVKYLNLDMKRFKELAIAQMKSGETVWFGSDVGQVSNRQKGILATTTYDFNSSMDIKLSQDKAGRLDYSESLMTHAMVLTGVDLDESGQPLKWKVENSWGEKVGKDGYFVASDAWMDEYTYQIVVRKELLTKEELEAYNAEPITLAPWDPMGALAN

SEQ ID NO: 2945 - DNA, 1335 bp, Streptococcus pyogenes
atgtcagcattaacagagacatttacagaacaattatttgctcattacgaagccaatgcaaaattttcagctattgagaatgccgttacgcataatggtttgctaaaatcattagaaacccgtcaaagtgaagtggacaatgattttgtgttttctattgatttaactaaagataaggtatctaaccaaaaggcttctggtcgttgctggatgtttgctgccttgaacactttccgacacaaattaatcacagaatttaagttagaaaattttgaactgtcacaagctcatactttcttttgggataagtatgaaaaagctaactggtttatggagcaggtcattgctacagctgaccaagaattaaccagtcgtaaagttaagtttctcttggatgttccacaacaagatggtggtcagtgggacatggtggtttccttgtttgagaagtatggagtggtgccaaaatctgtttacccagaatcaatctcatcaagtaacagtcgtgaattaaaccagtatttgaataaattattgcgccaagatgctcaaattcttcgtgacctgattgcgtcaggtgctaaggcagaccaagttgaggatcgaaaagcagagcttcttcaggaaatttttaacttcttggccatgacccttggtttaccacctcgtcattttgattttgcctaccgtgataaagatgaccactatcatgttgagaaaggtttgacaccgcaagcgttttacgacaaatttgttggcttaaagctttctgattatgtgtctgttattaatgcgccaactgctgataagccttatggcaaatcatacactgttgagatgctaggaaatgtggtcggtagtcgtgaggttcgctacctcaaccttgatatgaaacgtttcaaagaactagctatcaagcagatgcaggctggtgagtccgtttggtttggctctgatgtgggtcaagtttcagatcgtcaaaaaggcattttagcaactaatacttacgattttgaagctagtatggatatcaatcttagtcaagataaggctggacgtttggattatagtgaaagtttgatgacacatgctatggttttaacaggtgttgacttagatgaaacaggaaaaccgttaaaatggaaggttgaaaattcatggggtgagaaggttggtgacaaaggttactttgttgcttcagatgcttggatggatgaatatacctatcaaattgttgtccgtaaagaattcttaacagctgacgagttagcggcttatgaaaaagagccacaagtactagctccttgggatccaatgggtgctttagcacaatac

SEQ ID NO: 2946 - protein, 445 aa, Streptococcus agalactiae
MSALTETFTEQLFAHYEANAKFSAIENAVTHNGLLKSLETRQSEVDNDFVFSIDLTKDKVSNQKASGRCWMFAALNTFRHKLITEFKLENFELSQAHTFFWDKYEKANWFMEQVIATADQELTSRKVKFLLDVPQQDGGQWDMVVSLFEKYGVVPKSVYPESISSSNSRELNQYLNKLLRQDAQILRDLIASGAKADQVEDRKAELLQEIFNFLAMTLGLPPRHFDFAYRDKDDHYHVEKGLTPQAFYDKFVGLKLSDYVSVINAPTADKPYGKSYTVEMLGNVVGSREVRYLNLDMKRFKELAIKQMQAGESVWFGSDVGQVSDRQKGILATNTYDFEASMDINLSQDKAGRLDYSESLMTHAMVLTGVDLDETGKPLKWKVENSWGEKVGDKGYFVASDAWMDEYTYQIVVRKEFLTADELAAYEKEPQVLAPWDPMGALAQY

SEQ ID NO: 2947 - DNA, 2250 bp, Streptococcus agalactiae
gtgattacaattaaaaaggaatctgttatcaaactattgaagtatgcttttggcattataatgggatttattatcttagctattgtaataggtgggctcctatttgcatactacgttagtcgttctccgaaattaaccgatcaagctttaaaatccgttaactctagtttggtttatgatggtaataataaacttattgccgatttaggctcagaaaagcgtgaaagtgttagtgcggatagcattccactaaatttggttaacgctatcacttctatcgaagataaacgtttctttaaacatagaggtgtcgatatttatcgtattttaggtgcagcttggcataatcttgttagtagtaatacgcaaggtggttcaacccttgatcaacagttgattaaactggcttacttttctaccaataaatctgaccaaacgttaaaacgtaaatcacaggaagtttggcttgcgcttcaaatggagcgtaaatacaccaaagaagaaattcttactttctatattaataaagtttatatgggaaatgggaattatggtatgagaacaacagctaaatcatactttggtaaagacctaaaggaattatctattgcacaacttgctttgctcgctggtattcctcaagcacctacacaatatgacccttataaaaacccagaatctgctcaaacaagacgtaataccgttcttcagcagatgtatcaagataaaaacatttctaaaaaggaatacgaccaagctgttgcaactccagtaactgatggcttaaaagaattaaagcaaaaatctacttatccaaaatatatggataactacttaaaacaagttattagtgaagttaaacaaaaaactggtaaagatatctttactgctgggctaaaagtgtatactaatatcaacactgatgcacaaaaacaactatatgacatctacaacagtgacacttacatcgcttatccaaacaatgaattacaaatagcatctaccatcatggatgcgactaatggtaaagtcattgcacaattaggcgggcgtcatcagaatgaaaatatttcatttgggacaaatcaatctgtcttaacagaccgcgattggggttctacaatgaaacctatctcagcttatgcacctgctattgatagtggtgtctataattcaacaggtcaatcattaaacgactcagtttactactggcctggtacttctactcaactatatgactgggatcgtcaatatatgggttggatgagtatgcagaccgctattcaacaatcacgtaacgtccctgctgtcagagcacttgaagccgctggattagacgaagcaaaatctttccttgaaaaattaggcatatactatccagaaatgaactattcaaatgctatttcaagtaacaacagtagcagtgatgcaaaatatggtgcaagtagtgagaaaatggcagcggcttactcggcttttgcaaacggcggaacttactataaaccgcaatatgttaataaaattgaatttagcgatggaaccaatgatacttatgcagcgtctggtagccgtgcgatgaaagagactactgcctacatgatgacggatatgctgaaaacagtactaacatttggtactggtactaaagcagctatccctggtgttgcacaagctggtaagactggtacttccaactatacggaagatgagttagctaaaattgaagcaactactggtatctacaatagcgccgttggtacaatggctcctgatgaaaactttgtcggctatacttctaagtacacaatggcaatttggactggttataaaaatcgccttacaccactttatggtagccaactggatattgctactgaggtttatcgtgcaatgatgtcctacctaactggcggatacagtgcagattggacaatgccagaagggctctatcgaagcggaagctacttgtatatcaatgggacaactacaaccggcacttactcttcttctgtctataagaatatctatcaaaattctggacagtcaagtcaaagcagtagttcaacatcctctgagaaacaaaaagaggataagaatacagcaaatgatgccaattcatcatccccacaagtcgaaacacctaataatggtaatgctactacccctaataattccaatcaaactgtgccaggaactggacatggtaatggtaatggtaatggtaacaacaatacagtacctaacggtaat

SEQ ID NO: 2948 - protein, 750 aa, Streptococcus agalactiae
MITIKKESVIKLLKYAFGIIMGFIILAIVIGGLLFAYYVSRSPKLTDQALKSVNSSLVYDGNNKLIADLGSEKRESVSADSIPLNLVNAITSIEDKRFFKHRGVDIYRILGAAWHNLVSSNTQGGSTLDQQLIKLAYFSTNKSDQTLKRKSQEVWLALQMERKYTKEEILTFYINKVYMGNGNYGMRTTAKSYFGKDLKELSIAQLALLAGIPQAPTQYDPYKNPESAQTRRNTVLQQMYQDKNISKKEYDQAVATPVTDGLKELKQKSTYPKYMDNYLKQVISEVKQKTGKDIFTAGLKVYTNINTDAQKQLYDIYNSDTYIAYPNNELQIASTIMDATNGKVIAQLGGRHQNENISFGTNQSVLTDRDWGSTMKPISAYAPAIDSGVYNSTGQSLNDSVYYWPGTSTQLYDWDRQYMGWMSMQTAIQQSRNVPAVRALEAAGLDEAKSFLEKLGIYYPEMNYSNAISSNNSSSDAKYGASSEKMAAAYSAFANGGTYYKPQYVNKIEFSDGTNDTYAASGSRAMKETTAYMMTDMLKTVLTFGTGTKAAIPGVAQAGKTGTSNYTEDELAKIEATTGIYNSAVGTMAPDENFVGYTSKYTMAIWTGYKNRLTPLYGSQLDIATEVYRAMMSYLTGGYSADWTMPEGLYRSGSYLYINGTTTTGTYSSSVYKNIYQNSGQSSQSSSSTSSEKQKEDKNTANDANSSSPQVETPNNGNATTPNNSNQTVPGTGHGNGNGNGNNNTVPNGN

SEQ ID NO: 2949 - DNA, 2163 bp, Streptococcus pyogenes
gtgattacaattaaaaatccaaaaatccttaagtggctaaagtatgtattaagtgcaattcttagccttattatccttgttattattattggtggtcttttgtttaccttctacattagcagtgctccgaaactgtcagaagcccagttaaaatcaacaaactctagcttggtttatgacggtaataacaatctgattgctgatttgggttctgaaaagcgtgaaaatgtaacagctgatagtatccctattaatctagttaatgctattacctcaattgaagataaacgtttctttaaccatcgtggagtagatctttatcgtatttttggtgctgcctttcataatctaacgagtcagaccactcaaggggggtcaacgcttgatcagcaactcattaaactagcctatttttctactaatgaatctgatcaaaccttaaaacgtaaggctcaagaagtttggcttgctcttcaaatggagcgaaaatatactaaacaagaaatcctgactttttacatcaacaaagtatatatgggtaatggcaactatggtatgctgacagccgctaagtcttattatggcaaggatcttaaggatttatcttatgcccaactagccctattggctggaatccctcaagctcctagtcaatatgatccttaccttcatcctgaagctgctcaaaatcgccgtaacgtcgtgttgcaacagatgtacatggaaaaacatctgacgaaagcagaatatgaaactgccatcgcaactcccgtcgctgaaggtctacaatcactccaacagcgctcaacttatccaaaatatatggataattatctaaaacaagttattgaagaagtcaaaaaagaaacgaataaagatatttttaccgctggtttaaaagtttataccaatattatccccgatgcgcagcagactctttataatatttatcattctggtgattatgtttactatccagaccaagatttccaagttgcttcaacgattgttgatgtgacaaatggtcatgttattgctcagcttggcggacgtaatcaagatgaaaatgtttcatttgggactaaccaagctgttttaactgatcgtgactggggttctaccatgaagccaatcacagcctatgctcctgctattgaatctggtgtttatacttctactgctcagtcgactaatgactcagtctattattggcctggaaccactacccaattgtttaactgggaccttagatataacggatggatgacaatccaagctgctattatgctatcgcgaaatgtcccagcagtccgagcactggaagccgcaggacttgactatgctcgatctttcttaagcagtttaggtattaactatcccgaaatgcactactcaaacgctatctcaagtaataacagtagctcagataaaaaatatggtgcaagtagtgaaaaaatggccgctgcatacgctgcttttgcaaatggtggtatttatcataaaccaaggtatgtcaataaagtggaatttagtgatggtacaagtaaaacttttgatgaaaaaggaaaacgtgccatgaaagaaaccacggcctatatgatgacagatatgttaaaaactgttctcacttatggtacaggtactgctgctgccattcctggtgttgcgcaagctggtaaaacagggacttctaactacactgatgaggaactagctaaaattggtgaaaaatacggcctttatccagattatgttggtacattagcgccagacgaaaactttgttggctttactaagcgctacgccatggctgtttggacaggttacaaaaaccgcttgaccccagtatacggatcaagtctagagattgcatctgacgtttatcgtagcatgatgacttacttaacaaatggttacagtgaagattggacgatgccaaatggtctttatcgcagtggtggattcctctacttaagcggaacctatgcgagcaacaccgactatactaattcggtttacaacaatctttacagcaataacacgacaacagcttctagccaaacgacttcagatgatactagtagtagcaatgatacaagtaattcaaccaatacagacaacaatggcagtcatccatctaccgatgataaaaagacaactcat

SEQ ID NO: 2950 - protein, 721 aa, Streptococcus agalactiae
VITIKNPKILKWLKYVLSAILSLIILVIIIGGLLFTFYISSAPKLSEAQLKSTNSSLVYDGNNNLIADLGSEKRENVTADSIPINLVNAITSIEDKRFFNHRGVDLYRIFGAAFHNLTSQTTQGGSTLDQQLIKLAYFSTNESDQTLKRKAQEVWLALQMERKYTKQEILTFYINKVYMGNGNYGMLTAAKSYYGKDLKDLSYAQLALLAGIPQAPSQYDPYLHPEAAQNRRNVVLQQMYMEKHLTKAEYETAIATPVAEGLQSLQQRSTYPKYMDNYLKQVIEEVKKETNKDIFTAGLKVYTNIIPDAQQTLYNIYHSGDYVYYPDQDFQVASTIVDVTNGHVIAQLGGRNQDENVSFGTNQAVLTDRDWGSTMKPITAYAPAIESGVYTSTAQSTNDSVYYWPGTTTQLFNWDLRYNGWMTIQAAIMLSRNVPAVRALEAAGLDYARSFLSSLGINYPEMHYSNAISSNNSSSDKKYGASSEKMAAAYAAFANGGIYHKPRYVNKVEFSDGTSKTFDEKGKRAMKETTAYMMTDMLKTVLTYGTGTAAAIPGVAQAGKTGTSNYTDEELAKIGEKYGLYPDYVGTLAPDENFVGFTKRYAMAVWTGYKNRLTPVYGSSLEIASDVYRSMMTYLTNGYSEDWTMPNGLYRSGGFLYLSGTYASNTDYTNSVYNNLYSNNTTTASSQTTSDDTSSSNDTSNSTNTDNNGSHPSTDDKKTTH

SEQ ID NO: 2951 - DNA, 597 bp, Streptococcus agalactiae
atggttaactatccacatcagcttattcggaaaacaacagttacaaaatcaaagaaaaagaaaatcgattttgccaaccgtggtatgtcatttgaagctgctatcaatgcaaccaatgactactatttgtctcacgaattagctgtcattcataagaaaccaacgccagtacaaatcgtcaaggtagattatcctaaacgtagtcgtgctaagattgtagaagcttattttagacaagcttctactactgattattctggtgtttacaaaggttactatattgactttgaagccaaagaaacccggcagaaaactgctatgcctatgaaaaattttcatgctcaccaaatagagcacatggcaaatgtattacagcaaaaagggatttgctttgtcttgcttcatttttccacacttaaggaaacctatctactccctgctaatgagttaatttcattttatcagattgataaaggcaataaatcaatgcctattgattatatcagaaaaaatggatttttcgtaaaggagagtgcctttcctcaagtcccttacttagatattattgaagaaaaattattaggcggtgattacaat

SEQ ID NO: 2952 - protein, 199 aa, Streptococcus agalactiae
MVNYPHQLIRKTTVTKSKKKKIDFANRGMSFEAAINATNDYYLSHELAVIHKKPTPVQIVKVDYPKRSRAKIVEAYFRQASTTDYSGVYKGYYIDFEAKETRQKTAMPMKNFHAHQIEHMANVLQQKGICFVLLHFSTLKETYLLPANELISFYQIDKGNKSMPIDYIRKNGFFVKESAFPQVPYLDIIEEKLLGGDYN

SEQ ID NO: 2953 - DNA, 597 bp, Streptococcus pyogenes
atggttaattatcctcataatcttattcgacaaaaagtaagttccgttcaaaagcaaaataaggtggacttcgccaatagaggtatgtcctttgaagctgctatcaacgcgacaaatgattattatttatctcgtcaaatagctgtcattcacaaaaaacctactcctgtccaaattgtcaaagtggattaccctaaacgcagtcgggcaaaaatcgttgaagcgtactttagacaagcttcaacgactgactattgcggcgtttataaaggacattatgttgattttgaagcaaaagaaaccaggcaaaaaacagctatgcccatgaaaaatttccatttacatcagattgaacatatggcttgcgttttacatcaaaaaggaatctgctttgtccttcttcacttttccacactgaaggagacttactacctacctgctcaagccttgatttcattttatcagatagataatggcagtaaatcgatgcccattgattatatcagaaaaaatggctttaaggtagcatttggagcctttccacaagtcccttatttaaacataattgaacaaaattttttaggcggtgattacaat

SEQ ID NO: 2954 - protein, 199 aa, Streptococcus pyogenes
MVNYPHNLIRQKVSSVQKQNKVDFANRGMSFEAAINATNDYYLSRQIAVIHKKPTPVQIVKVDYPKRSRAKIVEAYFRQASTTDYCGVYKGHYVDFEAKETRQKTAMPMKNFHLHQIEHMACVLHQKGICFVLLHFSTLKETYYLPAQALISFYQIDNGSKSMPIDYIRKNGFKVAFGAFPQVPYLNIIEQNFLGGDYN

SEQ ID NO: 2955 - DNA, 516 bp, Streptococcus agalactiae
atgaagtcaactattcttgtaacaggttacaaaaattttgaattagggattttccaggataaggatcctcggattactattataaaaaaggctattgataaggattttagacgcttcttggaaaatggagcagactggtttatttttatgggaaatttagggtttgagtactgggctttggaagttgctcttgatttacaaaaagaatatgattttcaaattgcgacaatttttacctttgagaaccatggccaaaattggaatgaggctaataaagctaagttggcactctttaagcaagttgactttgttaaatatactttcccaagctatgaaaacccgggtcaatttaaacaatacaatcattttctcattaacaacacacaaggtgcatatcttttttatgattctgaaaatgaaactaatttaaaatttttgctagaaatgatggagaaaaaggaagcttatgatatttctttcctaacttttgatcgcttaaatgaaatatatgaggaa

SEQ ID NO: 2956 - protein, 172 aa, Streptococcus agalactiae
MKSTILVTGYKNFELGIFQDKDPRITIIKKAIDKDFRRFLENGADWFIFMGNLGFEYWALEVALDLQKEYDFQIATIFTFENHGQNWNEANKAKLALFKQVDFVKYTFPSYENPGQFKQYNHFLINNTQGAYLFYDSENETNLKFLLEMMEKKEAYDISFLTFDRLNEIYEE

SEQ ID NO: 2957 - DNA, 513 bp, Streptococcus pyogenes
atgactgcgattctaattacaggttaccgaagctttgaaatagggatttttgaccataaagacccacgagtttcaattattaaacaggctattcgtaaagatttaataggttatttggaaaatggtgtggattggtttatctttacagggaacttgggttttgaacaatgggctttggaagtagctaatgagctaaaagaggagtatcccttgcagatagctactatattcttgtttgaaacgcatggagataggtggaatgaaaaaaataaagaagttttaagtcagtttagggctgttgactttgtaaaatattactttccaaattacgaacaaccgacgcaatttagtcaatattatcagtttttattagaaaagacagaaggggcttatgttttttatgacacagaaaacgagaccaacttaaaatattttctcaagaaagcaaaagatatgccgcattatcagttgctattgctaacctttgatcggctaaatgatatgtcacaaagc

SEQ ID NO: 2958 - protein, 171 aa, Streptococcus pyogenes
MTAILITGYRSFEIGIFDHKDPRVSIIKQAIRKDLIGYLENGVDWFIFTGNLGFEQWALEVANELKEEYPLQIATIFLFETHGDRWNEKNKEVLSQFRAVDFVKYYFPNYEQPTQFSQYYQFLLEKTEGAYVFYDTENETNLKYFLKKAKDMPHYQLLLLTFDRLNDMSQS

SEQ ID NO: 2959 - DNA, 96 bp, Streptococcus agalactiae
atggaaaaatcaagcgtaaaacgttctcatatccgaaaaaacgatcattcctcatatatttcatttaagcgatcaaaagttaggaaagaaatatca

SEQ ID NO: 2960 - protein, 32 aa, Streptococcus agalactiae
MEKSSVKRSHIRKNDHSSYISFKRSKVRKEIS

SEQ ID NO: 2961 - DNA, 351 bp, Streptococcus agalactiae
ttgactggtttggagaatagaatggcaagtattatttatagcccaaaagatatttttgagcaagattttaaagttagtatgcggggatatgacaagaaagaagtcgatgtatttctggatgatgtcatcaaagattacgaaaattatcttgagcaaattgagaagctccaaatggaaaatagacgtctacaacaagctttagacaaaaaagaaagcgaagcttcaaatgtaagaaattcagggacagctatgtataatcaaaaaccgattgcccaatctgcaaccaattttgatattttaaaacgcattagccgccttgagaaagaagtttttggaagacaaattagagaa

SEQ ID NO: 2962 - protein, 117 aa, Streptococcus agalactiae
MTGLENRMASIIYSPKDIFEQDFKVSMRGYDKKEVDVFLDDVIKDYENYLEQIEKLQMENRRLQQALDKKESEASNVRNSGTAMYNQKPIAQSATNFDILKRISRLEKEVFGRQIRE

SEQ ID NO: 2963 - DNA, 324 bp, Streptococcus pyogenes
atgacaagtattatttatagtcctaaagatatttttgagcaagaatttaagactagtatgcgagggtttgataagaaagaagttgatgaatttcttgataatgtaattaaagattatgaaaatttcaatgctcaaattgaagctttaaaagctgagaatgaagccttaaaaaaggcgaagtttcaagctagaaatacagtttcagcgactgttcaacaaccagtaccgcaaccgactcgtgttgctcaatcagctactaattttgacatcttgaaacgtattagtaaattggaaaaagaggtttttggtaaacaaattattgag

SEQ ID NO: 2964 - protein, 108 aa, Streptococcus pyogenes
MTSIIYSPKDIFEQEFKTSMRGFDKKEVDEFLDNVIKDYENFNAQIEALKAENEALKKAKFQARNTVSATVQQPVPQPTRVAQSATNFDILKRISKLEKEVFGKQIIE

SEQ ID NO: 2965 - DNA, 1152 bp, Streptococcus agalactiae
atgaaagaatcattcaaattaatagcaactgctgctgctggtttagaagccattgttggtagagaaatcagaaacctaggaattgactgccaagttgagaacggtagagtccgtttccacggagatatcaaaacaatcattgaaacgaacctatggctacgagctgccgatcgtataaagattattgtaggagagtttccagcacctacttttgaggaactttttcagggtgtatatggccttgactgggaaaattatttaccgttaggggcaaaatttcctattgctaaagcaaagtgtgtcaagtcaaaattgcacaatgaacctagtgtacaagccatttctaaaaaagctgttgctaagaaacttcaaaaagtctttcaccgtcctgaaggagttcccttacaagaaaatggagctgaatttaaaatagaagtttctattttaaaagataaagcgactgtcatgattgatacgactggatcaagtctcttcaaacgtggctaccgtgcagaaaaaggtggtgcaccaattaaagaaaacatggcagcagctattattcaattatctaattggttccctgataagccattgattgatccaacttgtggttcaggtactttttgtattgaagctgctatgattggaatgaatatagctcctggttttaatcgtgattttgcctttgaggcgtggccatgggtagatcaaagtcaagtacaaaaggttcgtgatgaagctgagagtaaagcaaactatgatattgatttagatatttcaggttttgatttagacggtcgtatggtagaaattgctagaaaaaatgcagaagaagcaggacttggagatgttatcaaattgaaacaaatgcgtcttcaagatttaaaaacagataaaattaacggtgttattatctccaacccaccatatggtgaacgactcctggatgacaaagcagtggacattttgtataatgagatgggacaaacatttgcgcctttaaaaacttggagcaagtttatcctaactagtgacgaaggatttgaaaaaaaatacggctcacaagctgataaaaaacgtaagctttacaatggtactttaaaagttgatttgtaccaatattacggtgaacgtgtgagacgtcaagtaaaa

SEQ ID NO: 2966 - protein, 384 aa, Streptococcus agalactiae
MKESFKLIATAAAGLEAIVGREIRNLGIDCQVENGRVRFHGDIKTIIETNLWLRAADRIKIIVGEFPAPTFEELFQGVYGLDWENYLPLGAKFPIAKAKCVKSKLHNEPSVQAISKKAVAKKLQKVFHRPEGVPLQENGAEFKIEVSILKDKATVMIDTTGSSLFKRGYRAEKGGAPIKENMAAAIIQLSNWFPDKPLIDPTCGSGTFCIEAAMIGMNIAPGFNRDFAFEAWPWVDQSQVQKVRDEAESKANYDIDLDISGFDLDGRMVEIARKNAEEAGLGDVIKLKQMRLQDLKTDKINGVIISNPPYGERLLDDKAVDILYNEMGQTFAPLKTWSKFILTSDEGFEKKYGSQADKKRKLYNGTLKVDLYQYYGERVRRQVK

SEQ ID NO: 2967 - DNA, 1152 bp, Streptococcus pyogenes
atgaaagaaacatttagattagtcgcaactgcagccgcaggtttagaagctgtcgttggtaaagaagtcagagcactaggctttgattgtcaggttgaaaatgggaaagtttattttgaaggtgatgtagaagcgattgttaaaacaaatctttggttacgtgcagcagatcgtatcaaaattatcgtaggacaatttcctgctagaacctttgaagaattattccaaggtgtctttgccttggattgggaaaattatttaccgctaggagctaaatttccaatctcaaaagccaaatgtgttaagtctaaattgcataacgagccaagtgttcaggcgattaccaaaaaggccgttgttaagaaactgcaaaagcatttccacaggccagaaggagttcctcttcaagaagttgggtcaacgtttaacattgaggtatctattttaaaagaccaagccactattatgattgacacgacaggatctagcctatttaaacgagggtatcgcgttcaaaaaggtggagcaccgatcaaggaaaatatggcagctgctatcttggccttatctaactggtttccagataaacctctggttgatcccacctgtggatcgggaacgttttgcatcgaggcagccatgattgggatgaatattgctccaggatttaaccgttcgtttgcttttgaagaatggagctgggtagataaagatatggtgcaacaagttcgtgatgatgctgaacaagaagctaattatgaaatcgaattagatatttctggctttgatatcgatggccgcatgattgagattgctaaaagtaatgctgaagaagctggtttatctgatgtgattacctttaagcaaatgcgtctgcaagactttcgaacagacaaggttaatggtgtagtgatatcaaatcctccttatggagaacggttgcttgatgacaaagcggttgacatcttgtataatgaaatgggacaaacctttgcaccattgaaaacatggagcaaatttatccttacaagtgatgaactttttgaactaaaatacgggcaaaaagctgataaaaaacgtaaactttataacggcaccctaaaagttgatttgtaccaattttatggggaaagggtaaagcgacatctgata

SEQ ID NO: 2968 - protein, 384 aa, Streptococcus pyogenes
MKETFRLVATAAAGLEAVVGKEVRALGFDCQVENGKVYFEGDVEAIVKTNLWLRAADRIKIIVGQFPARTFEELFQGVFALDWENYLPLGAKFPISKAKCVKSKLHNEPSVQAITKKAVVKKLQKHFHRPEGVPLQEVGSTFNIEVSILKDQATIMIDTTGSSLFKRGYRVQKGGAPIKENMAAAILALSNWFPDKPLVDPTCGSGTFCIEAAMIGMNIAPGFNRSFAFEEWSWVDKDMVQQVRDDAEQEANYEIELDISGFDIDGRMIEIAKSNAEEAGLSDVITFKQMRLQDFRTDKVNGVVISNPPYGERLLDDKAVDILYNEMGQTFAPLKTWSKFILTSDELFELKYGQKADKKRKLYNGTLKVDLYQFYGERVKRHLI

SEQ ID NO: 2969 - DNA, 1461 bp, Streptococcus agalactiae
atgtcagaagatcaaaaacacccattttttgaaccaaaaaaagaaactgatggtcttgaatttaaagatgctaaagaaatgacagtagaagaggctgttagaaaagattctgaaattaaggctggtattaccgaagaagatagtattcttgataaatacatcaaacaacatcgtgatgaagtagcttcacaaaagtttgagacaaaatcaagcgattttgcaaaccttgatacggcatctttagatgattttatcaagaaacagcgcgaagaattatcagcgatgttagctgcagaagagctttctaaaaagttggataattcagtctctcaagaacaagatacagaagctaatgctgtctcacctaaagaagaatcttcacaagaacaagaaaatagtgtaaccccagttcctcctctgaatacggaagcagaaccaactgcaacagaaccagattcgactattgctgattcagaggagtataaatcctcttctaagaagcgtggaggtatcgtaggaacattgattgctcttattttacttctaatagtagcaatctttggttacaactatttcaagaataataattcgacaaattctcaaactgcaacaagtcaaagttctagttctaaggctacgacgacttcatcagaagaagataaaaaagctagtcagaacttagataatttcaacaaatcttatgctaacttttttgttgatgataagaaaacccaactcaaaaatagcgaatttgataaattgtcagaattagaaaagaaagttgatgctttaaaaggaactaaatactacggtaaagtaaaagttaaatttgatagtctaaaacgtcaaattgatgctgttaaagctgttaacgacaagtttaagtcgcctgctgtagttgatggtaagaagagtgaaaaattagaggtaaaagatggagcgaattttgactctttagatagtaaaactcttaatactggtaatgctagtctagatagtttacttcactccatcgtttcaactggtcgtaatcaggtaaaacaatccgaagaacaggcttcgtctaataaggtttcagacactcaaataactgaacaaccaaacgtaactaacggtcaatcttcctcatcagctgctacaataaataatcaggcagctggcactgcatcaggtaatttggaacgtaaccgtagtcgagtaccgtataataatgctgctattgcggatacaggaaatcctgcctggatatttaacccaggagtattagagaaaatcgtggccacttcacaggcgcgaggctatttctctggaaataactatattcttgaacctgtaaatattatcaatggtaatggttattacaatatgtttaaattagatggcacttatttgttctctatcaatgccaagacaggttactttgtaggtaacgctcctggaagagctgatagtttagattat

SEQ ID NO: 2970 - protein, 487 aa, Streptococcus agalactiae
MSEDQKHPFFEPKKETDGLEFKDAKEMTVEEAVRKDSEIKAGITEEDSILDKYIKQHRDEVASQKFETKSSDFANLDTASLDDFIKKQREELSAMLAAEELSKKLDNSVSQEQDTEANAVSPKEESSQEQENSVTPVPPLNTEAEPTATEPDSTIADSEEYKSSSKKRGGIVGTLIALILLLIVAIFGYNYFKNNNSTNSQTATSQSSSSKATTTSSEEDKKASQNLDNFNKSYANFFVDDKKTQLKNSEFDKLSELEKKVDALKGTKYYGKVKVKFDSLKRQIDAVKAVNDKFKSPAVVDGKKSEKLEVKDGANFDSLDSKTLNTGNASLDSLLHSIVSTGRNQVKQSEEQASSNKVSDTQITEQPNVTNGQSSSSAATINNQAAGTASGNLERNRSRVPYNNAAIADTGNPAWIFNPGVLEKIVATSQARGYFSGNNYILEPVNIINGNGYYNMFKLDGTYLFSINAKTGYFVGNAPGRADSLDY

SEQ ID NO: 2971 - DNA, 1467 bp, Streptococcus pyogenes
gtgtcagaagaaagcaaagaagtcgaagtaacaaaagaatcgcaaacattggggcttaatgaagccaagtcaatgacaattggtgaagctgtacgcaaacagtcagagataaaagcaggtgttactaaggatgatagtattttagataagtacattaagcaacaccgtgacgaagtttcttctcaaaagtttgatgctaagtatacagagcttgatacagctagtttagataactttatcaaaaaacaaagagaagcattgagtaaagccggtcttgttgatgacgaacctgtgtctgcggagtctgctgagcaagatagcactttggttgaagaagtagctgaagacttagctccaatggagactactgcggtggtaactgggattccggtggaagcgacagtccctgtgttagatctagatccatcagagagggtcattccagaaccacagatgaccaaggaagaaccaaaaagagatcagtttctttctgaagatagccaccatccagccaaacaaaacacgaaaaaaggttggttaatagctttatttctgctattattggccattcttgcagttgtatttggttggaaccatttcttgagacaagacagtggtaaaacaactcaaacagcaagtaaacagacaaagacctctttgcagaccgacagtgctaaaaaagcaacgcgcttgaaggctgctgctaaagctttcgaaaaactatatggtactttttatacagatgccacaaagagcaaattaaaaaatagtgcctttgctactttgccagatttagaagctgccttgaaagctttggaaggctctgcttactatgataaggcgaaagcaaaagtcgattcccttaagaaagctattgctgctattacagcggttaacggtaaatttgtttccgatgttgttgtagatggtgaaaaggtttcggctgaagtcaaggctgatgctaattttgatgatttatcaagtgcaaccttgacaataggaaatgcaaatcttgatgctgtcttgcaggcaagcatcacagaaggtcgtcagcaactagccagcaaggctgaggccgctaaagcagctaatgagcaagcagtccaggatcaagcagctcaaggacaaagtacatcagtagcaccatctggctatggcttgacaagttatgatcctgcaagcttacaacggcatttatcacgtgtaccttacaatcaagatgttattgctgacagagctaacccatcttgggcatttaatccaggagttcttgaaaaaattgtagcaacctcacaagctagaggttatatttcaggcaaccaatatattttagagccggttaatattattaatggcaatggttactataatatgtttaagcctgatggcacttatctgttctctattaattgtaagacgggttattttgtaggaaatggcaaaggttatgctgatgctttagattac

SEQ ID NO: 2972 - protein, 489 aa, Streptococcus pyogenes
VSEESKEVEVTKESQTLGLNEAKSMTIGEAVRKQSEIKAGVTKDDSILDKYIKQHRDEVSSQKFDAKYTELDTASLDNFIKKQREALSKAGLVDDEPVSAESAEQDSTLVEEVAEDLAPMETTAVVTGIPVEATVPVLDLDPSERVIPEPQMTKEEPKRDQFLSEDSHHPAKQNTKKGWLIALFLLLLAILAVVFGWNHFLRQDSGKTTQTASKQTKTSLQTDSAKKATRLKAAAKAFEKLYGTFYTDATKSKLKNSAFATLPDLEAALKALEGSAYYDKAKAKVDSLKKAIAAITAVNGKFVSDVVVDGEKVSAEVKADANFDDLSSATLTIGNANLDAVLQASITEGRQQLASKAEAAKAANEQAVQDQAAQGQSTSVAPSGYGLTSYDPASLQRHLSRVPYNQDVIADRANPSWAFNPGVLEKIVATSQARGYISGNQYILEPVNIINGNGYYNMFKPDGTYLFSINCKTGYFVGNGKGYADALDY

SEQ ID NO: 2973 - DNA, 480 bp, Streptococcus agalactiae
atgacaaaagaagttgtcgtagagagttttgaattagatcacaccatcgttaaagcaccctacgttcgtttaatttcagaagaagttggaccggtcggagacatcattactaactttgatatccgccttattcagcctaatgaaaatgctattgatactgctggtttacatactatcgagcaccttctggcgaagttaatccgccaacgaattaatggtttgattgattgttctccttttggttgtagaactggttttcacatgattatgtggggaaaacaggatgctactgaaattgctaaagtcatcaaatctagtctagaggctattgctggtggggtcacttgggaagacgttcctggaacaaccattgaatcttgtggaaattataaagaccacagtctccactctgctcaagaatgggcgaaattaattctttcccaagggatttctgacaatgcttttgagcgccacattgtc

SEQ ID NO: 2974 - protein, 160 aa, Streptococcus agalactiae
MTKEVVVESFELDHTIVKAPYVRLISEEVGPVGDIITNFDIRLIQPNENAIDTAGLHTIEHLLAKLIRQRINGLIDCSPFGCRTGFHMIMWGKQDATEIAKVIKSSLEAIAGGVTWEDVPGTTIESCGNYKDHSLHSAQEWAKLILSQGISDNAFERHIV

SEQ ID NO: 2975 - DNA, 480 bp, Streptococcus pyogenes
atgacaaaagaagttatcgtcgaaagttttgagctagatcatactattgtaaaggccccttatgttcgtcttatttctgaagaatttggacccaagggcgatcgtattacaaattttgatgttcgcctagtgcagcctaaccaaaattctattgaaacagccggtttgcataccattgaacacttacttgccaagctcatccgccaacgcattgatgggatgattgattgctctccttttggctgtcgaacaggttttcaccttatcatgtggggaaaacacagttctactgatattgccaaggtgattaaatccagcctagaagaaattgcaactgggattacttgggaagatgttcctggaacaactcttgaatcctgtgggaactataaggatcatagcctctttgccgccaaagaatgggctcaattgattattgatcaagggatttcagacgatccttttagtcgccatgtcatc

SEQ ID NO: 2976 - protein, 160 aa, Streptococcus pyogenes
MTKEVIVESFELDHTIVKAPYVRLISEEFGPKGDRITNFDVRLVQPNQNSIETAGLHTIEHLLAKLIRQRIDGMIDCSPFGCRTGFHLIMWGKHSSTDIAKVIKSSLEEIATGITWEDVPGTTLESCGNYKDHSLFAAKEWAQLIIDQGISDDPFSRHVI

SEQ ID NO: 2977 - DNA, 1605 bp, Streptococcus agalactiae
atgtttaatattatattagcaatggtttgtgcactcattggtttgattattggttatgtggctatttcaatgaaaatgaaatcatcaaaagaagctgcagaactaactcttttaaatgcagaacaagatgccgttgatttacgtggtaaagcagaaattgaagcagaacacatccgtaaagcagcggaacgtgaaagtaaagctcaccaaaaagaattacttttagaagcaaaagaagaggctagaaaatatcgtgaagagatcgaaaaggaatttaaatctgatagacaagagttgaaacagatggaggcacgtttaacagatcgtgcatcatctcttgatcgtaaagatgaaaatctatctaacaaagaaaaaatgttagatagcaaagaacaaagtctaaccgataaatctagacatattaatgagcgcgaacaggaaattgctactttagaaacaaaaaaagtagaagaattgtcacgcatcgcagagcttagtcaagaagaagctaaagatatcattttagctgataccgaaaaagatttagctcatgatattgcgacacgtattaaagaagcagaacgtgaagtaaaagatcgatcaaacaagatagcaaaagacttgctagcccaagctatgcaacgtttagctggtgaatatgttactgaacaaacaattacaactgttcatctccctgatgataatatgaagggacgtatcattggtcgtgaaggacgtaatattcgtactctggaaagtttgacaggtattgatgttatcatagatgatacgccagaagtcgttgtcttatcaggtttcgaccccattcgtcgtgaaattgctcgtatgactttagaatctttgattcaagatggacgtatccatccagctcgtattgaagagttggttgaaaaaaatcgtttggaaatggatcaacgtatccgtgagtatggtgaggcagcagcttatgagattggtgcaccaaatctgcatcctgatttgataaaaattatgggacgtttgcagttccgtacatcatatggtcaaaatgtacttcgtcattcagttgaagttggtaaacttgcaggtattttggctggagaactaggagaaaatgttgatttagctcgtcgggctggattcctccatgatatggggaaagctattgatcgcgaagttgaaggcagtcacgttgaaattggtatggaatttgctcgtaagtacaaagagcatccgattgttgttaatactattgcaagccaccatggtgatgtagaacctgacagcgttattgcagtaattgttgctgctgcagacgcccttagttcagcacgaccaggtgcgcgtaatgagtcaatggaaaattatatcaaacgtctgcgtgatttagaagaaattgctaatggctttgagggagtgcaaaatgcctttgcacttcaagccggacgtgaaattcgtatcatggtacaacctggtaaagtttctgatgatcaagtagttattatgtcgcataaggtacgtgaaaaaatcgaacaaaacttggattatccaggtaatattaaggtaacagttattcgtgaaatgcgagctgttgattttgcaaaa

SEQ ID NO: 2978 - protein, 535 aa, Streptococcus agalactiae
MFNIILAMVCALIGLIIGYVAISMKMKSSKEAAELTLLNAEQDAVDLRGKAEIEAEHIRKAAERESKAHQKELLLEAKEEARKYREEIEKEFKSDRQELKQMEARLTDRASSLDRKDENLSNKEKMLDSKEQSLTDKSRHINEREQEIATLETKKVEELSRIAELSQEEAKDIILADTEKDLAHDIATRIKEAEREVKDRSNKIAKDLLAQAMQRLAGEYVTEQTITTVHLPDDNMKGRIIGREGRNIRTLESLTGIDVIIDDTPEVVVLSGFDPIRREIARMTLESLIQDGRIHPARIEELVEKNRLEMDQRIREYGEAAAYEIGAPNLHPDLIKIMGRLQFRTSYGQNVLRHSVEVGKLAGILAGELGENVDLARRAGFLHDMGKAIDREVEGSHVEIGMEFARKYKEHPIVVNTIASHHGDVEPDSVIAVIVAAADALSSARPGARNESMENYIKRLRDLEEIANGFEGVQNAFALQAGREIRIMVQPGKVSDDQVVIMSHKVREKIEQNLDYPGNIKVTVIREMRAVDFAK

SEQ ID NO: 2979 - DNA, 1605 bp, Streptococcus pyogenes
atggttaatattattttattaattgtttctgccctcattggtttaatattaggttatgcacttatttcgattagactcaagtctgcgaaggaagctgcagagttgactcttttaaacgctgaacaagaagctgttgatattcgtggcaaagcagaagtagatgctgaacacatcaaaaaaacagctaaacgtgaaagtaaagcaaatcgtaaagaattacttttagaagcaaaagaagaggcaagaaaatatcgtgaagagattgaacaagaatttaagtctgaaagacaagagcttaaacaactcgagacacgcttagcggagcgctccttaactcttgaccgtaaagatgaaaacctatcaagtaaagaaaaggtactagatagtaaagaacaaagtctgaccgataaatctaaacacattgatgagcggcaacttcaagtggaaaaacttgaagaggagaaaaaagcagaactggaaaaagttgctgcgatgacgattgcagaagcgcgtgaagtgattttaatggagacggaaaacaaactgacccatgaaattgcgacgcgcattcgagatgccgaacgtgacatcaaggaccgaacagttaaaacagccaaggacttgttagcgcaagccatgcaacgccttgctggtgagtatgtgactgaacaaactattaccagtgtccatctcccagacgacaacatgaagggccgaattattggacgtgaaggccgtaatattcgtactttagagagcttgactggcattgacgttattattgacgatactcctgaagttgttatcttatcaggatttgatcctattcgacgtgaaattgctcgtatgaccttggaatctctgattgctgatggtcgcatccatccagctcgtatcgaggaattggttgagaaaaatcgtcttgaaatggataatcgtattcgtgagtacggtgaagctgcagcctatgagattggtgcaccaaaccttcatcctgatttgattaaaatcatgggacgcctgcaattccgtacctcgtttggtcaaaatgtcctacgtcactctgttgaggttggtaagttagctggtattttagctggtgagttaggtgaaaatgttgctcttgcccgccgtgctggtttcttgcatgatatgggtaaagctattgaccgtgaggttgaaggcagtcacgttgagattggaatggaatttgcacgtaaatacaaagaacatccagttgttgtcaacactattgctagccaccacggagatgtggagccagattctgtgatcgctgtgctagtagctgcagcagacgctctcagttcggctcgtccaggcgctcgtaatgagtcaatggagaattacatcaagcgtcttcgtgatttagaagaaatcgcgacaagttttgatggggtacaaaatagttttgctctacaagctggacgtgagattcgtattatggttcaacctgaaaaaatttcagatgatcaggttgtcattttgtcgcataaagtaagagaaaaaattgaaaacaatctagattacccaggaaatattaaagtaactgttattcgtgagatgagagcggttgattatgccaag

SEQ ID NO: 2980 - protein, 535 aa, Streptococcus pyogenes
MVNIILLIVSALIGLILGYALISIRLKSAKEAAELTLLNAEQEAVDIRGKAEVDAEHIKKTAKRESKANRKELLLEAKEEARKYREEIEQEFKSERQELKQLETRLAERSLTLDRKDENLSSKEKVLDSKEQSLTDKSKHIDERQLQVEKLEEEKKAELEKVAAMTIAEAREVILMETENKLTHEIATRIRDAERDIKDRTVKTAKDLLAQAMQRLAGEYVTEQTITSVHLPDDNMKGRIIGREGRNIRTLESLTGIDVIIDDTPEVVILSGFDPIRREIARMTLESLIADGRIHPARIEELVEKNRLEMDNRIREYGEAAAYEIGAPNLHPDLIKIMGRLQFRTSFGQNVLRHSVEVGKLAGILAGELGENVALARRAGFLHDMGKAIDREVEGSHVEIGMEFARKYKEHPVVVNTIASHHGDVEPDSVIAVLVAAADALSSARPGARNESMENYIKRLRDLEEIATSFDGVQNSFALQAGREIRIMVQPEKISDDQVVILSHKVREKIENNLDYPGNIKVTVIREMRAVDYAK

SEQ ID NO: 2981 - DNA, 147 bp, Streptococcus agalactiae
gtggaagtatccattccggaagtaggttcatctaaaaatagtaattggggcttaccaaccaaagttaaaacaaaagctaaaagtcgtttttgccctccagataaagtctctgtaaattgttgcaagtgcgtatcactccactgtaga

SEQ ID NO: 2982 - protein, 49 aa, Streptococcus agalactiae
MEVSIPEVGSSKNSNWGLPTKVKTKAKSRFCPPDKVSVNCCKCVSLHCR

SEQ ID NO: 2983 - DNA, 714 bp, Streptococcus agalactiae
atgattatagtaaaggagaaccaaatggcaaaagatataattaaggttgatcatatatttaaaagcatcgggcaaaaaacgattttagaagatatatcatttagtatagcttctaaccaatgtgtagcattgattggacctaatggtgcagggaaaacaactctgatgtcaactttgttaggtgatattagtatttcttcaggatcattgacgatttttaatctgcctgcacaccacaataggttaaaatataaggtggccatcttaccacaagaaaatgtattgccctcaaagtttacagtgagagaactcattgatttccaaaggtgtttatttccagaagtgctgccaatgtctctgattttagactatctacagtggagtgatacgcacttgcaacaatttacagagactttatctggagggcaaaaacgacttttagcttttgttttaactttggttggtaagccccaattactatttttagatgaacctacttccggaatggatacttccacacgtcaacgattttgggagctgattgcgacactaaaaaaagaaggtgtcacaattgtctattctagtcattatatcgaagaggtagaacatacagctgataggattttagtacttcataaaggaaagttattacgcgatacaacccccctttgccatgaagcaagaaaaaaccgaaaagttattcaccgttccgct

SEQ ID NO: 2984 - protein, 238 aa, Streptococcus agalactiae
MIIVKENQMAKDIIKVDHIFKSIGQKTILEDISFSIASNQCVALIGPNGAGKTTLMSTLLGDISISSGSLTIFNLPAHHNRLKYKVAILPQENVLPSKFTVRELIDFQRCLFPEVLPMSLILDYLQWSDTHLQQFTETLSGGQKRLLAFVLTLVGKPQLLFLDEPTSGMDTSTRQRFWELIATLKKEGVTIVYSSHYIEEVEHTADRILVLHKGKLLRDTTPLCHEARKNRKVIHRSA

SEQ ID NO: 2985 - DNA, 177 bp, Streptococcus agalactiae
ttgattacagagtgtgaagccaagagtgatagtataacgtttgttactggggaggctgaagctgtatggaaaatactggcagataatggttgtcctattgaagctattgagatgaccaatagaactttgttaaatcgtatttttgagactactaaggaggtaaaacatgagaatctt

SEQ ID NO: 2986 - protein, 59 aa, Streptococcus agalactiae
MITECEAKSDSITFVTGEAEAVWKILADNGCPIEAIEMTNRTLLNRIFETTKEVKHENL

SEQ ID NO: 2987 - DNA, 738 bp, Streptococcus agalactiae
atgagaatctttaaagcattattgaaaatggaatttcttttgacaaaacgtcaacttgccaatctcattatggctataggtatgccagtggctttttttctatttttttcaggatttatgggcgaaggactcactaaagccatcgaagctatctacgttcgtaattatatgataacgatggcaggattctcaagtcttagctttgctttttttacttttccattttctatgaaagatgatcaactctcaaaccgaatgcaattattaagacactcaccagtaccaatgtggcaatattatctagcaaaaattattcgtattttattttactattgcctagcaataactgttgttttcctaactgggcatattttaaggcaagttagtatgccaatagaacaatggatgcagagctttttattgctattaggaggagcaacatgttttattccttttggattgctcgtctcctactttaaaaatactgaactaatgtcaatggtagccaatatttgttatatgtcattagctgttcttggtggcatgtggatgccaattacaatgttcccaaaatggttgcaagctttatcaaagttaacccctacttaccatttgactcaagttatccttagtccgtttgctaatagttttgctggtttttctcttattattctgataggctatggtattataatgttagttatcgcttatctactatctcagaagaggcattcaatt

SEQ ID NO: 2988 - protein, 246 aa, Streptococcus agalactiae
MRIFKALLKMEFLLTKRQLANLIMAIGMPVAFFLFFSGFMGEGLTKAIEAIYVRNYMITMAGFSSLSFAFFTFPFSMKDDQLSNRMQLLRHSPVPMWQYYLAKIIRILFYYCLAITVVFLTGHILRQVSMPIEQWMQSFLLLLGGATCFIPFGLLVSYFKNTELMSMVANICYMSLAVLGGMWMPITMFPKWLQALSKLTPTYHLTQVILSPFANSFAGFSLIILIGYGIIMLVIAYLLSQKRHSI

SEQ ID NO: 2989 - DNA, 1083 bp, Streptococcus agalactiae
ttgaaaaataaaaaaaataactatgatttaatgtattttattccgttagtatttttgatttaccccataggagggattctctattatcactaccctttttggactttattttttacgctagcttttgtaggagcatatttatactctgttattatcaggggcgaatcaaagtatcacatgattgcctggtctacaatgttgacatatattttctacatgacaatttttataaatagtggtttcatctggtatatttactttctgagtaatttactcgtctatcgctttagagataaattgaagtcttttagattcattagttttgcttgtactctagccacagtggtatttttatgcttctttaaggcatcagactttggtgatagaatcatgtttctaattgttcctattttttgtatcggttacatgtggattgctattgaaaatagaaatagcgaagaacaaagagaaaaaattgcagagcaaaatcagtatatcaatattttgtcagctgaaaatgaacgtaaccgtatagggcgtgatttgcatgatagtttaggacatacatttgctatgatgacactaaagacagaactagcgttaaagttgttagaaaaaaggaactatgataaggtacaaaaagaactatcagaattaaatcatattagtcatcaatcgatgagtgaggtccgtcaaattgtttctaacctcaagtatcgtacagtagtggaagaaattgatgagttgtaccgcttgtttcaattatctaacattaagttaacagttgttaataagttagagacgtcacaactaagtccagtaacacaatctacaatcacaatgatattaaaggaattatccaataatattgttaagcatgctgaagctgatagcgtggagttgagtttagtaaggcaaggtgctactataaatattgagatgattgataatggttgtggttttacaaaccttgacggagatgagttgcatagtattcaagagagattaactatcgttgaagggacactaacgattttgtcccgaagtaaaccaactcatattcaggtggtattgaaagaggta

SEQ ID NO: 2990 - protein, 361 aa, Streptococcus agalactiae
MKNKKNNYDLMYFIPLVFLIYPIGGILYYHYPFWTLFFTLAFVGAYLYSVIIRGESKYHMIAWSTMLTYIFYMTIFINSGFIWYIYFLSNLLVYRFRDKLKSFRFISFACTLATVVFLCFFKASDFGDRIMFLIVPIFCIGYMWIAIENRNSEEQREKIAEQNQYINILSAENERNRIGRDLHDSLGHTFAMMTLKTELALKLLEKRNYDKVQKELSELNHISHQSMSEVRQIVSNLKYRTVVEEIDELYRLFQLSNIKLTVVNKLETSQLSPVTQSTITMILKELSNNIVKHAEADSVELSLVRQGATINIEMIDNGCGFTNLDGDELHSIQERLTIVEGTLTILSRSKPTHIQVVLKEV

SEQ ID NO: 2991 - DNA, 1002 bp, Streptococcus pyogenes
atgaaaaaacgttactatgctcttgtttggctctactcaaccattaccattttatctattgtttttgtggtcatggataatttaggaatcacttttaactaccttcgcaatcatttatggcaggtcgaacgtctagggttttcgattttattgttgattgtttctgtgactttattattgttgttattgtggattattatggatgataacagtaagcgtaacatcaaccaaaatctaaaatatattctcaataatcgacgactctatctagatgagacatcagaaatcaatactaatttaagtcgactttctaaaaaaatgtctcacctgactgctaacatgcaaaagaaagaaagtgcttatattcttgatagccaagaagttgtaaaacaagagcgcaaacgaattgcaagagatttacatgacacagtcagtcaagagctattcgcttcgtcattgattttatcaggaatttcgatgagtttggaacaactggacaaaacacaattacaaacacagttaacaacggttgaagcaatgttgcaaaatgctcaaaatgatctacgcattctccttttgcatcttagacctaccgagctagctaatcggactttatctgagggccttcatatgattcttaaggaattaacagataaaagtgatattgaagtcatttataaggaaaccattgctcagcttcctaaaacaatggaagataatctttttagaattgcccaagaattcattagcaacacgttaaaacatgctaaagctagtcgaattgaagtttatctcaatcaaacctcaacagaattacaattgaagatgattgatgatggtgtaggatttgatatggatcaggtaagggatttgagttatggtctgaagaatattgaagaccgtgtcaatgatttagcaggaaacctacatttaattagtcaaaaaggcaaaggagtttccatggatattagactgccgatagtgaagggagatgacgatgag

SEQ ID NO: 2992 - protein, 334 aa, Streptococcus pyogenes
MKKRYYALVWLYSTITILSIVFVVMDNLGITFNYLRNHLWQVERLGFSILLLIVSVTLLLLLLWIIMDDNSKRNINQNLKYILNNRRLYLDETSEINTNLSRLSKKMSHLTANMQKKESAYILDSQEVVKQERKRIARDLHDTVSQELFASSLILSGISMSLEQLDKTQLQTQLTTVEAMLQNAQNDLRILLLHLRPTELANRTLSEGLHMILKELTDKSDIEVIYKETIAQLPKTMEDNLFRIAQEFISNTLKHAKASRIEVYLNQTSTELQLKMIDDGVGFDMDQVRDLSYGLKNIEDRVNDLAGNLHLISQKGKGVSMDIRLPIVKGDDDE

SEQ ID NO: 2993 - DNA, 462 bp, Streptococcus agalactiae
atgaaattacttgttgctgaggatcagtccatgctacgagatgctatgtgccaattacttttgatggaagaaagtgtttctactattgatcaagctggaaatggtggagaagctattgccattttatccaataaagccatagatgttgcaatattggatgttgagatgccgatattatcaggtttagatgtcttagagtgggttagaaaataccagaatgttaaggtcataattgtaacaacctttaagcggtcaggttatttccaaagggctattcgttcaaatgtagatgcttatgttttgaaagaccgctcagtagctgatttgatgaaaacgattcaaaaagttttatctgggggtaaagaatattcgcctgaattaatggaaaacgttatatctaatcctttgagtgagcaagaaataaaaattctttccctaattgctcaagggaagaccagcaaa

SEQ ID NO: 2994 - protein, 154 aa, Streptococcus agalactiae
MKLLVAEDQSMLRDAMCQLLLMEESVSTIDQAGNGGEAIAILSNKAIDVAILDVEMPILSGLDVLEWVRKYQNVKVIIVTTFKRSGYFQRAIRSNVDAYVLKDRSVADLMKTIQKVLSGGKEYSPELMENVISNPLSEQEIKILSLIAQGKTSK

SEQ ID NO: 2995 - DNA, 645 bp, Streptococcus pyogenes
atgacgatgagtaagataaaagtgatattggtcgatgatcatgaaatggtccgcatgggactcaagagttttttgaatttacaagctgatattgatgtcgttggtgaggcctctaatggacgtgaaggggttgatttggcattggctttgaagccagatgttttggttatggatctagtgatgccagagttaggcggtgttgaggcaactttagaagtcctaaaaaaatggaaagaggctaaggtacttgtgttaacttcctatctagataatgaaaagatataccctgtcattgatgcaggagcgaagggttatatgttaaaaacatcgagtgcggctgaaattttaaatgccattcgcaaggtttcaaagggagagttagctattgaaacagaagttgacaaaaaaattaaggcgcatgatcaacaccctgacttgcatgaggaactaacagcgcgtgagtatgacattttacaccttttagctaaagggtatgataatcagaccatcgctgatgaactctttatttccttaaaaaccgtcaaaacacatgtgtccaatattctagccaagttagaagttggtgaccgaacccaagcggttgtctatgcttttcgacatcatttagtcccccaagacgataat

SEQ ID NO: 2996 - protein, 215 aa, Streptococcus pyogenes
MTMSKIKVILVDDHEMVRMGLKSFLNLQADIDVVGEASNGREGVDLALALKPDVLVMDLVMPELGGVEATLEVLKKWKEAKVLVLTSYLDNEKIYPVIDAGAKGYMLKTSSAAEILNAIRKVSKGELAIETEVDKKIKAHDQHPDLHEELTAREYDILHLLAKGYDNQTIADELFISLKTVKTHVSNILAKLEVGDRTQAVVYAFRHHLVPQDDN

SEQ ID NO: 2997 - DNA, 702 bp, Streptococcus agalactiae
atgcaaaaatttaaagaacgttttgatacgcttagtgatgcaattttggccattgctatgacgattttagttttggagataaaaactccggctacgatgggtgatattggtgactttacacggaacataggtttatttattgttagctttgttgttgtttttaatttttggtacgaaagggcacaaaatagcctagatgctcaaaagactaatgatgaaattatagctcttgatatcattgaacacctaggtatttgtttgattcctctctttactaaatttatgatttcttttgagaatcataattttgctgttatggcttatggactcttaacgttattagttggtctcacatcagacattattcggattcgtttggcaagttatgatttagtgaccattcctagtgaattgaaagagcgggttataaaagtcatgacaacttttgccattcgttcagttgtggttcgctttatcatcattatcctcgcttattttctacctgaggtagggatatttgcatatttagtcataccgctctttatgttttggcgtcgctctagagcaggaaaatactatgctaaaaagggcattgaggcaccatcttatatcaagctttttatccaaattggagagagagctcctgaggattttactaattcaagtagtggaataggtggggtaaaaagactctataaaaaa

SEQ ID NO: 2998 - protein, 234 aa, Streptococcus agalactiae
MQKFKERFDTLSDAILAIAMTILVLEIKTPATMGDIGDFTRNIGLFIVSFVVVFNFWYERAQNSLDAQKTNDEIIALDIIEHLGICLIPLFTKFMISFENHNFAVMAYGLLTLLVGLTSDIIRIRLASYDLVTIPSELKERVIKVMTTFAIRSVVVRFIIIILAYFLPEVGIFAYLVIPLFMFWRRSRAGKYYAKKGIEAPSYIKLFIQIGERAPEDFTNSSSGIGGVKRLYKK

SEQ ID NO: 2999 - DNA, 627 bp, Streptococcus agalactiae
atgtctgaacgtggtttgctaattgttttctcaggaccatctggtgttggtaaggggacagttaggcaagaaattttttcaacccctgaccataaatttgattattccgtttcaatgactactcgtccacaacgcccaggcgaagttgatggagttgattatttcttccgtacacgtgaagagtttgaagcgttgattaaagaaggtcaaatgcttgagtatgcggagtatgttggtaactactatggaactcctttaagttatgtcaacgagactttagacaaagggattgatgtttttcttgaaatagaagttcagggagcgcttcaagttaaatcgaaggttccggacggtgttttcattttcttaacaccaccagatttagaggaattagaagagcgtttagtaggacgtgggacagatagtccagaagtgattgcccaacgtattgaacgtgccaaagaagaaattgctttgatgagggagtatgactatgctgttgtcaatgatcaagtgtcattagcagcagaacgtgttaaacgtgtcattgaagcagaacattatcgtgtggatcgtgttattgggcgttataccaacatggtcaaagaaactgataaaaaattaagt

SEQ ID NO: 3000 - protein, 209 aa, Streptococcus agalactiae [sequence omitted]

SEQ ID NO: 3001 - DNA, 633 bp, Streptococcus pyogenes
atgtctgaacgcggtttgttaatcgtcttttctggcccttcaggtgtcggaaaaggaacggtaagacaagaaattttttcaacgccagatcataaatttgaatattcggtttcaatgacgactcgtccgcaaagaccgggcgaggttgatggggttgattatttcttccgcacacgtgaagaatttgaagaactcattaaaactggtcaaatgctagagtatgctgaatatgttggtaattactatggcacccctttaacttatgttaatgagactcttgataagggaattgatgtctttttagaaattgaagttcaaggagctcttcaggttaagtcaaaagtaccagatggtgtttttgtttttttaacaccaccagatttagatgaattagaagaccgcctggttggtcgtggtacagatagtcaagaagtcatagctcaacgtattgaaagagcaaaagaagaaattgcccttatgcgcgaatacgattatgcagttgttaatgatgaagttgccttggcagctgagcgggttaagcgtatcattgagacagaacactttcgtgtggagcgcgtgattggtcgttatgataaaatgattaaaataacaaaaaattcctttaaagctaaa

SEQ ID NO: 3002 - protein, 211 aa, Streptococcus pyogenes
MSERGLLIVFSGPSGVGKGTVRQEIFSTPDHKFEYSVSMTTRPQRPGEVDGVDYFFRTREEFEELIKTGQMLEYAEYVGNYYGTPLTYVNETLDKGIDVFLEIEVQGALQVKSKVPDGVFVFLTPPDLDELEDRLVGRGTDSQEVIAQRIERAKEEIALMREYDYAVVNDEVALAAERVKRIIETEHFRVERVIGRYDKMIKITKNSFKAK

SEQ ID NO: 3003 - DNA, 312 bp, Streptococcus agalactiae
atgatgttaaaaccttctatcgacactttgttggataaagttccttcaaaatattctttagttattttacaagctaagcgtgctcatgaattggaagctggtgagaaagccactcaagattttaaatctgtgaaatcaacacttcgcgctttagaagaaatcgagtcaggtaatgttgtaattcacccagatccatcagcaaaacgtgcctcagttcgcgctcgtatcgaagctgaacgccttgctaaagaagaagaagaacgtaaaatcaaagagcaaattgctaaagaaaaagaagacggcgaaaaaatt

SEQ ID NO: 3004 - protein, 104 aa, Streptococcus agalactiae
MMLKPSIDTLLDKVPSKYSLVILQAKRAHELEAGEKATQDFKSVKSTLRALEEIESGNVVIHPDPSAKRASVRARIEAERLAKEEEERKIKEQIAKEKEDGEKI

SEQ ID NO: 3005 - DNA, 315 bp, Streptococcus pyogenes
atgatgttaaaaccttccattgataccttattagataaagtaccatccaagtattcacttgtgattttacaagccaaacgtgcccatgaactagaagctggtgccactccaactcaagaatttaaatcagtgaagtcaacacttcaggcacttgaagaaattgaatcaggaaacgttgtgattcacccagatccttcagctaaacgtgaagctgtccgtgctaagattgaggcagaacgcttggccaaagaggaagaggaacgtaaaatcaaagaacaaattgccaaagaaaaagaagaagaaggagaaaaaatc

SEQ ID NO: 3006 - protein, 105 aa, Streptococcus pyogenes
MMLKPSIDTLLDKVPSKYSLVILQAKRAHELEAGATPTQEFKSVKSTLQALEEIESGNVVIHPDPSAKREAVRAKIEAERLAKEEEERKIKEQIAKEKEEEGEKI

SEQ ID NO: 3007 - DNA, 2388 bp, Streptococcus agalactiae
atggcaagaaaattagcacaggttattgttgatattcctctgatgcagacagataaaccattttcgtatgccattcctaaagatttggaagatttggtacaagtaggagtacgcgttcatgttccttttggaagaggaaatcgtcttttgcaaggctttgttgtcggtttcagagatgatgatgaattagagactaaggatattgcggaggtcctagattttgaacctgttttaaatcaggaacaactagacttagctgatcagatgcgccatactgtcttttcttataaaatatctattttgaaatcaatgttaccaagtcttttgaattcgcaatatgataaactcttgttagcaacagacacattaccatcagaagatagagaagatctatttggtcataaaacggaaattgtcttttcaagtttgtcttctcaagatgccaaaaaagcaggcagattaattcaaaaaggtttcatagaagttcaatatttagccaaagataagaaaacaataaaaacagaaaagatttacaaaatcaacagaactctgttagaaaagagccaaatagcagcaagagcgaaaaagagactggagttgaaagaattcctgttagaaaatcctcaaccagggcgcctcacagctttaaacaaacaattttcatctcctgtggttaattttttcagagaagaaggaatcattgaagtcattgaaaaagaagctagtagatctgataattattttaaaggaatcctaaaaacggattttttggatttaaatcaggaacaagctaaagtagttaaaatagttgttgaccaaattggtaaggaacagaataaacccttcttgttggaggggattacagggtctggtaagacagaggtatatcttcatatcattgataacgttttaaagttgggaaaaacagcgattgttctcgttccagaaatttctttaactccccagatgacgaatcgttttatttctcgttttggaaagcaagttgctattatgcactcgggcttgtcagaaggtgaaaaatttgatgagtggcgaaagataaaatcaggtcaagctaaagttgtcgttggagctcgttcagcaatttttgctcctttggaaaatatcggagccatcattatagatgaggaacatgaatcaacttataagcaagaatctaacccaaggtatcatgcgcgcgatgtggccttgctacgtgcagaatattataaagctgtgttactaatgggatcagcaactccaagtatcgaaagccgagctagagctagtcgggatgtttataaatttttagaattaaaacatcgtgctaatcctaaagcacgtattcctcaggttgaaattattgattttagaaattttattggtcaacaagaagttagtaatttcacatcatatttactagataaaatccgagatagattagataagaaagagcaagtggttcttatgctcaatcgtagaggttattctagttttattatgtgtcgagactgcggctacgttgatcaatgtcctaattgtgacatttctctgactttacatatggctacaaagaccatgaattgtcattattgtgggtttgaaaagcctattccaagaacatgtccaaattgcaatagtaaaagtatctcttactatggtactggaacccaaaaagcttatgaagaacttttgaaagttatcccagacgcaaagattttacggatggatgttgatacgacaaggcaaaaaggcggtcatgagtctattttgaagcgtttcggaaatcatgaagctgatattttattgggaacacagatgattgctaagggattggattttccaaatgttactttagttggagtactaaatgcagatacttctctgaatttacctgattttcgatcatcagagcgaacttttcagctattaactcaagtggctggacgtgctgggcgtgctgaaaaagaaggagaggttgtcattcaaacttataatcctaatcattatgctattcaattagcccaaaagcaagattttgaagctttttatcaatatgaaatgaatatccgtcgacaacttggttatcctccttattattttacagttggtttaacattatcgcataaagatgaagagtggttaatacgaaaatcttatgaagtattaagtttattgaagcaaggctttagtgataaagtaaagttgttaggtccaacgccaaaaccaattgcaagaacacataacctttatcactaccaaattattatcaagtatcgatttgaggacaaccttgaacttgttttgaatcgcttattagacatgactcaagacaaggagaatagagatcttcgcttagcaatagaccacgaaccgcaaaatatgatg

SEQ ID NO: 3008 - protein, 796 aa, Streptococcus agalactiae
MARKLAQVIVDIPLMQTDKPFSYAIPKDLEDLVQVGVRVHVPFGRGNRLLQGFVVGFRDDDELETKDIAEVLDFEPVLNQEQLDLADQMRHTVFSYKISILKSMLPSLLNSQYDKLLLATDTLPSEDREDLFGHKTEIVFSSLSSQDAKKAGRLIQKGFIEVQYLAKDKKTIKTEKIYKINRTLLEKSQIAARAKKRLELKEFLLENPQPGRLTALNKQFSSPVVNFFREEGIIEVIEKEASRSDNYFKGILKTDFLDLNQEQAKVVKIVVDQIGKEQNKPFLLEGITGSGKTEVYLHIIDNVLKLGKTAIVLVPEISLTPQMTNRFISRFGKQVAIMHSGLSEGEKFDEWRKIKSGQAKVVVGARSAIFAPLENIGAIIIDEEHESTYKQESNPRYHARDVALLRAEYYKAVLLMGSATPSIESRARASRDVYKFLELKHRANPKARIPQVEIIDFRNFIGQQEVSNFTSYLLDKIRDRLDKKEQVVLMLNRRGYSSFIMCRDCGYVDQCPNCDISLTLHMATKTMNCHYCGFEKPIPRTCPNCNSKSISYYGTGTQKAYEELLKVIPDAKILRMDVDTTRQKGGHESILKRFGNHEADILLGTQMIAKGLDFPNVTLVGVLNADTSLNLPDFRSSERTFQLLTQVAGRAGRAEKEGEVVIQTYNPNHYAIQLAQKQDFEAFYQYEMNIRRQLGYPPYYFTVGLTLSHKDEEWLIRKSYEVLSLLKQGFSDKVKLLGPTPKPIARTHNLYHYQIIIKYRFEDNLELVLNRLLDMTQDKENRDLRLAIDHEPQNMM

SEQ ID NO: 3009 - DNA, 2409 bp, Streptococcus pyogenes
atgtccatgacagaaaaggagaagcaaatggaaaaagtagctcatgtgattgtagatattccattgatgcaaacggacaagccattttcttatggtattccaaaagagttagtttctctcgtgcagcttggttctcgtgtgcatgttccttttggaaaagggaatcgtttgttgcaaggctttattattggttttggccaagaagattcaagctctcttaaactgattcagaccgttttagatcctgagccagtcctaaaccaagagcaattgacccttgctgatcagcttcgaaaaacagttttttcttataaaatcacgctcttaaaagcaatgattcctaatcttcttaactctaactatgataaagtgctaaggccagagtcaggtctaaaaaagtctgatagggactttctttttgaaggaaaaccatctgtcttatattctaccttagaccgcgagaaggaaaaaatagctcttaagggcatacaagctgggcatattactgttagttatttagccaaagacaagaaaaacctaaagacagaaaaatattatcacgtcgacttagacgccttagcggtacatcccatctctagtcgtgccaaaaagcgtcaattattaaaagactatctgctaacccatacgaaggaagctaaacttgcaacgctttatcaagccttttctagagatgtggtggcttactttgtgacaaatcacttaattcgtattgacgaacgtccaattgatcgcagtgagtcctattttgaccagatcaaaccatcttcttttttaaccttaaatgaacagcaggcgtcagctgttactgaaattgttgaacaaattgggaaaccgagtaaaccttttttgattgaagggattacaggttcgggtaagacagaagtttatcttcatatcatcgaagcggttttaaaacaggataagacagccattgttttagtgccagaaatttcgttgactcctcagatgacctctcgttttatttcccgtttcggaaagcaagtggctattatgcattcaggcttatcagatggtgaaaagtttgatgagtggcgcaagataaaaacaggacaggctaaggttgtggttggtgcccgctctgctattttctccccactagagcggattggtgcaattattatcgatgaggagcatgaatcaacctataaacaagaaagcaaccctagataccatgccagagaggttgccctgctcagagctaaacaccatcaagcagttgtggttatgggctctgctacgccaagtattgaaagccgagcaagggctagtaagggtgtctatcattttattcaattaacgcaaagagcaaaccctcttgctaagattccagaagtaacgattgttgattttcgtgattatattggacagcaagcagttagtaattttaccccatatttgattgataagattaaagaacgtttggttaaaaaagaacaagttgtcttaatgttaaatagacgtggttattctagttttgtgatgtgtcgggactgtggttatgtggacaaatgtcccaactgtgatatctctttaacccttcacatggatactaaaactatgaattgccattactgtgggtttcaaaaacctatcccaattacttgtcctgagtgtcatagcaatagtatccgctattatggcactggaactcaaaaagcttttgatgaattgcaaggggttattccagaagctaagatcttgagaatggatgttgacaccacacgaaaaaaaagaagtcacaaaaccatactagatagttttggtcgccaggaagcagatattttgttagggacgcaaatgattgccaaaggactggattttccaaatgtgactttagttggggtactaaatgcagatacttccttaaatttgccggattttcgagcgtcagaaaaaacgtttcaattgttaacacaggttgctggtcgggcaggccgtgcccataagccaggagaggtcttgattcaaacttataatcccgatcactatgctattcaattagctaagaaacaagattttgaagctttttaccgttatgagatgtctattcgtcatcaaatggcttatcccccttactactttacagtgggtattacgctttcgcatcgtttagaagcatcggttgtaaaaaaagcttatcaagttacagaactgctaaagagtcacttatcggataatattaaaatattaggaccgactcctaagccaattgctagaacacacaatttataccactatcaaattttgttaaaataccgttttgaagataacctagaagagacgctcaatcgtattcttgattggagtcaagaagcagataatcgtcatttaaaactaattattgattgtgaaccgcaacaattttta

SEQ ID NO: 3010 - protein, 803 aa, Streptococcus pyogenes
MSMTEKEKQMEKVAHVIVDIPLMQTDKPFSYGIPKELVSLVQLGSRVHVPFGKGNRLLQGFIIGFGQEDSSSLKLIQTVLDPEPVLNQEQLTLADQLRKTVFSYKITLLKAMIPNLLNSNYDKVLRPESGLKKSDRDFLFEGKPSVLYSTLDREKEKIALKGIQAGHITVSYLAKDKKNLKTEKYYHVDLDALAVHPISSRAKKRQLLKDYLLTHTKEAKLATLYQAFSRDVVAYFVTNHLIRIDERPIDRSESYFDQIKPSSFLTLNEQQASAVTEIVEQIGKPSKPFLIEGITGSGKTEVYLHIIEAVLKQDKTAIVLVPEISLTPQMTSRFISRFGKQVAIMHSGLSDGEKFDEWRKIKTGQAKVVVGARSAIFSPLERIGAIIIDEEHESTYKQESNPRYHAREVALLRAKHHQAVVVMGSATPSIESRARASKGVYHFIQLTQRANPLAKIPEVTIVDFRDYIGQQAVSNFTPYLIDKIKERLVKKEQVVLMLNRRGYSSFVMCRDCGYVDKCPNCDISLTLHMDTKTMNCHYCGFQKPIPITCPECHSNSIRYYGTGTQKAFDELQGVIPEAKILRMDVDTTRKKRSHKTILDSFGRQEADILLGTQMIAKGLDFPNVTLVGVLNADTSLNLPDFRASEKTFQLLTQVAGRAGRAHKPGEVLIQTYNPDHYAIQLAKKQDFEAFYRYEMSIRHQMAYPPYYFTVGITLSHRLEASVVKKAYQVTELLKSHLSDNIKILGPTPKPIARTHNLYHYQILLKYRFEDNLEETLNRILDWSQEADNRHLKLIIDCEPQQFL

SEQ ID NO: 3011 - DNA, 933 bp, Streptococcus agalactiae
atgacaaaattattattcatggggacccctgatttttcagcgacggttttaaaaggtattttagcagatggtaagtatgatgttttagctgttgtgacgcaaccagatcgtgctgtaggtcgtaaaaaagaaattaaaatgacccctgtaaaagaagtggccttggaaaacaacattcctgtgtatcagccggaaaaactatctggaagtccagaattagaacaactaatgaccctaggtgcagatggtattgtaacagctgcttttggtcaattcttaccaacaaagcttttggaatcggtaggttttgcaattaatgtacatgcttctctattgccaaaatatcgtggtggggcaccaattcattatgccattattaatggcgaaaaagaagctggggttaccatcatggaaatggttgcaaagatggatgcaggggatatggtatcaaaagcttccgttgagataactgatgaagacaatgtagggacaatgtttgatagactcgccgttgttggtcgtgaccttttattagatacgcttccaggttatctatcaggtgatattaagccgataccacaaaatgaagaagaggtaagtttttctcctaatattagtccagatgaagagagaattgattggaataaatcatcgcgcgacatttttaaccatgttcgagggatgtatccatggccagttgcacatacccttttggagggaaatcgttttaaactttatgaagtaacaatgtcagaaggaaagggctcaccgggtcaagtgatcgctaagacaaagaactcattgacagtagcaactggtgacggagctattgaactcaaatcagttcaaccagcagggaaacctcgtatggatataaaagactttttaaatggtgttggtcgtaatttagaaataggagataaatttggcgaa

SEQ ID NO: 3012 - protein, 311 aa, Streptococcus agalactiae
MTKLLFMGTPDFSATVLKGILADGKYDVLAVVTQPDRAVGRKKEIKMTPVKEVALENNIPVYQPEKLSGSPELEQLMTLGADGIVTAAFGQFLPTKLLESVGFAINVHASLLPKYRGGAPIHYAIINGEKEAGVTIMEMVAKMDAGDMVSKASVEITDEDNVGTMFDRLAVVGRDLLLDTLPGYLSGDIKPIPQNEEEVSFSPNISPDEERIDWNKSSRDIFNHVRGMYPWPVAHTLLEGNRFKLYEVTMSEGKGSPGQVIAKTKNSLTVATGDGAIELKSVQPAGKPRMDIKDFLNGVGRNLEIGDKFGE

SEQ ID NO: 3013 - DNA, 933 bp, Streptococcus pyogenes
atgataaaattattatttatgggaactccccaattttcagcaactgtattgaagggcttgctagataatcctgcctatgagattttaggagtggttactcagcctgatcgagctgttggacgcaaaaaagatattaaggtaacacctgtaaagcaattagctcttgagcatggaatatcaatctatcagccggaaaaattatcaggctctcaagaactcattgagattatgggacttggtgcagatggtattattacagcagcatttggccaatttttaccaacaatattacttgattcagtttcatttgctattaatgtacatgcatcattgttacctaaatatcgaggtggagcacctatccattatgctattatgaatggagataaagaggccggcgttactattatggaaatgattaaagaaatggatgcaggtgacatggtcgctaaagcaagcactccaattcttgaaaccgataatgtaggtactctttttgagaaattagccatcattggtcgagacttacttttggatagtttgccagcttatctttctggagaattaaaacctattcctcaagatcacagccaagctactttttcacctaatatctctccagaacatgaaaaattagattggacaatgtctaatcaagaagtgttcaatcatattcgaggtatgaacccttggccggtagcgcatacgtttttagaggggcaacgtttaaaaatttacgaagctcaactagctgaaggagagggattacctggacaagttgttgtcaaaaccaaaaaatctttggtaatagctactggacaaggtgctttgtccttgatcgttgtgcaaccggctggtaaacctaaaatgtcaataatagactttttaaacggcattggtagaaaacttgaagtaggggacatcattggcaga

SEQ ID NO: 3014 - protein, 311 aa, Streptococcus pyogenes
MIKLLFMGTPQFSATVLKGLLDNPAYEILGVVTQPDRAVGRKKDIKVTPVKQLALEHGISIYQPEKLSGSQELIEIMGLGADGIITAAFGQFLPTILLDSVSFAINVHASLLPKYRGGAPIHYAIMNGDKEAGVTIMEMIKEMDAGDMVAKASTPILETDNVGTLFEKLAIIGRDLLLDSLPAYLSGELKPIPQDHSQATFSPNISPEHEKLDWTMSNQEVFNHIRGMNPWPVAHTFLEGQRLKIYEAQLAEGEGLPGQVVVKTKKSLVIATGQGALSLIVVQPAGKPKMSIIDFLNGIGRKLEVGDIIGR

SEQ ID NO: 3015 - DNA, 1320 bp, Streptococcus agalactiae
ttggcgaatgattggaaaaagagtgcgcgtggtttagctttaatgactttagaggaagtttttgataaaggagcttattctaatatcgcacttaataagagtttaaaaaaatctagactatcagataaagatcgtgccttagtaacagaaattgtctatggaactgtggctagaaaaataacgctagaatggtatctatcacactttatagttgatcgtgataagcttgaattatgggtatatcatctcttgctactgagcctttatcaactactctatctggacaacatcccagatcacgctattgttaatgatgctgtcactattgctaagaatcgaggcaataaaaagggtgctgaaaagttaattaatgccgttttacgaagagtaagttcggagacgctccctgaaattgcatcaataaaacgccaaaacaaacgttactctgttgcttattccatgccagtgtggctcgtaaaaaaattaattgaccaatatggtgagacaagagctttagctattatggagagtttatttgagcgaaataaagccagtcttcgtgtgactgacttatcgcaaaaacaaactatcaaagaaactttaaatgttagagattcacatattgcagagacagctttagttgcagactcaggaaattttgcatcgacatcatttttccaagatggcctcattactatccaagatgaatctagtcaattagttgctccaacactcaaagtctcaggtaatgaccaagtattggatgcatgtagtgcaccaggaggaaaaacaagtcatatcgcctcatatttgactacaggggcagtaactgctttagatttgtatgatcataaattggaattggttatggaaaatgcaaaacgcctaggtctgtcagataagataaaaactaaaaagttagatgcaagtaaagctcatgagtattttcttgaggatacttttgacaaaattttagtagacgcaccttgttcaggtatcgggctaattcgccgtaaaccagatattaagtacaataaagctaatcaagactttgaagcactccaagagattcaattgtctatcctatctagcgtttgtcaaacgctacgtaaaggtggtataataacctatagcacttgtaccatttttgaggaagaaaattttcaagttattgaaaaattcttagaaaaccaccccaattttgagcaagtagaactgagtcatacacaagaggatattgtaaagagaggctgtattagtataagccctgaacaatatcatacagatggcttttttattggacaagtcaaacgtatcttg

SEQ ID NO: 3016 - protein, 440 aa, Streptococcus agalactiae
MANDWKKSARGLALMTLEEVFDKGAYSNIALNKSLKKSRLSDKDRALVTEIVYGTVARKITLEWYLSHFIVDRDKLELWVYHLLLLSLYQLLYLDNIPDHAIVNDAVTIAKNRGNKKGAEKLINAVLRRVSSETLPEIASIKRQNKRYSVAYSMPVWLVKKLIDQYGETRALAIMESLFERNKASLRVTDLSQKQTIKETLNVRDSHIAETALVADSGNFASTSFFQDGLITIQDESSQLVAPTLKVSGNDQVLDACSAPGGKTSHIASYLTTGAVTALDLYDHKLELVMENAKRLGLSDKIKTKKLDASKAHEYFLEDTFDKILVDAPCSGIGLIRRKPDIKYNKANQDFEALQEIQLSILSSVCQTLRKGGIITYSTCTIFEEENFQVIEKFLENHPNFEQVELSHTQEDIVKRGCISISPEQYHTDGFFIGQVKRIL

SEQ ID NO: 3017 - DNA, 1320 bp, Streptococcus pyogenes
ttggcagataattggaaaaaaagtacgcgaggcaaagccctccttgtcattgaagctatttttgatcagggggcttacacaaacatagcgcttaatcagcaactaagcaataaagctttatctgctaaggacagagctctattaactgagattgtatatggtaccgtttcacgtaaaattagcttggaatggtatttagcccattatgtcaaagaccgagataaattggacaaatgggtttattatctccttatgctcagtctttatcaactgacttatttagataagttaccagcgcatgccattgttaacgatgcggttggtattgccaaaaatcgtggcaataaaaaaggtgcagagaagtttgtcaatgctattttacgtcaattcaccagccatcctctcccagatatggaaacaattaagcgtcgaaataagtattattcggtcaagtattcactgcctgtttggttggttaaaaagttagaagaccaatttggttctgacagatcagtggccatcatggaaagtttatttgtgcgtagtaaggctagtattcgcgtgacagaccctttgaagctagaggaagttgctgaggctttagatgcagaacgttcccttttatcagcaactggtttaaccaaagcgtcaggtcattttgcagccagtgattatttcacaaatggggacatcactattcaagatgaaagcagtcagcttgtagctcctactttaaacattgacggtgacgacataattcttgatgcgtgtagcgctccagggggcaagacctctcatatagcatcttacttaaaaacaggtaaagttattgccttagatctctatgatcataaactagagttggtgaaggaaaatgctaaccgcttaggagttgctgataacattgagacaagaaaactagatgccagagaggttcatcgtcattttgaaaaggatagctttgataagattttggtggatgctccttgctcaggaattggtttgattcgtcgaaaacccgatatcaaatataataaagaaagtcaaggtttcaatgctctgcaagctatccagctagagatattgtctagtgtttgtcaaaccttgcgtaaaggtggtataataacatacagtacttgcactatttttgatgaggagaatcgtcaagtcatcgaagcatttttacagagtcatcctaattttgaacaagtaaaactgaaccatacacaagcagatattgtcaaggatggttatcttattatcacaccagaacaataccagactgatggcttctttattggacaagtcagacgagtcttg

SEQ ID NO: 3018 - protein, 440 aa, Streptococcus pyogenes
LADNWKKSTRGKALLVIEAIFDQGAYTNIALNQQLSNKALSAKDRALLTEIVYGTVSRKISLEWYLAHYVKDRDKLDKWVYYLLMLSLYQLTYLDKLPAHAIVNDAVGIAKNRGNKKGAEKFVNAILRQFTSHPLPDMETIKRRNKYYSVKYSLPVWLVKKLEDQFGSDRSVAIMESLFVRSKASIRVTDPLKLEEVAEALDAERSLLSATGLTKASGHFAASDYFTNGDITIQDESSQLVAPTLNIDGDDIILDACSAPGGKTSHIASYLKTGKVIALDLYDHKLELVKENANRLGVADNIETRKLDAREVHRHFEKDSFDKILVDAPCSGIGLIRRKPDIKYNKESQGFNALQAIQLEILSSVCQTLRKGGIITYSTCTIFDEENRQVIEAFLQSHPNFEQVKLNHTQADIVKDGYLIITPEQYQTDGFFIGQVRRVL

SEQ ID NO: 3019 - DNA, 735 bp, Streptococcus agalactiae
atggaaatatctcttttaacagatattgggcaacgtcgttccaataatcaagattttattaatcaatttgaaaataaagccggcgtcccactaatcatcttagcagatggtatgggaggacatcgtgcaggaaatattgctagcgagatgactgtaactgatctaggaagtgattgggcggagacagatttttctgagttatcagaaattcgtgattggatgcttgtctctattgaaacagagaatcgcaaaatatatgaattaggtcagtcagatgattacaaaggtatgggaactaccattgaagcagttgccattgtaggagataatattattttcgcacatgtaggagattcacgtatcggtatcgttcgtcaaggagagtatcatttattgacgagtgatcattctcttgttaatgaattggtaaaagctggccaattaacagaagaagaagctgctagtcatcctcaaaaaaatattattacgcaatcaattggtcaagccaatccagtcgaacctgatttaggagttcatctacttgaagaaggtgactaccttgtagttaatagtgatggactaactaatatgttgagtaatgccgatattgctacagtactaacacaagaaaaaaccttagatgataagaatcaagatttaatcactctagcaaaccatagaggaggtcttgataatatcactgtggcactagtttacgttgaaagtgaggcggtt

SEQ ID NO: 3020 - protein, 245 aa, Streptococcus agalactiae
MEISLLTDIGQRRSNNQDFINQFENKAGVPLIILADGMGGHRAGNIASEMTVTDLGSDWAETDFSELSEIRDWMLVSIETENRKIYELGQSDDYKGMGTTIEAVAIVGDNIIFAHVGDSRIGIVRQGEYHLLTSDHSLVNELVKAGQLTEEEAASHPQKNIITQSIGQANPVEPDLGVHLLEEGDYLVVNSDGLTNMLSNADIATVLTQEKTLDDKNQDLITLANHRGGLDNITVALVYVESEAV

SEQ ID NO: 3021 - DNA, 738 bp, Streptococcus pyogenes
atgaagatttcattaaaaacagacattgggcaaaaacgctcaaacaatcaagattttatcaataagtttgataataaaaaaggcatcactttagtgattttagcagacggtatgggtggccacagagctggaaatattgccagtgagatgacagtcacagacctgggaagagaatgggtaaaaacagacttcacagagttaagtcagattagagattggttatttgaaactatccagtcagaaaatcaacggatttatgatctaggccaatcagaagactttaaaggaatgggaacgactgttgaagcagtagctttagttgaatctagcgccatttatgctcatattggtgattcacggattggtcttgtccatgatgggcattataccttattgaccagtgatcattctttagtgaatgagttggttaaggcaggacagatcacagaagaagaagctgctagccatccacaaagaaatattatcactcaatctattggtcaagcttccccagtagagcctgatttaggagtgagggttttggagccaggggattatcttgtcattaacagtgatggtctaaccaatatgatttcaaatgatgaaattgtgactatcttgggcagtaaggttagtcttgatgaaaaaaaccaagaaatgattgacttagctaacctaagaggaggcctagataatattacaatcgctttggttcataacgaaagtgaggacgtcgaa

SEQ ID NO: 3022 - protein, 246 aa, Streptococcus pyogenes
MKISLKTDIGQKRSNNQDFINKFDNKKGITLVILADGMGGHRAGNIASEMTVTDLGREWVKTDFTELSQIRDWLFETIQSENQRIYDLGQSEDFKGMGTTVEAVALVESSAIYAHIGDSRIGLVHDGHYTLLTSDHSLVNELVKAGQITEEEAASHPQRNIITQSIGQASPVEPDLGVRVLEPGDYLVINSDGLTNMISNDEIVTILGSKVSLDEKNQEMIDLANLRGGLDNITIALVHNESEDVE

SEQ ID NO: 3023 - DNA, 1953 bp, Streptococcus agalactiae
atgattcagattggcaaattatttgctggtcgttatcggatccttaaatcaatcggacgaggtggaatggcggatgtttatctagctcgagatctaattttagataatgaagaggtcgcaataaaagtattgcgaaccaattatcaaacagatcagattgcggttgctcgcttccagagagaagcacgagcaatggctgagctgacacatcctaatattgtcgctattcgtgatataggtgaagaagacggacagcagttcttagtaatggaatatgttgatggattcgatttaaaaaagtatattcaagacaatgcacccctatcaaataatgaagttgttcgaatcatgaatgaagtcctttcagccatgtcactggcacatcagaaaggtatcgtacaccgtgatttaaaacctcaaaatattttattaactaaaaaagggactgtaaaagttacagatttcggtattgcggtagcgtttgctgaaactagtttaacgcaaacgaattctatgttaggtagtgttcattatttatcgccagagcaggcgcgtggttcaaaagcgactgttcagagtgatatttatgccatgggaatcatgctttttgaaatgttaactggccatattccttatgatggggatagtgcagttactattgccctacagcacttccaaaaaccactaccatcaatccttgcagaaaataaaagcgttccacaagctttggaaaacattgtcattaaagcaacagctaaaaagctaacagatcgctataagacaacttatgagatgggacgtgatttatcaactgctctaagctcgacacgtcaccgtgaaccaaaacttgtttttaatgatactgagagtactaagacactacccaaagtaacatctacagtatcatctctaacgacagaacaactgttgcgtaatcaaaaacaggccaaaacaacagaaaaaataactcctgattctgcgagtaacgataaaacgaagtctaaaaagaaggcttctcatcgacttcttggtacaatcatgaaattattctttgcactctgtgttgtaggaataattgtatttgcttataaaattttagtaagtcctacgactattcgtgttccagatgttagcaacaaaacagtagctcaagcaaaaatgacattggaaaattctggattgaaagtaggagctattcgtaatattgagagtgatagtgtttcagaaggacttgtcgtaaaaacagaccctgctgcaggacgttctcgcagagaaggggctaaagttaatctttatattgccactccaaacaagagtttcactctaggtaattataaggaacataattacaaagatatcctcaaagatcttcaaggcaaaggtgttaaaaaatctttaatcaaggttaagcgtaaaattaataatgattatactactggtacaatcttagcacagtcgcttccagaaggaacatcttttaatcctgatggtaataagaaattaacacttacggttgctgttaatgatccaatgattatgcctgatgtaacaggtatgactgttggagaagtaatagaaaccttgacagacctcggattagatgcagataatcttgtcttctatcaaatgcaaaatggcgtttatcaaacagtagtaacacctccatcttcaagtaagatagcaagtcaggatccttattacggaggagaagttggattaaggagaggagataaagttaagctgtatcttcttggttctaaaacaacgaataactcatcatctacgccaatagattcttcggcttcaagctcaacaggaacaactacctcggattctgtaagctcatcaacggatgctagcacttctgatagtagtagcacttctacaagtagttcaacactaccaagtgatagtacaactaatacaggaacagctaacaatccattaactcaa

SEQ ID NO: 3024 - protein, 651 aa, Streptococcus agalactiae
MIQIGKLFAGRYRILKSIGRGGMADVYLARDLILDNEEVAIKVLRTNYQTDQIAVARFQREARAMAELTHPNIVAIRDIGEEDGQQFLVMEYVDGFDLKKYIQDNAPLSNNEVVRIMNEVLSAMSLAHQKGIVHRDLKPQNILLTKKGTVKVTDFGIAVAFAETSLTQTNSMLGSVHYLSPEQARGSKATVQSDIYAMGIMLFEMLTGHIPYDGDSAVTIALQHFQKPLPSILAENKSVPQALENIVIKATAKKLTDRYKTTYEMGRDLSTALSSTRHREPKLVFNDTESTKTLPKVTSTVSSLTTEQLLRNQKQAKTTEKITPDSASNDKTKSKKKASHRLLGTIMKLFFALCVVGIIVFAYKILVSPTTIRVPDVSNKTVAQAKMTLENSGLKVGAIRNIESDSVSEGLVVKTDPAAGRSRREGAKVNLYIATPNKSFTLGNYKEHNYKDILKDLQGKGVKKSLIKVKRKINNDYTTGTILAQSLPEGTSFNPDGNKKLTLTVAVNDPMIMPDVTGMTVGEVIETLTDLGLDADNLVFYQMQNGVYQTVVTPPSSSKIASQDPYYGGEVGLRRGDKVKLYLLGSKTTNNSSSTPIDSSASSSTGTTTSDSVSSSTDASTSDSSSTSTSSSTLPSDSTTNTGTANNPLTQ

SEQ ID NO: 3025 - DNA, 1896 bp, Streptococcus pyogenes
atgattcagattggcaaattatttgctggtcgttatcgcattctgaaatctattggccgcggtggtatggcggatgtttatttagcaaatgacttgatcttggataatgaagacgttgcaatcaaggtcttgcgtaccaattatcaaacagatcaggtagcagttgcgcgtttccaacgagaagcgcgggccatggctgaattgaaccatcccaatattgttgccatccgggatataggtgaagaagacggacagcaatttttagtaatggaatatgtggatggtgctgacctaaagagatacattcaaaatcatgctccattatctaataatgaagtggttagaattatggaagaagtcctttctgctatgactttagcccaccaaaaaggaattgtacacagagatttaaaacctcaaaatatcctactaactaaggagggtgttgtcaaagtaactgatttcggcatcgcagtagcctttgcagaaacaagcttgacacaaactaattcgatgttaggcagtgttcattacttgtctccagaacaggctcgcggctccaaagcgacgattcaaagtgatatttatgcgatggggattatgctctttgagatgttgacaggccatatcccttatgacggcgatagtgctgttacgattgccttgcaacattttcaaaagcctcttccatctattatcgaggagaaccacaatgtgccacaagctttggagaatgttgttattcgagcaacagccaagaaattaagtgatcgttacgggtcaacctttgaaatgagtcgtgacttaatgacggcgcttagttataatcgtagtcgggagcgtaagattatctttgagaatgttgaaagtaccaaacccctccccaaagtggcctcaggtcccaccgcttctgtaaaattgtctccccctaccccaacagtgttaacacaggaaagtcgattagatcaaactaatcaaacagatgctttacagccccccaccaaaaagaaaaaaagtggtcgttttttaggtactttattcaaaattcttttttctttctttattgtaggtgtagcactctttacttatcttatactaactaaaccaacttctgtgaaagttcctaatgtagcaggcactagtcttaaagttgccaaacaagaactgtatgatgttgggctaaaagtgggtaaaatcaggcaaattgagagtgatacggttgctgagggaaatgtagttagaacagatcctaaagcaggaacagctaagaggcaaggctcaagcattacgctttatgtgtcaattggaaacaaaggttttgacatggaaaactacaaaggactagattatcaagaagctatgaatagtttgatagaaacttatggtgttccaaaatcaaaaatcaaaattgagcgcattgtaactaatgaatatcctgaaaatacagtcatcagtcaatcgccaagtgcgggtgataaatttaatccaaacggaaagtctaaaattacgctcagtgttgctgttagtgatacgatcactatgcctatggtaacagaatatagttatgcagatgcagtcaataccttaacagctttaggtatagatgcatctagaataaaagcttatgtgccaagctctagctcagcaacgggctttgtgccaattcattctcctagttctaaagctattgtcagtggtcaatctccttactatggaacgtctttgagtctgtctgataaaggagagattagtctttacctttatccagaagaaacacactcttctagtagctcatcgagttcaacgtcaagttcaaacagttcttcaataaatgatagtactgcaccaggtagcaacactgaattaagcccatcagaaactacttctcaaacacct

SEQ ID NO: 3026 - protein, 632 aa, Streptococcus pyogenes
MIQIGKLFAGRYRILKSIGRGGMADVYLANDLILDNEDVAIKVLRTNYQTDQVAVARFQREARAMAELNHPNIVAIRDIGEEDGQQFLVMEYVDGADLKRYIQNHAPLSNNEVVRIMEEVLSAMTLAHQKGIVHRDLKPQNILLTKEGVVKVTDFGIAVAFAETSLTQTNSMLGSVHYLSPEQARGSKATIQSDIYAMGIMLFEMLTGHIPYDGDSAVTIALQHFQKPLPSIIEENHNVPQALENVVIRATAKKLSDRYGSTFEMSRDLMTALSYNRSRERKIIFENVESTKPLPKVASGPTASVKLSPPTPTVLTQESRLDQTNQTDALQPPTKKKKSGRFLGTLFKILFSFFIVGVALFTYLILTKPTSVKVPNVAGTSLKVAKQELYDVGLKVGKIRQIESDTVAEGNVVRTDPKAGTAKRQGSSITLYVSIGNKGFDMENYKGLDYQEAMNSLIETYGVPKSKIKIERIVTNEYPENTVISQSPSAGDKFNPNGKSKITLSVAVSDTITMPMVTEYSYADAVNTLTALGIDASRIKAYVPSSSSATGFVPIHSPSSKAIVSGQSPYYGTSLSLSDKGEISLYLYPEETHSSSSSSSSTSSSNSSSINDSTAPGSNTELSPSETTSQTP

SEQ ID NO: 3027 - DNA, 693 bp, Streptococcus agalactiae
atgaaaaaatttcagttttttctacttgttgaagccgttgtcttagttatgggattaatgaaaattttatctgatgactggacaagttttatttttattctcgctttgattcttttagccttaagattttataacaacgatagtcgtcataattttctgttaacgacaagtttgttattactatttttaatctttatgcttaacccttacattattgcagccgttgtttttgcagttttgtatgttctaatcaatcatttctcgcaagttaagaaaaaaaatcgttatgctttgattcaatttaagaatcatcaattagatgttaagacaacacgaaaccaatggttaggtactgatcaacacgaaagtgacttttatgcttttgaagatattaatattataagaatctctgggactgatacaattgatttaacaaatgttattgtatctgggcaggataatgttattataattcaaaaagtttttggtgatactaaagtattggttcctttagacgttgccgtaaaggctgatattagttctgtttacggtagtgtacagtactttgattttgaggagtatgatctaagaaatgaatctataaaattgtcacaagaggaagaatattaccttttgaaacgtgtcaaattagttgtaaacactatcgctgggaaagttgaggttagtcgtaaa

SEQ ID NO: 3028 - protein, 231 aa, Streptococcus agalactiae
MKKFQFFLLVEAVVLVMGLMKILSDDWTSFIFILALILLALRFYNNDSRHNFLLTTSLLLLFLIFMLNPYIIAAVVFAVLYVLINHFSQVKKKNRYALIQFKNHQLDVKTTRNQWLGTDQHESDFYAFEDINIIRISGTDTIDLTNVIVSGQDNVIIIQKVFGDTKVLVPLDVAVKADISSVYGSVQYFDFEEYDLRNESIKLSQEEEYYLLKRVKLVVNTIAGKVEVSRK

SEQ ID NO: 3029 - DNA, 684 bp, Streptococcus pyogenes
atgcaattttccaggaattctgataaaatacaaagaaataaggggaaactaatgaaaaaatttcaattctttttacttatcgagtgtatactgctagctatgggtatcatgacaatcttggataatgatttatcaagttttatcctaattctagttcttatcttattagcattacgcttttataaccaagatagccgcaataattttttactaactgtcagtttattgtttctttttttaattttcatgcttaatccctacattatcatggctgttcttttggggatagtttacattttcattaaccatttttcacaagtcaaaaagaagaatcgctttgccttgattcgtttcaaggaagaaaagattgaagtgaacaataccaagcatcaatggattggtactgctaattatgaaagtgattattattgttttgatgacattaacatcattcgaatctcaggaaatgacacggttgacttaaccaatgttattgtgacaggaatggataatatcattgtgatacgtaaaatttttggaaatacgactatattggtacctattgatgtcactgttactttagatgttagttccatatacggaagcgttgatttttttagatgtcagcaatatgatttgcgcaacgaatctattaagtttaaagaaacggataaccaatccctt

SEQ ID NO: 3030 - protein, 228 aa, Streptococcus pyogenes
MQFSRNSDKIQRNKGKLMKKFQFFLLIECILLAMGIMTILDNDLSSFILILVLILLALRFYNQDSRNNFLLTVSLLFLFLIFMLNPYIIMAVLLGIVYIFINHFSQVKKKNRFALIRFKEEKIEVNNTKHQWIGTANYESDYYCFDDINIIRISGNDTVDLTNVIVTGMDNIIVIRKIFGNTTILVPIDVTVTLDVSSIYGSVDFFRCQQYDLRNESIKFKETDNQSL

SEQ ID NO: 3031 - DNA, 1017 bp, Streptococcus agalactiae
atgaaaaagcaccactactttttagctttcttctatggaagtgtcattatatttgccatttgttttgtcattattgatagtttgggtgttaatttggtgcacctctatcaaacgtctcgtttgtggctgattgaacaattgattttctctattttctttctatctttagcggtaactatccttttattgctaacttggtttttattagatgataatagtaaacgtcaaattaaccataatttacgtcgcattttaaataaccaatcaataaatgttaccgatgatggtactgaaatatcgaccaatattcaacggctctctaaaaaaatgaatttaatgacagcaagtctacaatctaaggaaaatagtcgtattttaaaaagccaagaaattgtgaaacaagaacgtaagcgtattgcacgtgatttacacgacacagttagtcaggatttgttcgctgcttccatggttttgtcagggatagcacagaatgtttctcagctagacgttgatcaggttggctcgcaattattagcagtagaagaaatgcttcagcatgcacaaaatgatttgagaattctgctacttcatttgaggccagttgaattagaaaataagaccctatctgaaggattcagaatgatattgaaagaattgaccgataagagcgacattgaagttgtttatcatgaatcaattctaaccttacccaaaaagattgaagacaatatttttagaattggtcaagaatttatcagtaatactttaaagcattcacaagccagtcgtctcgaagtttaccttaatcaaacagagaatgaattgcagttaaaaatgattgataatggtattggatttgatatggattctgtctatgatttaagttatgggttaaaaaatattgaagatcgagtagaagatttagcaggaaatttacagcttctcagtcagcctggtaaaggagttgctatggatataagattacctttagtaaatcagagtgaggataaaaatgga

SEQ ID NO: 3032 - protein, 339 aa, Streptococcus agalactiae
MKKHHYFLAFFYGSVIIFAICFVIIDSLGVNLVHLYQTSRLWLIEQLIFSIFFLSLAVTILLLLTWFLLDDNSKRQINHNLRRILNNQSINVTDDGTEISTNIQRLSKKMNLMTASLQSKENSRILKSQEIVKQERKRIARDLHDTVSQDLFAASMVLSGIAQNVSQLDVDQVGSQLLAVEEMLQHAQNDLRILLLHLRPVELENKTLSEGFRMILKELTDKSDIEVVYHESILTLPKKIEDNIFRIGQEFISNTLKHSQASRLEVYLNQTENELQLKMIDNGIGFDMDSVYDLSYGLKNIEDRVEDLAGNLQLLSQPGKGVAMDIRLPLVNQSEDKNG

SEQ ID NO: 3033 - DNA, 651 bp, Streptococcus agalactiae
gtgaggataaaaatggataaaataaaaattgtacttgttgatgaccatgagatggttcgtctcggtttaaaaagttttttaaacttacaagctgatgttgaagtaataggtgaggcctcaaatggtttagaaggcataaaaaaagcactggagttacgtccagacgttgttgttatggacttagtaatgcctgaaatggacggtgtagaagcaaccttagcattattgaaggattggccagaagctgccattttagtcttaacatcttacttggataatgaaaaaatttaccctgttattgaagcaggtgccaaaggctatatgttaaagacctcaagcgcagcagagattcttaatgccattcgtaaagtttcaaggggagaacaagctattgaaaatgaagtagataagaaaattaaggctcatgataaatgtccagctttacatgagggcttaacagcaagggaacgtgatatccttaatttattagccaaaggttatgacaatcaaaggattgctgatgaattatttatctcgttaaagactgttaaaactcatgtttctaatattttgggaaaactaaatgtagcagatcgaactcaagcagttgtctatgctttccaacaccatttggtaccacaagatgatgaa

SEQ ID NO: 3034 - protein, 217 aa, Streptococcus agalactiae
MRIKMDKIKIVLVDDHEMVRLGLKSFLNLQADVEVIGEASNGLEGIKKALELRPDVVVMDLVMPEMDGVEATLALLKDWPEAAILVLTSYLDNEKIYPVIEAGAKGYMLKTSSAAEILNAIRKVSRGEQAIENEVDKKIKAHDKCPALHEGLTARERDILNLLAKGYDNQRIADELFISLKTVKTHVSNILGKLNVADRTQAVVYAFQHHLVPQDDE

SEQ ID NO: 3035 - DNA, 1398 bp, Streptococcus agalactiae
atggacgcaaaaactaaatataaagcaaaaaaaataaaggcagtgttttttgatattgatgacacgcttcgtgttaaagatacaggttatatgccaccatcaatcttaaaagtttttaaagctttgaaagataaaggaatcgttgtaggtattgcttcaggaagagcacgatatggcgttccaaaagaagttcaagatttaaatgccgattattgtgtaaaattaaatggagcttacgttaaggacaaggataagaatattatcttccatcgtcctattccagctgaatatgtagagcaatataagaaatgggcggacactgttggtattaagtacggtttagctggtcgtcatgaggcagttttatcagatcgtgatgatttggtaaatgatgcgattgatattgtgtattctgatctcgaagttaatccagatttcaataaagaacatgatatttatcagatgtggacatttgaagataaaggagatagccttcatctacctgaaccgttagctgaacatcttcgcttgatacgttggcatgatcattcttcagatgttgtgttaaaaggaacatcgaaggctttaggtgtttctaaagttgttgaacatttgggcttaaagccagagaatatcttggttttcggagatgagctcaatgatttagaactctttgattatgctggactagctgtggcgatgggagtgtcacacccagaagctcaaaaaaaagcagattttatcacaaaaaaagtagaagaagatggcattttgtatgccctggaggaactaggtttgatagaaaaagaattaacatttccacaagtagatattgaaaatacagaaggtcctgtggctgtcattaaaacaaatcacggggatatgactgtaaaactcttcccggatcatgctcctaaaacggtagcaaactttattggtttagctaaacaaggttattatgatggtattatcttccatcgtattattccagattttatgattcagggtggtgatccaactggtacaggtatgggtggtgaatctatctatggggaaagttttgaagacgaattttccgaggaattatataatgttcgcggagctctttcaatggctaatgctggaccaaatacgaatggcagccaatttttcatcgtccaaaatacaaaaattccttatgcgaaaaaggaattagagcgaggtggttggccaacaccaattgctgagttgtatgctggacaaggtggtacaccgcatctagatcgtcgccacagtgtatttggacaattagtagaccaaagttcttttgaggtacttgatgagattgcggcagtagagactggttctcaagacaaaccattggaagatgttgttattttaacgattgaggttaaagaa

SEQ ID NO: 3036 - protein, 466 aa, Streptococcus agalactiae
MDAKTKYKAKKIKAVFFDIDDTLRVKDTGYMPPSILKVFKALKDKGIVVGIASGRARYGVPKEVQDLNADYCVKLNGAYVKDKDKNIIFHRPIPAEYVEQYKKWADTVGIKYGLAGRHEAVLSDRDDLVNDAIDIVYSDLEVNPDFNKEHDIYQMWTFEDKGDSLHLPEPLAEHLRLIRWHDHSSDVVLKGTSKALGVSKVVEHLGLKPENILVFGDELNDLELFDYAGLAVAMGVSHPEAQKKADFITKKVEEDGILYALEELGLIEKELTFPQVDIENTEGPVAVIKTNHGDMTVKLFPDHAPKTVANFIGLAKQGYYDGIIFHRIIPDFMIQGGDPTGTGMGGESIYGESFEDEFSEELYNVRGALSMANAGPNTNGSQFFIVQNTKIPYAKKELERGGWPTPIAELYAGQGGTPHLDRRHSVFGQLVDQSSFEVLDEIAAVETGSQDKPLEDVVILTIEVKE

SEQ ID NO: 3037 - DNA, 1410 bp, Streptococcus pyogenes
ttggaggaaagtatggacgcaaaactaaaatacaaagctaaaaaaatcaaaatggtgttctttgatattgatgataccttgagggtcaaagatacgggttatatgcctgagtcgattcaaagagtatttaaggctttgaaggcaaaaggcatcttggttggtattgcttcaggtcgcgctcggtacggtgttccacaagaagttcaagatttacatgctgactattgtgtcaaattaaatggagcttatgtcaaagacgatgctaaaactattattttccaagctccgattccagcagatgttgttgtggcctataaaaaatgggcggatgatatgggcattttttatggaatggcgggtcgtcatgaagcggtgttgtccgctcgaaatgacatgattagcaatgctattgataatgtctacgctcaactagaggtctgtccggattataatgagtatcatgatgtttaccagatgtggactttcgaggacaagggagatggcttgcagttgcctgctgaattagcagagcaccttcgtttggtcagatggcacgataactcatcagatgttgtcttgaaaggtacgtcaaaagcgctaggtgtttcaaaagtagttgaccatttaggattaaaacctgaaaatattttggtttttggagatgaactcaatgacctagagttatttgactatgctggtatcagtattgcaatgggagtatcacatccattactgcaagaaaaagcagattttatcacaaaaaaagttgaagaagatggcattttatatgccttggaggaattaggattgattgacaaagaattacagtttccacaattggatttgccaaaccataaaggaccaaaagcaaccattaaaacaaaccatggcgatatgaccctggtcttgttcccagatcatgctcctaaaacagtagccaatttcttaggtttggctaaagaagggtactatgatgggattatcttccaccgtattattcctgaatttatgattcaagggggcgatccaacaggaacaggaatgtgtggacaatccatctatggtgaaagttttgaagatgaattttcggatgaactctataatctccgtggggccttgtcgatggctaatgcgggaccaaatactaacggcagtcagttctttattgttcaaaatagtaagattccttatgccaaaaaagaactagaacgtggtggttggccggctccaattgcagcttcttacgctgcaaatggtggaactcctcaccttgatcgtcgtcatacggtctttggtcagcttgtggacgaaacttcattccaagttttggatttgattgctggcgttgaaactggcgcacaggataaacctaaagaagacgttatcattgaaacaatcgaggtatttgac

SEQ ID NO: 3038 - protein, 470 aa, Streptococcus pyogenes
LEESMDAKLKYKAKKIKMVFFDIDDTLRVKDTGYMPESIQRVFKALKAKGILVGIASGRARYGVPQEVQDLHADYCVKLNGAYVKDDAKTIIFQAPIPADVVVAYKKWADDMGIFYGMAGRHEAVLSARNDMISNAIDNVYAQLEVCPDYNEYHDVYQMWTFEDKGDGLQLPAELAEHLRLVRWHDNSSDVVLKGTSKALGVSKVVDHLGLKPENILVFGDELNDLELFDYAGISIAMGVSHPLLQEKADFITKKVEEDGILYALEELGLIDKELQFPQLDLPNHKGPKATIKTNHGDMTLVLFPDHAPKTVANFLGLAKEGYYDGIIFHRIIPEFMIQGGDPTGTGMCGQSIYGESFEDEFSDELYNLRGALSMANAGPNTNGSQFFIVQNSKIPYAKKELERGGWPAPIAASYAANGGTPHLDRRHTVFGQLVDETSFQVLDLIAGVETGAQDKPKEDVIIETIEVFD

SEQ ID NO: 3039 - DNA, 372 bp, Streptococcus agalactiae
ttgaggttaaagaataaaatgaagattggcgataagttaaagggaacagtcactggcattaggccttatggagcctttgtttctcttgaggatggtaggactggacttatccatatttctgaaattaaaacaggttacattgataatatttatgatgttcttagtgtaggtgatgaagtctatgttcaggttatagatgtagatgaatttacacaaaaagcaagtttatcgcttcggacccttgaagaagagagacatcatattcagcatcgtcatcgattttctaacaatcgtcttaagataggtttcaaaccacttgaggaaaatttacctagttgggttgaggaaggtctagcctacttgaataataaa

SEQ ID NO: 3040 - protein, 124 aa, Streptococcus agalactiae
MRLKNKMKIGDKLKGTVTGIRPYGAFVSLEDGRTGLIHISEIKTGYIDNIYDVLSVGDEVYVQVIDVDEFTQKASLSLRTLEEERHHIQHRHRFSNNRLKIGFKPLEENLPSWVEEGLAYLNNK

SEQ ID NO: 3041 - DNA, 375 bp, Streptococcus pyogenes
atgaaaattggcgacaaactgcatggcaccatcactgggattaaaccatacggagcctttgttgcccttgaaaatgggacaacaggtctcattcatatttcagaaataaaaacgggatttattgacgatattgatcaattattggctataggcaaccaggttttagtacaagtaattgatattgatgaatatagtaaaaagccaagtttatctatgcggaccttagcagaagaaaaacagcattttttccatcgtcatcgttattccaacagtcggcacaagattggctttaggccacttgaagagcagttacctcagtggattgaagaaagcctgcagtttttaaaaaagaacactaaaaagagtctggaacct

SEQ ID NO: 3042 - protein, 125 aa, Streptococcus pyogenes
MKIGDKLHGTITGIKPYGAFVALENGTTGLIHISEIKTGFIDDIDQLLAIGNQVLVQVIDIDEYSKKPSLSMRTLAEEKQHFFHRHRYSNSRHKIGFRPLEEQLPQWIEESLQFLKKNTKKSLEP

SEQ ID NO: 3043 - DNA, 774 bp, Streptococcus agalactiae
atgacaaatgaaaaaggtattgtattcaacattcaacattttagtattcacgatggtccaggtattcgaacaaccgttttcttaaagggttgtcctcttagatgtccttggtgtgctaatcccgagtcgcaaaaaatggttccagaaacaatgagagatgccattactaatgaaagcgtcatcgtgggcgaagaaaaatcggttgatgatattattgaagaagttttaaaagatattgatttttacgaagaatctggtgggggcataacgctatctggcggtgaaatatttgcacaatttgaatttgccaaggcaattttaaaacgtgctaaatcactgggaatccacacggctattgaaacaactgcttatactagacatgaacaattcatagatcttatccaatacgttgattttatttacaccgatttaaaacattacaatagcctcaaacaccaagaaaagacgatggttaagaatgcttcaatcatcaaaaacattcattatgcttttgccaacggtaaaacgattgtgctacgtattcctgtcatacctaattttaacgattcattagaagatgctgaagaatttgcttgtttatttgatcgcctagatatccgtcaagtgcaactcttacctttccaccaatttgggcaaaacaaatatcaattacttaatcgtcaatatgaaatggaagagatcgctgcactacacccagaggatctactcgattatcaagctatttttagcaagtataatattcactgctacttt

SEQ ID NO: 3044 - protein, 258 aa, Streptococcus agalactiae
MTNEKGIVFNIQHFSIHDGPGIRTTVFLKGCPLRCPWCANPESQKMVPETMRDAITNESVIVGEEKSVDDIIEEVLKDIDFYEESGGGITLSGGEIFAQFEFAKAILKRAKSLGIHTAIETTAYTRHEQFIDLIQYVDFIYTDLKHYNSLKHQEKTMVKNASIIKNIHYAFANGKTIVLRIPVIPNFNDSLEDAEEFACLFDRLDIRQVQLLPFHQFGQNKYQLLNRQYEMEEIAALHPEDLLDYQAIFSKYNIHCYF

SEQ ID NO: 3045 - DNA, 771 bp, Streptococcus pyogenes
atgactgatcgcggtattgttttcaacatccaacattttagtattcatgacggtcctggtattcggacaaccgtttttttaaaaggttgccccttgagatgtccatggtgtgccaatcccgaatcccaacaaaaagcgcctgagcagatgttaacaagtgatgggcttaatactaaaatagttggagaggaaaaaaccgtggacgaggtgatcgaagaagtccttaaagaccttgatttctacgaagagtcaggtgggggcatgaccctgtcagggggggaaatctttgctcagtttgactttgccttagccctgttaaaagcagccaaagcagcaggtcttcacaccgcaattgaaaccaccgcctttgccaaacacgagcaatttgtcacccttgttgactacgtggactttatctataccgatttgaaacattataatcagctcagacaccaaaaagtgactggggttcgtaatgacttgattatcaagaatattcattatgcctttcaagctggaaaagaaatcgtcttgcgcatccctgttattccccaatttaatgattccctagacgatgctaaagccttctcagagctctttaatcagcttgagattgaccaagtgcaactgttacctttccatcaatttggagaaaacaagtacaaacttctaggtagggagtatgagatggctgaggtcaaggcttatcatcccgaagatttagcagactatcaggctgttttcctcaaccataatattcattgctatttt

SEQ ID NO: 3046 - protein, 257 aa, Streptococcus pyogenes
MTDRGIVFNIQHFSIHDGPGIRTTVFLKGCPLRCPWCANPESQQKAPEQMLTSDGLNTKIVGEEKTVDEVIEEVLKDLDFYEESGGGMTLSGGEIFAQFDFALALLKAAKAAGLHTAIETTAFAKHEQFVTLVDYVDFIYTDLKHYNQLRHQKVTGVRNDLIIKNIHYAFQAGKEIVLRIPVIPQFNDSLDDAKAFSELFNQLEIDQVQLLPFHQFGENKYKLLGREYEMAEVKAYHPEDLADYQAVFLNHNIHCYF

SEQ ID NO: 3047 - DNA, 534 bp, Streptococcus agalactiae
atgaatagattagaaaatattattagtttagtatcccagtaccaaaaaatagatgttaatacactctcggagttgttgcaagtttctaaagtaacgatacgtaaagatttagataaactagaaggcaaagggcttttgcatagagagcacggttatgcagttttaaacagtggggatgaccttaatgttaggttatcttttaaccataaaactaaaaaagaaattgctgccttagctgcaaatatggtgtctgacaatgacactatcttaatagaatcaggctctacttgtgctcttttagcagaaaatatctgtcagacaaagcgaaatgtcactattttgaccaactcttgctttattgctaactatttacgagagtatgattcatgccaaattgtcttacttggtggtgagtatcaatcaagttcacaggttacggtaggtcctctcttgaaaaagatgatttcactttttcatgtctcgttagcttttgttgggactgatggttttgatccmaaaactaggatttatggg

SEQ ID NO: 3048 - protein, 178 aa, Streptococcus agalactiae
MNRLENIISLVSQYQKIDVNTLSELLQVSKVTIRKDLDKLEGKGLLHREHGYAVLNSGDDLNVRLSFNHKTKKEIAALAANMVSDNDTILIESGSTCALLAENICQTKRNVTILTNSCFIANYLREYDSCQIVLLGGEYQSSSQVTVGPLLKKMISLFHVSLAFVGTDGFDPKTRIYG

SEQ ID NO: 3049 - DNA, 747 bp, Streptococcus pyogenes
atgatgaatcgattagaacgtattattcaactggtttcccagaagaaaaaaatagatgttaacagtttatcagagcaattagacgtttcgaaagtaaccattcgaaaagaccttgataagcttgaaagtaagggcttgttgcgacgggaacatggctatgcggtgctaaacagtggcgatgacctcaatgtacgcttgtcctacaattacaacataaagcgacggattgcagaaaaagcagctgaattggtacaagacaacgataccattatgattgaatctggctcaacctgtgcccttttggcagaagtgctttgccagaccaaacgaaatattaaagtcattaccaattcgtgcttcattgccaactacattcgtcaatatagtagctgtcaaatcattttactgggcggttattaccagcccaattcagaggtgactgttggtcctttattgaaagaaatgatatccctttttcatgtcaatcgtgtctttgttggaacagacggtttcaacaaagatcttggctttatgggcaaggacatgatgcgctcagaaggggtgcgttacatggcagatgctgctgaggaagtggtgattctgaccgattccagcaagttttcaaaaaccagtctggtacaccagttgtcattagctgatgtcaatcgcgtcattacagaccaagcactagacaagcaaacacaagagttattaagtgctagtggtcttgttcttgattttgtttct

SEQ ID NO: 3050 - protein, 249 aa, Streptococcus pyogenes
MMNRLERIIQLVSQKKKIDVNSLSEQLDVSKVTIRKDLDKLESKGLLRREHGYAVLNSGDDLNVRLSYNYNIKRRIAEKAAELVQDNDTIMIESGSTCALLAEVLCQTKRNIKVITNSCFIANYIRQYSSCQIILLGGYYQPNSEVTVGPLLKEMISLFHVNRVFVGTDGFNKDLGFMGKDMMRSEGVRYMADAAEEVVILTDSSKFSKTSLVHQLSLADVNRVITDQALDKQTQELLSASGLVLDFVS

SEQ ID NO: 3051 - DNA, 246 bp, Streptococcus agalactiae
ttgatccmaaaactaggatttatgggtagagatttaatgcgttctgaagttgcacaagagatggcgaatgctgccgatgaagtcattattttaacagattctagtaagtttaatcagactgcattggtggaacagcttccgttgtcaactgtatcacaagttattacagataaacatccaaattcggaaattgctaatttgttccaagaagcagagattaccattcaatctttattacaagtacca

SEQ ID NO: 3052 - protein, 82 aa, Streptococcus agalactiae
  MISC_FEATURE (1)..(82): Xaa = Any Amino Acid
MIXKLGFMGRDLMRSEVAQEMANAADEVIILTDSSKFNQTALVEQLPLSTVSQVITDKHPNSEIANLFQEAEITIQSLLQVP

SEQ ID NO: 3053 - DNA, 987 bp, Streptococcus agalactiae
atgagtatgaaattagagcgtcaaaaattgttagctaaagtagcttacctttactatatggaagggaaaagccaatctgagattgccaatgaattaggaatttatcgtacaacaataagtcgtatgttagccaaagcgagagaagaaggtcttgttagaatcgaaatttcagattttaatccagaaatttttcagttagaatcctattttaaaagtaaatatcaccttaaagatattgagattgtttcttcgcgaaaagatagcgatacttcagagatagagaaggatttagcacatgtagctgcagctatgattcgaaaaaaaattaaagagaatgacaaggtggggattgcttgggggaggacacttagtaaagtagttgaagcaatgcgtcctcatccggtttctcaagtttcttttgttcctttggccggaggtccaagtcatattaatgcacgctatcacgttaatactctggtttacgaaatgtcaaggcgtttccaaggaagttgtactttcattaatgcaactctagttcaagaaaacgctaatttagcgaaaggaatattaacttcaaaatattttgaggggctaatggataattgggaaaaacttgatgtggcaattgtgggcgttggtggtaaacctaaaagcaatgaacaacagtggcttgaccttttaaatcaagatgattttcaatgcttggatgaagaagcagctgtaggtgaaattacttgtcgtttttttaatcattcaggtgatcctgtgaatcaacatttagctaaaaggacaataggaattaccttagaacaactacagaaagttcctaatagaatagcggttgctcatggcaattataaggctgcggcactcttagccgttttaaaaaaggggtatattaatcatttagttactgatttttccacagccttaaatattttaagattagataaagacacctttgtggatactatatatcaaaagagc

SEQ ID NO: 3054 - protein, 329 aa, Streptococcus agalactiae
MSMKLERQKLLAKVAYLYYMEGKSQSEIANELGIYRTTISRMLAKAREEGLVRIEISDFNPEIFQLESYFKSKYHLKDIEIVSSRKDSDTSEIEKDLAHVAAAMIRKKIKENDKVGIAWGRTLSKVVEAMRPHPVSQVSFVPLAGGPSHINARYHVNTLVYEMSRRFQGSCTFINATLVQENANLAKGILTSKYFEGLMDNWEKLDVAIVGVGGKPKSNEQQWLDLLNQDDFQCLDEEAAVGEITCRFFNHSGDPVNQHLAKRTIGITLEQLQKVPNRIAVAHGNYKAAALLAVLKKGYINHLVTDFSTALNILRLDKDTFVDTIYQKS

SEQ ID NO: 3055 - DNA, 978 bp, Streptococcus pyogenes
atgaaagaagaacgcagacggctccttgccaaggtggcttacttgcattatgttcaaggcaagagccaaaccttgatttcaaaggaaatgaatatctaccgaacaacggtttgtcggatgttagcaaaagccaaggaagaaggcattgttcggattgaaattgccgactatgatgctgatttatttgctttagaagaatacgtgcgacagcagtatggcttggaaaaactagaccttgtgcccaaccaggttgaagataccccaatggataccttgacaaatgttgctaaaacagcagctgaggtttttagacatgttgttaaagatggcgataagatcggtctgtcctggggagcgactctttcttgcttgatggatgagttaaatccaaaagcgatgaaagatgtgtttatttatcctttggcaggaggacctagccatattaatgccaaataccatgtcaataccctggtttaccgcttggctcgcatctttcatggtaatagcgcttttatgaacgctatggtcattcaagaagacaaacacttggctaagggaatcttacaatctaaatactttaacgacattttaacaagctgggaccagttagatcttgccttagtaggaattggtggggagcctaatagccttgagcagagccaatggcgtgatttattaaccagctcagatcatgaccaactcaaatatgaaaaagccgttggtgaagtttgttgccgtttctttgatcaggcaggtcagccagtttacactggcctacaggatcgaactattggtatttcactagaacagttgaggcgtgtccccaaaacaatggctgttgcaacaggtaaacacaaggctaaggcaatattggcagccttaaaagcaggttttatcaattatctagtgacggataaagagaccatgctagctgttttagcgttagatgaagatattgatcttaataacgttcttctt

SEQ ID NO: 3056 - protein, 326 aa, Streptococcus pyogenes
MKEERRRLLAKVAYLHYVQGKSQTLISKEMNIYRTTVCRMLAKAKEEGIVRIEIADYDADLFALEEYVRQQYGLEKLDLVPNQVEDTPMDTLTNVAKTAAEVFRHVVKDGDKIGLSWGATLSCLMDELNPKAMKDVFIYPLAGGPSHINAKYHVNTLVYRLARIFHGNSAFMNAMVIQEDKHLAKGILQSKYFNDILTSWDQLDLALVGIGGEPNSLEQSQWRDLLTSSDHDQLKYEKAVGEVCCRFFDQAGQPVYTGLQDRTIGISLEQLRRVPKTMAVATGKHKAKAILAALKAGFINYLVTDKETMLAVLALDEDIDLNNVLL

SEQ ID NO: 3057 - DNA, 327 bp, Streptococcus agalactiae
gtgcttatggaaatcatagtcgcagaccaaattattatggggctcattttgaatgctggggatgctaaacaacatatctatcaagccttaaaacttgcaaaagaaggaaattttgcagaaagtaagattgaaatagaactagcagatagtgcactcctagaagctcataatcttcaaacacaattccttgcacaagaagcaggagggacaaggacagatatctcagcactctttattcattctcaggatcatttgatgacaagtattactgagattaacttgattaaagaaattattgatttacgccaggaattacatattcaaaaa

SEQ ID NO: 3058 - protein, 109 aa, Streptococcus agalactiae
MLMEIIVADQIIMGLILNAGDAKQHIYQALKLAKEGNFAESKIEIELADSALLEAHNLQTQFLAQEAGGTRTDISALFIHSQDHLMTSITEINLIKEIIDLRQELHIQK

SEQ ID NO: 3059 - DNA, 318 bp, Streptococcus pyogenes
atgcaagttattgtaccagaccaaatcattatgggcttaattttaaatgcaggcgatgccaaacaacatatctaccaagctctgaaatgtgctaaagaggacgattatgccactagtgaaaaagaaatggccttagcagatgatgccttattagaagcccacaatttacagacccagtttcttgcccaagaagctagtggtaataagtcagagattacagctctttttgttcactcacaggatcacttgatgacgaccattacagaaattaatctcatcaaagagattattgaccttcgtaaagaattggcaactaaa

SEQ ID NO: 3060 - protein, 106 aa, Streptococcus pyogenes
MQVIVPDQIIMGLILNAGDAKQHIYQALKCAKEDDYATSEKEMALADDALLEAHNLQTQFLAQEASGNKSEITALFVHSQDHLMTTITEINLIKEIIDLRKELATK

SEQ ID NO: 3061 - DNA, 318 bp, Streptococcus agalactiae
atgataaaaattggtttattctgtgcagcaggtttttcaacaggtatgttagtaaacaatatgaaaatcgcagcggataaagaagggatagaggcacatattgaagcttattcacaaggaaaaattgcagattatgctaaagatttagatgttgcattacttggtccacaagttagctatactctagataaatcaaaatcaatctgtgatgaatacggtgtaccgatagcagttattccaatggcagattatggtatgttggatggtgtaaaagttttgaaacttgctttgagtttattggaaacaagaaaagaggct

SEQ ID NO: 3062 - protein, 106 aa, Streptococcus agalactiae
MIKIGLFCAAGFSTGMLVNNMKIAADKEGIEAHIEAYSQGKIADYAKDLDVALLGPQVSYTLDKSKSICDEYGVPIAVIPMADYGMLDGVKVLKLALSLLETRKEA

SEQ ID NO: 3063 - DNA, 327 bp, Streptococcus pyogenes
atgactaaaaaggagattgacatgattaaaattggattgttttgtgcagcaggattttcaaccggtatgttggtgaacaacatgaaagtagctgctgaaaaaaaaggcattgattgtcagattgaagcctatgctcaagggaaattagcggactatgcaccattacttgatgtggcacttttaggcccacaggttgcctatactctggataaatcagaagctatttgtaaagacaatgatatccctattgcagttatcccaatggctgattatggaatgttagacggcaacaaggtgcttgatttagcccttagccttgttaaagaa

SEQ ID NO: 3064 - protein, 109 aa, Streptococcus pyogenes
MTKKEIDMIKIGLFCAAGFSTGMLVNNMKVAAEKKGIDCQIEAYAQGKLADYAPLLDVALLGPQVAYTLDKSEAICKDNDIPIAVIPMADYGMLDGNKVLDLALSLVKE

SEQ ID NO: 3065 - DNA, 1299 bp, Streptococcus agalactiae
atgtcaaagtttgatagtcagaaaataattactccgattatgaagtttgtcaatatgcgagggattattgcactcaaagatggcatgctagcaattctaccactaacagttgttgggagtctctttttaatattagggcagcttccatttaaaggtcttaatcaagccatagctaatgtttttggaccagaatggacagaaccatttatgcaagtttattcaggaacttttgcgattatgggcttgatttcctgttttgcaattgcttatgcttatgctaaaaatagtagtgtagaaccgttacctgctggcgttttatcactttcgtctttctttattttaatgaaatcatcttatattcctgtaaaaggagaagcaatagcggatgctatttctaaggtttggtttggcggtcaggggattattggagcaattattattggcttagtagttggtgctatctatacatggtttatccaacatcatattgttataaaaatgccagagcaagtaccacaggcaatagcaaaacaatttgaagctatgattccagcttttgttatctttcttttatcgatgattgtttatttgattgctaaggtaacaactggaggtacctttattgagatgatttatgatatcattcaagtaccgttgcaaggcttaacaggctcactttatggagcaattgggattgctttctttatttcattcttatggtggtttggtgtccatggccaatctgtggtgaatggtattgtgactgctttgttactatccaatttagatgccaataagtctttattagcagcaaatcgcttaacattagataatggcgctcacattgtaacacagcagtttttggatagtttcttgattttatcgggctcaggaataacttttggactagttattgcgatgctttttgcagcaaaatcaaaacaatacaaggcacttgggaaagtggccgcttttcccgcaattttcaatgttaacgagccaatcgtctttggctttccaatcgtaatgaatcctgtgatgtttctgccttttattttagtaccagttttggcagctttaattgtttatggagctattgcggttggttttatgcaaccattctcaggtgttactttaccatggagtactccagcaattatttctggattcatggtaggtggttggcaaggtgcactcgtccaaatagtcattttagctatctcaactgctgtttacttcccattctttaaaatccaagataatattacttacaaaaatgaatgtgaaatggaaagggga

SEQ ID NO: 3066 - protein, 433 aa, Streptococcus agalactiae
MSKFDSQKIITPIMKFVNMRGIIALKDGMLAILPLTVVGSLFLILGQLPFKGLNQAIANVFGPEWTEPFMQVYSGTFAIMGLISCFAIAYAYAKNSSVEPLPAGVLSLSSFFILMKSSYIPVKGEAIADAISKVWFGGQGIIGAIIIGLVVGAIYTWFIQHHIVIKMPEQVPQAIAKQFEAMIPAFVIFLLSMIVYLIAKVTTGGTFIEMIYDIIQVPLQGLTGSLYGAIGIAFFISFLWWFGVHGQSVVNGIVTALLLSNLDANKSLLAANRLTLDNGAHIVTQQFLDSFLILSGSGITFGLVIAMLFAAKSKQYKALGKVAAFPAIFNVNEPIVFGFPIVMNPVMFLPFILVPVLAALIVYGAIAVGFMQPFSGVTLPWSTPAIISGFMVGGWQGALVQIVILAISTAVYFPFFKIQDNITYKNECEMERG

SEQ ID NO: 3067 - DNA, 2454 bp, Streptococcus agalactiae
atgaccaaacaattactcactcaaaaatatacaaatgatgttcaacaaaattctcaaaagcattttggctatttgacagagcgcatgtattcttatcgcgataaggttcttgataagaaaccattcatagatgcagaacgtgctatcttggtaactgaagcctatcaaaagcatcaggaaaaacctaatgttttaaagagagcttacatgttgcaaaatattttggaaaaaatgacaatctatattgacgatgagacaatgattgtcggtaaccaagcttcatctgataaagatgctcctatttttccagaatacactctagaatttgttgtaaatgaactagacctttttgaaaaacgagatggtgatgtcttttacattacagaagaaaccaaagaacaaattagaaatattgcacctttctgggaaaataataatttacgggctcgtgcgggcgttatgcttccagaagaagttcaagtttatatggagacaggcttctttgggatggaaggtaagatgaattctggggatgctcacttagctgtcaactatcagaagttactagaagaagggcttattggctttgaaaaaaaagcaagaaaagctaaagctgacttagatttaacaaagcctgagagtattgacaaatatcatttctatgattctattttaattacaatagaagctgttaaaacctatgcagagcgttttgctatcctagcaaaaaaacaagctaaaacagcaaatgctaagagacgtcaggaattgttagatatcgctagtatttgtgaacgagtgccctattacccagctgaaacgtttgcagaagccgttcaatcggtttggtttattcagtgtattcttcaaatagaatcaaacggtcattctctatcttatggacgctttgatcaatacatgtatccatatgttaaatctgacttagaagctggacgtgagactgaggattcgatcgttgagcgcctaactaacctatggattaaaacaataactattaataaggttcgtagccaagctcatacgttttcgtctgctggtagtcctctttaccaaaatgtaacgattggaggacaaacacgacataaggaagatgctgttaatcctttatcatttctagtactaaaatcagtcgctcagacacacttaccacagcctaatctaacggttcgttatcatgctaacctagacaagtcattcatgaatgaagctattgaagttatgaaattaggctttggtatgccagcttttaataatgatgaaattattattccatcatttattaaaaaaggagtttccgaagaagatgcctatgattattcagcgattggttgtgtcgaaacagcagttcctgggaaatggggttatcgttgtaccggcatgagctatatcaacttccctaaagtgttattaattacaatgaatgacggtattgacccggcttctgggaagagatttgcgccttcttatgggcatttcacccagatgacctcatataaagaacttaaagaagcttgggacaaaacacttcgttacttaactcgaatgagcgttattgttgaaaatgctattgatattagtctcgaaagagaagtacctgatattctttgttcagctttaactgatgattgtattggacgaggtaagcacttaaaagaaggtggtgcagtatatgactacatatctggtctacaagttggaatcgctaatctttcagactcacttgctgcgcttaaaaaattagtatttgaagaaaaacgcctaaccacattagaagtatggcaagcattgcagagtgattacgcaggtccgcgtggtgaagaaattcgtcaaatgttgatcaatgaagcaccaaaatatggaaatgatgatgactacgcggatagtttagtacgtgagtgttatgatgtttatgttgaagaaattgctaaatatcccaacacacgctatggacgtggaccaatcggtggtattcgctattcaggaacgtcctctatttcagcaaatgtaggccaaggacgaggtactttagcaactccagatggtaggcatgcaggaactccattagctgaaggttgttcaccatctcataatatggacaaaaagggacctacctctgttttgaaatcagtttcgaagttaccaactgatgagattgtcggcggtgtactccttaaccaaaaagtcaaccctcaaaccttggcaaaagaagaagataaacaaaaattaattgccttacttagaacattcttcaatcgccttcatggttaccatatccagtataatgttgtctcacgtgagactttgattgatgctcagaagcaccctgaaaaacaccgcgatttgattgtgcgtgtagcaggttattctgcattctttaatgtcctatctaaggcaactcaagatgatattattgcacgtacagaacatgctctt

SEQ ID NO: 3068 - protein, 818 aa, Streptococcus agalactiae
MTKQLLTQKYTNDVQQNSQKHFGYLTERMYSYRDKVLDKKPFIDAERAILVTEAYQKHQEKPNVLKRAYMLQNILEKMTIYIDDETMIVGNQASSDKDAPIFPEYTLEFVVNELDLFEKRDGDVFYITEETKEQIRNIAPFWENNNLRARAGVMLPEEVQVYMETGFFGMEGKMNSGDAHLAVNYQKLLEEGLIGFEKKARKAKADLDLTKPESIDKYHFYDSILITIEAVKTYAERFAILAKKQAKTANAKRRQELLDIASICERVPYYPAETFAEAVQSVWFIQCILQIESNGHSLSYGRFDQYMYPYVKSDLEAGRETEDSIVERLTNLWIKTITINKVRSQAHTFSSAGSPLYQNVTIGGQTRHKEDAVNPLSFLVLKSVAQTHLPQPNLTVRYHANLDKSFMNEAIEVMKLGFGMPAFNNDEIIIPSFIKKGVSEEDAYDYSAIGCVETAVPGKWGYRCTGMSYINFPKVLLITMNDGIDPASGKRFAPSYGHFTQMTSYKELKEAWDKTLRYLTRMSVIVENAIDISLEREVPDILCSALTDDCIGRGKHLKEGGAVYDYISGLQVGIANLSDSLAALKKLVFEEKRLTTLEVWQALQSDYAGPRGEEIRQMLINEAPKYGNDDDYADSLVRECYDVYVEEIAKYPNTRYGRGPIGGIRYSGTSSISANVGQGRGTLATPDGRHAGTPLAEGCSPSHNMDKKGPTSVLKSVSKLPTDEIVGGVLLNQKVNPQTLAKEEDKQKLIALLRTFFNRLHGYHIQYNVVSRETLIDAQKHPEKHRDLIVRVAGYSAFFNVLSKATQDDIIARTEHAL

SEQ ID NO: 3069 - DNA, 2415 bp, Streptococcus pyogenes
atgactgaaacaaaaagcccttattttggacatttaacagacagaatgactcactatcgtgaagctgtgttagacaagaaaccttatattgatgctgagcgtgctattttagccactgaagcctatcaaaaacaccaaaataagccagcaaacctcaaacgcgcttacatgcttcaaactattttggaaaacatgaccatctatattgaggatgaaagcctcattgctggtaaccaagcctcttcaaacaaggatgcaccgattttcccagaatacactctggaatttgtcctcaacgaacttgatctttttgaaaaacgagatggggatgtcttctacattaccgaagaaaccaagcaacagctccgagacattgccccattctgggaaaacaataacctgcgtgctcgctgcggtgtcttgctaccagaagaagtgcaagtgtacatggaaacaggtttctttggcatggaaggcaagatgaactctggggatgctcatttagcggttaattaccaaaaactcttggagcatggcttaaagggatttgaagaacgggcacgagctgccaaagctgcgcttgatttgaccattcctgaaaacattgacaaataccatttttacgactctgtttttattgtcattgatgcagtcaaaacttatgctaaacgctatgccaagttggctagagaactagcaaaaacggctaaaccagaacgtcaagcagaattgttagacatcgcgcgcatttgtgataaagtaccttacgaaccagcgaaaacctttgcagaggctgtgcaatctgtctggttcattcagtgtattttgcaaattgaatcaaatgggcattccctatcttatggccgctttgaccagtacatgtatccttatgtcaaagctgatttggaggctggccgtgaaacagaagacacaattgttgaacgtttgaccaacctctggattaagaccttgaccattaataaagtacggagccaagcccacaccttctcatcagcaggtagtccactttaccaaaacgtgacaatcggcggtcaaacacgcgataaaaaagatgcggtcaacccactgtcttaccttgtcctacggagtgtggctcaaaccaaattgccacaacctaacttgactgttcgttaccacaaaggcctagacaatacctttatgaacgaatgtatcgaggtcatgaaacttggttttggtatgccagccatgaacaacgatgaaatcatcattccatctttcatcaaaaaaggtgtctcagaagaagatgcttatgattactcagccattggctgtgtggaaacagcagttcctggaaaatggggctaccgttgcacggggatgagttacatcaacttccctaaaatcttgctgattaccatgaatgacgggattgacccagcatcaggcaagcgctttgcaaaaggacacggtcacttcaaagacatgacctcttatgaagaattaaaagcagcatgggatgccaccctgcgcgaaattacccgcatgagcgtcattgttgaaaatgccattgacctcggtcttgaacgtgaagtaccagatattctttgctcagccttgacagatgattgtatcggtcgtggcaagaccttaaaagaaggcggagctgtttacgactatatctcaggccttcaagttggtattgccaacctatcagactccctagcagcgctgaaaaaattagtgtttgaagaaggtcgcttgaccccagaggaactctggaaggcccttgaaagtgactttgctggagaacgcggagaagacatccgccaaatgctcatcaatgacgcaccaaaatatggtaatgatgatgactacgcagatagtttagtcgtcgaagcttacgacacctacattgatgaaattgccaaatacccaaatacccggtatggccgtggcccaatcggaggtatccgctattctgggacatcatcaatctcagccaatgtcggacaaggaaaagggaccttggcgacaccagacggtcgccatgcaggcacaccactagcagaaggctgttcaccagaacacagcatggacaaaaaaggcccgacttcagtattgaaatctgttgctaaattaccaacagatgagattgtcggaggagtgctactcaaccaaaaagttaacccacaaaccctggccaaagaagaagacaaactgaaattaatggccttacttcgtaccttctttaatcgcctacacggttatcatatccagtacaatgtcgtgtcacgtgagaccttgattgatgcccaaaaacatcctgaaaagcaccgcgacctcattgtccgtgttgccggctactcagctttcttcaatgtgctctcaaaagcaacccaagatgacattattgaacgtacagaacacacactt

SEQ ID NO: 3070 - protein, 805 aa, Streptococcus pyogenes
MTETKSPYFGHLTDRMTHYREAVLDKKPYIDAERAILATEAYQKHQNKPANLKRAYMLQTILENMTIYIEDESLIAGNQASSNKDAPIFPEYTLEFVLNELDLFEKRDGDVFYITEETKQQLRDIAPFWENNNLRARCGVLLPEEVQVYMETGFFGMEGKMNSGDAHLAVNYQKLLEHGLKGFEERARAAKAALDLTIPENIDKYHFYDSVFIVIDAVKTYAKRYAKLARELAKTAKPERQAELLDIARICDKVPYEPAKTFAEAVQSVWFIQCILQIESNGHSLSYGRFDQYMYPYVKADLEAGRETEDTIVERLTNLWIKTLTINKVRSQAHTFSSAGSPLYQNVTIGGQTRDKKDAVNPLSYLVLRSVAQTKLPQPNLTVRYHKGLDNTFMNECIEVMKLGFGMPAMNNDEIIIPSFIKKGVSEEDAYDYSAIGCVETAVPGKWGYRCTGMSYINFPKILLITMNDGIDPASGKRFAKGHGHFKDMTSYEELKAAWDATLREITRMSVIVENAIDLGLEREVPDILCSALTDDCIGRGKTLKEGGAVYDYISGLQVGIANLSDSLAALKKLVFEEGRLTPEELWKALESDFAGERGEDIRQMLINDAPKYGNDDDYADSLVVEAYDTYIDEIAKYPNTRYGRGPIGGIRYSGTSSISANVGQGKGTLATPDGRHAGTPLAEGCSPEHSMDKKGPTSVLKSVAKLPTDEIVGGVLLNQKVNPQTLAKEEDKLKLMALLRTFFNRLHGYHIQYNVVSRETLIDAQKHPEKHRDLIVRVAGYSAFFNVLSKATQDDIIERTEHTL

SEQ ID NO: 3071 - DNA, 666 bp, Streptococcus agalactiae
atggaatttttacttgacactttaaatttagaagctataaaaaaatggcatcatatactgccactagcaggtgtaacttcaaatcccaccattgctaagaaagaaggagatatacattttttccaacgcattcgtgatgttcgagaaattattggacgtgaagcaagtttgcatgttcaagtagtggccaaagattatcaaggaatattggatgatgctgctaaaatacgccaagaaacggacgatgacatttatatcaaagtcccagttacgccagatggattagcagcaattaaaacgttaaaagcagaaggttataatattacagccacagcaatatacaccagtatgcaaggtcttttggctatatcagctggagcagactacctagcaccttactttaaccgaatggagaaccttgatattgatgcgacacaagttattaaggaattagcgcaagcaatagagcggacaggttcttctagcaaaattttagcagctagttttaaaaacgcttcacaagtaacgaaggccttatcacagggtgctcaatcaatcaccgcgggaccagatatttttgaatcagtctttgcgatgccatctattgcaaaagctgttaacgactttgcagatgattggaaagccagtcaacactcagaacatatt

SEQ ID NO: 3072 - protein, 222 aa, Streptococcus agalactiae
MEFLLDTLNLEAIKKWHHILPLAGVTSNPTIAKKEGDIHFFQRIRDVREIIGREASLHVQVVAKDYQGILDDAAKIRQETDDDIYIKVPVTPDGLAAIKTLKAEGYNITATAIYTSMQGLLAISAGADYLAPYFNRMENLDIDATQVIKELAQAIERTGSSSKILAASFKNASQVTKALSQGAQSITAGPDIFESVFAMPSIAKAVNDFADDWKASQHSEHI

SEQ ID NO: 3073 - DNA, 666 bp, Streptococcus pyogenes
atggaatacatgttagacactttagatttagaagctattaaaaaatggcatcacattttgcctctcgcaggtgtgacctcaaacccttctattgccaaaaaagaaggtgagattgatttctttgaacggattcgagaagtccgtgctattatcggtgacaaggcttctattcatgttcaagtgatcgcccaagattacgaaggcatcttaaaagatgctgctgaaatccgcaggcaatgtggagatagtgtgtatgtcaaagtacctgtaaccacagagggccttgcagccattaaaaccttgaaagccgaaggctatcacatcacagcaaccgctatttatacgaccttccaaggactattagccattgaagctggcgctgattatttggctccttactataaccgtatggaaaatcttaatattgatccagaagctgtcatagaacaattagcagaagctattaaccgcgagaatgctaatagtaagattttggcagcaagctttaaaaatgtggctcaggttaataaatcctttgctctaggagcacaagccatcactgctggcccagatgtgtttgaagcaggatttgccatgccatctattcaaaaagcggttgacgattttggcaaggattgggaagccattcatcaccgcaagagcatt

SEQ ID NO: 3074 - protein, 222 aa, Streptococcus pyogenes
MEYMLDTLDLEAIKKWHHILPLAGVTSNPSIAKKEGEIDFFERIREVRAIIGDKASIHVQVIAQDYEGILKDAAEIRRQCGDSVYVKVPVTTEGLAAIKTLKAEGYHITATAIYTTFQGLLAIEAGADYLAPYYNRMENLNIDPEAVIEQLAEAINRENANSKILAASFKNVAQVNKSFALGAQAITAGPDVFEAGFAMPSIQKAVDDFGKDWEAIHHRKSI

SEQ ID NO: 3075 - DNA, 1092 bp, Streptococcus agalactiae
ttgagaatgaaagttttcgcaagtccatcgcgctatatacaaggaaaggatgctttattccaaagtattgaacatatcaaatctttaggtcagactccacttatcctttgtgatgatgttgtttataatatcgttggagaaaggtttttatcttatctacaagacgatttgttaccacatcgtgtttcctttaacggagaagcatctgataatgaaatcaatcgtgtcgttgctgttgcgaaagaaaagaatagtgaccttattattggacttggtggtggaaaaactattgactctgcaaaggcaattgcagataaagttaatttaccagtggtcattgcaccaacagtagcttcaacagatgccccaacatcagcgttatcagtaatctatacagatgaaggagcttttgaaaaatatattttttattcaaagaatccagacttagttttagttgatactcaagtaattgcccaagcgccaaaacgtttactagcttctgggatagcagatggcttagctacttgggttgaagcgagagcagtcttacaaaaaaatgggatagcgatggctggcggtagacagactttagcgggcgtggcaattgcccaagcatgtgagcgtactttatttaatgatagtttacaagctttagcggcttgtgatgccaaagtggttacaaaagctttagaaaatgttattgaagctaataccttacttagtggtttaggttttgaaagtgcaggattagctgcagctcatgctattcataatggttttactgccttgagtggagatattcatcacttaacccatggtgaaaaagttgcctatggaacgttgacgcaacttttcctcgaaaatagaccaaaggaagaaattgatcgctacattaatctttaccaagcgattggaatgccaactacacttgcagaactccatttgggtgatgcaacatatgaagaacttttaaaagttggtcagcaagcaacaattgaaggtgaaacaatacatgaaatgccattcaaaattagtgcagaggatgtcgctgcagccctgttaacggttgaccgttatgtttcaaatcatcaa

SEQ ID NO: 3076 - protein, 364 aa, Streptococcus agalactiae
MRMKVFASPSRYIQGKDALFQSIEHIKSLGQTPLILCDDVVYNIVGERFLSYLQDDLLPHRVSFNGEASDNEINRVVAVAKEKNSDLIIGLGGGKTIDSAKAIADKVNLPVVIAPTVASTDAPTSALSVIYTDEGAFEKYIFYSKNPDLVLVDTQVIAQAPKRLLASGIADGLATWVEARAVLQKNGIAMAGGRQTLAGVAIAQACERTLFNDSLQALAACDAKVVTKALENVIEANTLLSGLGFESAGLAAAHAIHNGFTALSGDIHHLTHGEKVAYGTLTQLFLENRPKEEIDRYINLYQAIGMPTTLAELHLGDATYEELLKVGQQATIEGETIHEMPFKISAEDVAAALLTVDRYVSNHQ

SEQ ID NO: 3077 - DNA, 1086 bp, Streptococcus pyogenes
atgaaagtatttgcaagtccatctcgttacattcaaggtaaaaatgccttgtttaccaatgttaaaaccctaaaacaactaggggatagccccattttactgtgtgatgacgtggtgtatggcatcgtcggagaaagatttgaaagctatttgatagataatggcatgactcctgttcacgtagcctttaatggcgaagcctcagataatgaaatcagccgcgtggttgccattgccaaggaaaatggcaatgatgttattattggacttggtggtggaaaaaccattgacagtgctaaggctatcgctgacttacttgctgttccggtgattattgccccaaccattgcttcaacagatgccccaacctcagccttatcggttatttacaccgatgaaggagcctttgaaaaatacattttctattcaaagaatccagatcttgtattggttgacacacaagtgatctgtcaggcaccaaaacgcttattggcgtcagggattgcagatgggttagcaacatgggtagaggcgcgtgctgttatgcaaaaaaatggagacaccatggcaggtggcaatcaaaccttggcaggagttgccattgccaaagcctgtgagcagaccttgtttgcagatggcctaaaagcgatggctagctgtgacagacaagtcgtgaccccggccttggaaaatgtcattgaagccaatacacttcttagtgggcttggttttgaaagtgcgggtctggctgctgcacatgccattcacaatggctttacagcgctgacaggtgctattcatcaccttacccatggtgaaaaagtcgcctatggcacgttgacccaactcttcttggaaaatcgttcgcgtgaagaaattgaccgctacatcgacttttaccaagctattggcatgccaacaaccctcaaagaaatgcatttagacacggctactcaagaggatttcttaaaaattggccgtcaagcaaccatggcaggcgaaaccatccatcaaatgccatttgttatcagtccagaagatgtagcagcggctttggttgctgttgatgcctatgttacgagtcga

SEQ ID NO: 3078 - protein, 362 aa, Streptococcus pyogenes
MKVFASPSRYIQGKNALFTNVKTLKQLGDSPILLCDDVVYGIVGERFESYLIDNGMTPVHVAFNGEASDNEISRVVAIAKENGNDVIIGLGGGKTIDSAKAIADLLAVPVIIAPTIASTDAPTSALSVIYTDEGAFEKYIFYSKNPDLVLVDTQVICQAPKRLLASGIADGLATWVEARAVMQKNGDTMAGGNQTLAGVAIAKACEQTLFADGLKAMASCDRQVVTPALENVIEANTLLSGLGFESAGLAAAHAIHNGFTALTGAIHHLTHGEKVAYGTLTQLFLENRSREEIDRYIDFYQAIGMPTTLKEMHLDTATQEDFLKIGRQATMAGETIHQMPFVISPEDVAAALVAVDAYVTSR

SEQ ID NO: 3079 - DNA, 924 bp, Streptococcus agalactiae
atgtcaaaaatttataattctattacagacttaatcggaaatacacccattattcaattacatcatattgttccagaaggagctgcagaggtgtacgttaagttagaatcctttaacccaggttcatctgtcaaagatcgtatcgctctagctatgattgaagatgcagagcaaaaagggattcttaaagccggagatacaatcgtagaacctacatctggtaatacaggtatcggtttggcttgggtaggaaaagctaaagggtataatgttattattgttatgccagaaaccatgtcaattgaacgtcgtaaaatcattcaagcctatggtgctcaattagtactaacacctggtagtgaagggatgaagggagctattgctaaggcaaaagaaatttctgcagagcaaaatgcttggctacccctgcaatttaataatcaagccaatccagaaatccacgaaaaaacgactggtagggaaattatcgagacttttggtgaaaaaggtttagatgcttttatcgcaggtgtgggaactggtgggacaattactggtgtctctcgtgcattaaaaaaagtcaatcctgatgtcgctatttatgctgtagaagctgatgaatctgcaatcctttctggtgagcaacctgggcctcataaaatacaagggatttctgcaggtttcattccagaaacattggctacagattcttatgatcatatcattcgcgttacatctgacgatgctattgaaacaggacgtatcatcggcggactagaaggtttcctcgcaggaatttctgcttcagctgctatttatgctgctattgaagtggccaaacaactaggaaaagggaaaaaggttttagctcttctccctgataatggcgaacgttacttatcaacaagcctgtatgattttgaa

SEQ ID NO: 3080 - protein, 308 aa, Streptococcus agalactiae
MSKIYNSITDLIGNTPIIQLHHIVPEGAAEVYVKLESFNPGSSVKDRIALAMIEDAEQKGILKAGDTIVEPTSGNTGIGLAWVGKAKGYNVIIVMPETMSIERRKIIQAYGAQLVLTPGSEGMKGAIAKAKEISAEQNAWLPLQFNNQANPEIHEKTTGREIIETFGEKGLDAFIAGVGTGGTITGVSRALKKVNPDVAIYAVEADESAILSGEQPGPHKIQGISAGFIPETLATDSYDHIIRVTSDDAIETGRIIGGLEGFLAGISASAAIYAAIEVAKQLGKGKKVLALLPDNGERYLSTSLYDFE

SEQ ID NO: 3081 - DNA, 939 bp, Streptococcus pyogenes
atgactaaaatttacaaaactataacagaattagtaggtcaaacacctattatcaaacttaaccgtttaattccaaacgaagctgctgacgtttatgtaaaattagaagcttttaacccaggatcttctgttaaagatcgtattgctttatcgatgattgaagctgctgaagctgaaggtctgataagtcctggtgacgttattatcgaaccaacaagtggtaatacaggtattggtcttgcatgggtaggtgctgctaaagggtatcgagtcattattgttatgcccgaaactatgagcttggaaagacggcaaatcattcaggcttatggtgcagagcttgtcttaacacctggagcagaaggtatgaaaggggctattgcaaaagctgaaactttagcaatagaactaggtgcttggatgcctatgcaatttaataaccctgccaatccaagcatccatgaaaaaacaacagctcaagaaattttggaagcttttaaggagatttctttagatgcattcgtatctggtgttggtactggaggaacactttctggtgtttcacatgtcttgaaaaaagctaaccctgaaactgttatctatgctgttgaagctgaagaatctgctgtcttatctggtcaagagcctggaccacataaaattcaaggtatatcagctggatttatcccaaacacgttagataccaaagcctatgaccaaattatccgtgttaaatcgaaagatgctttagaaactgctcgactaacaggagctaaggaaggcttcctggttgggatttcttctggagctgctctttacgccgctattgaagtcgctaaacagttaggaaaaggcaaacatgtgttaactattttaccagataatggcgaacgctatttatcgactgaactctatgatgtaccagtaattaagacgaaa

SEQ ID NO: 3082 - protein, 313 aa, Streptococcus pyogenes
MTKIYKTITELVGQTPIIKLNRLIPNEAADVYVKLEAFNPGSSVKDRIALSMIEAAEAEGLISPGDVIIEPTSGNTGIGLAWVGAAKGYRVIIVMPETMSLERRQIIQAYGAELVLTPGAEGMKGAIAKAETLAIELGAWMPMQFNNPANPSIHEKTTAQEILEAFKEISLDAFVSGVGTGGTLSGVSHVLKKANPETVIYAVEAEESAVLSGQEPGPHKIQGISAGFIPNTLDTKAYDQIIRVKSKDALETARLTGAKEGFLVGISSGAALYAAIEVAKQLGKGKHVLTILPDNGERYLSTELYDVPVIKTK

SEQ ID NO: 3083 - DNA, 642 bp, Streptococcus agalactiae
atgaactataaaacgataaaatcagacggaattgtcgaagaagaaattaaaaaatcgcgatttatttgtcatctaaagcgagtagagtccgaagaggaggggcgtaattatattacgcaaatcaagaaagcgcactacaaagccaatcattcgtgttcagctatggttattggcgaaaaaggggatataaaacgatctagtgatgatggagaacctagtggtacagcaggtatccctatgctaaccgtacttgaaaagcaaggcctgacaaatgttgttgccgtcgttacacggtattttggaggtatcaaattaggcgcaggggggcttattcgtgcctactctggtagcgtagctaataccatcaaagagatcggggtagtagaagttaaagaacaaattggtattcgtattcaattaacttatcctcaatatcaaacttttgacaacttcctaaaagagcaccaccttcaggagtttgaaacagaatttttagaagctgtaacctgtaaaatatacgttgaccctaaggaatttgaacacacaataactaatttgacagagttctaccaaggaaaagctttgttaactgaagaagggagtcaaattgttgaaattccctttaaggctgaaaccgataaa

SEQ ID NO: 3084 - protein, 214 aa, Streptococcus agalactiae
MNYKTIKSDGIVEEEIKKSRFICHLKRVESEEEGRNYITQIKKAHYKANHSCSAMVIGEKGDIKRSSDDGEPSGTAGIPMLTVLEKQGLTNVVAVVTRYFGGIKLGAGGLIRAYSGSVANTIKEIGVVEVKEQIGIRIQLTYPQYQTFDNFLKEHHLQEFETEFLEAVTCKIYVDPKEFEHTITNLTEFYQGKALLTEEGSQIVEIPFKAETDK

SEQ ID NO: 3085 - DNA, 645 bp, Streptococcus pyogenes
ttgtacaatttttttatggaacattttaagacaatcaaagccagtggttttttcgaagaaagtattaaaaaatctcgtttcatttgtcatatcaaacgagtgagcactgaagaagatggtaagaattttgttaatgctatcaaaaaagaacattacaaagctaatcattcctgctttgcgatgattatcggtaacaacagacagatcaagcgctcaagtgatgatggtgaaccttcaggaactgctggaatacctatcctttctgtgttagaaaagcagtgtttaacaaatgtagtagttgtggtaacgcgttactttggtggtattaaattaggaacaggtgggttaatcagagcatactctaacatgaccgcaacagctattaaacgatttggcatcattgaagttaaacagcagataggactagaaatcacactttcttatccccaatatcaactatactctaacttgctagatcaattggctttaaccgaaacagaaactaagttttcagacacgataaagacaacactttattgtgatactgaacgtgtggaaaatctcattgatactttaacaaattattatcatggtcagataagctgtgagaaaatcggatccaaagttattgaattcccctgtgat

SEQ ID NO: 3086 - protein, 215 aa, Streptococcus pyogenes
LYNFFMEHFKTIKASGFFEESIKKSRFICHIKRVSTEEDGKNFVNAIKKEHYKANHSCFAMIIGNNRQIKRSSDDGEPSGTAGIPILSVLEKQCLTNVVVVVTRYFGGIKLGTGGLIRAYSNMTATAIKRFGIIEVKQQIGLEITLSYPQYQLYSNLLDQLALTETETKFSDTIKTTLYCDTERVENLIDTLTNYYHGQISCEKIGSKVIEFPCD

SEQ ID NO: 3087 - DNA, 1287 bp, Streptococcus agalactiae
atggaaaattatttaggtaggctttggacaaaagcacaattatctgagcaacttagaaaaattgcaattagcttgccatcttttataaagaaaggaagcgactatatttgtacccgatgctctagttctgttgctaaaaattgccaattaccaactggaaattattattgtagagaatgtatagtttttggaagagttactagtaatgaaaatttatattatttcccacaaaaaacattttctaaaacgaattctttaaaatggaaaggggaactgacaccttatcaaaatgaggtttcagaagagttgttgaaaggtatttcaagtaaggaaaatcttcttgttcatgctgtgacaggggctggtaaaacagaaatgatataccactctgtcgccaaagtaattgatactggaggaagcgtttgtattgccagtcctagaattgatgtttgtttagaattgtataagcgactttcaaacgattttagatgtgccataacattaatgcatggagaatctccttcttatcagagatcccctttaactattgccacaacacatcaattgttaaaattttatcatgcttttgatttgctaattgttgatgaagttgatgcttttccgtatgtcgacaacccgatactataccagggtgtaaaacaggccttaaaggaaaacggaacaagtatttttctgactgcaacttcaacgactgagttagaaagaaaagttgcaagaaaagaactaaaaaaattgcatctagctaggagatttcatgccaatccgttagtgatacccgagatggtttgggtaagtggtatccagaaaagcttgcagacacaaaaactacctcccaaattatatcagttgataaataaacagcgacaaacgagatatcctttgttattatttttcccccatatttcagaaggtcaggtattcaccgaaattttaagacaagcctttcctatggaaaaaattggttttgtttcaagtaagagcacatctaggttaaagttagtgcaagattttcgagataacaaattgtctatcctagtgtcaactaccattctagagagaggagtaactttccctagcgtcgacgtttttgttatacaagcaaatcatcatttgtttacgaaaagttccttggtacaaatttcaggaagagttggaagagcattagaaaggcccgaagggctcctttacttccttcatgatgggaaaagtaaatcgatgcaccaagctataaaggagattaaaaacatgaatcatataggaggattt

SEQ ID NO: 3088 - protein, 429 aa, Streptococcus agalactiae
MENYLGRLWTKAQLSEQLRKIAISLPSFIKKGSDYICTRCSSSVAKNCQLPTGNYYCRECIVFGRVTSNENLYYFPQKTFSKTNSLKWKGELTPYQNEVSEELLKGISSKENLLVHAVTGAGKTEMIYHSVAKVIDTGGSVCIASPRIDVCLELYKRLSNDFRCAITLMHGESPSYQRSPLTIATTHQLLKFYHAFDLLIVDEVDAFPYVDNPILYQGVKQALKENGTSIFLTATSTTELERKVARKELKKLHLARRFHANPLVIPEMVWVSGIQKSLQTQKLPPKLYQLINKQRQTRYPLLLFFPHISEGQVFTEILRQAFPMEKIGFVSSKSTSRLKLVQDFRDNKLSILVSTTILERGVTFPSVDVFVIQANHHLFTKSSLVQISGRVGRALERPEGLLYFLHDGKSKSMHQAIKEIKNMNHIGGF

SEQ ID NO: 3089 - DNA, 1323 bp, Streptococcus pyogenes
atggagtctattgaaaatagttatggacggttgttgctagaaagccagttaccagattcagcaaagcagcttgctcaacctttaaaaagtgtagtaatattgagaggaaaaatgatttgtcaacgttgtcactatcagcttgatgaagaagcacgattgccaagtggagcctattattgccgattttgtcttgtctttggacgaaatcaatcagataaattgctctatgctatcccacctatgcattttccaaaaggtaattatctggtttggggtggtcaactaactgcttatcaagagatgatttcccaacaattattaatcaatatgcaaaatcaaaaaacaacattagttcatgctgtaactggtgcaggaaaaacagaaatgatttatgctgcgattgaggcggtaattaacacaggtggctgggtttgcattgccagcccaagagtagatgtttgtgtagaggtggctactcgtttatcccaagccttctcctgcagcatctgtttaatgcacgcagagtctcttccttatcaaagagctcctattatagtagccacaacgcatcagctgctaaaatttcacaaggcttttgatctcttaattattgatgaagtagacgcattcccttttgtaaataatattcaacttcattatgctgcaagtcaggctttaaaagaaggtggcgcaaagattttattaactgcaacttcaactagaactttagaaagaaaggtaaacaagggagaagtagtcaagctgacattggcgagacgctttcataataggccattagttattccaaaatttataagaagttttaatctatttaaaatgatacatcggcaaaaacttcctcttaaaattttaaaatacttaaaaaaacaaagaaaaacaggctatccccttttaatttttctacccactattataatggcagaatctgttacagcaatcttaaaagagttattgcccgccgaacaaatagcttgtgtttctagtcaatcacaaaacaggaaagaagatatcacagcttttcgtcaagggaaaaaaacgattttaattacaacatcaattttagaaaggggtgtgacatttccccaaattgatgtttttgttcttgggtctcatcatcgtgtctatagttcccaaagtcttgttcaaattgctggacgagttggaagatctatagacagaccagacggaacgttatatttctttcatgaaggtatcagtaaagcaatgctactagcaagaaaagagattaaagaaatgaattataaagggtattcgcatgatctgtctactatgtcaacaaat

SEQ ID NO: 3090 - protein, 441 aa, Streptococcus pyogenes
MESIENSYGRLLLESQLPDSAKQLAQPLKSVVILRGKMICQRCHYQLDEEARLPSGAYYCRFCLVFGRNQSDKLLYAIPPMHFPKGNYLVWGGQLTAYQEMISQQLLINMQNQKTTLVHAVTGAGKTEMIYAAIEAVINTGGWVCIASPRVDVCVEVATRLSQAFSCSICLMHAESLPYQRAPIIVATTHQLLKFHKAFDLLIIDEVDAFPFVNNIQLHYAASQALKEGGAKILLTATSTRTLERKVNKGEVVKLTLARRFHNRPLVIPKFIRSFNLFKMIHRQKLPLKILKYLKKQRKTGYPLLIFLPTIIMAESVTAILKELLPAEQIACVSSQSQNRKEDITAFRQGKKTILITTSILERGVTFPQIDVFVLGSHHRVYSSQSLVQIAGRVGRSIDRPDGTLYFFHEGISKAMLLARKEIKEMNYKGYSHDLSTMSTN

SEQ ID NO: 3091 - DNA, 663 bp, Streptococcus agalactiae
atgacttgtttgttatgtcatgaaatagatttatcgcaattaacttttgtggaacttatgcttctaaaaccaaagcaaaacgtaatttgtcaaacgtgcaagggtagttttgaagcacttagtagggagatgggttgccaaacatgttgcaagcaaattccccaaaaacaatgtcaagattgtatttattggggtaaaaaaggtatagaggtaaatcatttttccctttatagatacaatgaagcaatgaaaaaaaatttttctctttttaaatttcaaggggattatttgttgaaagatgtttttacaaaagaaataaaagctgctctaaaaaagtataagggctacactatagtgccagttcccttgagtcatgaaggataccaaaataggcaatttaatcaagtgattgcttttctacaatcggcaaatataccttacaaaaatattctttctaaaaaagatggaggtaagcaatcggctaataataaagaagaaagactcaaacaagttcagcaatttacattaaaaaatgaggctgagttaggggacaaccttttaattgttgatgatatttatacaacaggcgcaacaatagcacaaatcaggaaactattagaagaaaaaggtataaaaaatataaaaagtttttcattagcacgc

SEQ ID NO: 3092 - protein, 221 aa, Streptococcus agalactiae
MTCLLCHEIDLSQLTFVELMLLKPKQNVICQTCKGSFEALSREMGCQTCCKQIPQKQCQDCIYWGKKGIEVNHFSLYRYNEAMKKNFSLFKFQGDYLLKDVFTKEIKAALKKYKGYTIVPVPLSHEGYQNRQFNQVIAFLQSANIPYKNILSKKDGGKQSANNKEERLKQVQQFTLKNEAELGDNLLIVDDIYTTGATIAQIRKLLEEKGIKNIKSFSLAR

SEQ ID NO: 3093 - DNA, 663 bp, Streptococcus pyogenes
atgatctgtctactatgtcaacaaattagtcaaacaccaataagtattacagaaatcatctttttaagacgtatctcttcaccgatttgtcaacaatgtcaaaaaagctttcaaaagataggaaaaagtgtttgtgcgacatgttgtgcaaactcagatataatagcttgtcgagattgtctaaaatgggaaaacaaaggatacaatgtaaatcatagaagcttatattgttataatgctgctatgaaagcatacttcagtcaatataagtttcaaggagactatttattaagaaaagtttttgcagtagaacttgccgatgttatcaccaagtactataaaggctatatcccagtcccggttcctgtaagtcccggttgttttcgagaaagacaatttaatcaagtgagcgctattcttgaggcagctaatgttagctacctttctctttttgaaaagctagataatactcaccaatcttccagaacaaaaaaagagagattattagtagaaaaatcttatcgactactaaaagtatcaaacattcctgataaaatccttatagtagatgatatttatactactggtagtacaattatcgctcttagaaaacaattggctaaagtagcaaatagtgacattaaaagtttgtcaattgcacgt

SEQ ID NO: 3094 - protein, 221 aa, Streptococcus pyogenes
MICLLCQQISQTPISITEIIFLRRISSPICQQCQKSFQKIGKSVCATCCANSDIIACRDCLKWENKGYNVNHRSLYCYNAAMKAYFSQYKFQGDYLLRKVFAVELADVITKYYKGYIPVPVPVSPGCFRERQFNQVSAILEAANVSYLSLFEKLDNTHQSSRTKKERLLVEKSYRLLKVSNIPDKILIVDDIYTTGSTIIALRKQLAKVANSDIKSLSIAR

SEQ ID NO: 3095 - DNA, 552 bp, Streptococcus agalactiae
atgattaaatacagtattcgtggtgaaaacatcgaagtaacagaagctattcgtgagtatgttgagaccaaactctctaaagttgaaaaatactttaatgaagcacaagaattagatactagagtcaacctcaaagtatacagagagaagaccgcaaaagttgaagtaacaatcttaatagattctattactttacgagcagaagatgtttcacaagatatgtatgggtcaattgacttagttgttgataaaattgagcgtcaaattcgtaaaaataaaactaaaattgcgaaaaaatatcgtgaaaagattccagcaagtcaagttttcacaacagaatttgaggctgagccagatgaagaagcagtaagccaaagaattgtacgtactaagaatgttaatctaaaaccaatggatgttgaggaagcattgttgcaaatggaacttttaggtcatgatttctttatctatacagatgcagaagataatacgacaaatgtcctttacaagcgtgaagatggcgaactaggtttaattgaagctaaaggaaat

SEQ ID NO: 3096 - protein, 184 aa, Streptococcus agalactiae
MIKYSIRGENIEVTEAIREYVETKLSKVEKYFNEAQELDTRVNLKVYREKTAKVEVTILIDSITLRAEDVSQDMYGSIDLVVDKIERQIRKNKTKIAKKYREKIPASQVFTTEFEAEPDEEAVSQRIVRTKNVNLKPMDVEEALLQMELLGHDFFIYTDAEDNTTNVLYKREDGELGLIEAKGN

SEQ ID NO: 3097 - DNA, 546 bp, Streptococcus pyogenes
atgattaagttcagtattcgtggagaaaatatcgaagtgacagaagctattcgcgattatgtagaatcaaagcttactaaaatcgaaaaatattttgctaaagaccaagaaatagatgcacgtgttaatttaaaagtttatcgggagagatcttcaaaagttgaggtaacgatcccattagattcagtaacccttcgtgctgaagatgtttcacaggatatgtacggctctattgatttagttgttgataagatcgaacgccaaattagaaaaaataaaaccaaaattgctaaaaaacatcgcgaaaaggttccaactggtcaagtctttacaactgagtttgaagctgaagaagtcgatgagataccagaagtacaagttgtacgtactaaaaatgtgacattaaaaccaatggatgttgaagaagcgcgtttacagatggaactattgggacatgatttctttatctacactgattctgaagatggcgcaacaaacattttataccgtcgcgaagatggaaacctaggattaatagaagctaaa

SEQ ID NO: 3098 - protein, 182 aa, Streptococcus pyogenes
MIKFSIRGENIEVTEAIRDYVESKLTKIEKYFAKDQEIDARVNLKVYRERSSKVEVTIPLDSVTLRAEDVSQDMYGSIDLVVDKIERQIRKNKTKIAKKHREKVPTGQVFTTEFEAEEVDEIPEVQVVRTKNVTLKPMDVEEARLQMELLGHDFFIYTDSEDGATNILYRREDGNLGLIEAK

SEQ ID NO: 3099 - DNA, 144 bp, Streptococcus agalactiae
atgaacgaatgtgcagggtggatttacattgtaaatccgtcaatgacaaaaaacaataaatctgtcagcgagacagaaaagagcaaagctcaaacttttaatgagagtttgatcctggctcaggacgaacgctggcggcgtgcc

SEQ ID NO: 3100 - protein, 48 aa, Streptococcus agalactiae
MNECAGWIYIVNPSMTKNNKSVSETEKSKAQTFNESLILAQDERWRRA

SEQ ID NO: 3101 - DNA, 348 bp, Streptococcus agalactiae
  misc_feature (1)..(348): n = a, c, g, or t
atggcaattatttaccttatcgttgcagtgtttgctggtgaggcttatattgcaaaagaaataagtaacggtgtcaatggtcttgtttatgccctccaactagctgggcaatttgcggcaggtgtattcgttattttagcaggtgtacgccttatcctaggtgaaattgtaccagcctttaagggaatctcagaaaaattggttccaaattcaaaaccagccttggattgtccaattgtttacccttatgcacctaatgcagtattgattggttttatctcaaagtttgttggtggattggttagtatgatagtcatgattgtgactggcactannnnnttaattaat

SEQ ID NO: 3102 - protein, 116 aa, Streptococcus agalactiae
  MISC_FEATURE (1)..(116): Xaa = Any Amino Acid
MAIIYLIVAVFAGEAYIAKEISNGVNGLVYALQLAGQFAAGVFVILAGVRLILGEIVPAFKGISEKLVPNSKPALDCPIVYPYAPNAVLIGFISKFVGGLVSMIVMIVTGTXXLIN

SEQ ID NO: 3103 - DNA, 1023 bp, Streptococcus agalactiae
atgacaaaaccaattatcttaacaggtgatagaccgacaggaaagttgcatattggacattatgtaggtagcttaaaaaatagagttctacttcaaaatgagggtagctatactttatttgtctttttagcagaccaacaagcactgacagaccatgctaaagatccgcaaactattgttgaatcaattggtaatgttgcacttgattatttagctgttgggttagatccaaacaagtcgactttattcattcaaagtcaaattcctgagttagcagaattaagtatgtattatatgaacttggtttcacttgcacgtttagaacgtaatccaactgtaaaaacagaaattgctcaaaaaggttttggtgagtctattccagcaggattcttagtttatcctgttgcacaagcagctgatataaccgcttttaaagctaaccttgttcctgtagggactgaccaaaaaccaatgattgaacaaacacgtgaaatagttagatctttcaatcatgcttataattgtcaggttttagttgaaccagagggaatctatccagaaaatgatgcagcaggtcgtctgccagggttagatggtaatgcaaaaatgtctaagtcattaaataatggaatctttttagcagatgatatggatacagttaagaaaaaagttatgagtatgtatactgatccaaaccacattaaagtagaagaaccaggacaaatcgaaggtaatatggtatttcattaccttgatgtttttggaagagatgaagaccaaaaagagattactgctatgaaagaacactatcaaaaaggtggacttggggatgttaaaacaaaacgttatctacttgatatcttagagcgtgaattatcacctattagagaacgtcgcctcgaatatgctaaagatatgggacaagtttatcaaatgttacaaaaaggtagtgagaaagctcaagctgttgcagcctctactttggatgaggttaaatcagccatgggtttgaactattttaaa

SEQ ID NO: 3104 - protein, 341 aa, Streptococcus agalactiae
MTKPIILTGDRPTGKLHIGHYVGSLKNRVLLQNEGSYTLFVFLADQQALTDHAKDPQTIVESIGNVALDYLAVGLDPNKSTLFIQSQIPELAELSMYYMNLVSLARLERNPTVKTEIAQKGFGESIPAGFLVYPVAQAADITAFKANLVPVGTDQKPMIEQTREIVRSFNHAYNCQVLVEPEGIYPENDAAGRLPGLDGNAKMSKSLNNGIFLADDMDTVKKKVMSMYTDPNHIKVEEPGQIEGNMVFHYLDVFGRDEDQKEITAMKEHYQKGGLGDVKTKRYLLDILERELSPIRERRLEYAKDMGQVYQMLQKGSEKAQAVAASTLDEVKSAMGLNYFK

SEQ ID NO: 3105 - DNA, 1023 bp, Streptococcus pyogenes
atgatgacaaaacctattattttaactggagatagaccaactggaaaattacatttaggtcattatgtcggaagtcttaaaaatcgtgtctttttacaaaatgaaaacaagtataagatgtttgttttcttggccgatcaacaggcactgacggatcatgctaaagaatccgaattaattcaagaatctattggaaatgttgccttggattacctctctgtcggtttggatccgaagcaatcaacgatttttattcaaagtcagattccagagctagctgaattgagcatgtattatatgaatctggtatcattagcacgtttggaaagaaatcccactgttaaaaccgaaattgctcagaaaggttttggcgaaagtattccatctggttttttggtttatccagtatcacaggccgctgatattacagcatttaaagcgaatttagtacctgtaggtaacgaccagaaaccgatgattgaacaaacacgtgaaattgtgagaagttttaatcatacttaccatacagactgtttagtagaacctgaaggtatttatccagaaaatgaaaaagctggacgcttacctggtcttgatggcaatgccaaaatgtctaagtcattgggaaatggaatctatctctcagatgatgcagataccgttcgcaaaaaagtgatgagcatgtatactgatccaaatcatattaaaatagaagatcctggtcaaattgaagggaatatggtctttcattatttggatatttttgctagaaaagaagatcaagctgatatcgaagcaatgaaagagcattatcaaataggtggtttaggagatgtgaaaacgaaacgctaccttttagatattttagaacgtgaattagcacctattcgtgaaagacgtttggagtacgctaaagatatgggagaggtgttccgtatgttacaagaaggtagtcaaaaagcaagaactgtggcagccaagactttatcagaagtgaagtcagcaatgggtattaattatttt

SEQ ID NO: 3106 - protein, 341 aa, Streptococcus pyogenes
MMTKPIILTGDRPTGKLHLGHYVGSLKNRVFLQNENKYKMFVFLADQQALTDHAKESELIQESIGNVALDYLSVGLDPKQSTIFIQSQIPELAELSMYYMNLVSLARLERNPTVKTEIAQKGFGESIPSGFLVYPVSQAADITAFKANLVPVGNDQKPMIEQTREIVRSFNHTYHTDCLVEPEGIYPENEKAGRLPGLDGNAKMSKSLGNGIYLSDDADTVRKKVMSMYTDPNHIKIEDPGQIEGNMVFHYLDIFARKEDQADIEAMKEHYQIGGLGDVKTKRYLLDILERELAPIRERRLEYAKDMGEVFRMLQEGSQKARTVAAKTLSEVKSAMGINYF

SEQ ID NO: 3107 - DNA, 954 bp, Streptococcus agalactiae
ttggtaaaagaacatcaaaaaatcgtagttgccttaggtggcaacgctattctatcaacagatgcttcagcaaaagcacaacaagaagcattaatcaacacatcaaaatcactggtcaaactgattaaagaaggccatgatgtcattgttactcatggaaatggtccccaagttggtaacttattgctacagcaagcagcttcagattctgaaaagaatccagcaatgcctttggatacttgtgttgccatgacagaaggaagtattggtttttggttacaaaatgctcttaacaatgaattacaagaacaaggcattgacaaagaggttgcaacagtggtaactcaagttattgtagatgaaaaagatcaagctttcactaatccaacaaaacctattggcccattcttatctgaagaagatgccaagaaacaagcccaagaaacaggttcaaaatttaaagaagatgctggccgtggatggcgtaaagtcgttccttcaccaaaaccggttggtatcaaagaagcttctgttattagacggttagtggactctggtgtggttgttattagcgcaggtggcggaggtgtaccagttattgaagatgctaatacaaaggcattaaaaggggttgaagctgttattgacaaagactttgccagtcaaactttatcagaacttgttgatgctgacttattcatcgtcttaactggcgttgacaacgtttttgttaattttaataaacctaatcaagaaaaattagaagaagttactgtttcacaaatgaaacaatatatcactgaaaatcaatttgcccctggaagtatgctaccaaaggtcgaagctgcgattgcttttgttgaaaataaacctgaatcacgagctattattacttcacttgaaaatattgataatgttttagcccaaaatgcagggacacaaattgttgcaaat

SEQ ID NO: 3108 - protein, 318 aa, Streptococcus agalactiae
MVKEHQKIVVALGGNAILSTDASAKAQQEALINTSKSLVKLIKEGHDVIVTHGNGPQVGNLLLQQAASDSEKNPAMPLDTCVAMTEGSIGFWLQNALNNELQEQGIDKEVATVVTQVIVDEKDQAFTNPTKPIGPFLSEEDAKKQAQETGSKFKEDAGRGWRKVVPSPKPVGIKEASVIRRLVDSGVVVISAGGGGVPVIEDANTKALKGVEAVIDKDFASQTLSELVDADLFIVLTGVDNVFVNFNKPNQEKLEEVTVSQMKQYITENQFAPGSMLPKVEAAIAFVENKPESRAIITSLENIDNVLAQNAGTQIVAN

SEQ ID NO: 3109 - DNA, 948 bp, Streptococcus pyogenes
atgacgaaacaaaaaatcgtagtcgcacttggaggaaatgctattctttcaacagatgcgtcagcaaaagcacaacaagaagccttgatttccacatcaaaatcactggttaaattaattaaagaaggtcatgaagtcatcgtgacccacggcaatggcccacaagttggtaatctcttgttacaacaagcagcagcagattctgaaaagaatccggctatgcctttggatacttgtgttgccatgacagaaggtagcatcggtttttggttagttaatgccctcgataatgaattgcaagcccaaggtattcaaaaagaagtggcagctgttgtcactcaagtgatcgtggatgccaaagacccagcttttgaaaacccaacaaaaccaattggtccatttcttaccgaagaagatgccaaaaaacaaatggcggagtctggtgcaagtttcaaagaagatgcaggtcgtggctggcgtaaggttgtgccatcaccaaaaccagttggtattaaagaagccaatgtcatcagaagtctcgttgattctggcgttgttgtggttagtgctggtggtggcggtgtgcccgttgtggaagatgctactagcaagaccctgactggtgtggaagctgttattgacaaggactttgctagtcaaaccctttcagaattggtggacgcagacctctttatcgttttgacaggagttgataatgtttacgtcaacttcaacaaacctgaccaagccaaattggaagaagtgactgtctctcaaatgaaagaatacatcacacaagaccaatttgcaccaggtagtatgttaccaaaagtggaagctgccattgcttttgttgaaaacaaaccaaatgctaaagccattatcacatcgctcgaaaatattgacaatgtactatcagcaaacgctggaacacaaattatcgcaggg

SEQ ID NO: 3110 - protein, 316 aa, Streptococcus pyogenes
MTKQKIVVALGGNAILSTDASAKAQQEALISTSKSLVKLIKEGHEVIVTHGNGPQVGNLLLQQAAADSEKNPAMPLDTCVAMTEGSIGFWLVNALDNELQAQGIQKEVAAVVTQVIVDAKDPAFENPTKPIGPFLTEEDAKKQMAESGASFKEDAGRGWRKVVPSPKPVGIKEANVIRSLVDSGVVVVSAGGGGVPVVEDATSKTLTGVEAVIDKDFASQTLSELVDADLFIVLTGVDNVYVNFNKPDQAKLEEVTVSQMKEYITQDQFAPGSMLPKVEAAIAFVENKPNAKAIITSLENIDNVLSANAGTQIIAG

SEQ ID NO: 3111 - DNA, 1437 bp, Streptococcus agalactiae
atgaggtataaaatggaaaaagaaaaaaaattaggtcttttaccactaacaatgcttgtcattggctctcttatcggtggcggaatctttgatttaatgcaaaatatgagttccagagccggtttggtaccaatgcttattgcttgggtaattactgctatcgggatggggactttcgttttaagttttcaaaatttatctgaaaaaaggccggacctaacagctggaatctttagttacgctaaagaggggtttggaaactttatgggatttaactctgcatggggttattggttatcagcttggcttggaaatgttgcctacgctgcactcttattcagttcactcggttatttctttaaattctttggtaatggaaataatatcatctcaattattggagcaagtatagttatttgggttgtccatttcttaattttaagaggtgttaatacagctgcatttattaataccatagttacctttgcaaaattagtacctgttattattttcttaatttcagcgttattagctttcaaatttaacatttttagtcttgatatctggggaaatggattacatcaatcaattttcaaccaagtcaattcaactatgaaaaccgctgtttgggtatttattggtattgagggcgccgttgtcttctcaggtcgtgctaaaaaacactctgatattggtaaagcaagtatcctagcattattcactatgatttcactttatgtattgatttctgttttatcacttggtatcatgtcacgtccagaacttgcaaacttaaaaacaccagctatggcttacgttctagaaaaggctgttggtcactggggcgctatcttagttaaccttggtgttatcatttcagtatttggcgctattcttgcttggactttatttgcagcagaattaccatatcaagctgctaaagaaggtgcttttcctaaattctttgcaaaagaaaataaaaacaaagctccaatcaattcactcttagtcactaatctttgtgtacaagcattcttaatcacgttcttattcacacaaagtgcttatcgttttggtttcgcattagcatcatctgctatcttaattccttatgcttttacagcactatatcaattacaattcacactccgtgaggataagtcaactccaggacatcaaaagaatttaattatcggtatcctcgctacaatctatgctgtttaccttatctacgctggtggttttgattacttacttttgacaatgattgcttacactctaggtatgattctctatattaaaatgagaaaagatgacaagcttcctatctttgtgggatatgaaaaaattagtgccattgtcattctagcgctttgcttattatgtattattgaaattatgactggacaaattgacattgctgcaatcctagcaggt

SEQ ID NO: 3112 - protein, 479 aa, Streptococcus agalactiae
MRYKMEKEKKLGLLPLTMLVIGSLIGGGIFDLMQNMSSRAGLVPMLIAWVITAIGMGTFVLSFQNLSEKRPDLTAGIFSYAKEGFGNFMGFNSAWGYWLSAWLGNVAYAALLFSSLGYFFKFFGNGNNIISIIGASIVIWVVHFLILRGVNTAAFINTIVTFAKLVPVIIFLISALLAFKFNIFSLDIWGNGLHQSIFNQVNSTMKTAVWVFIGIEGAVVFSGRAKKHSDIGKASILALFTMISLYVLISVLSLGIMSRPELANLKTPAMAYVLEKAVGHWGAILVNLGVIISVFGAILAWTLFAAELPYQAAKEGAFPKFFAKENKNKAPINSLLVTNLCVQAFLITFLFTQSAYRFGFALASSAILIPYAFTALYQLQFTLREDKSTPGHQKNLIIGILATIYAVYLIYAGGFDYLLLTMIAYTLGMILYIKMRKDDKLPIFVGYEKISAIVILALCLLCIIEIMTGQIDIAAILAG

SEQ ID NO: 3113 - DNA, 1341 bp, Streptococcus pyogenes
atggcgtcaaatcacatgaacgaacaagaaagagaacaggcaaagtttagcttgagcggtgccactctttacgggatcaatgccgttatcggctctggtatttttctcttacctagggccatttataagggccttggccctgcatccatcgctgttatgtttggaacagctattttgaccatcatgttggcagtttgttttgcagaagtctctggttattttgggaaaaacggcggagccttccaatattccaaacgagcttttggtgattttattggctttaacgttggcttccttggttggaccgttaccatcttcgcttgggcagccatggcagctgggtttgccagaatgtttatcattactttccctgcctttgaaggttggcacattccacttagtattgggttaatcatcttactatctttgatgaatatcgctggtttgaaaacctctaaaattgtcaccatcacagccaccattgctaagttaattccaatcgttgccttttgtgcctgtacccttttcttcatcaaaaacgggcttcctaactttaccccatttgttcagttggaaccagggactaacctcttaggggctatctccaatactgctgtttatatcttctatggctttatcggttttgaaaccctctctattgtcgctggggaaatgcgtgaccctgaaaaaaatgtaccgcgtgctcttttaggatcaatcagtatcgtctctgtcttatatatgctgattatcggtggaaccattgccatgcttggctctcaaatcatgatgaccaatgcacctgttcaagatgcctttgttaaaatgataggccctgctggcgcttggatggtctcaatcggtgctttaatttccattacaggtcttaacatgggagaatccatcatggtgccacgttacggtgctgccattgctgatgaagggctcttaccagctgctattgccaagcaaaatcaaaatggcgcgccactcgttgctatcttggtttcaggagcaattgccattgtactcctgcttactggctcatttgaaagcttagcaaaactcagtgttgttttccgcttcttccaatacattccaacagcactagccgttatgaaattacggaaggacgatcccgatgctaatgtgatcttccgagtaccatttggccctattatcccaattcttgcagttatcgttagtttagttatgatttggggtgacaacccaatgaactttgtttatggtgcagttggtgtcatcattgcaagtagtgtgtactaccttatgcacggacgtaaccaccaaatggaccaaatgccccctaaggaacaaatc

SEQ ID NO: 3114 - protein, 447 aa, Streptococcus pyogenes
MASNHMNEQEREQAKFSLSGATLYGINAVIGSGIFLLPRAIYKGLGPASIAVMFGTAILTIMLAVCFAEVSGYFGKNGGAFQYSKRAFGDFIGFNVGFLGWTVTIFAWAAMAAGFARMFIITFPAFEGWHIPLSIGLIILLSLMNIAGLKTSKIVTITATIAKLIPIVAFCACTLFFIKNGLPNFTPFVQLEPGTNLLGAISNTAVYIFYGFIGFETLSIVAGEMRDPEKNVPRALLGSISIVSVLYMLIIGGTIAMLGSQIMMTNAPVQDAFVKMIGPAGAWMVSIGALISITGLNMGESIMVPRYGAAIADEGLLPAAIAKQNQNGAPLVAILVSGAIAIVLLLTGSFESLAKLSVVFRFFQYIPTALAVMKLRKDDPDANVIFRVPFGPIIPILAVIVSLVMIWGDNPMNFVYGAVGVIIASSVYYLMHGRNHQMDQMPPKEQI

SEQ ID NO: 3115 - DNA, 1011 bp, Streptococcus agalactiae
atgacacaagtatttcaaggacgtagtttcttagcagaaaaagatttttctcgtgaggaatttgaatatcttattgatttttcagctcatttaaaagaccttaaaaaacgtggtgttcctcatcattatcttgaaggtaaaaatattgctctcttatttgaaaaaacatctactcgtactcgcgcagcctttacaactgcagcaattgacctaggcgctcatccggaataccttggtgcaaatgatattcaacttggtaaaaaagaatcaacagaagatactgctaaggttttaggacgtatgtttgatggtattgaattccgtggttttagccaaagaatggttgaagagcttgctgaattttctggagtacctgtctggaatggtttaacagatgaatggcatccaacacaaatgctagctgactaccttactatcaaagaaaacttcggtaaacttgaaggtattactcttgtttactgtggtgacggacgtaacaatgttgccaactcgcttttagtggctgggactttgatgggggtcaatgtacacatcttttctccaaaagaacttttccctgctgaagagattgttaaattggctgaagaatatgccaaagagtccggggctcacgttctcgttactgataatgtagacgaagctgtaaagggagcagatgtcttttacactgatgtctgggtatcgatgggagaagaagataagttcaaagaacgcgttgaacttcttcaaccatatcaagtaaacatggaactgattaaaaaagctaataatgataatcttatcttcttacactgcttacctgcattccatgatacaaataccgtttacggcaaagacgtcgctgaaaaatttggcgtcaaggaaatggaagttactgatgaagtcttccgtagcaaatatgctcgtcatttcgaccaagctgaaaatcgtatgcacactattaaagctgtaatggctgcaacccttggaaatcttttcattccaaaagtt

SEQ ID NO: 3116 - protein, 337 aa, Streptococcus agalactiae
MTQVFQGRSFLAEKDFSREEFEYLIDFSAHLKDLKKRGVPHHYLEGKNIALLFEKTSTRTRAAFTTAAIDLGAHPEYLGANDIQLGKKESTEDTAKVLGRMFDGIEFRGFSQRMVEELAEFSGVPVWNGLTDEWHPTQMLADYLTIKENFGKLEGITLVYCGDGRNNVANSLLVAGTLMGVNVHIFSPKELFPAEEIVKLAEEYAKESGAHVLVTDNVDEAVKGADVFYTDVWVSMGEEDKFKERVELLQPYQVNMELIKKANNDNLIFLHCLPAFHDTNTVYGKDVAEKFGVKEMEVTDEVFRSKYARHFDQAENRMHTIKAVMAATLGNLFIPKV

SEQ ID NO: 3117 - DNA, 1011 bp, Streptococcus pyogenes
atgacacaagtatttcaaggacgtagcttcctagcagaaaaagattttacacgcgctgaattagaataccttattgatttttcagcacatttgaaagatttgaaaaaacgtggtgtgcctcatcactacttagaaggtaaaaacattgccctcttgtttgaaaaaacatcaactcgtacgcgtgcagcttttacaacagcagccattgacctaggtgctcacccagaatacctcggtgccaatgacatccaacttggtaaaaaagaatcaacagaagacactgctaaagtattgggtcgtatgtttgatgggattgaattccgtggctttagccaacgcatggttgaagaattggcagaattctcaggtgtgccagtttggaatggtttgactgatgaatggcacccaacccaaatgcttgctgactattttacagtgaaagaaaactttggcaaacttgaaggccttacccttgtttactgtggtgacgggcgtaataacgttgccaattcccttcttgtgactggtgctatccttggtgttaatgttcatatcttctcaccaaaagaacttttcccagaagaagagattgtgacattggctgaaggctatgctaaagaaagtggcgctcgtatccttatcacagaagatgctgacgaagctgttaaaggcgcagacgtgctttacacagatgtttgggtatcaatgggtgaagaagacaaattcaaagaacgtgttgaattgcttcaaccatatcaagtcaacatggaccttgttcaaaaagcaggaaatgacaagcttatcttcttgcactgcttgccagctttccatgacacaaataccgtttatggtaaagacgttgctgaaaaattcggcgtgaaagaaatggaagtcactgatgaagtcttccgcagcaaatacgctcgtcattttgaccaagctgaaaaccgcatgcacactatcaaagcggttatggcagcaacccttggtaacctctttattccaaaagtg

SEQ ID NO: 3118 - protein, 337 aa, Streptococcus pyogenes
MTQVFQGRSFLAEKDFTRAELEYLIDFSAHLKDLKKRGVPHHYLEGKNIALLFEKTSTRTRAAFTTAAIDLGAHPEYLGANDIQLGKKESTEDTAKVLGRMFDGIEFRGFSQRMVEELAEFSGVPVWNGLTDEWHPTQMLADYFTVKENFGKLEGLTLVYCGDGRNNVANSLLVTGAILGVNVHIFSPKELFPEEEIVTLAEGYAKESGARILITEDADEAVKGADVLYTDVWVSMGEEDKFKERVELLQPYQVNMDLVQKAGNDKLIFLHCLPAFHDTNTVYGKDVAEKFGVKEMEVTDEVFRSKYARHFDQAENRMHTIKAVMAATLGNLFIPKV

SEQ ID NO: 3119 - DNA, 429 bp, Streptococcus agalactiae
atgaagctattagtcaatcacttgccttaccaaagagctgcaagcctatatattcgcttttctgttttcgttatcgaaagaaatataaaaatggaagaagaattcgatgataatgacgagcaagatactatttatgctgttctttatgatgggaaacagccagtttcaacaggacgctttcttcctgaaactcaaacagaagctcgtttgactcgaattgcgactttaaaaggttatcgtggtaacggctatggtaccaaaattattatagcactagaaaattatgcaaaagaaaatggttatcactatctaactatacatgctgaattgacagcaaaagatttctaccagacacttgggtatcaagctactgggaatatttatatggaagacggggaagcctgtcaaacactcgaaaaatatttaatt

SEQ ID NO: 3120 - protein, 143 aa, Streptococcus agalactiae
MKLLVNHLPYQRAASLYIRFSVFVIERNIKMEEEFDDNDEQDTIYAVLYDGKQPVSTGRFLPETQTEARLTRIATLKGYRGNGYGTKIIIALENYAKENGYHYLTIHAELTAKDFYQTLGYQATGNIYMEDGEACQTLEKYLI

SEQ ID NO: 3121 - DNA, 426 bp, Streptococcus pyogenes
atggcagataaatttgatgccaatgacgaaacaagaacggtttatgcagtcgtttatgacaatgaccagcccgtttcaacaggacaatttttagctgaaacgaaaatagaagcacgattgacacgcattgtaaccttagcagattattgtggttgcggttatggtgccaaagtcactgaagcgctcgaaacttataccagacgagaaggcttttaccaactaaccattcacagtgaactgacagcacaaaccttttatgaaaacctaggttatcagtcctatggtcccaagtgtttagaagatggtgagtattgtcagtcccttgcaaaaaccattcttaaatgggagaagaatatggacatagcaatgctaattgcgattgttggtggtctattaggctgctatctctatctcacaaaaaataat

SEQ ID NO: 3122 - protein, 142 aa, Streptococcus pyogenes
MADKFDANDETRTVYAVVYDNDQPVSTGQFLAETKIEARLTRIVTLADYCGCGYGAKVTEALETYTRREGFYQLTIHSELTAQTFYENLGYQSYGPKCLEDGEYCQSLAKTILKWEKNMDIAMLIAIVGGLLGCYLYLTKNN

SEQ ID NO: 3123 - DNA, 1230 bp, Streptococcus agalactiae
atgactcaaacacatccaattcatgttttctcagaaattggaaaacttaaaaaagttatgctacaccgtccaggtaaagaaatagaaaatctgatgcctgattatttagagagactcttgtttgatgatatcccatttttggaagatgcacaaaaagaacacgatgcgtttgcacaagcacttcgcaacgaaggagtcgaagtactttaccttgaaaatcttgctgccgagtcgttaacaaaccaagaaattcgtgaacagtttatcgatgagtacattggcgaagcaaatgttcgcggtcgtgctactaaaaaagctattcgagaattattactcaatatcaaagataataaagaacttatcgaaaaaactatggcaggtatccaaaagtctgagctacctgaaatcccatcttctgaaaaaggtctaactgatcttgtcgaatctaattatccatttgccatagatccgatgccaaatctttactttacacgtgatccatttgcaactattgggaatggagtttcattaaatcatatgttctctgaaacacgtaatcgcgaaactttatacggtaaatatatctttacacatcacccagagtacggtggaaaagtccctatggtctatgaacgtgaagaaacaactcgtattgaaggtggagatgagcttgtcctttctaaagatgtccttgccgttggtatctctcaacgtactgatgctgcctctattgaaaaactcttagtcaatatttttaaacaaaatttaggttttaaaaaggttttagcatttgaatttgcaaataatcgtaaatttatgcaccttgacacagtctttacaatggttgactatgacaagtttacaattcacccagaaattgaaggcgatcttcgcgtttactctgtaacttacgaaaaccaagatcttcatattgaagaagaaaaaggtgatttggcagatcttctagcgaaaaacctaggagttgagaaagtggaattgattcgttgtgggggtgacaacttagtcgctgctggacgtgaacaatggaatgatggttcaaatacattaactatagcaccaggtgtcgttatcgtttacaacagaaatacaatcacaaatgcaatcttagagtccaaaggattgaaattaattaagattaatggaagtgaattagttcgtgggcgtggtggaccacgctgcatgtcaatgccatttgaacgtgaagacctt

SEQ ID NO: 3124 - protein, 410 aa, Streptococcus agalactiae
MTQTHPIHVFSEIGKLKKVMLHRPGKEIENLMPDYLERLLFDDIPFLEDAQKEHDAFAQALRNEGVEVLYLENLAAESLTNQEIREQFIDEYIGEANVRGRATKKAIRELLLNIKDNKELIEKTMAGIQKSELPEIPSSEKGLTDLVESNYPFAIDPMPNLYFTRDPFATIGNGVSLNHMFSETRNRETLYGKYIFTHHPEYGGKVPMVYEREETTRIEGGDELVLSKDVLAVGISQRTDAASIEKLLVNIFKQNLGFKKVLAFEFANNRKFMHLDTVFTMVDYDKFTIHPEIEGDLRVYSVTYENQDLHIEEEKGDLADLLAKNLGVEKVELIRCGGDNLVAAGREQWNDGSNTLTIAPGVVIVYNRNTITNAILESKGLKLIKINGSELVRGRGGPRCMSMPFEREDL

SEQ ID NO: 3125 - DNA, 1233 bp, Streptococcus pyogenes
atgactgctcaaacaccaattcatgtttattctgaaattggaaaattaaaaaaagtgttgctccacagacccggtaaagaaattgaaaatcttatgccagactacttggaacgcttgttgtttgatgatattccattcttagaggatgcccaaaaagaacatgatgcttttgcccaagctttgcgtgacgaaggtattgaagtcttgtaccttgagaccttagctgcagaatctcttgtcactccagaaattcgcgaagctttcatcgatgaatacctaagtgaagctaatatccgtggaagagctactaaaaaagccattcgtgaattgttgatggctatcgaagacaatcaagaattgattgaaaaaaccatggcaggagttcaaaaatctgaacttccagagatcccagcatctgaaaaaggcttgactgacttggttgaatccaattacccatttgccatcgacccaatgccaaacctttatttcacacgggacccattcgcaactatcggtacaggtgtttctcttaaccacatgttctcagaaacccgtaaccgtgaaaccctttatggtaaatacattttcactcatcacccaatttatggtggtggtaaagtgcctatggtttatgaccgtaatgaaaccactcgcattgaaggtggggacgaacttgttctttcaaaagatgtgcttgcggttggtatttctcaacgtacagatgctgcttctattgaaaaattgttggttaacatctttaaacaaaaccttggcttcaagaaagtattggcctttgaatttgcaaataaccgtaaatttatgcacttagacactgtctttaccatggttgactatgacaaattcaccattcacccagaaattgaaggcgaccttcgtgtttactctgtcacttacgacaatgaagaacttcatatcgttgaagaaaaaggtgatttagcagaacttcttgctgctaaccttggtgttgaaaaagttgaccttatccgttgtggtggtgacaacttagtagcagcaggtcgtgaacaatggaacgatggttctaataccttgaccatcgcaccaggtgtggttgtggtttataaccgtaacaccattaccaatgccattcttgaatctaaaggcttgaagttgatcaagattcacggaagtgaattggttcgcggtcgtggtggacctcgttgtatgtcaatgccatttgaacgtgaagatatt

SEQ ID NO: 3126 - protein, 411 aa, Streptococcus pyogenes
MTAQTPIHVYSEIGKLKKVLLHRPGKEIENLMPDYLERLLFDDIPFLEDAQKEHDAFAQALRDEGIEVLYLETLAAESLVTPEIREAFIDEYLSEANIRGRATKKAIRELLMAIEDNQELIEKTMAGVQKSELPEIPASEKGLTDLVESNYPFAIDPMPNLYFTRDPFATIGTGVSLNHMFSETRNRETLYGKYIFTHHPIYGGGKVPMVYDRNETTRIEGGDELVLSKDVLAVGISQRTDAASIEKLLVNIFKQNLGFKKVLAFEFANNRKFMHLDTVFTMVDYDKFTIHPEIEGDLRVYSVTYDNEELHIVEEKGDLAELLAANLGVEKVDLIRCGGDNLVAAGREQWNDGSNTLTIAPGVVVVYNRNTITNAILESKGLKLIKIHGSELVRGRGGPRCMSMPFEREDI

SEQ ID NO: 3127 - DNA, 618 bp, Streptococcus agalactiae
atggacagaaaccttgaaacagaacttaaacagttactgtctgatagtcattctttagcaaaaaaatatttgcaagagaaagaattcagtcaaaacagagttatccaaacttatcgcaaagcatatcaaacctttaaaactaaaaaaggtgcacgttcaagtatcgaagcattattgaagcgagttaattcaggaaacgaaattactagtataaatcctctagttgatatctataatgccgctagccttaggtttggattacctattggtgctgaggatagtgatacatttagaggtgatttaaaactaactattaccaatggtggtgatgaattttacttgattggcgaagattttaacagaccaactctttcaggtgagcttgcctatgttgatgatgttggagcagtttgccgctgttttaattggcgtgatggaaaacgtactatgattaccgataatactcagaatgcttttttagttatcgaattaattgataatggaagagaaattatttttaaagaagcgttggactttatcgccaccaatacaaatcgttttctaaaagctaaaacacagaccatcatattagataaagaacacagtgaaataacgcta

SEQ ID NO: 3128 - protein, 206 aa, Streptococcus agalactiae
MDRNLETELKQLLSDSHSLAKKYLQEKEFSQNRVIQTYRKAYQTFKTKKGARSSIEALLKRVNSGNEITSINPLVDIYNAASLRFGLPIGAEDSDTFRGDLKLTITNGGDEFYLIGEDFNRPTLSGELAYVDDVGAVCRCFNWRDGKRTMITDNTQNAFLVIELIDNGREIIFKEALDFIATNTNRFLKAKTQTIILDKEHSEITL

SEQ ID NO: 3129 - DNA, 714 bp, Streptococcus pyogenes
atggttgaatttgtagcagatcaaagtttttgggaactttttccaggtgccaaactaggtgtcgtcttattaaaggatgttcagaaccaagcagagtcaccagaagatgtcaaacagctcttagcagacagccatgagttagcaaaagcttatttaacagcagacaattttagtgataatcaggtggttcaagtctaccgcaaggcctatcaacactttaaaaccaaaaaaggagctcgctctagcattgaagcccttctcaagcgggtgtcaaatggtcaaagcattccgtctattaacccactagtggatatttataatgcggctagtctacgttttggtttacctgctggagccgaagatagtgacagttttatcggagatttgcgtctgacgataacagatggtggtgacgacttttacttgattggggatgctgacaacaacccaaccttgccaaatgaactctgttataaagatgatattggagcgttttgtcgttgccttaactggcgagatggcgaacgcaccatggtgacagaacacaccaaaaatgcatttctgatcatcgaagctcttgatcaagaaggtcaaaatagattgcaagaagctctgaaattcattgaaggcagcgcaaaaatgtaccttcatgcaatcacttctgtgcatgtgttggataaagacaatccacacgtgccactttttacagaaaac

SEQ ID NO: 3130 - protein, 238 aa, Streptococcus pyogenes
MVEFVADQSFWELFPGAKLGVVLLKDVQNQAESPEDVKQLLADSHELAKAYLTADNFSDNQVVQVYRKAYQHFKTKKGARSSIEALLKRVSNGQSIPSINPLVDIYNAASLRFGLPAGAEDSDSFIGDLRLTITDGGDDFYLIGDADNNPTLPNELCYKDDIGAFCRCLNWRDGERTMVTEHTKNAFLIIEALDQEGQNRLQEALKFIEGSAKMYLHAITSVHVLDKDNPHVPLFTEN

SEQ ID NO: 3131 - DNA, 93 bp, Streptococcus agalactiae
ttgattaagattactccaattttagaagttggaaacaaattccagtacgatgaatcaacaataaatttagtcatgaaggcctctcaatttttt

SEQ ID NO: 3132 - protein, 31 aa, Streptococcus agalactiae
MIKITPILEVGNKFQYDESTINLVMKASQFF

SEQ ID NO: 3133 - DNA, 678 bp, Streptococcus agalactiae
gtgattacaaaagaacaatatttttatttcagacaactagatgattttaaacactttactattgaacaatttgaccatattgtgagccacattaaacatcgtacagctctaaaaaatcataccttattttttgaaggtgattaccgtgaaaaactgtttttaatccagtcaggacatgtaaaaattgaacaatcagacgcttctggttctttcatttatacagattatgttagacaaggtacggtttttccttatggaggtctctttttggatgatgattaccatttttcagcagtggctattacggatattgagtatttttctctgccaatggctttatacgaagaatactctcttcaaaatatcaatcaaatgaagcatctttgtcggaaatattctaagctattacgagttcatgaaatacgacttcgtaatatggtgacttcaagtgccagtatgagagttatccaatcgcttgcaactctacttttgcaagttcctacagaaaggggacatttaccttttcctattacaacgattgaaattgccaatatgagcggaactactcgcgagacagttagtcatgttttaaaggaattacgccaaaaagatatcgttgaaatgaaaggaaagaagcttctctataataataaaaattatttcaagaaattcattgaa

SEQ ID NO: 3134 - protein, 226 aa, Streptococcus agalactiae
MITKEQYFYFRQLDDFKHFTIEQFDHIVSHIKHRTALKNHTLFFEGDYREKLFLIQSGHVKIEQSDASGSFIYTDYVRQGTVFPYGGLFLDDDYHFSAVAITDIEYFSLPMALYEEYSLQNINQMKHLCRKYSKLLRVHEIRLRNMVTSSASMRVIQSLATLLLQVPTERGHLPFPITTIEIANMSGTTRETVSHVLKELRQKDIVEMKGKKLLYNNKNYFKKFIE

SEQ ID NO: 3135 - DNA, 678 bp, Streptococcus pyogenes
gtgattcgaagagaagattatcaataccttagaaaactaaacgattttcgctacttttctattgaacaatttgacaaaattgtagggcagatggaattccgaaaagctaaaaaggaccatatccttttttttgagggagataaaagagataagctttttctagtgacctctggttatttcaaggtggagcagtccgatcaatcaggaaccttcatgtatacggatttcatcagacacggcaccatttttccttacggtggcctctttacagatgattattaccatttttcagtggtagccatgacagacgtgacttatttttactttccagtcgatttatttgaagattattcgcttgaaaatcgtctacaaatgaaacacttatatagtaagatgtctaagctgctcgagttacatgagttgagggtccgaaacttgattacatcaagtgctagttctcgtgtgattcaatctctggcgattttgctggttgaaatgggtaaagacagtgataccttaccttttcaattaacaacaacagatattgctcaaataagtgggacgacaagagaaacagttagccatgtgcttagagatttgaagaagcaagaattgattaccataaaaggtaagtatttgacttatctagataaagactattttttacaatacacaaag

SEQ ID NO: 3136 - protein, 226 aa, Streptococcus pyogenes
VIRREDYQYLRKLNDFRYFSIEQFDKIVGQMEFRKAKKDHILFFEGDKRDKLFLVTSGYFKVEQSDQSGTFMYTDFIRHGTIFPYGGLFTDDYYHFSVVAMTDVTYFYFPVDLFEDYSLENRLQMKHLYSKMSKLLELHELRVRNLITSSASSRVIQSLAILLVEMGKDSDTLPFQLTTTDIAQISGTTRETVSHVLRDLKKQELITIKGKYLTYLDKDYFLQYTK

SEQ ID NO: 3137 - DNA, 1482 bp, Streptococcus agalactiae
ttgatgtcaaattgggatactaagtttttgaaaaaaggttttacttttgatgatgttctgcttattcctgctgaaagccatgttttaccaaatgaagttgatatgaagacaaagttggctgataatttgacattaaacattccaatcattacagctgcaatggatacagttacagatagtaagatggctattgctattgcacgtgctggtgggcttggtatcattcataaaaatatgtcaatagttgatcaagcagaagaagttcgtaaagttaaacgctcagaaaatggtgttattattgacccattcttcttgacaccagataatactgtctctgaagctgaggaattgatgcaaaactatcgcattagtggagttcctattgtagagacactcgagaatcgtaaattagttggaattattactaaccgtgatatgcgtttcatttctgattataaacaactaatctcagagcacatgacaagtcaaaatcttgtaacagctcctattggtacagatcttgaaactgcagagcgtattcttcatgagcatcgtattgaaaagctacctttagtagatgatgagggacgtctttcaggacttattactattaaggatatcgaaaaagttattgaatttcctaaggcagcaaaagatgaatttggacgtctcttagttgcaggtgcagtaggtgtaacctctgatacttttgaacgtgcagaagctttgtttgaagcaggtgcagatgctattgtcattgatacagcacatggacattcagctggtgtgctccgtaaaattgctgaaattcgtgctcacttccctaatcgcacattgattgcgggaaatattgctacagcagaaggagcgcgtgcactttatgatgcaggtgtggatgtcgttaaagttggtattggtccaggttcaatttgtacgactcgtgtcgttgctggggtaggtgttcctcagattacagctatttacgatgcagcggctgttgcgcgtgagtacggtaagactatcattgctgatggtggtattaaatattcaggtgatattgtaaaagcacttgcagcaggtggaaatgcagttatgctaggttcaatgtttgcaggaacagatgaagcgccaggagaaacagaaattttccaagggcgtaagttcaagacataccgtggtatgggctcaattgcagcaatgaaaaaaggttcaagcgatcgttatttccaaggttctgtaaacgaggctaacaaattggttccagaaggtattgaaggtcgtgtagcatacaaaggttcagtagccgatattgttttccaaatgcttggtggcattcgctctggtatgggatatgtaggtgcagcgaacataaaagaacttcatgataatgctcaatttgttgaaatgtcaggagctggcttgaaagaaagccatccccatgatgttcaaattacaaatgaggcaccaaattattcagtacac

SEQ ID NO: 3138 - protein, 494 aa, Streptococcus agalactiae
MMSNWDTKFLKKGFTFDDVLLIPAESHVLPNEVDMKTKLADNLTLNIPIITAAMDTVTDSKMAIAIARAGGLGIIHKNMSIVDQAEEVRKVKRSENGVIIDPFFLTPDNTVSEAEELMQNYRISGVPIVETLENRKLVGIITNRDMRFISDYKQLISEHMTSQNLVTAPIGTDLETAERILHEHRIEKLPLVDDEGRLSGLITIKDIEKVIEFPKAAKDEFGRLLVAGAVGVTSDTFERAEALFEAGADAIVIDTAHGHSAGVLRKIAEIRAHFPNRTLIAGNIATAEGARALYDAGVDVVKVGIGPGSICTTRVVAGVGVPQITAIYDAAAVAREYGKTIIADGGIKYSGDIVKALAAGGNAVMLGSMFAGTDEAPGETEIFQGRKFKTYRGMGSIAAMKKGSSDRYFQGSVNEANKLVPEGIEGRVAYKGSVADIVFQMLGGIRSGMGYVGAANIKELHDNAQFVEMSGAGLKESHPHDVQITNEAPNYSVH

SEQ ID NO: 3139 - DNA, 660 bp, Streptococcus agalactiae
atgaaaaattatggaaaaattttaaaagagttgagagaggacaaaggtatatccctaagttctctagccaaaagtgctcaattatcaaaatcaactctatcacgttttgaaaatggtgagacacaaataggtattgataaatttattaaagctttacaaacgttggaggttggggtaactatcaatgaagtatccattctagattcaaaagttaaggctggaacttctaatactgatttagagcaattaactttactggaatcttatcgagataatgaagatatcatgagaattttcagtttccaaaaacaacaatcctgtgatagaatagaaagcaatgttctcaaaatattggctaaactttttatttcaaatttagggttaaatatgaggctgcctcaagatgagattaacctggtagttacttatctgaatggtgtgacacagtacaatgatttttatttcaaagtcatctgctattttcaagatattttacctgaagatgttattttaaataagattagtaatatgactaaagaacagttaccttattctaaatcactggtcaatttattgataaaacaagtcattatagctttggaaaaagatagtgttgataaagctatagtatttgctgatcttgctaataaagttagtcaa

SEQ ID NO: 3140 - protein, 220 aa, Streptococcus agalactiae
MKNYGKILKELREDKGISLSSLAKSAQLSKSTLSRFENGETQIGIDKFIKALQTLEVGVTINEVSILDSKVKAGTSNTDLEQLTLLESYRDNEDIMRIFSFQKQQSCDRIESNVLKILAKLFISNLGLNMRLPQDEINLVVTYLNGVTQYNDFYFKVICYFQDILPEDVILNKISNMTKEQLPYSKSLVNLLIKQVIIALEKDSVDKAIVFADLANKVSQ

SEQ ID NO: 3141 - DNA, 864 bp, Streptococcus agalactiae
ttggaaggtttacttattgcattgattcccatgtttgcgtggggaagtattggatttgttagtaataaaattggaggacgtccaaatcaacaaacatttggaatgactttaggagcattgctatttgcgattatcgtatggttatttaaacagccagagatgactgcctcattgtggatttttggtatcttaggtggtatcctatggtcagtcggccaaaatggtcaattccaagcaatgaaatatatgggagtctctgttgctaatccactgtcaagtggtgcacaattagtaggtggaagcctagttggtgctttagtctttcatgaatggactaagccaatccaatttattttaggattgacagcgttgacattattagttatcggcttctatttctcaagtaaacgtgatgtctcagaacaagctttggcaacacatcaagagttttcaaaaggatttgctacaattgcttattcaactgtaggttacatctcatacgcagttttatttaataacattatgaagttcgacgctatggccgttattttacccatggctgttggaatgtgtctaggtgcaatttgtttcatgaagtttcgtgttaactttgaggctgttgttgttaaaaatatgattacaggtctcatgtggggcgttggtaatgtcttcatgttattggcagcagctaaagcagggctagcaattgcttttagtttttctcaacttggagtaattatctctattattggtggtattttatttttaggtgagacaaaaacgaagaaagagcagaagtgggttgtcatgggtatcctttgttttgttatgggtgctatattacttggtattgttaaatcttat

SEQ ID NO: 3142 - protein, 288 aa, Streptococcus agalactiae
MEGLLIALIPMFAWGSIGFVSNKIGGRPNQQTFGMTLGALLFAIIVWLFKQPEMTASLWIFGILGGILWSVGQNGQFQAMKYMGVSVANPLSSGAQLVGGSLVGALVFHEWTKPIQFILGLTALTLLVIGFYFSSKRDVSEQALATHQEFSKGFATIAYSTVGYISYAVLFNNIMKFDAMAVILPMAVGMCLGAICFMKFRVNFEAVVVKNMITGLMWGVGNVFMLLAAAKAGLAIAFSFSQLGVIISIIGGILFLGETKTKKEQKWVVMGILCFVMGAILLGIVKSY

SEQ ID NO: 3143 - DNA, 861 bp, Streptococcus pyogenes
ttggaaggtattttttatgcacttattcccatgtttacatggggaagcattggatttgttagtaacaaaattggaggaaaaccttcgcaacaaactctaggaatgacttttggggctttattattttcattagctgtttggttaattgttagacctgagatgacactgcaactttggctttttggaatattgggtggttttatctggtcaattggtcaaactggtcaatttcatgccatgcaatacatgggagtctccgttgccaatcctttgtcaagtggctctcaacttgttctgggaagtttgattggtgtcctcgtttttcatgaatggacaagacctatgcaatttgtagtaggaagtctagcactattacttctgattgttggtttttacttttctagtaaacaagatgatgctaatgcacaagtcaatcaccttcataatttttcaaaaggatttagggcgctcacttattcaacaattggttacgtgatgtatgctgtattatttaataacatcatgaaatttgaagttttgtcagtcattttacccatggcagtaggtatggttttaggagctataactttcatgtcatttaaaatttccattgaccagtatgtgattaaaaatagcgttgttggattactttggggcattgggaatatttttatgcttttagctgcatcaaaagcaggacttgctattgcctttagtttctcacaattaggtgctatcatttcgattgtcggaggcattttattcctaggcgaaaccaaaaccaaaaaagaaatgcgttgggttgtcacaggaattatttgttttatcgtaggtgctattttattaggtgtggtcaaatct

SEQ ID NO: 3144 - protein, 287 aa, Streptococcus pyogenes
LEGIFYALIPMFTWGSIGFVSNKIGGKPSQQTLGMTFGALLFSLAVWLIVRPEMTLQLWLFGILGGFIWSIGQTGQFHAMQYMGVSVANPLSSGSQLVLGSLIGVLVFHEWTRPMQFVVGSLALLLLIVGFYFSSKQDDANAQVNHLHNFSKGFRALTYSTIGYVMYAVLFNNIMKFEVLSVILPMAVGMVLGAITFMSFKISIDQYVIKNSVVGLLWGIGNIFMLLAASKAGLAIAFSFSQLGAIISIVGGILFLGETKTKKEMRWVVTGIICFIVGAILLGVVKS

SEQ ID NO: 3145 - DNA, 1107 bp, Streptococcus agalactiae
atgtggataaaaaatatttctttaaaacattatcgtaattatgaagaagcacaagtagatttttcacccaacctcaatattttcattggccgcaatgctcaaggaaagacaaattttttagaagcaatctacttcttggctttgactcgaagtcaccgtacccgttctgataaagaacttgtacattttaaacaccatgatgtacaaattacaggtgaggtaatccgcaaaagtggccatcttaacttagatattcaattatctgaaaaaggaagaatcactaaagttaaccatcttaaacaggcaaaattatctgattatattggggctatgactgtcgtactttttgcccctgaagatcttcaattagttaaaggtgcacctagtctaagacgaaaatttttagatatagatattggacaaattaagccaacgtacttagctgaactttcaaattacaatcatgtattaaaacaaagaaacacttatctaaaaactactaataacgtcgacaaaacttttttaacagtccttgatgaacaattagctgattatggaagtcgtgtcattgaacaccgttttgattttatccaagccctaaatgatgaagcggacaaacatcactacattatcagtactgagttagaacatttatctattcactacaaatcgtcaatagagtttacagataagtcaagtattagggaacattttttaaaccaattatctaaaagccactcaagagacatctttaagaaaaacacaagcatcggacctcatcgtgatgatattactttctttattaatgatatcaatgctacttttgctagccaagggcaacaaagaagccttattttatcattgaaattagcagaaattgagctaataaaaaccgttaccaacgattatccgattctcttacttgacgacgtcatgagtgaacttgacaaccatcgtcaactaaaactcttagagggaatcaaagagaatgttcaaacatttattactacaacaagtttagaacatttaagtgctttacctgatcaactcaaaatctttaacgttagtgatggtactattagtattaatgaaaaaaaagcaacagat

SEQ ID NO: 3146 - protein, 369 aa, Streptococcus agalactiae
MWIKNISLKHYRNYEEAQVDFSPNLNIFIGRNAQGKTNFLEAIYFLALTRSHRTRSDKELVHFKHHDVQITGEVIRKSGHLNLDIQLSEKGRITKVNHLKQAKLSDYIGAMTVVLFAPEDLQLVKGAPSLRRKFLDIDIGQIKPTYLAELSNYNHVLKQRNTYLKTTNNVDKTFLTVLDEQLADYGSRVIEHRFDFIQALNDEADKHHYIISTELEHLSIHYKSSIEFTDKSSIREHFLNQLSKSHSRDIFKKNTSIGPHRDDITFFINDINATFASQGQQRSLILSLKLAEIELIKTVTNDYPILLLDDVMSELDNHRQLKLLEGIKENVQTFITTTSLEHLSALPDQLKIFNVSDGTISINEKKATD

SEQ ID NO: 3147 - DNA, 1104 bp, Streptococcus pyogenes
atgtggattaaagagttagagttaaaacattatcgcaattatgaccacctgcttgcctcattttcgtcgggtttaaatgtctttatcggtaataatgctcaaggaaaaaccaattttctcgaggcaatctattttctatcacttactagaagtcatcgcacgagggctgataaagaattgattcattttgatcactcaactgtttctcttactggtaagattcagcgtattagtggtactgttgatttagaaatcaatctatcagataaaggacgtgtgacaaagattaatgcgctaaagcaagcaaaattatctgattatattggaacgatgatggttgtgctttttgcaccagaagatttgcaactagttaagggagcacctagccttcgtcgcaaatttatcgacattgaccttggtcaaattaagcctgtttacttatctgagttatcccattataaccacgtgcttaaacagcgtaatagctatttaaaaagtgcccaacaaattgatgccgcttttctagctgttctagatgagcaattagctagctatggagcccgtgtcatggaacatcgtattgattttatcaatgcgttagagaaagaagcaaatactcatcaccaagccatctcaaatggtttagaaagtctctctctctcctatcagtcgtcagttgtctttgacaaaaaaactaatatttaccaacaatttttacaccaacttgaaaaaaatcatcagaaagatttcttccgtaaaaacactagcgttggtccacatcgcgatgaattagccttttacattaacgggatgaatgctaactttgctagtcaaggtcagcaccgcagccttatcctttccttaaaaatggctgaagttagtttaatgaaggccttgactggagataatcccattcttttactagacgatgtcatgagcgagctagacaatacacgacaaacaaagttacttgaaacagtaattaaagaaaatgtccaaacctttatcacaacaacaagtttggatcacctgtcacagttgccagaaggtatccgtatttttcacgtgacaaaaggaaccgttcaaattgattctgatattcac

SEQ ID NO: 3148 - protein, 368 aa, Streptococcus pyogenes
MWIKELELKHYRNYDHLLASFSSGLNVFIGNNAQGKTNFLEAIYFLSLTRSHRTRADKELIHFDHSTVSLTGKIQRISGTVDLEINLSDKGRVTKINALKQAKLSDYIGTMMVVLFAPEDLQLVKGAPSLRRKFIDIDLGQIKPVYLSELSHYNHVLKQRNSYLKSAQQIDAAFLAVLDEQLASYGARVMEHRIDFINALEKEANTHHQAISNGLESLSLSYQSSVVFDKKTNIYQQFLHQLEKNHQKDFFRKNTSVGPHRDELAFYINGMNANFASQGQHRSLILSLKMAEVSLMKALTGDNPILLLDDVMSELDNTRQTKLLETVIKENVQTFITTTSLDHLSQLPEGIRIFHVTKGTVQIDSDIH

SEQ ID NO: 3149 - DNA, 351 bp, Streptococcus agalactiae
atggattataaattatttgatgaatatattactttacaatcacttctaaaagagattggtatcattcaaagtggcggagccattaaaaaatttttagcggataatcgagtattgtttaacggtgaccttgaaaataggcgtggaaagaaactccgcctgggggatattattactattcctgatcaaaatatcgagatcattataaggaagccatcagatcaagaaattgaagaacgtaatatagaaatagctgaaaaacagcgtgtttcagcaatcgttaaagaaatgaataaaaacaccaacaaaggtaaatcaaaaactagcaaaaaaccagttcgctttccagggaca

SEQ ID NO: 3150 - protein, 117 aa, Streptococcus agalactiae
MDYKLFDEYITLQSLLKEIGIIQSGGAIKKFLADNRVLFNGDLENRRGKKLRLGDIITIPDQNIEIIIRKPSDQEIEERNIEIAEKQRVSAIVKEMNKNTNKGKSKTSKKPVRFPGT

SEQ ID NO: 3151 - DNA, 435 bp, Streptococcus pyogenes
ttgaatgacaaaatggagatgacaatgatatacaaattatttacagaatttatcaccctacaagcccttcttaaagaattaggaattatccaaagtggtggcgctatcaagggatttctcgctgaaacaaccgttctatttaatggtgaagatgagaaacgtcgaggcaaaaaaatcagagtaggggataagatttctctacctgaccaagacttaattatcactattgttgagcctagtcaagaagaaaaagaacaatttgccgaagaaatggctgaaaagacacgtgtagcggctctagtgaaacaaatgaaccaagctaacaaaaagacttcttctaaacataacaatcgtcaatctactaccaaaaaatcactaagagcaactaagaaaactaaaggtaaaccaactgcacctgtccgcttcccaggtatc

SEQ ID NO: 3152 - protein, 145 aa, Streptococcus pyogenes
LNDKMEMTMIYKLFTEFITLQALLKELGIIQSGGAIKGFLAETTVLFNGEDEKRRGKKIRVGDKISLPDQDLIITIVEPSQEEKEQFAEEMAEKTRVAALVKQMNQANKKTSSKHNNRQSTTKKSLRATKKTKGKPTAPVRFPGI

SEQ ID NO: 3153 - DNA, 1242 bp, Streptococcus agalactiae
atgaaaatagttgaaggcgtttctctacatttaattaaaaaccaacaatttaagactaatcatcttacttttcgattttcaggtgattttaataataaaacagtagcacgtagatcgctcgttgctcaaatgttagttactgcaaatgctaagtatcctaaggtacaagaatttcgagaaaagttagcttccttatatggcgctagtttatcaactaagatttctactaagggtcttgttcacattgttgatattgatattgtatttgttaaaaatacctttactttagaacaagaaaatatcgttgaacaaattattacattcttggaggatatgctgttttctcctttaatttctttagaacagtatcaaacatctatttttgatactgagaagaaaaaccttattcaatatttagaggctgatattgaagataatttttatagcagtgacttagcactaaaatctttattctacaataataagacacttcgtttacctaagtatggtacagcatctttagtggaatcagaaaattcatttacagcttatcaagaatttcagaagatgcttaaggaagatcaattagatatttttgtcgtaggggattttgatgactatcgaatgattcaggcttttaatcgtatggcatttgagccacgtcacaaagtattagcttttgattatacgcagacttatgaaaatataacgagaagtcaagtagaagataaggacgttaatcaatctattatgcaattggcttatcatcttccaataacttataaagatgaagattattttgctttaatagtatttaacggtttatttggtgcttttgcccactccttgttgtttacagaaattcgagaaaagcaaggtttagcctatactataggtagtcaatttgacagctttacaggtctctttacgatatatgcaggtattgataaagagaatcgtgagcgttttttgaagcttattaataagcaattcaataatattaagatgggcaggttttcttctacattattgaaacaaacaaaagatatattgaaaatgaactatgttttagcttctgataatcctaaggtcatagttgaccacatttatcatgaacattatttagatcagtttcatacttcagcactattcattgacaaagtagacgatgtaacaaaatcagatattgtcagcgtagcaacaaaattaaaattacaagctttttattttttggaaggaaac

SEQ ID NO: 3154 - protein, 414 aa, Streptococcus agalactiae
MKIVEGVSLHLIKNQQFKTNHLTFRFSGDFNNKTVARRSLVAQMLVTANAKYPKVQEFREKLASLYGASLSTKISTKGLVHIVDIDIVFVKNTFTLEQENIVEQIITFLEDMLFSPLISLEQYQTSIFDTEKKNLIQYLEADIEDNFYSSDLALKSLFYNNKTLRLPKYGTASLVESENSFTAYQEFQKMLKEDQLDIFVVGDFDDYRMIQAFNRMAFEPRHKVLAFDYTQTYENITRSQVEDKDVNQSIMQLAYHLPITYKDEDYFALIVFNGLFGAFAHSLLFTEIREKQGLAYTIGSQFDSFTGLFTIYAGIDKENRERFLKLINKQFNNIKMGRFSSTLLKQTKDILKMNYVLASDNPKVIVDHIYHEHYLDQFHTSALFIDKVDDVTKSDIVSVATKLKLQAFYFLEGN

SEQ ID NO: 3155 - DNA, 1242 bp, Streptococcus pyogenes
atgaaaattgttcagggagtacaacttcatctgattaagaccaaacagtttaaaaccaatcatattacctttcgtttttcaggtgatttgaaccaaaaaacagtagcaaaaaaagtcttagtggcacagatgttagcaacagctaatgagtgttatccaactgttaggcagtttagagaaaaattagcacgactttatggagctagcttgtcaactaacgtgttaacaaaagggttagttcatattgtggatatcgatattacttttattcaagatagatatgcttgcaatggggaaaaaatactagatgaaatgattcagtttttaaaagatatcttgttctcacccctattatccatcgcccagtatcagcctaaagtttttgagactgaaaaaaataatttgattaactacatcgagtcagatagagaggattctttttactacagctctcttaaggtaaaagaattgttttattgtaataagaatctacaaatgtcagaatatggtagcccagaactaattgcaaaagagactgcctatactagctatcaagaatttcataaaatgctcaatgaagatcagattgatattttcattttaggagattttgatgattatcgcgttgttcagctaattcatcaatttccacttgataaccgaaataaaaacctaaatttctttcatttacaaaattctgtcaatattattaaagaatctattgaaaaaagagcagttcatcaatctattttacaattagcttatcacttcccttcagtttttggacaacgtgactattatgctttagttcttttaaatgggttgttaggctcttttgcacattcccgtctctttataaaaattagagaagaagaaggacttgcttatagtatagggtgtcgttttgatagttatacaggattatttgaaatttatactggaattgacagtcaacatcgcactaaaacgttacaactaatcatccaagaattaaatgccattaaaatgggacgattctcagaacaattgattaaaaagaccagatcgatgttgttgaataatgccttattatcagaagattataataaaaatataattgaaagaatatacagatcttcttacattgattcttcttattctattaaaaattggattaaaggggttaatgaagttaataaagcagatatcattaaagtagctaatcttttaaagcttcaaactgtctattttttagaaggaata

SEQ ID NO: 3156 - protein, 414 aa, Streptococcus pyogenes
MKIVQGVQLHLIKTKQFKTNHITFRFSGDLNQKTVAKKVLVAQMLATANECYPTVRQFREKLARLYGASLSTNVLTKGLVHIVDIDITFIQDRYACNGEKILDEMIQFLKDILFSPLLSIAQYQPKVFETEKNNLINYIESDREDSFYYSSLKVKELFYCNKNLQMSEYGSPELIAKETAYTSYQEFHKMLNEDQIDIFILGDFDDYRVVQLIHQFPLDNRNKNLNFFHLQNSVNIIKESIEKRAVHQSILQLAYHFPSVFGQRDYYALVLLNGLLGSFAHSRLFIKIREEEGLAYSIGCRFDSYTGLFEIYTGIDSQHRTKTLQLIIQELNAIKMGRFSEQLIKKTRSMLLNNALLSEDYNKNIIERIYRSSYIDSSYSIKNWIKGVNEVNKADIIKVANLLKLQTVYFLEGI

SEQ ID NO: 3157 - DNA, 1281 bp, Streptococcus agalactiae
atgacagttaataaaataacttatcagaaccttcaggaggaagtatataagttaacattagagagcggactaaatgtataccttattccaaagccatcatttaaggaaactgttggagtattgacagcaaattttggatcactccatacaaaatatacgaggaatggttgtgtagaacattatccggcaggaattgctcacttcttagaacataaattatttgaactggataaaggacaagacgctgcaactcaatttactaaatatggcgccgagagtaacgcctttacaacttttgataaaactagtttttatttttcaactataagtcacattacaaactgcttagatatactacttgactttgtattgacaacaaactttacagaagagtcaattactaaagaaaaagatattatcaaacaagaaattgaaatgtatcaagatgacccagaatataggctttatcaaggagtgttatcgaacctttaccccaactctccattagcatttgatatcgctggagattaccaatcaatctctcaaataaccttaaccgatttacaagaaaatcacaaagacttttatcagttgtctaatatgaatttagttcttgttggacaatttagtccacaagaaattataacttaccttcaaaaaaattctcatttcacaagttactcacagaatattgaccgagattctattagccttgagcctgttataaaaaacaactcttgccatatgacagtgacaaaacctaaattagctattggttatcgaaaatcaaatcatatgatacatggttcttacctaaaagagaaaatcggattacagctattttttgcaatgcttttaggatggacttctacaattaaccaagactggtacgaatctggtcaaattgatgattcttttgatatagaaattgaagttcatccagattttgagtgcgttattatttctttagatacgacagagccaattgctttttcaactcagttgaggttattgctaaaaaatgctttgcaatcatctgatcttaccgaaagccacttaaaaaacgttaagagagagctctatggcgattttttaagaagcttagattctattgaaaatctcgcaatgcaattcgtcacctatttatatgatggaaaaacgatgtatttggatttgccatctatcgttgaagaattagatttggaagatgtcattacgattggtaaggatttcttagataatgctgacacatctgacttcgttatttttccaaaatcttcg

SEQ ID NO: 3158 - protein, 427 aa, Streptococcus agalactiae
MTVNKITYQNLQEEVYKLTLESGLNVYLIPKPSFKETVGVLTANFGSLHTKYTRNGCVEHYPAGIAHFLEHKLFELDKGQDAATQFTKYGAESNAFTTFDKTSFYFSTISHITNCLDILLDFVLTTNFTEESITKEKDIIKQEIEMYQDDPEYRLYQGVLSNLYPNSPLAFDIAGDYQSISQITLTDLQENHKDFYQLSNMNLVLVGQFSPQEIITYLQKNSHFTSYSQNIDRDSISLEPVIKNNSCHMTVTKPKLAIGYRKSNHMIHGSYLKEKIGLQLFFAMLLGWTSTINQDWYESGQIDDSFDIEIEVHPDFECVIISLDTTEPIAFSTQLRLLLKNALQSSDLTESHLKNVKRELYGDFLRSLDSIENLAMQFVTYLYDGKTMYLDLPSIVEELDLEDVITIGKDFLDNADTSDFVIFPKSS

SEQ ID NO: 3159 - DNA, 1287 bp, Streptococcus pyogenes
atgacaaaattagtaaagataaactatcctaatattgacgaagacctttactatgtaaaattagaaaatggtttaactgtttattttataaaaaaaatagggtttttagaaaaaacagctatgttgacagtaggtttcggttctcttgacaataagttgacagtcgatgacgaatcacgagatgctccagcaggtattgcacactttttagaacataaactctttgaagatgaatcaggtggagatatttcattaaagtttacacagctaggagcagagacaaatgcctttacaactttcaaccaaacgagtttcttcttttcaacagctagtaaatttcaggaaaatttggaactccttcaatattttgttctttctgctaatataacagatgaatctgttagtagagaaaaaaaaataatcgggcaagaaattgatatgtatcaagatgatgctgactaccgtgcatatagtggaatccttcagaacttatttccaaaaacaagtttagctaatgatattgctggctcaaaagcatccattcaaaagatcacgaaaatattattggaaacgcatcatacttatttttaccaacctactaatatgagtctattcattgtcggtgatattgatattgacgaaacttttttagctattcaaaggtttcaaaccacattatcctatccagatagaaaaagggtaactgttgatcctttacactattatcctgtcattaaatcatcttctgttgacatggatgttactactgccaagctggttgttggttttcgagggtatctgaccttaactcagcattcactattaacgtatcgtattgccttgaagctatttttatcaatgcttataggttggacttctaaaatctatcatacgctatatgaagatggtaaaatagacgattcatttgatgtggatgttgaaattcatcataattttcaatttgtattaatatcacttgatacaccagagcctatcgcaatgtctaactatatccgtcaaaaattagctactataaagatatcaaaagagtttacaaatgagcacttaaatctattaaaaaaagaaatgtatggtgactttattcagagtttagactctatagaacatttaacccatcagttcagtctatacctgtctgattctgataaagaaacatattttgatattccaaaaattatagaaagactcactctaaaagatgttgttacaattggaaaagcattttttgaaaaagctgatgcttcagacttcacagtcttcccaaaa

SEQ ID NO: 3160 - protein, 429 aa, Streptococcus pyogenes
MTKLVKINYPNIDEDLYYVKLENGLTVYFIKKIGFLEKTAMLTVGFGSLDNKLTVDDESRDAPAGIAHFLEHKLFEDESGGDISLKFTQLGAETNAFTTFNQTSFFFSTASKFQENLELLQYFVLSANITDESVSREKKIIGQEIDMYQDDADYRAYSGILQNLFPKTSLANDIAGSKASIQKITKILLETHHTYFYQPTNMSLFIVGDIDIDETFLAIQRFQTTLSYPDRKRVTVDPLHYYPVIKSSSVDMDVTTAKLVVGFRGYLTLTQHSLLTYRIALKLFLSMLIGWTSKIYHTLYEDGKIDDSFDVDVEIHHNFQFVLISLDTPEPIAMSNYIRQKLATIKISKEFTNEHLNLLKKEMYGDFIQSLDSIEHLTHQFSLYLSDSDKETYFDIPKIIERLTLKDVVTIGKAFFEKADASDFTVFPK

SEQ ID NO: 3161 - DNA, 561 bp, Streptococcus agalactiae
atgtttccaaaaggagaatttatgatgaagaaagaaaatattccgaatctattaactgtagtcagaattttaatgattccgttatttatagtattaacttcagtaacaacaagtacaacttggcatattgttgcagctattgtatttgctattgcaagtttgaccgattacctagatggttatctagcacgtaaatggcaagtagtaacaaattttgggaaatttgcagacccattagctgataaaatgctagttatgagtgcttttatcatgttagttggactagacttagcaccagcttgggtttcagctattatcatttgtagagagttagcagttacaggtttgcgtttacttttagttgaaacaggtggaacagtacttgctgcagctatgccagggaaaataaagacggctactcaaatgtttgcagttatttttttgttagtacattggatgacacttggtaacatcatgttatacattgctctattctttaccttgtattcaggctacgactattttaaaggtgcaggcttcttatttaaggatacttttaaa

SEQ ID NO: 3162 - protein, 187 aa, Streptococcus agalactiae
MFPKGEFMMKKENIPNLLTVVRILMIPLFIVLTSVTTSTTWHIVAAIVFAIASLTDYLDGYLARKWQVVTNFGKFADPLADKMLVMSAFIMLVGLDLAPAWVSAIIICRELAVTGLRLLLVETGGTVLAAAMPGKIKTATQMFAVIFLLVHWMTLGNIMLYIALFFTLYSGYDYFKGAGFLFKDTFK

SEQ ID NO: 3163 - DNA, 540 bp, Streptococcus pyogenes
atgataaaaaaagaaaatattcctaatctattaactcttgttcgaatcgcaatgattcctttctttctttttattacttcctcatctaataaggtggggtggcatatttttgcagctgtgatttttgcaattgccagttttaccgattatctagatgggtatcttgcgcgtaagtggcatgtagccagtaattttggaaagtttgccgatcctctagcagataagatgcttgtcatgagtgcctttatcatgttagttggacttggcttagttcctgcgtgggtgtcagctgttattatttgccgagaattggcagtaactggtcttcgattactacttgttgaaaccggaggaaaggtccttgcagctgctatgccgggaaaaatcaaaacagcgacacaaatgttgtctattattttattactttgccattggatattcctaggaaacgtcttactctatattgctctttttttcactatttattctggatatgattattttaaaggagcaagctttctttttaaggatacgtttaaa

SEQ ID NO: 3164 - protein, 180 aa, Streptococcus pyogenes
MIKKENIPNLLTLVRIAMIPFFLFITSSSNKVGWHIFAAVIFAIASFTDYLDGYLARKWHVASNFGKFADPLADKMLVMSAFIMLVGLGLVPAWVSAVIICRELAVTGLRLLLVETGGKVLAAAMPGKIKTATQMLSIILLLCHWIFLGNVLLYIALFFTIYSGYDYFKGASFLFKDTFK

SEQ ID NO: 3165 - DNA, 837 bp, Streptococcus agalactiae
atgacaaatattattaccgttaataatctcttttttaaatatgatagtaatcaaacacattatcaattggagaatgtatcgtttcatgtgaaacaaggagaatggctatctattattggtcataatggttctgggaaatccactactgttcgtttaatagatggacttttagaggcggagtctggccagattatcattgatggacaagagttaaccgaagataatgtctgggagttacgtcacaagattggcatggtatttcaaaatcctgataaccaatttgtaggggcaactgttgaagatgacgtcgcctttggtttggaaaataaaggtattcctttgaaagacatgaaagaaagagtggaccaagcacttgatttggtaggaatgtctgaatttaaaatgagggagcctgcacgtttatctggaggacaaaagcagcgtgtagccattgcaggagctgtagctatgcgtccacaagttatcatcttggatgaggcgactagtatgcttgatcctgagggacgattggaactgataagaacgatacgagctattcgtcaaaaatataatcttactgttatttcaattacacacgacttagatgaagttgcattgagtgatcgtgtcatcgttatgaaaaatggtaaagttgagtcgacatccactccaaaagcgttatttggtcgtggaaatcgtttgattagtttaggtttagatgttccctttacaagtaggttaatggcagaactggctgctaatggtcttgatatagggacagagtatcttacagagaaggaattagaagaacaattatgggaattgaatttaaaaatg

SEQ ID NO: 3166 - protein, 279 aa, Streptococcus agalactiae
MTNIITVNNLFFKYDSNQTHYQLENVSFHVKQGEWLSIIGHNGSGKSTTVRLIDGLLEAESGQIIIDGQELTEDNVWELRHKIGMVFQNPDNQFVGATVEDDVAFGLENKGIPLKDMKERVDQALDLVGMSEFKMREPARLSGGQKQRVAIAGAVAMRPQVIILDEATSMLDPEGRLELIRTIRAIRQKYNLTVISITHDLDEVALSDRVIVMKNGKVESTSTPKALFGRGNRLISLGLDVPFTSRLMAELAANGLDIGTEYLTEKELEEQLWELNLKM

SEQ ID NO: 3167 - DNA, 888 bp, Streptococcus pyogenes
atgattattttaaaggagcaagctttctttttaaggatacgtttaaataacatgtcagctattattgaacttaaaaaagttacatttaattaccataaagaccaagaaaaaccaacattagatggcgtatcgtttcatgtgaaacaaggtgagtggctgtctatcattggccataatggatctggtaaatcaacgactattcggttaattgatggattattggaaccagaatcagggtctattattgttgatggagatctactaaccataactaatgtttgggaaattcgtcataaaattggtatggtctttcaaaaccctgataatcagtttgttggagcaactgttgaagatgatgttgcttttgggcttgaaaataaaggtattgcacatgaagatataaaagagagggttaatcatgctttagagttagtcggcatgcagaactttaaagaaaaagaaccagcccgtttatctggtggccaaaaacagcgcgtagctattgcaggtgcagttgctatgaagcctaaaattattattttagatgaagctactagtatgcttgaccctaaaggacgattagagttaatcaaaactataaaaaacatccgtgacgactaccagctgactgttatttccattactcatgacttagatgaagttgctcttagtgatagagttttagtgatgaaagatggtcaagtggaatcaacatcaacaccagaacaattatttgcaagaggggatgaactactccaattaggtcttgatatcccttttacaacatctgttgtacagatgcttcaagaagaaggttatcctgttgactatggatatctcacagaaaaggaattagaaaatcagttatgtcaattaatctccaaaatg

SEQ ID NO: 3168 - protein, 296 aa, Streptococcus pyogenes
MIILKEQAFFLRIRLNNMSAIIELKKVTFNYHKDQEKPTLDGVSFHVKQGEWLSIIGHNGSGKSTTIRLIDGLLEPESGSIIVDGDLLTITNVWEIRHKIGMVFQNPDNQFVGATVEDDVAFGLENKGIAHEDIKERVNHALELVGMQNFKEKEPARLSGGQKQRVAIAGAVAMKPKIIILDEATSMLDPKGRLELIKTIKNIRDDYQLTVISITHDLDEVALSDRVLVMKDGQVESTSTPEQLFARGDELLQLGLDIPFTTSVVQMLQEEGYPVDYGYLTEKELENQLCQLISKM

SEQ ID NO: 3169 - DNA, 840 bp, Streptococcus agalactiae
atgggaattgaatttaaaaatgtaagttatacctatcaagccggcactccttttgaagggcgtgccctttttgacgtcaatctgaaaattgaagatgcttcctataccgcgttcattgggcacacaggttctggaaaatcaactattatgcaacttttgaatggtttacatattcctacaaaaggtgaggtaattgtcgatgatttttctattaaagcaggggacaagaacaaagaaatcaaatttataaggcaaaaagttggtttagtttttcaatttccagaaagtcagctttttgaagagacagttttaaaggatgttgcttttggaccacaaaattttggtatttctcagattgaagctgaaaggctggctgaagaaaaattaaggttagttggtatcagtgaggatttattcgataaaaatccatttgaactttctggagggcagatgaggcgggttgctatagctggtattttagcgatggaacccaaagtactagtactggatgagccaacagctggacttgatcctaagggaagaaaagaattaatgactctttttaaaaatcttcataaaaaaggaatgactatcgtcttagtgactcacttaatggacgatgtagcggattatgctgactatgtgtatgttttagaagcagggaaagtaaccttatcaggacaaccaaaacagatttttcaagaagtagaacttttagaaagtaaacaattaggagttcccaaaatcaccaagtttgctcaaagactatctcataagggattaaatttacctagtttaccaattactattaacgaatttgtggaggctattaagcatgga

SEQ ID NO: 3170 - protein, 280 aa, Streptococcus agalactiae
MGIEFKNVSYTYQAGTPFEGRALFDVNLKIEDASYTAFIGHTGSGKSTIMQLLNGLHIPTKGEVIVDDFSIKAGDKNKEIKFIRQKVGLVFQFPESQLFEETVLKDVAFGPQNFGISQIEAERLAEEKLRLVGISEDLFDKNPFELSGGQMRRVAIAGILAMEPKVLVLDEPTAGLDPKGRKELMTLFKNLHKKGMTIVLVTHLMDDVADYADYVYVLEAGKVTLSGQPKQIFQEVELLESKQLGVPKITKFAQRLSHKGLNLPSLPITINEFVEAIKHG

SEQ ID NO: 3171 - DNA, 840 bp, Streptococcus pyogenes
atgtcaattaatctccaaaatgtaagttatacttatcaagcagggactccttttgaagggcgtgccctttttaacattaatttagatattttagatggttcttatacggcttttatcggacatactggatccgggaaatcgaccattatgcaattgctaaatggtttacacgttccgacaacgggaattgtcagcgtagataaacaagatataacgaatcactctaaaaataaagagattaaatctattcgaaaacatgtaggattagtttttcaatttccagaaagtcaactatttgaagagacagttttgaaagatgttgcttttggccctcaaaattttggggtctctccggaggaagcagaagctttagcgcgtgaaaaactagctcttgttgggatttcagaaaatctttttgaaaagaatccatttgaactctcagggggtcaaatgcgtcgtgttgctattgcgggtatccttgctatgcagccaaaggttttagttttagatgaaccgactgctggtcttgatcctaaagggcgtaaagaattaatgactatttttaaaaagttacaccaatctggcatgactattgttttagtaacccatctgatggatgatgtggccaattacgcagattttgtatatgttcttgacaaaggtaaaattattttatcaggaaaacccaaaacaatttttcaacaagtcagtttgcttgagaaaaaacagttaggagttcctaaggtgactaaacttgctcaaaggcttgttgatagaggaatacctatctcttctttgcctattaccttagaggagctaagagaggtactaaaacatgga

SEQ ID NO: 3172 - protein, 280 aa, Streptococcus pyogenes
MSINLQNVSYTYQAGTPFEGRALFNINLDILDGSYTAFIGHTGSGKSTIMQLLNGLHVPTTGIVSVDKQDITNHSKNKEIKSIRKHVGLVFQFPESQLFEETVLKDVAFGPQNFGVSPEEAEALAREKLALVGISENLFEKNPFELSGGQMRRVAIAGILAMQPKVLVLDEPTAGLDPKGRKELMTIFKKLHQSGMTIVLVTHLMDDVANYADFVYVLDKGKIILSGKPKTIFQQVSLLEKKQLGVPKVTKLAQRLVDRGIPISSLPITLEELREVLKHG

SEQ ID NO: 3173 - DNA, 810 bp, Streptococcus agalactiae
ttgtggaggctattaagcatggataaattgattttgggacgttacataccaggtaattctctcattcataaattagatcctcgaagtaagttactagccatgttgctttttatcattattgttttttgggcaaataatgtagtgacaaatgtgatcgtattcatttttacgttggttattgtgggtttatctcagataaaattttcctattttttcaatggtattaaaccgatggttggtattattttatttacaaccctcttccagatgctgtttgcacaaggcgggcaggttatcttctcgttttggatttttagcatcactagccttgggttacaacaagcagcacttatttttatgagatttgttttaattatcttcttttcgacattacttaccttaactactactccgttaagtttagcagatgctgttgaatctttgttaaaaccattggaagtactgagagtaccagcacacgagattggtttgatgttatcccttagcttacgtttcgttcctactttaatggatgatacaacacgtatcatgaatgctcaaagagctcgtggagttgattttggagagggaaacctaattcataaggttaagtctattatccctattttgattccattatttgcttctagttttaaaagagcagatgcgttggcaattgctatggaagcaagaggttatcaaggcggagccaatcgtagtaagtaccgtttattgaagtggactgttcgggatacttttagtatattacttatgttattattgggtttgagtttgtttctattaaaaaat

SEQ ID NO: 3174 - protein, 270 aa, Streptococcus agalactiae
MWRLLSMDKLILGRYIPGNSLIHKLDPRSKLLAMLLFIIIVFWANNVVTNVIVFIFTLVIVGLSQIKFSYFFNGIKPMVGIILFTTLFQMLFAQGGQVIFSFWIFSITSLGLQQAALIFMRFVLIIFFSTLLTLTTTPLSLADAVESLLKPLEVLRVPAHEIGLMLSLSLRFVPTLMDDTTRIMNAQRARGVDFGEGNLIHKVKSIIPILIPLFASSFKRADALAIAMEARGYQGGANRSKYRLLKWTVRDTFSILLMLLLGLSLFLLKN

SEQ ID NO: 3175 - DNA, 798 bp, Streptococcus pyogenes
atggataagctgattcttggtcgttatattcccggagattctctcattcatcgtcttgacccaagaagtaaattattagcgatgattatttatattgtcattatcttttgggctaacaatgttgtgacaaatttgttgatgttgacttttactttagcagttgtttttttgtcaaaaatcaagttgtctttctttttaaatggggttaaaccaatgattggtattatcctcttcacgactttatttcagatgtttttctcacaaggaggaaaagtaatttttagttggtggttcattagcataactgatttaggattgagccaagctattttaatttttatgcgtttcgttctaattattttcttttcaacgctgttaacgttgacgacaacacctttaagcctatctgatgcagttgaatcattattaaaacctttaacaagatttaaagttccagctcacgagatcggactaatgctttctttaagtttacgttttgtgcctactttaatggatgataccacgcgtattatgaatgcacaaagggcccgtggagttgattttggagagggaaatttaattcaaaaagttaaatccattattcctattttaatccctcttttcgcttcaagctttaaaagagccgacgcattagctattgctatggaagctagaggttatcagggaggagaagggcgaactaaatatcgtcaattagactggcagctaaaagatagtttagctattggaatagtttctttattgggtttgctactttttttcttgaaaacctctttg

SEQ ID NO: 3176 - protein, 266 aa, Streptococcus pyogenes
MDKLILGRYIPGDSLIHRLDPRSKLLAMIIYIVIIFWANNVVTNLLMLTFTLAVVFLSKIKLSFFLNGVKPMIGIILFTTLFQMFFSQGGKVIFSWWFISITDLGLSQAILIFMRFVLIIFFSTLLTLTTTPLSLSDAVESLLKPLTRFKVPAHEIGLMLSLSLRFVPTLMDDTTRIMNAQRARGVDFGEGNLIQKVKSIIPILIPLFASSFKRADALAIAMEARGYQGGEGRTKYRQLDWQLKDSLAIGIVSLLGLLLFFLKTSL

SEQ ID NO: 3177 - DNA, 822 bp, Streptococcus pyogenes
gtggcaaccaattcaattattgccgacatgacaaaagctattgctggtgataaaatcgatctgcacagcattgtgccaatcggtcaagaccctcatgagtacgaaccattaccagaagatgttgaaaaaacaagtaatgctgatgtgattttctataatggtatcaatctagaagatggcgggcaagcttggttcaccaaactagtgaaaaatgctcaaaaaacgaaaaacaaagattactttgccgtgtctgatggcattgatgtgatttacttggaaggtgcaagcgaaaaaggaaaagaagatccacatgcttggttaaatctcgaaaacggaatcatttattcaaaaaacattgccaaacaattgattgcaaaggatcctaaaaacaaagaaacttatgaaaagaacctaaaagcttatgtggctaaattggaaaaactagacaaagaagccaaatcaaaatttgatgctattgcagaaaataaaaaattgattgtgactagtgaaggctgcttcaagtacttttcaaaagcttacggtgtcccatctgcttatatctgggaaattaacaccgaagaagaaggaacaccagatcaaatttcatcattgattgaaaaactaaaagtcatcaagccatctgcgctttttgtagagtcaagtgtcgatagacgccctatggaaactgtttctaaagatagtggtattcctatttattctgagatctttacagattcaattgctaaaaaaggtaaacctggcgatagttattatgctatgatgaaatggaaccttgacaaaatttctgaaggtctagcaaaa

SEQ ID NO: 3178 - protein, 274 aa, Streptococcus pyogenes
VATNSIIADMTKAIAGDKIDLHSIVPIGQDPHEYEPLPEDVEKTSNADVIFYNGINLEDGGQAWFTKLVKNAQKTKNKDYFAVSDGIDVIYLEGASEKGKEDPHAWLNLENGIIYSKNIAKQLIAKDPKNKETYEKNLKAYVAKLEKLDKEAKSKFDAIAENKKLIVTSEGCFKYFSKAYGVPSAYIWEINTEEEGTPDQISSLIEKLKVIKPSALFVESSVDRRPMETVSKDSGIPIYSEIFTDSIAKKGKPGDSYYAMMKWNLDKISEGLAK

SEQ ID NO: 3179 - DNA, 702 bp, Streptococcus agalactiae
atgaataaaagaagaaaattatcaaaattgaatgtaaaaaaacatcatttagcttatggagctatcactttagtagcccttttttcatgtattttggctgtaatggtcatctttaaaagttcacaagttactactgaatctttgtcaaaagcagataaagttcgcgtagccaaaaaatcaaaaatgactaaggcgacatctaaatcaaaagtagaagatgtaaaacaggctccaaaaccttctcaggcatctaatgaagccccaaaatcaagttctcaatctacagaagctaattctcagcaacaagttactgcgagtgaagaggcagctgtagaacaagcagttgtaacagaaaacacccctgctaccagtcaggcacaacaagcttatgctgttactgagacaacttatagacctgctcaacaccagacgagtggccaagtattgagtaatggaaatactgcaggggctattggctcagcagctgcagcacaaatggctgctgcaacaggagtccctcagtctacttgggaacatattattgcccgtgaatcaaatggtaatcctaatgttgctaatgcctcaggagcttcaggacttttccaaacgatgccaggttggggttcaacagctacagttcaggatcaagttaattcagctattaaagcttatcgtgctcaaggtttatcagcttggggttac

SEQ ID NO: 3180 - protein, 234 aa, Streptococcus agalactiae
MNKRRKLSKLNVKKHHLAYGAITLVALFSCILAVMVIFKSSQVTTESLSKADKVRVAKKSKMTKATSKSKVEDVKQAPKPSQASNEAPKSSSQSTEANSQQQVTASEEAAVEQAVVTENTPATSQAQQAYAVTETTYRPAQHQTSGQVLSNGNTAGAIGSAAAAQMAAATGVPQSTWEHIIARESNGNPNVANASGASGLFQTMPGWGSTATVQDQVNSAIKAYRAQGLSAWGY

SEQ ID NO: 3181 - DNA, 612 bp, Streptococcus pyogenes
atgtttaagaaagaaaatttaaaacaacgttattttaattttggattagtagcgttagctctaacaatattagccatcatttttgccttctcaagtaaaaatgctgatactaagtcttatgctaagaagtcagaaagtaaaatggtaacaatcgacaaggctccaaaaaataatcatgctattactaaagaagaaagcaaagaaaaagcaaagagcattgcttcggagcctattcccacagtagaaaactctgtagctccgacagtaacagaggaagtaccggttgttcagcaagaagtgactcaaactgttcagcaggtatcttcagtagcctataatccaaacaatgtggtactttccaatggaaatactgctggtattgtaggaagtcaagcggcggcacagatggcagcagcaacaggtgttccacaatcaacttgggaacatataattgcgcgtgaatctaatggaaatcctaacgcagctaatgcttctggggcatcagggttgttccagacaatgccaggttggggttctacagcaacggttgaagatcaagtcaatgcagccttgaaagcctatagtgcacaaggtttatcagcttggggttac

SEQ ID NO: 3182 - protein, 204 aa, Streptococcus pyogenes
MFKKENLKQRYFNFGLVALALTILAIIFAFSSKNADTKSYAKKSESKMVTIDKAPKNNHAITKEESKEKAKSIASEPIPTVENSVAPTVTEEVPVVQQEVTQTVQQVSSVAYNPNNVVLSNGNTAGIVGSQAAAQMAAATGVPQSTWEHIIARESNGNPNAANASGASGLFQTMPGWGSTATVEDQVNAALKAYSAQGLSAWGY

SEQ ID NO: 3183 - DNA, 870 bp, Streptococcus agalactiae
atgttttatacaattgaagagctggtagagcaagctaatagccaacataagggtaacatagcagagctcatgatccaaacggaaattgaaatgactggtagaagtcgtgaagaaattcgttatattatgtcccgaaatcttgaagtcatgaaagcttctgttattgatggattaacccctagtaaatcaatcagtggtttaacaggcggtgatgctgtcaagatggatcaatatttacaatcaggaaaaactatttcagataccacaatcctagctgccgttaggaatgctatggctgttaatgagttaaatgctaagatgggactggtctgtgcaacaccaactgcaggtagtgcaggatgtttaccagctgtgatttctacagccattgaaaagcttaatttaacagaagaagagcaacttgattttctatttacagccggcgcatttggtctcgtcattggtaataatgcctctatctcaggtgcagaaggaggttgccaagctgaagttgggtcagctagtgctatggctgcggctgctttagttatggctgctggaggtactcctttccaagctagccaagctatagcatttgttattaaaaatatgcttggacttatctgtgaccctgttgcaggtttagttgaagtcccttgtgtgaagcggaatgctcttggatcaagttttgcacttgttgctgctgatatggccttggctggtattgaatcgcaaattccagtagatgaagttattgatgcaatgtatcaagttggatcaagtttaccgactgcttttcgtgagactgcagaaggaggacttgctgccacgccgacaggaagacgttatagtaaagaaatttttggggaa

SEQ ID NO: 3184 - protein, 290 aa, Streptococcus agalactiae
MFYTIEELVEQANSQHKGNIAELMIQTEIEMTGRSREEIRYIMSRNLEVMKASVIDGLTPSKSISGLTGGDAVKMDQYLQSGKTISDTTILAAVRNAMAVNELNAKMGLVCATPTAGSAGCLPAVISTAIEKLNLTEEEQLDFLFTAGAFGLVIGNNASISGAEGGCQAEVGSASAMAAAALVMAAGGTPFQASQAIAFVIKNMLGLICDPVAGLVEVPCVKRNALGSSFALVAADMALAGIESQIPVDEVIDAMYQVGSSLPTAFRETAEGGLAATPTGRRYSKEIFGE

SEQ ID NO: 3185 - DNA, 870 bp, Streptococcus pyogenes
atgttttatactattgaagaacttgtcaaacaagctgaccaacaatttaatggaaatattgctgaactcatgattgccacggaagtggagatgtctggaagaaatcgagaagatattatcaaaatcatgtcacgcaatttacaagttatgaaagcagctgtaacagaaggactaacctcaaccaaatctatcagtggtttgacagggggcgatgcggtcaaaatggataactacattaaaaaagggaacagcctttctgatactactattcttaatgctgttagaaatgctatagctgtaaacgaattaaatgctaaaatgggacttgtctgtgcaacacccactgcaggaagtgcaggatgcttaccagcagtgctcgcaacagctattgaaaaacttgacttatcagaaaaagaacaattagagtttttatttactgcaggagcttttggtcttgttattggaaataacgcctctatttctggtgcagaaggtggatgccaagcagaagttggttctgcagctgctatgagtgcagctgctcttgttaaagcagccggtggaacatctcatcaagctagtcaagctattgcgtttgttatcaaaaatttattaggacttgtctgtgatcctgttgccggcctagtagaagtgccttgtgtcaaacgcaatgccctaggagcaagtttcgcccttgtcgcagctgatatggctttagctgatattgattctcaaattcctgttgacgaagttattgatgctatgtatcaagtcggctctgccatgccaactgctttccgtgaaacagcagaaggtggtttagccgctactccaactggacgacgttacagcgtagaaatatttggcgaa

SEQ ID NO: 3186 - protein, 290 aa, Streptococcus pyogenes
MFYTIEELVKQADQQFNGNIAELMIATEVEMSGRNREDIIKIMSRNLQVMKAAVTEGLTSTKSISGLTGGDAVKMDNYIKKGNSLSDTTILNAVRNAIAVNELNAKMGLVCATPTAGSAGCLPAVLATAIEKLDLSEKEQLEFLFTAGAFGLVIGNNASISGAEGGCQAEVGSAAAMSAAALVKAAGGTSHQASQAIAFVIKNLLGLVCDPVAGLVEVPCVKRNALGASFALVAADMALADIDSQIPVDEVIDAMYQVGSAMPTAFRETAEGGLAATPTGRRYSVEIFGE

SEQ ID NO: 3187 - DNA, 666 bp, Streptococcus agalactiae
atgaaacatttaaaatttcaatcggtcttcgacattattggtcctgttatgattggaccatcaagtagtcatactgcaggagctgtccgcattggtaaagttgtccattctatttttggtgaacctagtgaagtaacctttcatttatacaattcttttgctaaaacttaccaaggacacggtactgataaagcattggttgcagggattctaggaatggatacagataatccagatattaaaaactctcttgaaattgctcatcaaaaaggaattaagatttactgggatatcctaaaagatagtaattcaccacatccaaatactgcgaaaataactgttaaaaatggggataggagcatgagtattacaggagtgtcaattggtggcggaaacatccaagttactgagttgaatggattctcagtttcattaacaatgaatactcctactttaattatcgttcatcaagatatacctggcatgattgctaaagtaactgatattttatctgactttaacattaatattgctcaaatgaatgtaacacgcgaaagtgcaggagaaaaagctatcatgattatagaagtagattcacgagattgtcaacaagctgtcaaaaagatagaagctattcctcatttacacaatgtcaacttctttgat

SEQ ID NO: 3188 - protein, 222 aa, Streptococcus agalactiae
MKHLKFQSVFDIIGPVMIGPSSSHTAGAVRIGKVVHSIFGEPSEVTFHLYNSFAKTYQGHGTDKALVAGILGMDTDNPDIKNSLEIAHQKGIKIYWDILKDSNSPHPNTAKITVKNGDRSMSITGVSIGGGNIQVTELNGFSVSLTMNTPTLIIVHQDIPGMIAKVTDILSDFNINIAQMNVTRESAGEKAIMIIEVDSRDCQQAVKKIEAIPHLHNVNFFD

SEQ ID NO: 3189 - DNA, 675 bp, Streptococcus pyogenes
ttgcctatgaatacacaaaaatttcaatcagtttttgacatcattgggccagtaatgattggtccatcaagtagtcacacagctggtgccgtcagaattggtaaggtagtccattccatctttggagatattcctgatgaagtgacgtttcacctttataattcatttgctaaaacctacagaggacatggtactgataaggctcttgttgcaggaattatgggtatgggtactgataatcctgatattaaaaattctctagaaattgctcatcaaaaagggataaaaatctattgggatatcttaaaagatagtaatgctccccatcccaatactgttaaaatcagtgtcaaaaaagctgacaaaacacttagtgttactggtgtttcaattggaggaggaaacattcaagtaacagaactaaatggtttttctgtctcgttatccatgaatactcctactatagttactgtacacaaagatattcccggaatgatcgcaaaggtaactgatatcctatcttccaataatattaatatcgccacaatgaatgttacacgtgaatccgctggtgaaaaagctactatgattatagaagtcgattctagagagtgccaagaagcagccaaccaaattgcaaaaattcctcatatttataatgtcaacttctttgac

SEQ ID NO: 3190 - protein, 225 aa, Streptococcus pyogenes
LPMNTQKFQSVFDIIGPVMIGPSSSHTAGAVRIGKVVHSIFGDIPDEVTFHLYNSFAKTYRGHGTDKALVAGIMGMGTDNPDIKNSLEIAHQKGIKIYWDILKDSNAPHPNTVKISVKKADKTLSVTGVSIGGGNIQVTELNGFSVSLSMNTPTIVTVHKDIPGMIAKVTDILSSNNINIATMNVTRESAGEKATMIIEVDSRECQEAANQIAKIPHIYNVNFFD

SEQ ID NO: 3191 - DNA, 1191 bp, Streptococcus agalactiae
atgattgatctaagaacaacttggcccttcaagcctaagttaaaaataaaactttttgatgggagaattcttatgactgataattcaaacattcgtgtcgttgtaggcatgagtggaggtgttgattcatcagtaactgccctgcttttaaaagagcaaggttatgatgttattggtgtttttatgaaaaattgggatgacacagatgaatttggtgtttgtacggctactgaagattataaagatgttgctgctgttgctgatcagatcggcataccatactactctgtcaactttgaaaaagagtattgggacagggttttcgaatattttttagcagaatatcgagcaggtcgtacgccaaatccagatgttatgtgtaataaggaaattaaatttaaagcatttctagattatgcgatgacattaggtgctgactatgtagcaacaggtcattatgcacaagtaacacgtgatgagaacggaatagttcatatgcttagaggagcagataataataaggatcaaacttattttctaagtcaattatctcaggagcaattgcaaaaaacgttatttccacttggtcatttacaaaaaccagaagttcgccgtatagctgaagaagcaggacttgcgaccgctaagaaaaaagactctactggtatttgttttattggagaaaaaaatttcaaggatttcctgggtcaatatttaccggctcaaccaggtcgtatgatgactgttgatggtcgtgacatgggtgaacatgctggtttaatgtattatactattggtcaaagagggggccttggtattggtgggcaacatggtggagataataaaccttggtttgtagttggaaaggatttaagtaaaaacattctttatgtaggtcaaggtttctatcatgactcattgatgtcaactagcttgacagcttctgaaatccactttacacgtgatatgcctaatgaatttaagctagaatgtacagctaagttcagatatcgtcaacctgacagtaaagttacagtttacgtaaaaggtaatcaagcaagggttgtgtttgatgatttacaacgagcaatcacaccaggtcaagctgttgttttttataatgaacaagaatgtttaggcggtgggatgattgatcaggcttatcgtgatgataaaatctgtcaatacatt

SEQ ID NO: 3192 - protein, 397 aa, Streptococcus agalactiae
MIDLRTTWPFKPKLKIKLFDGRILMTDNSNIRVVVGMSGGVDSSVTALLLKEQGYDVIGVFMKNWDDTDEFGVCTATEDYKDVAAVADQIGIPYYSVNFEKEYWDRVFEYFLAEYRAGRTPNPDVMCNKEIKFKAFLDYAMTLGADYVATGHYAQVTRDENGIVHMLRGADNNKDQTYFLSQLSQEQLQKTLFPLGHLQKPEVRRIAEEAGLATAKKKDSTGICFIGEKNFKDFLGQYLPAQPGRMMTVDGRDMGEHAGLMYYTIGQRGGLGIGGQHGGDNKPWFVVGKDLSKNILYVGQGFYHDSLMSTSLTASEIHFTRDMPNEFKLECTAKFRYRQPDSKVTVYVKGNQARVVFDDLQRAITPGQAVVFYNEQECLGGGMIDQAYRDDKICQYI

SEQ ID NO: 3193 - DNA, 1137 bp, Streptococcus pyogenes
ttgatgggagaattttttatgacagataactcaaagatacgtgttgtcgttggtatgagtggtggcgttgattcatctgtaacagctctacttttaaaggagcaaggttatgatgttattggtgtcttcatgaaaaactgggacgatacagatgaatttggtgtttgcacagctactgaagattacaaagatgtagcagccgttgctgataaaatcggtattccttactattcagtcaattttgaaaaagaatattgggacagagtatttgaatatttcttggccgaataccgagcaggtcgtactccaaatcctgatgtcatgtgtaataaggaaataaaatttaaagctttccttgactatgccatgactttaggtgcagattatgtagcaacgggacactatgctcaagtcaagcgtgatgaaaatggtacggttcacatgttacgtggagctgataatggcaaagaccaaacctactttttaagtcaactatcacaggaacaactacaaaagactttattcccccttggtcatttgcaaaagtcagaagttagagaaatcgctgagcgagcagggcttgcaacggctaaaaagaaagattcaacaggtatttgttttattggtgaaaagaatttcaaacagtttttgagccagtacttaccggcacaaaaaggtcgcatgatgactattgatggtcgcgatatgggagaacatgccggccttatgtattatactattggtcagcgtgggggtctgggcattggtggtcagcatggtggggataatcaaccttggtttgttgtcggtaaagatttgtcgcaaaatattttatacgttggtcaaggtttctaccatgaagccctaatgtcaaatagtcttgacgcctcagtcatccattttacacgtgagatgccagaagagttcacatttgaatgtactgctaaatttcgctatcgtcaacccgattcacacgtggcggtgcatgttcgaggagataaggcagaagttgtttttgcagagccacagcgcgcgattactcctggtcaagctgttgttttctatgacggaaaagaatgccttggtggtggtatgattgacatggcttataaaaatgggcagccttgtcagtacatt

SEQ ID NO: 3194 - protein, 379 aa, Streptococcus pyogenes
LMGEFFMTDNSKIRVVVGMSGGVDSSVTALLLKEQGYDVIGVFMKNWDDTDEFGVCTATEDYKDVAAVADKIGIPYYSVNFEKEYWDRVFEYFLAEYRAGRTPNPDVMCNKEIKFKAFLDYAMTLGADYVATGHYAQVKRDENGTVHMLRGADNGKDQTYFLSQLSQEQLQKTLFPLGHLQKSEVREIAERAGLATAKKKDSTGICFIGEKNFKQFLSQYLPAQKGRMMTIDGRDMGEHAGLMYYTIGQRGGLGIGGQHGGDNQPWFVVGKDLSQNILYVGQGFYHEALMSNSLDASVIHFTREMPEEFTFECTAKFRYRQPDSHVAVHVRGDKAEVVFAEPQRAITPGQAVVFYDGKECLGGGMIDMAYKNGQPCQYI

SEQ ID NO: 3195 - DNA, 609 bp, Streptococcus agalactiae
atgatttcaaaatttattttagctttcatggcttttttcgccattatgaatcccatttctaatttgccagcttttatggctttagtagctgatgatgatcagaagatttcacgtcggattgcagcaaaaggagtattacttgcttttgtcattattgtaatctttgtattaagtggccacttactttttaacttatttgggattaccctagccgccctaaaaatatctggtggaatattggtaggcattataggttataaaatgattaatggtatacattcaccaaccaataaaaacctagaggagcataaggatgatccaatgaatgtggcagtttcaccattagcaatgccccttttggcaggtccgggtactattgcaactgctatggggttatcaagtggtggtttatctggcaaactcattactatacttgcttttgccatattatgtgtgataatgtatgttattttaataagtgcaaacgaaattactaaatttcttggaaaaaatgcaatgactataatcaccaaaatgatgggacttattttgatgactatcgggatagagatgctaataacaggcataaaaattggttttcatttaaca

SEQ ID NO: 3196 - protein, 203 aa, Streptococcus agalactiae
MISKFILAFMAFFAIMNPISNLPAFMALVADDDQKISRRIAAKGVLLAFVIIVIFVLSGHLLFNLFGITLAALKISGGILVGIIGYKMINGIHSPTNKNLEEHKDDPMNVAVSPLAMPLLAGPGTIATAMGLSSGGLSGKLITILAFAILCVIMYVILISANEITKFLGKNAMTIITKMMGLILMTIGIEMLITGIKIGFHLT

SEQ ID NO: 3197 - DNA, 1839 bp, Streptococcus agalactiae
gtggaagctagtctagctgctagtcgtatgggatgtaagacacttctagccactatcaacttagaaatgttagcatttatgccttgtaatccttctataggtggctctgctaaaggtatcgttgtcagagagattgacgctttaggtggtgaaatgggtaaaaacattgataaaacctatatacaaatgaaaatgcttaatacaggtaaggggcctgctgtccgtgccttaagagcacaagctgataaagccctctatgcacaaacaatgaagcaaactgtagaaaagcaagaaaatcttaccttaagacaagctatgattgacgaaatacttgttgaagatggaaaggttgtgggggttcgtacagcaactaatcagaaattttcagcaaaatctgttgttataacaacaggtactgctcttcgaggagagattatattaggtgatcttaagtactcctcgggccctaataatagtttagcttctgtgacattggcagataatttaagagacctaggattagaaattggtcgtttcaaaactggaacacctcctcgtgtaaaagcctcctctattaattatgaaaagacagagatacaacctggggatgagcaaccaaatcatttttcatttatgtctagggatgaagattatattactgaccaggtaccgtgctggttgacctatacgaatactttgagtcatgacatcatcaatcaaaatctacaccgtgctcctatgttttctggaatcgttaagggagttggtcctagatattgtccgtcaattgaagataaaattgtgcgttttgctgataaagagcgccaccaactcttcttagaaccagaaggtagatacactgaagaagtttatgttcaagggctatcaacgagtcttcctgaggatgttcaagttgatttattacgttctataaaagggcttgaaaatgctgaaatgatgcgtacaggctatgctattgagtatgatattgtattgcctcatcaattaagagcaacactcgaaacaaaagtaattgctggtttgtttactgcaggacagactaatggtacttcaggttatgaagaagctgctggtcaagggttggttgctgggatcaacgctgctcttaaagttcaagggaagccagaacttattttaaaacgaagtgatgcttacattggtgtcatgattgatgatttagttaccaaagggactctagaaccatatcgtctgttgacaagtcgcgcagaatatcgtctgattcttcgtcatgataatgcagatatgcgtttaacagaaatcggttatgagattggcctagtagatgaagagcgttatgcgatatttaaaaagcgtcaaatgcaatttgaaaatgaattagaacgtttagactctataaagttaaagccagtttctgagacaaataaacggattcaagaattgggctttaaacctttgacagatgctttaactgccaaagaatttatgcgccgcccacaaatcacatatgcagtagcaacggattttgttggttgtgctgatgagccattagacagtaaggttattgaacttttggaaactgaaattaaatacgaaggctatattaaaaaggctttagatcaagttgcaaaaatgaaacgaatggaagaaaaacgtattccccctcatattgactgggacgacattgattctatcgcaacagaagctagacaaaaattcaaaaaaattaacccagaaacgctaggtcaggctagtcgtatttcaggagttaatccagccgatattagtattttaatggtttaccttgaaggaagacaaaaaggtcgtaaaaatatcaat

SEQ ID NO: 3198 - protein, 613 aa, Streptococcus agalactiae
MEASLAASRMGCKTLLATINLEMLAFMPCNPSIGGSAKGIVVREIDALGGEMGKNIDKTYIQMKMLNTGKGPAVRALRAQADKALYAQTMKQTVEKQENLTLRQAMIDEILVEDGKVVGVRTATNQKFSAKSVVITTGTALRGEIILGDLKYSSGPNNSLASVTLADNLRDLGLEIGRFKTGTPPRVKASSINYEKTEIQPGDEQPNHFSFMSRDEDYITDQVPCWLTYTNTLSHDIINQNLHRAPMFSGIVKGVGPRYCPSIEDKIVRFADKERHQLFLEPEGRYTEEVYVQGLSTSLPEDVQVDLLRSIKGLENAEMMRTGYAIEYDIVLPHQLRATLETKVIAGLFTAGQTNGTSGYEEAAGQGLVAGINAALKVQGKPELILKRSDAYIGVMIDDLVTKGTLEPYRLLTSRAEYRLILRHDNADMRLTEIGYEIGLVDEERYAIFKKRQMQFENELERLDSIKLKPVSETNKRIQELGFKPLTDALTAKEFMRRPQITYAVATDFVGCADEPLDSKVIELLETEIKYEGYIKKALDQVAKMKRMEEKRIPPHIDWDDIDSIATEARQKFKKINPETLGQASRISGVNPADISILMVYLEGRQKGRKNIN

SEQ ID NO: 3199 - DNA, 1896 bp, Streptococcus pyogenes
atgacacatgaatttacagaaagctatgacgtcattgtcataggtgcaggtcatgctggtgttgaagccagtttggccactagtcgtatgggttgtaaaactttattggcaacaatcaaccttgatatgttggcttttatgccgtgtaatccttctattggaggatctgccaaagggatagtggttagagagattgatgctcttggcggcgaaatgggtaaaaatattgataaaacttatatccagatgaaaatgcttaatacaggtaagggaccagctgtacgcgctctccgagctcaagcagataaatccctgtatgcgcgtgaaatgaaacatacggttgaaaaacaggctaatttgactcttcgccaaacgatgattgatgatattctagttgaagatggacgagttgtaggtgttttaacagccacaggacaaaaatttgcagctaaggcagttgtagtgacaacaggaacagctctgcgtggcgaaattattttaggagaactcaaatattcttctgggcctaataatagtttggcatcagtaaccttagcagataatttaaaaaaactcggcttagaaattggcagattcaaaacaggaacgcctcctcgtgtcaaagcatcttctattaattacgatcaaacggaaattcagccaggtgatgacaaacctaatcatttttcatttatgtcaaaagatgctgattatctcaaagatcaaattccctgctggttgacttatacgaatcaaactagtcatgatatcattaatcagaacctttacagagcaccgatgttttctggcattgttaaaggtgtaggccctcgttactgcccatctattgaagataagattgttcgctttgctgataaagaacgtcatcaacttttcttagagccagaggggcgtgatacagaagaagtgtatgttcaagggttgtcaacgagtcttccagaagatgtccaaaaagatttgattcattcgatcaaaggacttgaaaaggctgaaatgatgcgcactggttatgctattgaatatgatattgttttacctcaccagctacgtgccacacttgaaaccaagctaatttcaggactctttacggctgggcaaactaatggaacttctgggtatgaagaggctgctggccaaggacttattgctggaatcaatgctgctttgaaagttcaaggtaagccagaacttattttgaaacggagcgatgcctatattggcgttatgattgacgatttggttaccaaaggaaccttggaaccttatcgattgttgacatcgcgagctgagtatcgtttgattttacgtcatgacaacgctgatatgcgtttgacagagattggtcgcgacattgggttggttgatgatgagcgttggaaggccttcgaaattaagaaaaaccaatttgataacgaattaaaacgtctgaacagtatcaaattaaaaccgattaaagaaaccaatgaccgcgttcaagatctaggcttcaaaccgttaaccgatgcgatgactgctaaagaattcatgcgtcgtccagaaattgattatgcgactgcagtctcttttgttggtcctgcggctgaagatttagatgctaaaatcattgaacttttagaaacagaaatcaagtacgaaggctatattcgcaaagctttagatcaggttgctaagatgaaacgcatggaagaaaaacgtattcctacaaatattgattgggatgctattgattctattgcaactgaggcgcgtcagaaatttaagaaaattaatcctgaaacaattggacaagctagtcgtatttcaggagtcaatcctgcggacatcagtatcttgatgatttatttagaaggaaacggaaaagctcatcgaaaatat

SEQ ID NO: 3200 - protein, 632 aa, Streptococcus pyogenes
MTHEFTESYDVIVIGAGHAGVEASLATSRMGCKTLLATINLDMLAFMPCNPSIGGSAKGIVVREIDALGGEMGKNIDKTYIQMKMLNTGKGPAVRALRAQADKSLYAREMKHTVEKQANLTLRQTMIDDILVEDGRVVGVLTATGQKFAAKAVVVTTGTALRGEIILGELKYSSGPNNSLASVTLADNLKKLGLEIGRFKTGTPPRVKASSINYDQTEIQPGDDKPNHFSFMSKDADYLKDQIPCWLTYTNQTSHDIINQNLYRAPMFSGIVKGVGPRYCPSIEDKIVRFADKERHQLFLEPEGRDTEEVYVQGLSTSLPEDVQKDLIHSIKGLEKAEMMRTGYAIEYDIVLPHQLRATLETKLISGLFTAGQTNGTSGYEEAAGQGLIAGINAALKVQGKPELILKRSDAYIGVMIDDLVTKGTLEPYRLLTSRAEYRLILRHDNADMRLTEIGRDIGLVDDERWKAFEIKKNQFDNELKRLNSIKLKPIKETNDRVQDLGFKPLTDAMTAKEFMRRPEIDYATAVSFVGPAAEDLDAKIIELLETEIKYEGYIRKALDQVAKMKRMEEKRIPTNIDWDAIDSIATEARQKFKKINPETIGQASRISGVNPADISILMIYLEGNGKAHRKY

SEQ ID NO: 3201 - DNA, 1980 bp, Streptococcus agalactiae
atgaaaagatttcgttttgcaaccgtccatttagttttaataggcctgattttatttggactattagctatttgtgttaggttatttcaatcctatacggctctattattggctatttttgttgctttatcttttgttgttgccttattatattaccaaaagataacttatgaactatctgaagttgaacaaattgaattacttaatgatcaaacagaagtttctcttaagagtcttcttgaacaaatgccagttggtgttatacaatttgatcttgaaacaaatgatattgagtggtttaacccttatgcagaattgatttttactggggataatggtcattttcagtctgctactgttaaagatatcattactagtagacgtaatggaacggctgggcaatcatttgaatacggtgataacaaatattcagcttatttggatacagagacgggtgttttctatttcttcgataatttcatggggaatagaagaaactatgatagttcaatgctacgtccagttattggtattatttccattgataactacgatgatattatggatactatgttagaggctgatatgtcaaagattaacgccttcgtgactagttttatttctgattttacacagtctaaaaatattttttatcgtcgtgtcaatatggatcgatactatatttttaccgactatagcgttttaaatacattgataaaagataaatttgatattttaaatgagtttcgaaaacgcgctcaggaaaaccatttatcattaacattaagtatgggaatttcttatggtgatggtaaccataatcaaattgggcaaattgctttagaaaatcttaatacagcactcgttcgcggaggagatcaaatagtagtacgtgaaaatgatagtagtaaaaaagcactttactttggtggtggtgctgtttcaactattaaacgttcacgaacacgtaccagagctatgatgactgctatttctgaccgtttgaaagtagttgatagtgtctttattgtgggacacaggaaattggacatggatgcactaggtgcatctgtagggatgcaattttttgctagtaatattgttaatgccagttatgtagtttatgacccaaatgacatgaattctgatattgaaagagcaattgattacttgcaagaagacggcgaaacacgtctcgtaagtgttgagagagcttttgaattaattactcaaaattctttattagtcatggtagaccattctaaaacagctttaaccttatctaaggaattctttaacaagtttgcagatgttattgtggtagatcatcatagaagagatgaagattttccaaaaaatgctgttctttcatttatagaaagtggcgcaagtagtgccagcgaattagttacagaattgattcaatttcaacaagctaaagataaattaagccgcagtcaagcaagtattttaatggctggtatcatgcttgatacaagaaattttgcatctaatgtaacgagtagaacttttgatgtggcaagctatttacgcggtttaggtagtaatagtatggctattcaaaaaatatcagctacagattttgatgaatatcgtttaattaatgaattgattttaaaaggtgagcgtatttatgataacatcattgttgctaccggagaagaacataaagtttactcgcatgttatagctagtaaagcagctgacaccatgttgacaatggcaggtattgaggctacttttgttattactaaaaacagttcaaatattggtatttcagcgcgcagtagaaataatatcaatgtccagcgtattatggaaaaacttggtggtggcggacattttagttttgctgcttgtcaaatacaagacaagtctgtaaagcaagttagacgtatgttactggaaataattgacgaagatttaagagaaaatagtacagtcgaaaatagaagggat

SEQ ID NO: 3202 - protein, 660 aa, Streptococcus agalactiae
MKRFRFATVHLVLIGLILFGLLAICVRLFQSYTALLLAIFVALSFVVALLYYQKITYELSEVEQIELLNDQTEVSLKSLLEQMPVGVIQFDLETNDIEWFNPYAELIFTGDNGHFQSATVKDIITSRRNGTAGQSFEYGDNKYSAYLDTETGVFYFFDNFMGNRRNYDSSMLRPVIGIISIDNYDDIMDTMLEADMSKINAFVTSFISDFTQSKNIFYRRVNMDRYYIFTDYSVLNTLIKDKFDILNEFRKRAQENHLSLTLSMGISYGDGNHNQIGQIALENLNTALVRGGDQIVVRENDSSKKALYFGGGAVSTIKRSRTRTRAMMTAISDRLKVVDSVFIVGHRKLDMDALGASVGMQFFASNIVNASYVVYDPNDMNSDIERAIDYLQEDGETRLVSVERAFELITQNSLLVMVDHSKTALTLSKEFFNKFADVIVVDHHRRDEDFPKNAVLSFIESGASSASELVTELIQFQQAKDKLSRSQASILMAGIMLDTRNFASNVTSRTFDVASYLRGLGSNSMAIQKISATDFDEYRLINELILKGERIYDNIIVATGEEHKVYSHVIASKAADTMLTMAGIEATFVITKNSSNIGISARSRNNINVQRIMEKLGGGGHFSFAACQIQDKSVKQVRRMLLEIIDEDLRENSTVENRRD

SEQ ID NO: 3203 - DNA, 1974 bp, Streptococcus pyogenes
atgaaaaaatttcgttttgaaaccattcatttgattatgatgggattgattttatttggactgctggcactttgtgtcagtattatgcaatcaaaaatattaatattattagctatttttctcgttttgctatttgttgttgctcttttatggtatcaaaaagaagcttatcaattatcagacttagctcatattgagctcttaaatgaacaaacagaagataacctaaaaacgctacttgataatatgcctgttggagtagttcaatttgatcaagagaccaacgctgtagaatggtataatccttatgcagaattaatttttacaactgaagagggttttatacaaaacggtttgattcagcaaattattacggaaaaacgtcgtgaagatatttctcaaacatttgaagtttctggtaataaatacacttcttatattgatgtatcatcaggaattttttatttttttgatagctttgtgggaaacaggcaattagctgatgctagtatgttaagaccggttgttggcattatttcggttgataattatgatgatatcactgatgatttatcagatgcagatacctcaaaaattaattcatttgtagctaacttcattgatgagtttatggagtcaaaacggattttttaccgtcgtgttaatatggatcgctactatttctttacagactttaaaacattaaatgatttgatggataataaattttctgtcttagaagagtttcgtaaagaagctcaagatgctcagcgccctttaacactcagcataggaatttcttttggtgaagaaaatcatagccagattggacaggtagctcttgagaatcttaatattgcgcttgttcgtggtggtgatcagattgtcattcgtgaaaatgcggatcatacgaatccaatttatttcgggggagggtctgtttctacagttaaacgttcaagaacacgtacccgtgctatgatgacagctatttcagatcgaatcaagatggtggacaatgtttttattgttggacataggaaacttgatatggatgcactaggttcagctgttggtatgcaatttttcgcaggtaacattattgaaaatagttttgccgtttacaatccagatgagatgagtccagatattgaaagggctattgagcgattgcaggctgacggaaagactcgtctaatcagtgtttctcaagcaatgggtttagtgactccaagatcacttttagtaatggttgaccattctaagatatctttaacactttctaaagaattttatgaacagtttcaaaatgttattgtagttgatcatcacagaagagatgatgattttcctgataatgctatcttaacttttattgaaagtggagcaagtagtgctgcggagctcgtcactgagttaattcaatttcaaaatgctaaaaaatgtttaaataagatccaagccagtgttttaatggcaggtattatgcttgatactaaaaatttttctacgcgagtgacaagtcgtacctttgatgtcgctagttacttaagaagcaaaggaagtgatagtgttgaaattcaaaatatatccgcaacagattttgaagaatataagcaaataaatgaaattattttacaaggagaacgtcttggtgacagtatcattgtagctgcaggagaaaaaaatcatctttatagcaatgttattgctagtaaagctgcagatacgatactgtcaatggctcacgttgaggctagctttgtattagttgaaacagcttctcataagattgctatttcagctagaagtcgtagtaaaatcaatgttcaacgtgtgatggaaaaattaggtggaggaggccactttaatcttgctgcctgtcagttaacggatatcagtcttccccaagcgaagtacttattattgaaaactattaatatgacaatgaaagaaacaggagaagtagaatca

SEQ ID NO: 3204 - protein, 658 aa, Streptococcus pyogenes
MKKFRFETIHLIMMGLILFGLLALCVSIMQSKILILLAIFLVLLFVVALLWYQKEAYQLSDLAHIELLNEQTEDNLKTLLDNMPVGVVQFDQETNAVEWYNPYAELIFTTEEGFIQNGLIQQIITEKRREDISQTFEVSGNKYTSYIDVSSGIFYFFDSFVGNRQLADASMLRPVVGIISVDNYDDITDDLSDADTSKINSFVANFIDEFMESKRIFYRRVNMDRYYFFTDFKTLNDLMDNKFSVLEEFRKEAQDAQRPLTLSIGISFGEENHSQIGQVALENLNIALVRGGDQIVIRENADHTNPIYFGGGSVSTVKRSRTRTRAMMTAISDRIKMVDNVFIVGHRKLDMDALGSAVGMQFFAGNIIENSFAVYNPDEMSPDIERAIERLQADGKTRLISVSQAMGLVTPRSLLVMVDHSKISLTLSKEFYEQFQNVIVVDHHRRDDDFPDNAILTFIESGASSAAELVTELIQFQNAKKCLNKIQASVLMAGIMLDTKNFSTRVTSRTFDVASYLRSKGSDSVEIQNISATDFEEYKQINEIILQGERLGDSIIVAAGEKNHLYSNVIASKAADTILSMAHVEASFVLVETASHKIAISARSRSKINVQRVMEKLGGGGHFNLAACQLTDISLPQAKYLLLKTINMTMKETGEVES

SEQ ID NO: 3205 - DNA, 450 bp, Streptococcus agalactiae
atgaaagttatttttttacaagatgttaaggggaaaggaaaaaaaggtgaggttaaggaagtacctactggttatgctcaaaacttcttattaaaaaagaatctagctaaagaagcaacgacacaagctatcggtgaattaaaaggaaaacaaaagtccgaagaaaaagcacaagcagaaattttagcacaggcaaaggagctgaaaacacaattagaatccgaaactacccgagtgcaatttattgaaaaggtaggtccagatggtcgtacgtttggttctatcacagccaaaaagattgctgaagagttacaaaaacaatacggcattaaaattgacaaacgtcatattgatttagatcatactattagagcgattggtaaggttgaagtaccagtaaaattacataaacaggtttcttcacagattaagcttgatatcaaagaagcg

SEQ ID NO: 3206 - protein, 150 aa, Streptococcus agalactiae
MKVIFLQDVKGKGKKGEVKEVPTGYAQNFLLKKNLAKEATTQAIGELKGKQKSEEKAQAEILAQAKELKTQLESETTRVQFIEKVGPDGRTFGSITAKKIAEELQKQYGIKIDKRHIDLDHTIRAIGKVEVPVKLHKQVSSQIKLDIKEA

SEQ ID NO: 3207 - DNA, 450 bp, Streptococcus pyogenes
atgaaagttatttttttagcagatgtaaaaggaaaaggtaaaaaaggagaaatcaaagaggtcccaacaggctatgctcaaaatttccttattaagaaaaatttagctaaagaagcaactagtcaaagcatcggtgaattaaaaggaaaacaaaaagctgaagaaaaagctcaagctgaaatattagcagaagctcaagctgtcaaggctgttttggatgaggacaaaacacgtgttcaatttcaagaaaaagttggtccagatggacgtacatttggttccatcacagctaaaaagatttcagaagaattgcaaaagcaatttggtgtaaaagttgataaacgtcatattgttttagatcatcctatccgcgccattggtctaattgaagttcctgtgaaattacataaggaagtaacagctgagattaaattggctatcacagaagca

SEQ ID NO: 3208 - protein, 150 aa, Streptococcus pyogenes
MKVIFLADVKGKGKKGEIKEVPTGYAQNFLIKKNLAKEATSQSIGELKGKQKAEEKAQAEILAEAQAVKAVLDEDKTRVQFQEKVGPDGRTFGSITAKKISEELQKQFGVKVDKRHIVLDHPIRAIGLIEVPVKLHKEVTAEIKLAITEA

SEQ ID NO: 3209 - DNA, 1353 bp, Streptococcus agalactiae
ttggtagaagtatctgagctaagagtacaacctcaagacctgttggcagaacaggccgttctaggatctatctttatctcaccagagaaactgattatggtgagagaatttataagtccagatgatttttataaatattcacacaaagttatcttcagagcgatgattaccttagctgatagaaatgatgcaattgatgctgctactgttagaaatattttagatgaccaaggtgatcttcaaaacattggtgggttgggctatattgttgaattagttaatagtgttccaacaagtgctaatgcggagttttatgccaaaatagtttctgagaaagccatgttgcgagatatcatttctaagttgacagatactgtcaacatggcctatgaaggaaatgattctgatgaaattattgccaccgctgagaaggctttagttgatattaacgaacacagtaatcgtagcgggtttagaaagatatctgatgttttaaaagttaattacgaaaacttagaattacgttcacagcaaacctcagatgtcacaggtttaccaactggatttagagatttagacaggattactacaggtttacatccagatcaattaatcatcttagcggcccgtcctgcagtaggtaaaacagcctttgttttaaatattgctcaaaatgttggaactaaacaaaatagacctgtagctattttttcacttgaaatgggggctgagagtttagttgaccgtatgttggcagcagagggaatggttgattctcatagtttacgaactggtcagttgacggatcaagattggaataatgtaacgattgctcaaggagctttggcggatgcgccaatttatattgatgatacgcccgggattaaaattacagaaattagagcacgctctaggaagttatctcaagaagttgatgatggtttaggtttaatcgtcattgactacctccaattaatttcaggaactagaccagaaaatcgtcagcaagaagtttctgaaatttcaaggcagttgaagattttagctaaagaattaaaggttcctgttatcgcattaagccagctctctcgtggggttgagcaaaggcaggataaacgaccggtcttatctgatattcgtgaatctggatcgattgaacaagatgctgacattgttgctttcttatatcgagatgattattatcgtagagagggcgaagaagcagaggaaattgtagaagataatactgttgaggttattttagaaaagaaccgtgctggtgcgcgtgggacagtaaaattaatgtttcaaaaggaatataataaattttctagtatagctcaatttgaagaa

SEQ ID NO: 3210 - protein, 451 aa, Streptococcus agalactiae
MVEVSELRVQPQDLLAEQAVLGSIFISPEKLIMVREFISPDDFYKYSHKVIFRAMITLADRNDAIDAATVRNILDDQGDLQNIGGLGYIVELVNSVPTSANAEFYAKIVSEKAMLRDIISKLTDTVNMAYEGNDSDEIIATAEKALVDINEHSNRSGFRKISDVLKVNYENLELRSQQTSDVTGLPTGFRDLDRITTGLHPDQLIILAARPAVGKTAFVLNIAQNVGTKQNRPVAIFSLEMGAESLVDRMLAAEGMVDSHSLRTGQLTDQDWNNVTIAQGALADAPIYIDDTPGIKITEIRARSRKLSQEVDDGLGLIVIDYLQLISGTRPENRQQEVSEISRQLKILAKELKVPVIALSQLSRGVEQRQDKRPVLSDIRESGSIEQDADIVAFLYRDDYYRREGEEAEEIVEDNTVEVILEKNRAGARGTVKLMFQKEYNKFSSIAQFEE

SEQ ID NO: 3211 - DNA, 285 bp, Streptococcus agalactiae
atgagtgatgcatttgcagatgttgcaaaaatgaaaaaaataaaagaagatatcaagtcacatgagggacagatggtcgaacttactctcgaaaatggtcgtaagagggaaaaaaataaaattgggcgcctaattgaagtttacccatctttgtttatcgtagagtataaggatactgcagctgtaccaggagcaattgataatacttatgtagagtcttacacttattcagatattttaactgagaaaactttaattcgttattttgatgacgagtcagcagaa

SEQ ID NO: 3212 - protein, 95 aa, Streptococcus agalactiae
MSDAFADVAKMKKIKEDIKSHEGQMVELTLENGRKREKNKIGRLIEVYPSLFIVEYKDTAAVPGAIDNTYVESYTYSDILTEKTLIRYFDDESAE

SEQ ID NO: 3213 - DNA, 300 bp, Streptococcus pyogenes
ttgaagaaagataagaaagagagacaaaaaatgagcgatgcatttacagatgttgcaaaaatgaaaaaaattaaagaggacataagagcccatgaaggacagttagtagaattaacccttgagaatggacggaaacgggaaaaaaataaaattggtaggcttattgaagtttacagttcactctttatcattgagtatagtgatagctctgatactccaggagcaattgataattcttatgtcgaatcatacacctattcagatattttgacagaaaaaacattaattcgttatttagat

SEQ ID NO: 3214 - protein, 100 aa, Streptococcus pyogenes
LKKDKKERQKMSDAFTDVAKMKKIKEDIRAHEGQLVELTLENGRKREKNKIGRLIEVYSSLFIIEYSDSSDTPGAIDNSYVESYTYSDILTEKTLIRYLD

SEQ ID NO: 3215 - DNA, 609 bp, Streptococcus agalactiae
atgtcacgttatactggtccatcatggaaacaatcacgtcgccttggtttatcacttacaggcacaggtaaagaattggcacgtcgtaactacgtacctggtcagcacggtcctaataaccgtagcaagctttcagaatatggcttgcagttagctgagaaacaaaaacttcgtttttcatacggacttggtgaaaaacaattccgtaacttgttcgtacaagctactaaagcaaaagaaggaactcttggtttcaactttatggttcttttagagcgtcgtcttgataacgttgtttatcgtttaggacttgcaacaactcgtcgccaagctcgtcaatttgttaaccatggtcatatccttgttgatggtaaacgtgttgatatcccatcataccgcgttactccaggacaagttatttcagttcgtgaaaaatcaatgaaagtacctgcaatccttgaagctgttgaagctactttaggacgtccagctttcgtatcatttgatgctgaaaaacttgaaggttcattgactcgccttccagaacgcgatgaaattaacccagaaatcaatgaagcacttgtcgttgaattctacaacaaaatgctt

SEQ ID NO: 3216 - protein, 203 aa, Streptococcus agalactiae
MSRYTGPSWKQSRRLGLSLTGTGKELARRNYVPGQHGPNNRSKLSEYGLQLAEKQKLRFSYGLGEKQFRNLFVQATKAKEGTLGFNFMVLLERRLDNVVYRLGLATTRRQARQFVNHGHILVDGKRVDIPSYRVTPGQVISVREKSMKVPAILEAVEATLGRPAFVSFDAEKLEGSLTRLPERDEINPEINEALVVEFYNKML

SEQ ID NO: 3217 - DNA, 609 bp, Streptococcus pyogenes
atgtcacgttatactggtccatcatggaaacaatcacgtcgccttggtttatcacttacaggcacaggtaaagaattggcacgtcgtaactacgttcctggtcaacacggtccaaacaaccgtagcaaactctcagaatatggtttgcagttagctgagaaacaaaaacttcgtttctcatacggtttaggtgaaaaacaattccgtaacttgttcgttcaagctacaaaaatcaaagaaggaactcttggtttcaactttatggttcttttagaacgtcgtcttgacaacgttgtttaccgtctaggtttagcaactactcgtcgtcaagcacgtcaattcgttaaccacggtcacatccttgttgacggtaaacgcgttgatatcccttcataccgcgttgatccaggtcaagtgatttcagttcgcgaaaaatcaatgaaagtacctgcaatccttgaagctgttgaagctactcttggacgtccagctttcgtatcatttgatgctgaaaaacttgaaggttcattgactcgccttccagaacgcgatgaaattaacccagaaatcaatgaagcacttgtcgttgaattctataacaaaatgctt

SEQ ID NO: 3218 - protein, 203 aa, Streptococcus pyogenes
MSRYTGPSWKQSRRLGLSLTGTGKELARRNYVPGQHGPNNRSKLSEYGLQLAEKQKLRFSYGLGEKQFRNLFVQATKIKEGTLGFNFMVLLERRLDNVVYRLGLATTRRQARQFVNHGHILVDGKRVDIPSYRVDPGQVISVREKSMKVPAILEAVEATLGRPAFVSFDAEKLEGSLTRLPERDEINPEINEALVVEFYNKML

SEQ ID NO: 3219 - DNA, 294 bp, Streptococcus agalactiae
atgaatctaaatgatagattaaaaatagaagaaatggaagagaagtatgatagcttcaaacctagaatcaatgcattagtagaagctatagatgattttcaaaagcactatgaagattacgtgaaattaagagaattttatggtagcgaagactggtttagactatcagaacaaacagaaaataatctcaaatgcggtgtactgagtgaggatcagctctttgattttataggagaacataacgagcttgtaggccaatttttagatatgtcttctcaaatgtatcgtcattta

SEQ ID NO: 3220 - protein, 98 aa, Streptococcus agalactiae
MNLNDRLKIEEMEEKYDSFKPRINALVEAIDDFQKHYEDYVKLREFYGSEDWFRLSEQTENNLKCGVLSEDQLFDFIGEHNELVGQFLDMSSQMYRHL

SEQ ID NO: 3221 - DNA, 294 bp, Streptococcus pyogenes
atgacaaagcaagatcagttaatcgttgaaaaaatggaacaaacctatgaggcctttagcccaaagctagcaaatctcatagaagccctagatgcctttaaagagcattatgaggaatatgccacacttagaaatttttacagtagtgacgaatggtttcggcttgcaaaccaaccttgggatgatatcccgtgcggtgtcctatctgaagacctcctctttgatatgatcggtgaccataaccaactactagctgatatcttagacttggcccctatcatgtacaagcatatg

SEQ ID NO: 3222 - protein, 98 aa, Streptococcus pyogenes
MTKQDQLIVEKMEQTYEAFSPKLANLIEALDAFKEHYEEYATLRNFYSSDEWFRLANQPWDDIPCGVLSEDLLFDMIGDHNQLLADILDLAPIMYKHM

SEQ ID NO: 3223 - DNA, 537 bp, Streptococcus agalactiae
atggtaaacgatacgaggagagaaaaaacaaaaagagctattgaagcagctatgattacgttattaaaagatcagagcttcgatgaaatttcaacgattaatctaactaaaacagctggaatcagtcgttctagtttttatactcattataaagataaatatgaaatgattgatcaataccaacagtcactcttcaataaagtcgaatatatttttgatcgcaatcaatttaaaaaagaagatgccttgctcgaaatttttcaattcttagatagagaatcattatttgctgctctcttaacccaaaatggaacaaaagaaattcagacctacatccttaataaattacaattaatgctttctaaagaattacctgtggtcaatccagatgcaacaaagtctgatatcaaccgtttgtattatagtgtctatctcagtcatgctatttttggagtctatcaaatgtggataacacgaggaaaaaaagaaagccctcaacaaattacacaagtgctactcagtttattacctcaaact

SEQ ID NO: 3224 - protein, 179 aa, Streptococcus agalactiae
MVNDTRREKTKRAIEAAMITLLKDQSFDEISTINLTKTAGISRSSFYTHYKDKYEMIDQYQQSLFNKVEYIFDRNQFKKEDALLEIFQFLDRESLFAALLTQNGTKEIQTYILNKLQLMLSKELPVVNPDATKSDINRLYYSVYLSHAIFGVYQMWITRGKKESPQQITQVLLSLLPQT

SEQ ID NO: 3225 - DNA, 531 bp, Streptococcus pyogenes
atggtcaaccgtaaagaaaatacgaagcaagcaattttaaaagcaatggttatgttactaaaaaccgaaagttttgacgatattaccacagttaaattatctaaaagagctggaattagtcgctctagtttttacacacactataaagataaatatgaaatgattgactattatcagcaaaccttttttcacaaattagaatatatttttgagaaaaaatatcaaaataaagaacaagccttccttgaagtatttgaatttctccaaagagaacagcttctctcttcccttttgtctgctaacggtactaaagaaatacaggcctttatcatcaataaagttcgcctactcatcactactgatttacaggacaagttcagtaccgaagagttatctcaaacggaaaaagaataccaaagtatctacttagcccatgctttttttggtgtctgtcaaagttggattgctaaaggtaaaaaagaatcacctcaagaaatgacacaattcgttctcaaaatgcttacgagtacc

SEQ ID NO: 3226 - protein, 177 aa, Streptococcus pyogenes
MVNRKENTKQAILKAMVMLLKTESFDDITTVKLSKRAGISRSSFYTHYKDKYEMIDYYQQTFFHKLEYIFEKKYQNKEQAFLEVFEFLQREQLLSSLLSANGTKEIQAFIINKVRLLITTDLQDKFSTEELSQTEKEYQSIYLAHAFFGVCQSWIAKGKKESPQEMTQFVLKMLTST

SEQ ID NO: 3227 - DNA, 2433 bp, Streptococcus agalactiae
ttgtacatttttaaacacagtgtccaaaaacgagatttttatcttgaaattatctatcatcactgtataatatattttatcaaaaaaatgaacaatatgtccaaaataggagaaaaaatgttagacgaattaaaagcaatcataaaaagcccaaaattatggattacgatggctggggttgcactgattccaacgctatataatgttatctttctaagctcaatgtgggatccttatgggaatactaaaaatttacctgtggcagtcgttaaccaagataaatcggctaaattaaatggaaaaactatttcaattggcaaagatatggaggacaatttgtctaaaaatgatagcttagatttccattttacaacagctaaaagagcagaaaaagaattagaaaagggtcactattatatggttattacctttcctaaagatctttctagaaaagcgacaactctcatgacagaaaaaccagaaaggttaaatattacttataaaactactaaggggcgtagttttgtagcttcaaaaatgagtgagacagcagctaataaactaaaagatgaggtagcagaatctattacagggacttatactgaatcagtttttaaaaatatgggttctatgaaaacaggtatcaataaagctgctgatgggagtcaagaattattaaatggttctaataagctacaggatgggagccaaaccttgacaagtaatttagatgttttagcaagctctagtcaaactttttctggaggagctaataaactaaatagtggaataaacctttatacagatggtgtggggaccctatctaacgggttagaaacattatcagatggtgttactgcttacacaacaggtgtgcataagttgagtgaaggtagtcaaaaattagatgataagtctcaagcattggtggaaggatcagaaaagttgacggatggtttacaacaattgtcacaagcaactcaactaaaaccagagcaagaacgtactttgcagaacctttcagatggattaaagaatctaaatcagattattacaaatttacaatcgacagcaactactgatagcgatactaatagtaagttatttaattttttatcaactattgaatcaagtacaaaggctttgatgaatacggctgctgctgataaacaaaagcaaatgactgcggtacaatcaacgtcagcttttaaaagtttaacccctgaacaacaatctcaaatcacctcagcggttactggaacacctacttcagctgagacaattgcagcaaatatttcttcaaatatagaaaatatgaaaactgtgcttagtgaagcatctagttcagccccttctaataatggatcacaaaatcttcaaactttgtcaggaacagctaacaatttagtattaaaagctatctcagatttagataaaattcaaaaattgccaacggctactaagcagttatatcaaggtagtcaaaccttgacaaaaggaatcacggattatacgaatgctgtagggcaattacgcaaaggtgcagtaactttagatagtaaatccaatcaattgatttcaggaacacaaaaagcaagtcagggagctcaaactttagatagtaaatcggatcaattgagagacggagcggggcaattagctagtggttctgatagaattgcagatggttctaataagcttgctgggggaggacatcagttgacagatgggttgacagagttgtcaggtggtgtttctcaattatcaagttctttggggaaagctggggaccagttgtccatggtttctgtaaataaagataatgccaatgcagtatctagcccagtcactatcaagcatgaagattatgatagcgttgatacgaatggtgttggaatggcaccatacatgatttcagttgcgttgatggtggtagctttatcagccaatgttatttttgcgaaagctttatctggcaaagagccagctaatcgttttagttgggctaaaaataaattattaatcaatggattcattgcaactctagcagcaactatcttattttttgcagttcaattcataggtcttaaaccagattaccctggaaaaacctactttattatcctattgacagcatggactttgatggcattagtaactgctttagtgggatgggataataggtatggttccttcttgtcgttattaatattattattccagcttggttcaagcgcaggaacttacccaatagaattgagtcctaagttctttcaaacaattcaaccatttttaccgatgacttactctgtttcaggattaagagagaccatctcgttgacgggagacgttaaccatcaatggagaatgctagtaatctttttagtatcatcgatgatacttgctcttcttatttatcgtaaacaagaagat

SEQ ID NO: 3228 - protein, 811 aa, Streptococcus agalactiae
MYIFKHSVQKRDFYLEIIYHHCIIYFIKKMNNMSKIGEKMLDELKAIIKSPKLWITMAGVALIPTLYNVIFLSSMWDPYGNTKNLPVAVVNQDKSAKLNGKTISIGKDMEDNLSKNDSLDFHFTTAKRAEKELEKGHYYMVITFPKDLSRKATTLMTEKPERLNITYKTTKGRSFVASKMSETAANKLKDEVAESITGTYTESVFKNMGSMKTGINKAADGSQELLNGSNKLQDGSQTLTSNLDVLASSSQTFSGGANKLNSGINLYTDGVGTLSNGLETLSDGVTAYTTGVHKLSEGSQKLDDKSQALVEGSEKLTDGLQQLSQATQLKPEQERTLQNLSDGLKNLNQIITNLQSTATTDSDTNSKLFNFLSTIESSTKALMNTAAADKQKQMTAVQSTSAFKSLTPEQQSQITSAVTGTPTSAETIAANISSNIENMKTVLSEASSSAPSNNGSQNLQTLSGTANNLVLKAISDLDKIQKLPTATKQLYQGSQTLTKGITDYTNAVGQLRKGAVTLDSKSNQLISGTQKASQGAQTLDSKSDQLRDGAGQLASGSDRIADGSNKLAGGGHQLTDGLTELSGGVSQLSSSLGKAGDQLSMVSVNKDNANAVSSPVTIKHEDYDSVDTNGVGMAPYMISVALMVVALSANVIFAKALSGKEPANRFSWAKNKLLINGFIATLAATILFFAVQFIGLKPDYPGKTYFIILLTAWTLMALVTALVGWDNRYGSFLSLLILLFQLGSSAGTYPIELSPKFFQTIQPFLPMTYSVSGLRETISLTGDVNHQWRMLVIFLVSSMILALLIYRKQED

SEQ ID NO: 3229 - DNA, 144 bp, Streptococcus agalactiae
atgatatggtatgtcaaagtatttaggaggagaagatatgtctactttaacaataattattgcaacattaactgctttggaacatttttatattatgtatttggagacgttagccacccagtcaaatatgactgggaagatttt

SEQ ID NO: 3230 - protein, 48 aa, Streptococcus agalactiae
MIWYVKVFRRRRYVYFNNNYCNINCFGTFLYYVFGDVSHPVKYDWEDF

SEQ ID NO: 3231 - DNA, 264 bp, Streptococcus agalactiae
atgactgggaagatttttagtatgtctaaagaagagttgtcatatttacccgttattaaactttttaagaatcaaggtgtatacaacggcttgattggcctattcctcctttatgggttatatatttcacagaatcaagaaattgtagctgtttttttaatcaatgtattgctagttgctatttatggtgctttgacagttgataaaaaaatcttattaaaacagggtggtttacctatattagctcttttaacattcttattt

SEQ ID NO: 3232 - protein, 88 aa, Streptococcus agalactiae
MTGKIFSMSKEELSYLPVIKLFKNQGVYNGLIGLFLLYGLYISQNQEIVAVFLINVLLVAIYGALTVDKKILLKQGGLPILALLTFLF

SEQ ID NO: 3233 - DNA, 753 bp, Streptococcus agalactiae
gtgactttgattatgactgagaactggttacatactaaagatggttcagatatttattatcgtgtcgttggtcaaggtcaaccgattgtttttttacatggcaatagcttaagtagtcgctattttgataagcaaatagcatatttttctaagtattaccaagttattgttatggatagtagagggcatggcaaaagtcatgcaaagctaaataccattagtttcaggcaaatagcagttgacttaaaggatatcttagttcatttagagattgataaagttatattggtaggccatagcgatggtgccaatttagctttagtttttcaaacgatgtttccaggtatggttagagggcttttgcttaattcagggaacctgactattcatggtcagcgatggtgggatattcttttagtaaggattgcctataaattccttcactatttagggaaactctttccgtatatgaggcaaaaagctcaagttatttcgcttatgttggaggatttgaagattagtccagctgatttacagcatgtgtcaactcctgtaatggttttggttggaaataaggacataattaagttaaatcattctaagaaacttgcttcttattttccaaggggggagttttattctttagttggctttgggcatcacattattaagcaagattcccatgtttttaatattattgcaaaaaagtttatcaacgatacgttgaaaggagaaattgttgaaaaagctaat

SEQ ID NO: 3234 - protein, 251 aa, Streptococcus agalactiae
MTLIMTENWLHTKDGSDIYYRVVGQGQPIVFLHGNSLSSRYFDKQIAYFSKYYQVIVMDSRGHGKSHAKLNTISFRQIAVDLKDILVHLEIDKVILVGHSDGANLALVFQTMFPGMVRGLLLNSGNLTIHGQRWWDILLVRIAYKFLHYLGKLFPYMRQKAQVISLMLEDLKISPADLQHVSTPVMVLVGNKDIIKLNHSKKLASYFPRGEFYSLVGFGHHIIKQDSHVFNIIAKKFINDTLKGEIVEKAN

SEQ ID NO: 3235 - DNA, 2541 bp, Streptococcus agalactiae
ttgttgaaaaagctaattgaaaaagtcaaatcactgacttctgtgattaaaattgtattttttatatctgttttagtgcttattattgttgaaatgattcatttgaaacgaactatttctgttgagcaactaaagagtgtttttgggcaattatctccaatgaatcttttcttaattatccttgtgggggttatcgctgtcttaccgacaaccggatatgactttgtactgaatggacttttacgtacagataaaagcaaaaggtatattttacagactagttggtgtatcaacacttttaataacttgtcaggattcggtggcttaatcgatattgggttgcgcatggctttttatggtaaaaaaggtcaagagaagagtgacctaagagaagtgactcgttttttaccctatcttatttctggtctgtcatttattagtgtgattgccttaatcatgagccatatttttcatgccaaagctagtgttgattactattatttggtattaattggtgctagtatgtattttcctgttatttattggatttctggtcataaaggaagccattatttcggagatatgccatctagtactcgtataaaattaggtgttgtttctttttttgaatggggatgtgcggccgcagcatttataattatcggttatttaatgggcattcatctaccagtttataaaattttaccactattttgtattggttgtgccgtcgggattgtatcccttattcccggtggattaggaagttttgaattagttctatttacagggtttgctgccgagggactacctaaagaaactgtggttgcatggttattactttatcgtttagcctactatattattccattctttgcaggtatctatttctttatccattatttaggtagtcaaataaatcaacgttatgaaaatgtcccgaaagagttagtatcaactgttctacaaaccatggtgagccatttgatgcgtattttaggtgcattcttaatattttcaacagcattttttgaaaatattacttatattatgtggttgcagaagctaggcttggacccattacaagaacaaatgttatggcagtttccaggtttattgctgggggtttgttttattctcttagctagaactattgatcaaaaagtgaaaaatgcttttccaattgctattatctggattactttgacattgttttatcttaatttaggtcatattagttggcgactatctttctggtttattttactattgttaggcttattagtcattaagccaactctctataaaaaacaatttatttatagctgggaagagcgtattaaggatggaatcattatcgttagtttaatgggagttctattttatattgcaggactactattccctatcagggctcatattacaggtggtagtattgaacgcctgcattatatcatagcatgggagccgatagcattggctacgttgattcttactctcgtttatttatgtttggttaagattttacaaggaaaatcttgtcagattggtgatgtgttcaatgtggatcgttataaaaaactacttcaagcttacggtggttcttcggatagcggtttagcctttttaaatgataaaaggctctactggtaccaaaaaaatggagaagattgcgttgcgttccaatttgtaattgtcaataataaatgtcttattatgggggaaccagccggtgatgacacttatattcgtgaagctattgaatcgtttattgatgatgctgataagctagactatgaccttgttttttacagtattggacagaagttgacactacttttacatgagtatggttttgactttatgaaagttggtgaggatgctttagttaatttagaaacgtttactcttaaagggaataagtacaaacctttcagaaatgccctaaatagagttgaaaaggatggtttctatttcgaagttgtacaatcgccacatagtcaagagctactaaatagtttggaagagatttctaatacttggttagaaggacgtcctgaaaaaggtttctcactaggatattttaataaagattatttccaacaagccccaatagctttggtaaaaaatgctgaacacgaagttgttgcttttgctaatattatgccaaactatgaaaagagtattatctctattgatttaatgcgtcacgataaacagaaaattccgaatggcgttatggatttcctctttttatcattattctcttattatcaagagaagggataccactattttgatttggggatggcacctttatcaggagttggtcgcgttgaaacaagttttgctaaagagagaatggcgtatcttgtctatcatttcggtagtcatttctactcatttaatggtttacacaagtataagaagaagtttacaccattgtggtcggaacgttatatttcttgttctcgttcgtcctggttaatttgtgctatttgtgccctattaatggaagatagtaaaattaagattgttaaa

SEQ ID NO: 3236 - protein, 847 aa, Streptococcus agalactiae
MLKKLIEKVKSLTSVIKIVFFISVLVLIIVEMIHLKRTISVEQLKSVFGQLSPMNLFLIILVGVIAVLPTTGYDFVLNGLLRTDKSKRYILQTSWCINTFNNLSGFGGLIDIGLRMAFYGKKGQEKSDLREVTRFLPYLISGLSFISVIALIMSHIFHAKASVDYYYLVLIGASMYFPVIYWISGHKGSHYFGDMPSSTRIKLGVVSFFEWGCAAAAFIIIGYLMGIHLPVYKILPLFCIGCAVGIVSLIPGGLGSFELVLFTGFAAEGLPKETVVAWLLLYRLAYYIIPFFAGIYFFIHYLGSQINQRYENVPKELVSTVLQTMVSHLMRILGAFLIFSTAFFENITYIMWLQKLGLDPLQEQMLWQFPGLLLGVCFILLARTIDQKVKNAFPIAIIWITLTLFYLNLGHISWRLSFWFILLLLGLLVIKPTLYKKQFIYSWEERIKDGIIIVSLMGVLFYIAGLLFPIRAHITGGSIERLHYIIAWEPIALATLILTLVYLCLVKILQGKSCQIGDVFNVDRYKKLLQAYGGSSDSGLAFLNDKRLYWYQKNGEDCVAFQFVIVNNKCLIMGEPAGDDTYIREAIESFIDDADKLDYDLVFYSIGQKLTLLLHEYGFDFMKVGEDALVNLETFTLKGNKYKPFRNALNRVEKDGFYFEVVQSPHSQELLNSLEEISNTWLEGRPEKGFSLGYFNKDYFQQAPIALVKNAEHEVVAFANIMPNYEKSIISIDLMRHDKQKIPNGVMDFLFLSLFSYYQEKGYHYFDLGMAPLSGVGRVETSFAKERMAYLVYHFGSHFYSFNGLHKYKKKFTPLWSERYISCSRSSWLICAICALLMEDSKIKIVK

SEQ ID NO: 3237 - DNA, 1512 bp, Streptococcus agalactiae
atgacaacactaatcactacctttcaagagcgttttggagattggactcaaagtcttattgaacacctccagctatcactactaacacttattttagcaactttaattgctattccactcggtatcatcattagtcattataaaaaaatcagtcatgttgtccttcagataactgggatatttcaaacaattccttctttagccttgcttggtttatttataccttttatgggaattggaactgtaccagctgtcgttgcactaattatttacgctctatttccaattttacaaaatactgtaacagtactgatgcaaattgatgctaatctcattgaggcagcaaccgcttttggaatgacacgttgggaaaggcttaaaaagtttgagttagctttaagtatgcctgttatcatctcaggcattagaactgcctctgttatgattattggtacagctacattagctagtcttatcggagctggtggccttggatcatttattttgttagggattgatcgcaacaatccttctctaattctcataggggcaatctcttctgctgtcttagctattatatttagtggtttaattggattactagaaaaggctagattacgaaccatagccgtttctggtatacttttactagcaggcttaggactatcctatgctccaaaatggatgcctggaacaaatactgcaacgataactgttgcagggaagttaggaactgaaccagatattttaattaatatgtacaaagaacttattgaggatcagacagatatcaaagttaagcttaaacctaatttcggaaaaacaactttcttatatcaagccctaaaatctggtgatattgatctttacccagagtttacaggtactattacatcaagtttacttaaaaatcctcctaaagtaagtaataaccctaaacaggtttacaacttagccaaaaacggtattttaaaacaagataagttgtcacttttgtcacctatggcttatcaaaacacctacgctgtagctgttaaaaaagattacgctgaagctaatcaactcaaaaatatcagcgacctaaaaaaattagataaactaaaagctggtttcactttagaatttaaggatagagaggatgggagtattggtttacagaaacattatggtttaaaccttgatatctcaaccttagaacctgctttacgataccaagctatcaatagtaaagatgtcaatattattgacgcttactctaccgatagtgaattaatccagtatcaacttcaaattctcaaagacgataagcatctatttccgccatatcaaggagcaccgctactaaggcaagatacgattaaaaaataccctcaagtaaaaaaagctctcaataaacttgctggtcatatcactgaaaaagaaatgcaagaaatgaactaccaagtagctgtaaagcataaatcagcagctacagtagctaaacaatatttaaaagcacatcatattataaag

SEQ ID NO: 3238 - protein, 504 aa, Streptococcus agalactiae
MTTLITTFQERFGDWTQSLIEHLQLSLLTLILATLIAIPLGIIISHYKKISHVVLQITGIFQTIPSLALLGLFIPFMGIGTVPAVVALIIYALFPILQNTVTVLMQIDANLIEAATAFGMTRWERLKKFELALSMPVIISGIRTASVMIIGTATLASLIGAGGLGSFILLGIDRNNPSLILIGAISSAVLAIIFSGLIGLLEKARLRTIAVSGILLLAGLGLSYAPKWMPGTNTATITVAGKLGTEPDILINMYKELIEDQTDIKVKLKPNFGKTTFLYQALKSGDIDLYPEFTGTITSSLLKNPPKVSNNPKQVYNLAKNGILKQDKLSLLSPMAYQNTYAVAVKKDYAEANQLKNISDLKKLDKLKAGFTLEFKDREDGSIGLQKHYGLNLDISTLEPALRYQAINSKDVNIIDAYSTDSELIQYQLQILKDDKHLFPPYQGAPLLRQDTIKKYPQVKKALNKLAGHITEKEMQEMNYQVAVKHKSAATVAKQYLKAHHIIK

SEQ ID NO: 3239 - DNA, 720 bp, Streptococcus agalactiae
atgatttcatttgaaaatgttagtaaatcatatggtgatcataccatcattgataatattagttgccatattcaaagaggagaattctttgtccttgtgggggccagtggcagtggtaaaactaccatcctcaagatgattaatcgtctcatcgaaccaagccaaggcgctattactttagatggggaaaacattacatcacttgatttgcgacaattacgcttagaaactggttatgtcttgcaacaaattgcacttttccctaatttaacagttggagaaaatatagaacttatccctgaaatgaagggctggtcaaaaggtgaccaaaaaaaagccgctagcgaccttcttgataaggtgggtttacctgctaaggactactttaatcgctatcctcatgagctctctggtggggaacaacaacgcataggtatcctacgagcaatcgttgctaaacctaaggtactacttatggatgagccattttctgctttagaccctatctcaagacgtcaattacaagatatcaccaaacaattacagtctgaattgggtattacattagtgtttgtcacccatgacatgaaggaagctatgcgtcttgcagatagaatttgtgttattaaggaaggtaagatagtgcaattggatagaccagaaataattcaaaataatccctctgaccaatttgttagaaccctatttgaagaggagaac

SEQ ID NO: 3240 - protein, 240 aa, Streptococcus agalactiae
MISFENVSKSYGDHTIIDNISCHIQRGEFFVLVGASGSGKTTILKMINRLIEPSQGAITLDGENITSLDLRQLRLETGYVLQQIALFPNLTVGENIELIPEMKGWSKGDQKKAASDLLDKVGLPAKDYFNRYPHELSGGEQQRIGILRAIVAKPKVLLMDEPFSALDPISRRQLQDITKQLQSELGITLVFVTHDMKEAMRLADRICVIKEGKIVQLDRPEIIQNNPSDQFVRTLFEEEN

SEQ ID NO: 3241 - DNA, 831 bp, Streptococcus agalactiae
gtgaaattctatattattgatgatgaccccactatcactatgattttacaagatattattgaagaagatttcaataatacagtagtcagagtgaataatgtctccagtaaagcatacaacgaattgctgattgcagatgttgatatcgtattgattgatttattaatgccaatattagacggtgtaacattagtccaaaaaatctataaacagcgttccgatttaaaatttattatgatttcccaagtcaaagataatgatttacgacaagaagcatataaagcaggaatcgaattttttattaataaacccattaatattattgaagtaaaaagcgtcgtgaaacgtgtcactgatactatcgaaatgcaaaaaaaattaaatacaatccaaaatctcctagaaaatacgccatcatatcaaaagcctataacgactagtaacctcactaaaatccgttcaatactcagttatttaggtattacttcagagacagcctacacagatattcttaacatctgtgaacttttattaaaacaagaattaaattttgcccaatttgattttcaaaaagaactttctatcgatgaacaccaacaaaaaatcattttacaacgtattcgtcgtgccgttaaaaaagctatgataaatatggctcatctgtacattgatgattttgaaaatgaattaacactgcaatatgctaatgcattgtttggatttcagaatatccataatgaggcacaacttattcaaggaaaaagcatgtatggtggtaaaatttcacttaaacattttttcgatgaacttattttacagagtaaaacgttt

SEQ ID NO: 3242 - protein, 277 aa, Streptococcus agalactiae
MKFYIIDDDPTITMILQDIIEEDFNNTVVRVNNVSSKAYNELLIADVDIVLIDLLMPILDGVTLVQKIYKQRSDLKFIMISQVKDNDLRQEAYKAGIEFFINKPINIIEVKSVVKRVTDTIEMQKKLNTIQNLLENTPSYQKPITTSNLTKIRSILSYLGITSETAYTDILNICELLLKQELNFAQFDFQKELSIDEHQQKIILQRIRRAVKKAMINMAHLYIDDFENELTLQYANALFGFQNIHNEAQLIQGKSMYGGKISLKHFFDELILQSKTF

SEQ ID NO: 3243 - DNA, 1293 bp, Streptococcus agalactiae
atgctagatatattatcagaaaaacatctagaaagaaggcagcgtattattatctctgcaatagctatcgccttagctgctcaaatcaatatctcaatacttgctgatgggtttattatgaccttatctttgttcattttgcctgtctttttatattttaatgacgacattaatccaattcttctctgtctaggaattacttttgcttctcctatcttcagaggaatcatattaagtatcgctggcgaggctgagattcatcaaataattgaattcgttttaactgatatggcgttttatatttgttatggcatcaccttttatactatttattggcatcgttcctaccgtaataaaggtacttttttcttttctatcattatttgtgattattttgccaaccttgtagaaattagttttctcataaagtttaacaattatactataactatattcgctactttatttgccatagcacttttgcgagcttttattagttgcgctgtggcttatacttatagttatctatcacttctcttacaaaaagacgatcacgaacgtcgatactattattttatgtggtcaacttcagccgttaaaagcgaggtttattttatgcaaaaaaatatcattgaaattgaaaacatcatgaaaaatgcttatttattagataaagagttatccaaatatcatctacctaaagaataccaacacctctctctagatatttcgcgggacgttcacgaagttaagaaagattaccaaaatattattaaaggcttaggaacctattttagtgtaaaaaatgaatcaactatggcattgaaagatatctttcaaattgttttatcttatactaggagtattattcaatttcggcatcaagatatcattattctcgaaaataataaatgtaatttgataatatcaaactattactatttactaaccattatttccaatatcgttttaaatgcagtagaagctattgataaacaaaaaaagggtacaatcagtgttcacacagaagaattagaagattttattaaaattgagattagtgataacggaccaggaatacctgataaaatgaaacacatgattttcaaacctggattttcgactaaatttgatgctaatggtgatatctatcgaggaatcgggctatcccacgtgcgtattttaatggaagagcaatatcaaggaacgataactgtttgtcctaatcagccaaatggaacaacatttacactgttattccgtaaaaatcgatttaagttaggagataatacg

SEQ ID NO: 3244 - protein, 431 aa, Streptococcus agalactiae
MLDILSEKHLERRQRIIISAIAIALAAQINISILADGFIMTLSLFILPVFLYFNDDINPILLCLGITFASPIFRGIILSIAGEAEIHQIIEFVLTDMAFYICYGITFYTIYWHRSYRNKGTFFFSIIICDYFANLVEISFLIKFNNYTITIFATLFAIALLRAFISCAVAYTYSYLSLLLQKDDHERRYYYFMWSTSAVKSEVYFMQKNIIEIENIMKNAYLLDKELSKYHLPKEYQHLSLDISRDVHEVKKDYQNIIKGLGTYFSVKNESTMALKDIFQIVLSYTRSIIQFRHQDIIILENNKCNLIISNYYYLLTIISNIVLNAVEAIDKQKKGTISVHTEELEDFIKIEISDNGPGIPDKMKHMIFKPGFSTKFDANGDIYRGIGLSHVRILMEEQYQGTITVCPNQPNGTTFTLLFRKNRFKLGDNT

SEQ ID NO: 3245 - DNA, 996 bp, Streptococcus agalactiae
atgaaaaatttacgtaaccgtagttttcttactttattggattttagtacagcagaagttgaatttcttttaaaactttcagaagatttaaaacgtgctaaatacgcaggaattgaacaacaaaaacttgttggtaaaaatatcgctttgatttttgaaaaagattctacacggacacgttgcgcttttgaagttgctgctcacgatcaaggagctcatgttacttatttaggtccaacaggcagtcagatgggtaaaaaagagacctcaaaagacactgcgcgtgtgctaggtggtatgtatgatggtattgagtatcgtggattttctcaagaaacagttgagactttagccgaattttcaggagttcctgtgtggaatggtttaaccgatgctgatcatccaacgcaagtactagccgattttctgaccgctaaggaatgcttacataagccctataaagatattcgctttacgtatgtgggtgatggacgtaacaatgtcgctaatgccttgatgatcggtgcttctattgtaggcatgacttatcatttggtttgtcctaaagaattagagccagatcctgaactactctctaaatgtcaagaaattgcgaaaactactggtgcttctattgaaatcactgctgatattgcagaaggcgtcagagattcagacgtcctatatacagatgtttgggtttcaatgggagaaccggatgaagtttggaaagaaagaatagctcttttagaaccctatcgtattacccaagaaatgcttaatatgacagaaaatccaaacgttattttcgagcattgcttgccctcatttcataatatagatactaaagttggatacgacatttatgaaaaatatggtttgaaggaaatggaagtatcagatgaagtttttgaaggccctcactcagttgttttccaagaagctgaaaatcgtatgcatactattaaagcagttatggtagcaactttaggtgat

SEQ ID NO: 3246 - protein, 332 aa, Streptococcus agalactiae
MKNLRNRSFLTLLDFSTAEVEFLLKLSEDLKRAKYAGIEQQKLVGKNIALIFEKDSTRTRCAFEVAAHDQGAHVTYLGPTGSQMGKKETSKDTARVLGGMYDGIEYRGFSQETVETLAEFSGVPVWNGLTDADHPTQVLADFLTAKECLHKPYKDIRFTYVGDGRNNVANALMIGASIVGMTYHLVCPKELEPDPELLSKCQEIAKTTGASIEITADIAEGVRDSDVLYTDVWVSMGEPDEVWKERIALLEPYRITQEMLNMTENPNVIFEHCLPSFHNIDTKVGYDIYEKYGLKEMEVSDEVFEGPHSVVFQEAENRMHTIKAVMVATLGD

SEQ ID NO: 3247 - DNA, 924 bp, Streptococcus agalactiae
atggcaaaaattgttgttgcactaggaggaaatgccttaggaaattctccagaagaacaattaagattagtaaaacatactgcaaaatcattggtggccttgataaaaaagggacacgaaattgttgtaagtcatggtaatggaccacaagttggtgccattaatttaggaatgaattttgcggctgagagtggtcaaggaactaattttccttttccagaatgtggagcaatgagccaaggatacataggctatcatctccaacagagccttttaaatgaattacgtcaagagggaataaataaggaagttgctacaattattacccaaattgaggtggatgaatcagaccaagcatttagcgcacctaccaagcctataggcaccttttatgataaggagacatcagaaaagattgctatagagaaagggtatactttcgtagaagacgctggacgagggtatcgtcgtgttgttgcttcacctgaacctaaaaaaatcatcgaaattaatagcattaaaacacttattgaaaatgataccctagttatcgcaggtggaggtggaggcatccctgtcattaataagggaggttatgaaggtattgcagctgttattgataaagacaaatctagtgcactgttagcaggagaactagctgcggatcaattgattattctcactgcagttgattatgtttatactcaatttggtaaagaaaatcaaaaagctttaacagaggttaatgagaatcaaatgattgattacgttaaccaaggtgagtttgcaaaaggaagtatgttacctaaagtaatagcctgtatgagtttcttagatcacaatccgaaaggaacagccttaatcacctcattaaatggtttagaagatgcattagatgggaaattaggaacacgtataactaag

SEQ ID NO: 3248 - protein, 308 aa, Streptococcus agalactiae
MAKIVVALGGNALGNSPEEQLRLVKHTAKSLVALIKKGHEIVVSHGNGPQVGAINLGMNFAAESGQGTNFPFPECGAMSQGYIGYHLQQSLLNELRQEGINKEVATIITQIEVDESDQAFSAPTKPIGTFYDKETSEKIAIEKGYTFVEDAGRGYRRVVASPEPKKIIEINSIKTLIENDTLVIAGGGGGIPVINKGGYEGIAAVIDKDKSSALLAGELAADQLIILTAVDYVYTQFGKENQKALTEVNENQMIDYVNQGEFAKGSMLPKVIACMSFLDHNPKGTALITSLNGLEDALDGKLGTRITK

SEQ ID NO: 3249 - DNA, 117 bp, Streptococcus agalactiae
gtgaaactaataccagctgcatttgaagcaataacagaagaaaacggattaattgttgaaaatgatgtcccaacagaacttgctaagaaaatagcacctacacaaatgatagaatca

SEQ ID NO: 3250 - protein, 39 aa, Streptococcus agalactiae
MKLIPAAFEAITEENGLIVENDVPTELAKKIAPTQMIES

SEQ ID NO: 3251 - DNA, 1551 bp, Streptococcus agalactiae
atgccagaaaaaatgacaaacagtgaaaacaaaaggagtaaaggttttcgaatgccaggtgcctttacaatattattcattttaacaatcttttcggttttggctacatggtggatacctgctgggtcctattcaaaattacaatttgatacagcatcatccaaactagtagtaacagatccaaatggtaagacagttcatgttccagcaacgcaaacacagttggataagatgaatgtcaaaattaaaattaaagaatttacttctggtgctattagtaagccagtttcagttccaaatacttacaaacgtttgaagcaaaatccagcaggcattggctccgtgacgactagtatggtaaatggaaccattgaagctgttgatattatggtatttatcatggtacttggaggcatgataggagtagttagaaagagtggcgcttttgagtctggtcttctagctttaacaaagaaaaccaaaggtagagagtttttattgatatttttagtttccttattgatggttttaggcggtactctatgtggtattgaagaagaagcagttgctttttatcctattttagttccaatctttttagccatgggttatgattctatcatttgtgtaggtgctattttcttagcaagttctgttgggacatcattttcaacaattaatccgttttcttctgttattgcttcaaatgcagctggtattagtttcacagaaggcttatcatggcgtacagcagggtgtattgcaggtgctatttttgttgtggtgtatctacattggtatgctaaaaaaataaaagcgaatccagagttttcatattcctatgaagatagagtagaatttaatgctaaatggggcatgacaactaaccatacaccctcactctttactattagacaaaaaattattttaagtttatttgttatttcatttcctttgatggtttggggagtaatgtcacagggatggtggtttccaaccatggcttcttcctttttagctattacaattattattatgtttttaacagcaactggggcaaatggtattggagaaagggatgttgttgatgagtttgttaatggtgcatcaagccttgttggggtttcattaatcattggtttagcgcgtggtatcaatattattttgagccaaggttatatatcagatacgatgctttacacagcttcaaaattagcttcacatgttagtggctctgtctttatcattgttatgatgtttatctactttgtgttaggatttgttgttccatcctcgtcgggtttagcagtactttcaatgccaattctagcacctcttgcagatactgttgggattcctcgttcagtagtagtaatggcttatcaatttgggcagtatgcaatgttgtttttagcacctactggactagttatggcaaccttgcagatgttagatatgaagtactcccattggctaaaatttgtgtggccggttgttttattcctcctaatatttggtggcggtttgttagttctacaagttttaatactt

SEQ ID NO: 3252 - protein, 517 aa, Streptococcus agalactiae
MPEKMTNSENKRSKGFRMPGAFTILFILTIFSVLATWWIPAGSYSKLQFDTASSKLVVTDPNGKTVHVPATQTQLDKMNVKIKIKEFTSGAISKPVSVPNTYKRLKQNPAGIGSVTTSMVNGTIEAVDIMVFIMVLGGMIGVVRKSGAFESGLLALTKKTKGREFLLIFLVSLLMVLGGTLCGIEEEAVAFYPILVPIFLAMGYDSIICVGAIFLASSVGTSFSTINPFSSVIASNAAGISFTEGLSWRTAGCIAGAIFVVVYLHWYAKKIKANPEFSYSYEDRVEFNAKWGMTTNHTPSLFTIRQKIILSLFVISFPLMVWGVMSQGWWFPTMASSFLAITIIIMFLTATGANGIGERDVVDEFVNGASSLVGVSLIIGLARGINIILSQGYISDTMLYTASKLASHVSGSVFIIVMMFIYFVLGFVVPSSSGLAVLSMPILAPLADTVGIPRSVVVMAYQFGQYAMLFLAPTGLVMATLQMLDMKYSHWLKFVWPVVLFLLIFGGGLLVLQVLIL

SEQ ID NO: 3253 - DNA, 1491 bp, Streptococcus pyogenes
atgacagaagaaaaaaaacggggttttagaattccttcttcttacaccgttctttttatcattatagccatcatggcagtgttaacttggtttattccagctggcgcctacgaaaccgctaagggcggtggtgttatttcaggaacctacaaaacagtagcatccaatcctcaaggattttttgacatcttgatggctcccgttcgaggcatgttaggtgttgaaggcactgatggtgctattcaagtgtctttctttatcttaatggttgggggctttttaggagttgtcaacaaaacaggtgctcttgacacagggattgcgtcagtggttcgtaaaaacaaaggtagagaaaaaatgctgattgctattttaatccctttgtttgctctaggtggaacgacctatggtatgggggaagaaaccatggccttttacccacttttaattcctgttatgattgcggttggttttgacagtattgttgctgtagccattattttgattggttctcaaattgggtgtctagcctccactattaacccatttgcaactggtgtagcagctgatgctgctggtgtcagcattgcagatggaatgatttggcgtgttatccaatgggttattcttgtcggcatgtctatttggtttgtttacaattacgctagtaagattgaagaagacccaagtaaatcattggttgcagacaaggaagaagagcataaggaactcttccagttgcaaaattctggagaagacttaaacaagcgccaacgaaacgttttgaccatttttactttgacctttgtcattatgattcttagtttgattccgtgggaagattttggcatcaaattctttactaatatcaatacttggttaaccacaatgcctatcttagggggagttattgggaaaaccatgggagcatttggtacttggtatttcccagaaatcaccatgctctttatcatgatgggtgtcttagttgctattgtttatcgtatgagtgaagaagacttttttagctcttttttgactggtgcaggtgaatttttaggtgttgccatgatctgtgctattgcacgcggtattcaagttatcatgaatggtggtatgattacagccactatcttacacttaggtgaaacaagtctttctggtttatcttctcaagtttttgtgatattagcttatattttctacctcccaatgtccttcttgattccatcaacatcaggacttgctggggctacaatgggaattatggcaccgcttggacaattctcaaatgtccctgctcaccttgttattacagccttccagtcagcttctggaatcttaaacatgatttctccaacttcagcaatcgttatgggagcacttgcgcttggtcgcgttgaccttggtacttggtggaaattcattggtaaatttattgtaatggtgatgcttgtaagcgtgctattacttgtagttgcaacattcttt

SEQ ID NO: 3254 - protein, 497 aa, Streptococcus pyogenes
MTEEKKRGFRIPSSYTVLFIIIAIMAVLTWFIPAGAYETAKGGGVISGTYKTVASNPQGFFDILMAPVRGMLGVEGTDGAIQVSFFILMVGGFLGVVNKTGALDTGIASVVRKNKGREKMLIAILIPLFALGGTTYGMGEETMAFYPLLIPVMIAVGFDSIVAVAIILIGSQIGCLASTINPFATGVAADAAGVSIADGMIWRVIQWVILVGMSIWFVYNYASKIEEDPSKSLVADKEEEHKELFQLQNSGEDLNKRQRNVLTIFTLTFVIMILSLIPWEDFGIKFFTNINTWLTTMPILGGVIGKTMGAFGTWYFPEITMLFIMMGVLVAIVYRMSEEDFFSSFLTGAGEFLGVAMICAIARGIQVIMNGGMITATILHLGETSLSGLSSQVFVILAYIFYLPMSFLIPSTSGLAGATMGIMAPLGQFSNVPAHLVITAFQSASGILNMISPTSAIVMGALALGRVDLGTWWKFIGKFIVMVMLVSVLLLVVATFF

SEQ ID NO: 3255 - DNA, 1362 bp, Streptococcus agalactiae
atgttattccaaagtaaaataaattaccctaaaaagtctagcatcatcactcaaattaccctctggtacagctcttttatttttatccttgttatcggtgtattaattggttcattttttatttcaaaaagcattgctgaaaacaaatctaaaaaaaatttagaagctaaagctgtgcaaatgagtcaagcgttagctaaaggtcatcggtatgaggcttttgaagatggaatattttattcagtctatgaccaaaatggaaaagttatctattctggttttccaaaaggatttaaaagggatttagaccatcaacataaacataaaaagaaattatctctattttccatggagaatcgtacctttcagtatgttgatattccaatttctgggaaaaatcagtggttacgtgctatccgtactgttgacagactggataagcaattaactgaattgttatttagtttgggtatcgttcttcctcttatgttgattataataactgttggtggctatttaattttaaagcgcacttttagaccgattcaagaaattactgaaaccgctcaatttattacccaaaatgaagactatactaagcgaattatcactaaaaataacgaaaatgaattaactgagctagcagctgttatcaatactatgttggcttctattgaatcatcatttgttcgggaaaaacaatttaacaatgatgtttctcatgaactacggactcctgtaacagttatactttctgaaagtgaatacggaaaaaactacgcagaaaatttaagtgaagcaaaagaatcctttgaggttatacaccgtcagtcactatcaatgaaaaaattagttgagcaacttctagaattgactaaggcagaaaatccattatcaattcagttagaacctcttaatttctcaattatgatgaagcaactagtatccgattcgagtagattattagataatacccctatacaccttgactctcaaatcgaagatgacctttggattataggtcaacaaacactactcaaacggctttttgataatctattttcaaatgctattaaatttacaaacaatcatatttctattagtctaagacagtccgataatcaaattgtcttctctattaaagataatggtctaggtatctcagttgatgaccaaagtaaaatttggaaccgtttctatcaagtggactctgctcgaaccaaggatagtcagtctggaattggtttagggctatctttagtaaaacaaatcgctacaatacaccgtgctaaaatatgggttgattctaaacctgatgatggcagtcagtttacgctcacctttccaaaattgaagaaagac

SEQ ID NO: 3256 - protein, 454 aa, Streptococcus agalactiae
MLFQSKINYPKKSSIITQITLWYSSFIFILVIGVLIGSFFISKSIAENKSKKNLEAKAVQMSQALAKGHRYEAFEDGIFYSVYDQNGKVIYSGFPKGFKRDLDHQHKHKKKLSLFSMENRTFQYVDIPISGKNQWLRAIRTVDRLDKQLTELLFSLGIVLPLMLIIITVGGYLILKRTFRPIQEITETAQFITQNEDYTKRIITKNNENELTELAAVINTMLASIESSFVREKQFNNDVSHELRTPVTVILSESEYGKNYAENLSEAKESFEVIHRQSLSMKKLVEQLLELTKAENPLSIQLEPLNFSIMMKQLVSDSSRLLDNTPIHLDSQIEDDLWIIGQQTLLKRLFDNLFSNAIKFTNNHISISLRQSDNQIVFSIKDNGLGISVDDQSKIWNRFYQVDSARTKDSQSGIGLGLSLVKQIATIHRAKIWVDSKPDDGSQFTLTFPKLKKD

SEQ ID NO: 3257 - DNA, 669 bp, Streptococcus agalactiae
atgaaaatccttgttgttgaagatgagtttgacttgaaccgtagtattgtaaaacttttaaaaaagcaacactacagtgttgacagtgcttcaaatggtgaagaagccttacaatttgtttcagtggcagaatatgatgtgattatcttagatgtaatgatgccaaaaatggacggcttcacctttttaaaactgcttcgcaacaaaggaagtcaagtatctattcttatgttgactgctcgagatgccgttgaagatcgtatcgcaggtctagattttggtgcggatgattaccttgtaaaaccatttgaatttggagaactcatggcccgaattcgagctatgttacgacgtgcaaatagacaagtatcttctgatgatattcaaattcaagatataacaatcaatttatctacaaagcaagtttggagaaacgacaatttgattgatttaacagctaaggaatacgaagtccttgagtatttggcacgtcacagagaccaagtcctctctcgtcatcaaattcgtgaacacgtttgggattatgattattatggagagtccaatattattgatgtccttatcaaaaaccttcgtcgaaaactagataacaatcgagatggatcactaataaaaactaaacgaggtttaggatatgttattccaaag

SEQ ID NO: 3258 - protein, 223 aa, Streptococcus agalactiae
MKILVVEDEFDLNRSIVKLLKKQHYSVDSASNGEEALQFVSVAEYDVIILDVMMPKMDGFTFLKLLRNKGSQVSILMLTARDAVEDRIAGLDFGADDYLVKPFEFGELMARIRAMLRRANRQVSSDDIQIQDITINLSTKQVWRNDNLIDLTAKEYEVLEYLARHRDQVLSRHQIREHVWDYDYYGESNIIDVLIKNLRRKLDNNRDGSLIKTKRGLGYVIPK

SEQ ID NO: 3259 - DNA, 684 bp, Streptococcus pyogenes
atgacaaagaaaattttaattattgaagatgaaaagaatctggctagattcgtttctcttgagctgcaacatgagggttatgaagtcattgttgaggtcaatggtcgtgaagggttagaaactgctttggaaaaagagtttgatttaatcctgcttgacttaatgttaccagagatggatggttttgaagtgacccgtcgtttgcaaaccgaaaaaacaacgtatatcatgatgatgactgcgcgtgattctattatggatgtggttgcaggtttagaccgcggtgcagacgactatattgttaaaccgtttgccattgaagaactacttgcccgtattcgtgctattttccgccgtcaagatattgaatctgagaagaaagtgcctagtcaaggcatttatcgagatctagttttaaatccacaaaaccgttcagttaatcgtggcgacgatgagatttctctcactaaacgtgaatatgatttgcttaatattttgatgactaatatgaatcgtgtcatgacacgtgaagaattattgtcaaatgtttggaaatatgatgaagccgttgagactaatgttgtagatgtctatattcgttatctccgcggcaaaattgacattccaggcaaggaatcttatatccaaacagtgcgtggcatgggatacgttattcgtgagaaa

SEQ ID NO: 3260 - protein, 228 aa, Streptococcus pyogenes
MTKKILIIEDEKNLARFVSLELQHEGYEVIVEVNGREGLETALEKEFDLILLDLMLPEMDGFEVTRRLQTEKTTYIMMMTARDSIMDVVAGLDRGADDYIVKPFAIEELLARIRAIFRRQDIESEKKVPSQGIYRDLVLNPQNRSVNRGDDEISLTKREYDLLNILMTNMNRVMTREELLSNVWKYDEAVETNVVDVYIRYLRGKIDIPGKESYIQTVRGMGYVIREK

SEQ ID NO: 3261 - DNA, 669 bp, Streptococcus agalactiae
atgacaaactataaaaacaactttaaaaaattcatgagcaataaattatacgtagggttagcttccattacgctacttggtattgggggagctataggagtaagtggagctgcattagcgcataaccatcactcagaacacatgtcttttgaacataagcatgaaggacacgataaacatcacgatcatagagaaaaatactcactaaaaacattaaagaatatctcgacaaaaatcgattataagactgccttagaaactgccaaaaaagaagctcgctcaggctttatttcacaaattgaattaaataccaaaggtgatacacctttttatgaaatcaaagttattgataataaaatagctaaaaaatataaaattgatgctaattctgggaagatcctttcaacaacatcagataatcaactcaattcaaaagatgcccaattaaaacaaccaagtaaagatattcagactgcattacaagctattcaagcaaaatataaaaatgcaaaaataaaagaaatttctcttgcgaataacaaatcaaataagctagtttataaagtaaaactacttgatggaaatactcctaagattgcccaatttgatagtgataaagcatcatttataaaggcaaataagcttaatacaactcataaaaatcacgac

SEQ ID NO: 3262 - protein, 223 aa, Streptococcus agalactiae
MTNYKNNFKKFMSNKLYVGLASITLLGIGGAIGVSGAALAHNHHSEHMSFEHKHEGHDKHHDHREKYSLKTLKNISTKIDYKTALETAKKEARSGFISQIELNTKGDTPFYEIKVIDNKIAKKYKIDANSGKILSTTSDNQLNSKDAQLKQPSKDIQTALQAIQAKYKNAKIKEISLANNKSNKLVYKVKLLDGNTPKIAQFDSDKASFIKANKLNTTHKNHD

SEQ ID NO: 3263 - DNA, 807 bp, Streptococcus agalactiae
atgcccaagaataggataaacaatttcatcaatataggaggcttaatcttagtaatctcttttctactattagtccttgatatagttaatcttccaacgaaatttggttttaatataaagactttaaatattgaaatttggaatatttacgctacgcttttaggaagcgggttaactctgtatggtgtaattataacaattaacagtcagtatgagtcacagatagaggatactaaacggattgtaaagcctatgattaatgtgtcacctgttgacgagtatagctacaaggataagtatattcaatttgactttatattccccaaagcatatccaaaccttttaagaaaggataatattgacactccaaatgtcaccatctctctggaaaatcttggaactagagaattgtataatttatatataggaaattttgaagctacttattttgatgatggtggctattattatcaacttaatccaattttatattcaaaccataaggtacaacttaatcttatgttctatgaaaaaaatggttatcttaaagaatttaatcaggaagataaatttcatttgctcatttctcctatcaaattttcaatctattttcaggattgcttgaataattggtacgaacaatcgtttaaattacgtattttccaccaagttcaagcagacaggtcagatgaagaaaattcactaacagttagtattgaaagagtagagatatattctgcccctaaagaaatttctcccgattcacttccgtggataactaatccaagtaagttatgccagtttggg

SEQ ID NO: 3264 - protein, 269 aa, Streptococcus agalactiae
MPKNRINNFINIGGLILVISFLLLVLDIVNLPTKFGFNIKTLNIEIWNIYATLLGSGLTLYGVIITINSQYESQIEDTKRIVKPMINVSPVDEYSYKDKYIQFDFIFPKAYPNLLRKDNIDTPNVTISLENLGTRELYNLYIGNFEATYFDDGGYYYQLNPILYSNHKVQLNLMFYEKNGYLKEFNQEDKFHLLISPIKFSIYFQDCLNNWYEQSFKLRIFHQVQADRSDEENSLTVSIERVEIYSAPKEISPDSLPWITNPSKLCQFG

SEQ ID NO: 3265 - DNA, 1143 bp, Streptococcus agalactiae
atgattttagaaaggaagatgcaaatggataacaaattcaaaaatatcccaaaacggcatttaccacaaaaactcccatttgactacacgtcaatatatactgacccacaaatcattaaattaactactagggcaaatattgcaatcggtacttacgaaggatttctagagtctatcattaaccctatgctactaatctcccctttgcttagccaagaagccgttctctcttcaaaacttgaagggacccatgccaccttgaaagacttacttaattatgaagctggtaataaagtagatattgagcgtgatgaattgcatgaaatcattaactaccgaaaggctctcttttatgctctagaaaacatttccaccatcaacaacatcgattctaaaggattaccgttatccaatagaattattaaagaaatgcacaaaattcttctagataatgttagaggtagtagtaaaaatcctggtaattttaagagaagtcaaaactatatcggtagtgtatcctcgatttcatacactcctgtccccgcggaaaaaacaccagaatacatgtctaatttggagcaatatatccattatgatgacttagacttattggttcagtcagcaattatccatgctcaatttgaaatgattcacccttttgaagacggtaatggacgaattggacgattgcttataccactattcctgtactatcaggaactactttcttatccaacattttatatgagttcgtattttgaaagagataggtctctttacatatcacacctatcaaacatttcaaaagacaacaactggaaagactggtttgagtattacctagaaggagtgatattgtccgcagaagagagtacaaaaaaagctcaggacatactaagcctatataacattatgaaggaacaagtcatccctaaacttaattctgtttcaggtatccagcttcttgactttatattctcggctccaatctttaaggcagaacaagttagtgaacacctaaaaatttctaagagaactacctatactttactaaataagttaattgatgaaggttatctttcaacagataatgctcaaaggaatagaacctactattgtcctcaacttctttcaatcgttcaa

SEQ ID NO: 3266 - protein, 381 aa, Streptococcus agalactiae
MILERKMQMDNKFKNIPKRHLPQKLPFDYTSIYTDPQIIKLTTRANIAIGTYEGFLESIINPMLLISPLLSQEAVLSSKLEGTHATLKDLLNYEAGNKVDIERDELHEIINYRKALFYALENISTINNIDSKGLPLSNRIIKEMHKILLDNVRGSSKNPGNFKRSQNYIGSVSSISYTPVPAEKTPEYMSNLEQYIHYDDLDLLVQSAIIHAQFEMIHPFEDGNGRIGRLLIPLFLYYQELLSYPTFYMSSYFERDRSLYISHLSNISKDNNWKDWFEYYLEGVILSAEESTKKAQDILSLYNIMKEQVIPKLNSVSGIQLLDFIFSAPIFKAEQVSEHLKISKRTTYTLLNKLIDEGYLSTDNAQRNRTYYCPQLLSIVQ

SEQ ID NO: 3267 - DNA, 918 bp, Streptococcus agalactiae
atgtttgaaatacttaaacctgataaaaaggctgttgggaaaagattgaggcaagtcaaggatgagttaaatttgtcttttacagattttggaaatcgtcttggactaaaaaaatcaaccatcaacgcatatgtaagaggagataacttagcgcctcttgaagttttagaaaaagtatcaaaaatctatggaaaacctgtaggttggttttactatggagaattggaagaatatattgaactttaccttagaaaacttggttatggtacattcctagatgaatatcctgagacaccgttaaagataaaggatgagctttttaggattaaagcaaatccaaaacaattaatcacaactaacgggggagtaaccattggaacatttgagaatcctaattgggaaaatgactttggttacccaaatgaaggctacctagatgatatcttttttgaaatgctttgtgaaactctaaagaactcaattagacaggaagctcaaacctacctaagtcagcaagaaggacttgacgatactaaaatcaaagaactctctaattactttgccaaccaaatctacatctcatatgattttgtcggaaatttagaaaatctttctaaagataaaatcaagcaagaagttaaagaaagctatgaacgtctgcttaaagattcacctcaagcaggtgtagaagttagctatgattccaattacctacttggttttctaataaatacacttgcggatagtcaaacaacaaggcaattactttcagatatgtcacaagcaacagtcggtatgcctttttcacaatttcatgagggacacgaattagttgaggttatccaatctgtcagaccacggctgatagaactttacaataacacgacctttgatgattggactgactgggcggagaaa

SEQ ID NO: 3268 - protein, 306 aa, Streptococcus agalactiae
MFEILKPDKKAVGKRLRQVKDELNLSFTDFGNRLGLKKSTINAYVRGDNLAPLEVLEKVSKIYGKPVGWFYYGELEEYIELYLRKLGYGTFLDEYPETPLKIKDELFRIKANPKQLITTNGGVTIGTFENPNWENDFGYPNEGYLDDIFFEMLCETLKNSIRQEAQTYLSQQEGLDDTKIKELSNYFANQIYISYDFVGNLENLSKDKIKQEVKESYERLLKDSPQAGVEVSYDSNYLLGFLINTLADSQTTRQLLSDMSQATVGMPFSQFHEGHELVEVIQSVRPRLIELYNNTTFDDWTDWAEK

SEQ ID NO: 3269 - DNA, 453 bp, Streptococcus agalactiae
atgaatgaatatgattatcaagaagttgtggatagggttgacggtcttaactcagtttcaacactgaaaaagtggcgattaaaaattgaaagcttgactggtactcaatttaaagaaagtagagtgagaacgggtcggaaatcttattctaaaatctatctctttacagatgatgaccttgcctactttcaagcggtcgcggataagaagtcctcattagggcttgagagggcaattctaagcgtttatgggagttccaagggaaaagaccatcagaaacccattagagagcttgtagacgagctagaagtttcttttatggaaattcaagaggattaccaaagaaacctaactgagttgaaacagaagttagaagtgcttcttgtcagaattcagaacttagagaaagagacaggggataaaacatctaagagaattggtttcttcaaacga

SEQ ID NO: 3270 - protein, 151 aa, Streptococcus agalactiae
MNEYDYQEVVDRVDGLNSVSTLKKWRLKIESLTGTQFKESRVRTGRKSYSKIYLFTDDDLAYFQAVADKKSSLGLERAILSVYGSSKGKDHQKPIRELVDELEVSFMEIQEDYQRNLTELKQKLEVLLVRIQNLEKETGDKTSKRIGFFKR

SEQ ID NO: 3271 - DNA, 207 bp, Streptococcus agalactiae
atgaagacggttcgccaccccaccgctgggcgagtggtcaatacggtagcccagagcaggtggggaaggtggcaaacggctgaaatcgaaattgaaattgcaccccgttccctattagggggtgcacacatacacgaaatgtggtcaaaacccttgataagcaaggggttcagcgatttgaagcaaatttcacgaaaaaaatcttta

SEQ ID NO: 3272 - protein, 69 aa, Streptococcus agalactiae
MKTVRHPTAGRVVNTVAQSRWGRWQTAEIEIEIAPRSLLGGAHIHEMWSKPLISKGFSDLKQISRKKSL

SEQ ID NO: 3273 - DNA, 429 bp, Streptococcus agalactiae
atgacaaaatttaacttaacagacgaaaccataaaagttggtgatttgaaattagataaatcacaatttgacattccaaagaaagtgactatcctttcttcacgggttgcaccagtctataaaaatgtcaatggcgaaagcattgcgacagatgaagtggctaaaatcacttgctctgtacaagatacagacaaaattcaagccttgaaagacttgggctattcttctgatgaccttaagggcattcgcttggagattgtagacaatcttgacaagttggctaaatccgttgaaaaggatgggttaaactcccttgtggtagaacttgtcaatccagaagtccatcttggttggcgagccaacaataatggtggagggaattggggtggcttaaagctagtggcaaccgatattaaatttattggagcc

SEQ ID NO: 3274 - protein, 143 aa, Streptococcus agalactiae
MTKFNLTDETIKVGDLKLDKSQFDIPKKVTILSSRVAPVYKNVNGESIATDEVAKITCSVQDTDKIQALKDLGYSSDDLKGIRLEIVDNLDKLAKSVEKDGLNSLVVELVNPEVHLGWRANNNGGGNWGGLKLVATDIKFIGA

SEQ ID NO: 3275 - DNA, 1026 bp, Streptococcus agalactiae
atggataactcagtgatgttagactatttagccgtaacgattaaaggcttggctccagatgatgtcattgagaaaatcctcattcttcctaaagacaagtttgtcctcaatgaatgggggataaacaagtatcaacggcattattccttctcagagataaaggtttacttcaataaggactggcaatcaaagatgggagtctttatcgaactgagagggcaggggtgccgtcagtatgaagaatatatggaaaacaatgtcaataactgggtaaccttgatgaaacgcatttctgaatgtcatagtaacgttacgagactagatattgccaacgatatctttgatgacagtctatccgtcccactcatttacagttattgtaaaaagcaactctgcatatcaaccgctaaaacctttgattaccatgaaaagagccttcttgaaaatggtgaaaaggtcggtgaaatggttacgattggtgttagaggtactcagcaatggtgtgtctataacaaattgttagaacaaaagctagaccaagaattgccaaatacgcccttatcatggacaagagcagagctgaggtgctggcaggaaaaagcaaatttactagccaaacagattaaagaggggcgaccgctcaaagagatttactttgaagttattaacggacactaccgttttgtcagcccgagggacaaggattctaaccgttggcgaagaaagacggtaaaatggtggaatgactatctagagacacaagaaaagacggtcttaagcgtaaaacggacaaaacctaccctaaaacgttctgagaagtggacagagaaacaagtctcacgaacactcggaaaactctatgtcgctaaggcggaatctcacgggcaagaaaaggcagatagctatatccagcacttacttgaattggggatttctaagctaaccgaaacagacgagactgacattcagcagtacaaacaagagcaactaagctcagcctattggggcataagaaaagacgacctg

SEQ ID NO: 3276 - protein, 342 aa, Streptococcus agalactiae
MDNSVMLDYLAVTIKGLAPDDVIEKILILPKDKFVLNEWGINKYQRHYSFSEIKVYFNKDWQSKMGVFIELRGQGCRQYEEYMENNVNNWVTLMKRISECHSNVTRLDIANDIFDDSLSVPLIYSYCKKQLCISTAKTFDYHEKSLLENGEKVGEMVTIGVRGTQQWCVYNKLLEQKLDQELPNTPLSWTRAELRCWQEKANLLAKQIKEGRPLKEIYFEVINGHYRFVSPRDKDSNRWRRKTVKWWNDYLETQEKTVLSVKRTKPTLKRSEKWTEKQVSRTLGKLYVAKAESHGQEKADSYIQHLLELGISKLTETDETDIQQYKQEQLSSAYWGIRKDDL

SEQ ID NO: 3277 - DNA, 1482 bp, Streptococcus agalactiae
atgagagataatggttcaagagtacttatcatcagttcttggcgaccagacccttataaggcgggtaatgtcttggtgaaattcgctatgcgattcacccaccctattactaaaaaatctcataagaaatacctttctacaggtgctagtaaagggtggtttaccaccaaggcaacaccgagcaaaaagttaccttctgggaaagaacgtctcttggtcagcgatattaaaaacacacaattaattactcaggtcacgcaagaactgaataaattagttgatgactatatcgccgagctaatgggcattaagcctaagaaagccaagaaacttttaaccctagaagaaatcgccaagccatttgataaagatggaaatttttacggtaaagcctttaaagcatggcatgaaagggtcaagccagccaataatacccttaaaacaagggttactatctataatcgctatattgagccgaactttgataccagaatgtccatcacgaaatttgcctttatgacagatgaaattcaaaatcttatcaatgcttcttctatgcacatggcgagaaatctgcatatctaccttaagatgatttttgactggtcagttgaaaatggacagataactcttacacaagacccgattgccagcaataaggttaaaaggcgagttctgacaaagagtgaggagcaggacaagaagcgtgaagatatagcagagaagtatctagaagcaagtgaggttaaccatgttctccgcctgatagagagctggactaatcgacctgataaccaacttatcgcagatgtattgagaatgatttttctaacaggcatgcgaccaagtgaggttttaggcttaaatgaagacatgcttgattttgagaaaaagtggataaaagttcattggcagagggcaagtaagaataaatcggatgatatgatggaagcactcaatcttgacgaaaaggaacgctaccgagcagaccttaagaccaaggaaagtgtccgcacgattccaatgagccctgaggttgagaagattctacgtcactatattgacagaaataaatttcaagctcaattcagtccgacttaccaagacttagggtatctctttactagaacctatattagggcaggtaatcgacaaggctctccgctttatcacaacgaactctcacaattcctgagaggtggctctagtcagtcagcaaagtataacaagaaagcaggcaagccctataaggatatcgatagctttctagactttggcagaccgattcatgtcatccctcatatgttccgccatagctttatctctattatggctagcgaaggtattgacctccctactattcgagaatttgtcggacactcggaggattccaaggagattgagcgtgtctatctccatgtgattaagaagcaaaaagataccatgagaggggcagttgaaaagctagaaaagttgattgaa

SEQ ID NO: 3278 - protein, 494 aa, Streptococcus agalactiae
MRDNGSRVLIISSWRPDPYKAGNVLVKFAMRFTHPITKKSHKKYLSTGASKGWFTTKATPSKKLPSGKERLLVSDIKNTQLITQVTQELNKLVDDYIAELMGIKPKKAKKLLTLEEIAKPFDKDGNFYGKAFKAWHERVKPANNTLKTRVTIYNRYIEPNFDTRMSITKFAFMTDEIQNLINASSMHMARNLHIYLKMIFDWSVENGQITLTQDPIASNKVKRRVLTKSEEQDKKREDIAEKYLEASEVNHVLRLIESWTNRPDNQLIADVLRMIFLTGMRPSEVLGLNEDMLDFEKKWIKVHWQRASKNKSDDMMEALNLDEKERYRADLKTKESVRTIPMSPEVEKILRHYIDRNKFQAQFSPTYQDLGYLFTRTYIRAGNRQGSPLYHNELSQFLRGGSSQSAKYNKKAGKPYKDIDSFLDFGRPIHVIPHMFRHSFISIMASEGIDLPTIREFVGHSEDSKEIERVYLHVIKKQKDTMRGAVEKLEKLIE

SEQ ID NO: 3279 - DNA, 1137 bp, Streptococcus pyogenes
atgtggtcagaaaaacacaaaagcggaaaagtaaattttgtagaacggtacaaacacccatacactggcaagtggtgcagagcttctgtccttatggaaaaagacacgccacgaatacgaaaagaagcccaaaaatatcttgacgaaaaaatatctgaaatcttaacaagtcttaccacaaccgatgcctacctactagatgtcatgaacgaatggtgggaacatcatcagaaatcactcaaatcaacttctgtccgctctcttgattttagaataagagaattgcgaaacttaattgatccagaagtgatgattgccaagataaccacgaaatacctgcaaagtattatcgacaaaataccaggtagttatgacaaacgtaaacgagcacggcagctgctcaaacaaaccttcgactacgctatcgctttagagtatgtctcaatcaatccagttattagtacccaactcgcaaaacctgttaagaccatcaaagactttgaagacgttgcccagaagtttttagaaaaagatgaactcaaaaggctattagatgaaatgtatagacgtaaaggatcgattaaaatggcttatctggcagaatttatgagcttaaatggctgccgcattggagaagctctagctatacagccagacaatatcaaaaatgatatcattgaaatccacggaactcttgactacacctcaaatggctatagaaacgctatcaaaaccacccctaaaacaaattccagttggcgtgaaacattgataaccaaacgtgaaaaagaaattattcaggatatactgaaaattaatgctcttgaaaaaaatactaatcctaattacaaggacatgggctacatcttcatttccagaaatggtgttcctattcaagacaacgccctcaacacctctatcagagcggcaaataagagactagaaaaaccgattcaaaaagaactcaccagccacatcttccgtcacaccctggtgagtcgccttgcagaaaacaaagtgcccttaaaaactatcatggatagagttggacatgctgactcgaaaactactcaacaaatctatacccacgtcacgaaaagcatgaaaaatgaagtcgtcgacatcttaaaccggcta

SEQ ID NO: 3280 - protein, 379 aa, Streptococcus pyogenes
MWSEKHKSGKVNFVERYKHPYTGKWCRASVLMEKDTPRIRKEAQKYLDEKISEILTSLTTTDAYLLDVMNEWWEHHQKSLKSTSVRSLDFRIRELRNLIDPEVMIAKITTKYLQSIIDKIPGSYDKRKRARQLLKQTFDYAIALEYVSINPVISTQLAKPVKTIKDFEDVAQKFLEKDELKRLLDEMYRRKGSIKMAYLAEFMSLNGCRIGEALAIQPDNIKNDIIEIHGTLDYTSNGYRNAIKTTPKTNSSWRETLITKREKEIIQDILKINALEKNTNPNYKDMGYIFISRNGVPIQDNALNTSIRAANKRLEKPIQKELTSHIFRHTLVSRLAENKVPLKTIMDRVGHADSKTTQQIYTHVTKSMKNEVVDILNRL

SEQ ID NO: 3281 - DNA, 624 bp, Streptococcus agalactiae
ttgaataaaattcatttgatatatagaattataaaagctgtacttcctaagaaaaagagaaaagaatatgatacaatgaacttgactaaattaaagaggaaagaaatgagaacatattcagataaaaacgaacttaaggaagaagtactaaaatcatataaaaaatatattgctgaattcaatgacattcctgagaagttgaaagatttaagaattgatgaggttgataggacaccagcggagaatctagcctatcaggttggctggactaccctgatactaaaatgggagtcagatgaacagagtggcttagaagttaaaacaccaactgagacgtttaaatggaatcaacttggagagctatatcagcattttactgagacctacgctagtctaaccatcaaagaacttacggctcaactcaatgataatgtagatgctataggtaacatgattgattcaatgagcgacgaagtcctatttaaacctcatatgagaaattgggctgatagtgcgactaagaatgcagtctgggaagtttataagtttattcatattaatacggtagctcctttcggaacatttagaactaagattcgcaagtggaaaaaagttgctttaaag

SEQ ID NO: 3282 - protein, 208 aa, Streptococcus agalactiae
MNKIHLIYRIIKAVLPKKKRKEYDTMNLTKLKRKEMRTYSDKNELKEEVLKSYKKYIAEFNDIPEKLKDLRIDEVDRTPAENLAYQVGWTTLILKWESDEQSGLEVKTPTETFKWNQLGELYQHFTETYASLTIKELTAQLNDNVDAIGNMIDSMSDEVLFKPHMRNWADSATKNAVWEVYKFIHINTVAPFGTFRTKIRKWKKVALK

SEQ ID NO: 3283 - DNA, 147 bp, Streptococcus agalactiae
atgcgcgtaaatattacacttgaacataaagaatctggtgaacgcttgtaccttacttcaaaaaacaaacgtaacactccagaccgtcttcaattgaaaaaatactcaccaaaacttcgtaaacacgttgttttcactgaagttaaa

SEQ ID NO: 3284 - protein, 49 aa, Streptococcus agalactiae
MRVNITLEHKESGERLYLTSKNKRNTPDRLQLKKYSPKLRKHVVFTEVK

SEQ ID NO: 3285 - DNA, 147 bp, Streptococcus pyogenes
atgcgcgtaaatattacacttgaacataaagaatctggtgaacgcttgtaccttacttcaaaaaacaaacgtaacactccagaccgtcttcaattgaaaaaatactcaccaaaattacgtaaacacgttacatttacagaggttaag

SEQ ID NO: 3286 - protein, 49 aa, Streptococcus agalactiae
MRVNITLEHKESGERLYLTSKNKRNTPDRLQLKKYSPKLRKHVTFTEVK

SEQ ID NO: 3287 - DNA, 180 bp, Streptococcus agalactiae
atggcaaaacctgcacgtcacacttcaaaagcgaagagaaacaaacgtcgtacacactacaaattgacagctccatctgtacaattcgacgaaactactggagattactcacgttcacaccgtgtatcactcaaaggatactacaaaggacgtaaaatcgctaaagctaacgaagctaaa

SEQ ID NO: 3288 - protein, 60 aa, Streptococcus agalactiae
MAKPARHTSKAKRNKRRTHYKLTAPSVQFDETTGDYSRSHRVSLKGYYKGRKIAKANEAK

SEQ ID NO: 3289 - DNA, 117 bp, Streptococcus pyogenes
atgacagctccatctgtacaattcgacgaaactactggagattactcacgttctcaccgtgtatcccttaaaggatactacaaaggacgtaaaatcgctaaagctaacgaagctaaa

SEQ ID NO: 3290 - protein, 39 aa, Streptococcus pyogenes
MTAPSVQFDETTGDYSRSHRVSLKGYYKGRKIAKANEAK

SEQ ID NO: 3291 - DNA, 1314 bp, Streptococcus agalactiae
atgtttaaagagaaaactaatcgaagaggtaaacttatgaaacttcaaaaaccaaaagggactcaggatatcttacctggagaatcagcaaagtggcaatacgttgaaaatgttatacgcaatctctttaaacaatatcattatgatgaaattcgtacaccaatgtttgaacattacgaggttattagtcgctcagttggggatacaacggatatcgttacaaaagagatgtatgattttcatgataaaggagatcgtcacattacgcttcgtccagaaggaacagcacctgttgtacgttcttatgttgaaaataaactatttgcaccagaagttcaaaaaccaaccaaaatgtattatattggatcaatgttccgatatgagcgcccacaggctggtcgtttacgagaatttcatcaagtaggcgttgagtgctttggatcaaataatccagcaactgatgttgaaacaatcgcaatgggacatcatctatttgaagatttaggtatcaaaaacgttaaacttcatcttaatagtttagggaatccagaaagtcgtcaggcctatcgccaagctcttattgattacttaacacccatacgtgaacaattgtctaaggatagtcaacgtcgtttgaatgaaaatccattgcgcgtactagactctaaggagccagaagacaaactagcagttgaaaatgctccttctattttagattatttagatgagtcaagccaagcccactttgatgctgtgtgtcatatgcttgatgctctaaatattccatacatcattgatactaatatggttcgtggtcttgattattataatcatactatttttgagtttatcactgagattgaagataatgaattaacgatctgtgctggaggccgttatgacggcttagtatcctattttggtggaccagaaacaccagcatttggttttggattaggattagaacgcttgctcttaatattagataagcaagggatttctttaccaatagaaaatactatagatctgtatatagctgtattaggatcagaggctaatctagctgccttagatttggcacaatcaatacgtcatcagggttttaaagtagagcgtgattatttgggtcgtaaaatcaaagcacaatttaagtctgcagatacttttaatgctaaagtgattatgacattaggtagcagtgaagtagattcgaaagaggtcggtttaaaaaataatcaaacacgtcaagaagttaaagttagttttgaaaacattaaaacagatttttcatctgtgcttaaacaattaggattg

SEQ ID NO: 3292 - protein, 438 aa, Streptococcus agalactiae
MFKEKTNRRGKLMKLQKPKGTQDILPGESAKWQYVENVIRNLFKQYHYDEIRTPMFEHYEVISRSVGDTTDIVTKEMYDFHDKGDRHITLRPEGTAPVVRSYVENKLFAPEVQKPTKMYYIGSMFRYERPQAGRLREFHQVGVECFGSNNPATDVETIAMGHHLFEDLGIKNVKLHLNSLGNPESRQAYRQALIDYLTPIREQLSKDSQRRLNENPLRVLDSKEPEDKLAVENAPSILDYLDESSQAHFDAVCHMLDALNIPYIIDTNMVRGLDYYNHTIFEFITEIEDNELTICAGGRYDGLVSYFGGPETPAFGFGLGLERLLLILDKQGISLPIENTIDLYIAVLGSEANLAALDLAQSIRHQGFKVERDYLGRKIKAQFKSADTFNAKVIMTLGSSEVDSKEVGLKNNQTRQEVKVSFENIKTDFSSVLKQLGL

SEQ ID NO: 3293 - DNA, 1278 bp, Streptococcus pyogenes
atgaaacttcaaaaaccaaaaggaacccaggatattctgcctggggatgctgcgaaatggcagtatgtggaatctgttgcgcgtgatacgtttagccaatataattatggagaaattcgtactcctatgtttgaacactacgaggtaatctcgcggtctgtaggtgatacgactgatattgtgacgaaggaaatgtatgatttctatgataaaggagatcgtcacattaccttgcgaccagagggtacagctccagtggtgcgttcttatgttgaaaataaattgtttgcgccagaggtccaaaaacccgtcaaactttattatatcggttccatgttccgctacgaacgtcctcaagctggtcgtttacgtgaatttcaccagattggggtagaatgtttcggcgctgctaatccagcaacagatgttgaaaccattgcgatggcctatcacctctttgaaaaattgggcattaaggatgtcacccttcatttaaatagtttggggagtcctgagagtcgtgcagcttatcgtcaagccttgattgactacttaacaccaatgcgtgatcaattatctaaagatagtcaacgtcgcttggatgaaaacccactgcgcgtgcttgattctaaagaaaaagaagataaactagccgttgaaaaagcgccttctattttggattacttagatgaggaaagtcaggcgcactttgaggcggtcaaagatatgcttgaagcacttgacattccttatgtgattgacaccaatatggtgcgtggccttgattactatagccacactatttttgaattcatcacgtctgtggaaggttctgacttaactatctgtgcgggtggacgttatgatagtttggtaggttattttggtgggcctgagactccaggatttggctttggtcttggtttagaacgtctcttgatgattattgaaaagcagggcattaccttgccaattgagacagagatggatatttaccttgctgtgttaggtgatggtgctaatagcaaagctttagaattggttcaagccattcgccgtcaagggtttacagctgaacgagattaccttggccgtaagattaaggctcagtttaaatcagccgatacctttaaagcaaaattggtaatgactttaggagaaagtgaagttgaagcaggcaaagctgtgattaagaataatcgtagtcgtcaagaagtggaagtcagttttgaagatatgatgacaaactttgcgaacatctcagagcaattattatct

SEQ ID NO: 3294 - protein, 426 aa, Streptococcus pyogenes
MKLQKPKGTQDILPGDAAKWQYVESVARDTFSQYNYGEIRTPMFEHYEVISRSVGDTTDIVTKEMYDFYDKGDRHITLRPEGTAPVVRSYVENKLFAPEVQKPVKLYYIGSMFRYERPQAGRLREFHQIGVECFGAANPATDVETIAMAYHLFEKLGIKDVTLHLNSLGSPESRAAYRQALIDYLTPMRDQLSKDSQRRLDENPLRVLDSKEKEDKLAVEKAPSILDYLDEESQAHFEAVKDMLEALDIPYVIDTNMVRGLDYYSHTIFEFITSVEGSDLTICAGGRYDSLVGYFGGPETPGFGFGLGLERLLMIIEKQGITLPIETEMDIYLAVLGDGANSKALELVQAIRRQGFTAERDYLGRKIKAQFKSADTFKAKLVMTLGESEVEAGKAVIKNNRSRQEVEVSFEDMMTNFANISEQLLS

SEQ ID NO: 3295 - DNA, 1800 bp, Streptococcus agalactiae
gtgctttttgttataataggttggaatgaatattttaaatggagaaaacagatgaaacgtagtatgtatgctgggcgtgttcgtagtgagcacataggaacatcgattactttaaaaggatgggttggtcgtcgtcgtgaccttggaggccttatttttattgatcttcgcgatcgcgagggaatcatgcaattagttattaatcctgaagaagtatcagcctcagttatggcaaccgcagaaagtctccgtagtgaatttgttatagaggttagcggtgtagtgacagcacgagaacaagctaatgataatttaccaacaggagaagttgaattaaaagtgcaagaattatcgattcttaatacctcgaaaacaacaccatttgaaattaaagatggtattgaggcaaatgatgatacacgcatgcgttaccgttacttggatcttcgtcgtccggaaatgcttgaaaatttcaaattacgtgcgaaagtaacacactcaatccgtaattaccttgacaacttagagtttattgatgtcgaaactccgatgctaacaaaatcaactccagagggggcacgagactatttggttccatcacgtgtcaaccaaggacatttttatgcccttccacaaagccctcaaattacaaaacagctattgatgaatgcgggatttgatcgttattatcaaattgtcaaatgtttccgtgatgaggatttacgtggagaccgtcaacctgagtttacacaagttgacttagagacatcattccttagtgatcaagaaattcaagacattgttgagggtatgattgctaaagtaatgaaagacactaaaggtttagaggtttctttaccattcccaaggatggcatatgatgatgcaatgaataactacgggtctgataagcctgatacaaggtttgatatgcttttacaagacttgacagaaattgtcaaagaagttgacttcaaggtgttctcagaagcttcagtagttaaagcgattgttgtcaaagataaggcggacaagtactctcgaaaaaatattgataaattaacagaaattgcaaaacaatacggtgccaaaggtttagcatggctaaaatatgcagataatactatttcaggtccggttgctaagttcttgacagctattgaaggtaggttgacagaagctttacagctagagaataatgacttaattctatttgtagcagatagtcttgaagtagctaacgagactttaggagcgcttcgtacacgcattgcaaaagaacttgaactcattgattattctaaatttaatttcctatgggttgttgattggccaatgtttgagtggtcagaagaagagggacgatatatgtcggctcatcatccattcaccttgccaacagcggagacagcgcatgagttggaaggggatttggctaaagtacgtgcagttgcctatgatattgttttgaatggatatgagttaggcggtggtagcctacgtattaaccaaaaagatacacaagagcgtatgttcaaggctttaggatttagcgctgaatcagctcaggaacagtttggtttcttacttgaagctatggattacggcttcccaccacatggtggattggcaataggccttgaccgctttgttatgttgttagcaggcaaggacaatattcgagaagttattgcattccctaaaaacaataaggctagtgatccaatgactcaagctcctagtctcgtttcagaacaacaattagaagaattatcacttactgtagaaagttatgaaaac

SEQ ID NO: 3296 - protein, 600 aa, Streptococcus agalactiae
MLFVIIGWNEYFKWRKQMKRSMYAGRVRSEHIGTSITLKGWVGRRRDLGGLIFIDLRDREGIMQLVINPEEVSASVMATAESLRSEFVIEVSGVVTAREQANDNLPTGEVELKVQELSILNTSKTTPFEIKDGIEANDDTRMRYRYLDLRRPEMLENFKLRAKVTHSIRNYLDNLEFIDVETPMLTKSTPEGARDYLVPSRVNQGHFYALPQSPQITKQLLMNAGFDRYYQIVKCFRDEDLRGDRQPEFTQVDLETSFLSDQEIQDIVEGMIAKVMKDTKGLEVSLPFPRMAYDDAMNNYGSDKPDTRFDMLLQDLTEIVKEVDFKVFSEASVVKAIVVKDKADKYSRKNIDKLTEIAKQYGAKGLAWLKYADNTISGPVAKFLTAIEGRLTEALQLENNDLILFVADSLEVANETLGALRTRIAKELELIDYSKFNFLWVVDWPMFEWSEEEGRYMSAHHPFTLPTAETAHELEGDLAKVRAVAYDIVLNGYELGGGSLRINQKDTQERMFKALGFSAESAQEQFGFLLEAMDYGFPPHGGLAIGLDRFVMLLAGKDNIREVIAFPKNNKASDPMTQAPSLVSEQQLEELSLTVESYEN

SEQ ID NO: 3297 - DNA, 1797 bp, Streptococcus pyogenes
ttggaaacgagcaggtttcacaggattctgtttgttttagggaatttatttatgaaacgtagcatgtatgcagggcgtgttcgcgaagaacacattggaacgacaatcacattgaaaggatgggtcagtcgtcgtcgtgacttgggtggtctcatctttattgatttgcgtgaccgtgagggtgtgatgcaattagtcattaaccctgaggaagtttccagtgatgtgatggcaactgctgaacgcttacgtagtgaatatgtgattgaagtggaaggttttgttgaagctcgacaacaagccaatgataagttggcgacaggaatggttgagttaaaagtatctgctttgaccattttaaacacagctaaaacgacgccttttgaaattaaagatgacgttgaagtaagtgatgacacgcgtttacgttaccgttacttagatttacgacgtccagaaatgttagaaaacttcaagctacgtgcaaaagtgactcattctatccgtaattaccttgatgaccttgagtttatcgatgtcgagacacctatgttgacaaaatcaactccagaaggtgcgcgtgactatctggtaccaagtcgtgttagccaagggcatttctatgctttgccacaaagtccgcaaataaccaaacagttattgatgaatgctggctttgatcgctattatcaaattgtgaaatgtttccgcgatgaagatctacgtggtgaccgtcaacctgagtttacacaagttgacttggaaacgtcattcctttctgaacaagaaattcaagacatcgttgaaggcatgattgctaaagtgatgaaagagacaaaagaaatagatgtaaccctaccattcccacgtatgagctacgatgtagcaatgaatagctacggctctgataaaccagacacacgttttgaaatgcttttacaagacttgacagtaactgtcaaaggaaatgacttcaaggttttctcagaagcaccagctgtcaaggcgattgtggtgaagggaaatgcagatcgatactctcgtaaagatattgacaaattaactgagtttgccaaacaatttggtgctaaaggccttgcctgggttaaggtgacagatggtcaattggcaggcccagtagccaagttcttgacagctattgagacagagttgtcaagccaattaaaacttgctgagaatgatttggttttatttgtagcggatactcttgaggttgctaataatacattaggtgcccttcgtaatcgtattgccaaggaccttgacatgattgatcagtcgcagtttaatttcctttgggtggttgattggccaatgtttgagtggtcagaagaagaaggacgttatatgtcagctcatcaccccttcactcttccaacgccagaatctgctcatgagttagagggtgatttggctaaggtacgggctattgcttacgacatcgttttaaatggttacgagcttggtggtggtagcctgcgtatcaatcaaaaagagatgcaagagcgcatgttcaaggctcttggctttaccgctgatgaagctaacgaccaatttggtttcttactagaagcgatggactacggctttcctcctcatggtggcttggcaattggtcttgaccgttttgtcatgttgcttgctggaaaagacaatattcgagaagttattgccttccctaaaaataacaaagcctctgatccaatgacgcaagcacctagtcttgtttctgaaaaccaattagaagaactcagtcttcaaatagaaagtcatgat

SEQ ID NO: 3298 - protein, 599 aa, Streptococcus pyogenes
LETSRFHRILFVLGNLFMKRSMYAGRVREEHIGTTITLKGWVSRRRDLGGLIFIDLRDREGVMQLVINPEEVSSDVMATAERLRSEYVIEVEGFVEARQQANDKLATGMVELKVSALTILNTAKTTPFEIKDDVEVSDDTRLRYRYLDLRRPEMLENFKLRAKVTHSIRNYLDDLEFIDVETPMLTKSTPEGARDYLVPSRVSQGHFYALPQSPQITKQLLMNAGFDRYYQIVKCFRDEDLRGDRQPEFTQVDLETSFLSEQEIQDIVEGMIAKVMKETKEIDVTLPFPRMSYDVAMNSYGSDKPDTRFEMLLQDLTVTVKGNDFKVFSEAPAVKAIVVKGNADRYSRKDIDKLTEFAKQFGAKGLAWVKVTDGQLAGPVAKFLTAIETELSSQLKLAENDLVLFVADTLEVANNTLGALRNRIAKDLDMIDQSQFNFLWVVDWPMFEWSEEEGRYMSAHHPFTLPTPESAHELEGDLAKVRAIAYDIVLNGYELGGGSLRINQKEMQERMFKALGFTADEANDQFGFLLEAMDYGFPPHGGLAIGLDRFVMLLAGKDNIREVIAFPKNNKASDPMTQAPSLVSENQLEELSLQIESHD

SEQ ID NO: 3299 - DNA, 942 bp, Streptococcus agalactiae
atgaaaactagacgaacccctttagaaaaaaaggtaaaatatattatcagtgtatgggctaaaaaatttggtctcttacacactttaaaaagtatctcacgagaaaaatatgcagagaaaatttcggcttcattgctgtatggtattctatccagtgttgctgtcaatttcttttttcaacctggacatgtttattcaagtggagcaactggtttagctcaggttatttcagctgtcagtaaacactggttttcttttgaaataccagttgctttagctttttatgccattaatatccctttgctgatattatcttggcgtaagattggacataaatttactatttttacgtttatcacagtaactgtaagctctatcttcattcaactaatgcctcaaatcacccttacaactgatcccttaatcaatgctatctttggtggtttaattatgggagctggtgttggttttagctttaagtctagaatttctagtgggggaacagatattatcagtttgacaattagaaagaaaacaggcagagatgtaggtagtatttcttttattattaatggtattattttattatttgcaggtcttttatttggttggaagtacgctttgtactcgatggtgaccatttttgtatcaagtagagttacagatgccatttttacaaagcaaaaaaagatgcaagcgatgattgttaccagtaagccttattgcgtcattaaacgtatccatcgtgatttacatcgtggtgtaacctgtatcaatgatgctgaaggtacttataatcatgagaaaaaagcagttttaataactatattaacacgtgaagaatttagtgattttaaatatttaatgctaaaagcggatccaaaagcctttgtttccgttgcagaaaatgttcatattattggacgattcgttgatgatgat

SEQ ID NO: 3300 - protein, 314 aa, Streptococcus agalactiae
MKTRRTPLEKKVKYIISVWAKKFGLLHTLKSISREKYAEKISASLLYGILSSVAVNFFFQPGHVYSSGATGLAQVISAVSKHWFSFEIPVALAFYAINIPLLILSWRKIGHKFTIFTFITVTVSSIFIQLMPQITLTTDPLINAIFGGLIMGAGVGFSFKSRISSGGTDIISLTIRKKTGRDVGSISFIINGIILLFAGLLFGWKYALYSMVTIFVSSRVTDAIFTKQKKMQAMIVTSKPYCVIKRIHRDLHRGVTCINDAEGTYNHEKKAVLITILTREEFSDFKYLMLKADPKAFVSVAENVHIIGRFVDDD

SEQ ID NO: 3301 - DNA, 939 bp, Streptococcus pyogenes
atgattaagaaaacaacctataagaaaaaagttaaatatgtcattagtagaggggccaagaaagttggcctactccacgctctaagaagtatttcaagagaaaaatatgcagagaagatttcggcttctctgctttatggcattctctctagtattgctgtgaattttttcttccagcctgggcatgtttattcaagtggagcaactggtctagcacaggttttttcagctcttagtcatcgtcttttaggctatgattttcccatcgcctttgcgttttatttgattaatattcctttgcttattttagcttggtataaaattgggcatcaatttaccatttttacctttatcacagtcagcatgagttctttctttattcaaatcatgcctcaagtgacgctgacgactgatcctcttatcaatgctatttttggtggtttggttatgggaatgggaattggtacaggtctcaaatcacgtatctctagtggggggactgatattgtcagtttgacccttaggaaacgaacaggcaaggatgtgggcagtctctcattgatggttaatggtgcaattttagcctttgcagggattttatttggctggcagtacgccctttattctatggtctctatctttgtatcaagtcgtgttacggatgccattttcaccaagcaaaagaaaatgcaggcaactattgttaccagccatccagagcgtgtgattcatatgatccataaacgtctgcatcgcggagtgaccagtatcaacgacgcagaagggacttacaagcatgaacaaaaagcagttttgattaccattttgacatgtgaagaatacccagaattcaaatggctgatgttaaaaacagacccacaagcctttgtttcagtggctgagaatgttagaattatcggtcgttttgtggaagatgat

SEQ ID NO: 3302 - protein, 313 aa, Streptococcus pyogenes
MIKKTTYKKKVKYVISRGAKKVGLLHALRSISREKYAEKISASLLYGILSSIAVNFFFQPGHVYSSGATGLAQVFSALSHRLLGYDFPIAFAFYLINIPLLILAWYKIGHQFTIFTFITVSMSSFFIQIMPQVTLTTDPLINAIFGGLVMGMGIGTGLKSRISSGGTDIVSLTLRKRTGKDVGSLSLMVNGAILAFAGILFGWQYALYSMVSIFVSSRVTDAIFTKQKKMQATIVTSHPERVIHMIHKRLHRGVTSINDAEGTYKHEQKAVLITILTCEEYPEFKWLMLKTDPQAFVSVAENVRIIGRFVEDD

SEQ ID NO: 3303 - DNA, 870 bp, Streptococcus agalactiae
atgttgaaactggatttaaaaacaaagataaaagaaactattttaattgcctttggtgtggctctctatactttcggctttgtcaaatttaatatggctaatcatttggctgaaggaggtatttccggtgtcactttgattatccatgcacttttcggagttaatccagcactttcatcacttctccttaatatcccgttatttatattaggggctaggattttagggaaaaaatccttattgttaactatatatggtacagtgttaatgtcttttttcatgtggttttggcaacaaatccctgtaacagtccctttgaaaaacgatatgatgttagttgcagtagctgctggaattttagcaggaactggtagtggtttagtatttagatatggtgcaactacaggtggtgcagatattattggtcgtattgtagaggaaaaatctggaataaaattagggcaaaccttattgtttattgatgctatagttctaacgtcttcacttgtttatattaatttacaacagatgctatatacgttagtagctagctttgtatttagtcaagtgttaacaaatgttgaaaatgggggctacactgttcgtggaatgatcattattaccaaagaatcagaatctgcagcagcaaccattttgcatgaaattaataggggtgtaacttttttacggggccaaggtgcctactcaggtagagagcatgatgtcttgtacgtagctcttaacccaagtgaagtgcgtgatgtgaaagaaatcatggctgatttagacccagatgcttttatttctgttataaatgtagatgaagttattagctcagattttaaaattcgacgaagaaattacgataaa

SEQ ID NO: 3304 - protein, 290 aa, Streptococcus agalactiae
MLKLDLKTKIKETILIAFGVALYTFGFVKFNMANHLAEGGISGVTLIIHALFGVNPALSSLLLNIPLFILGARILGKKSLLLTIYGTVLMSFFMWFWQQIPVTVPLKNDMMLVAVAAGILAGTGSGLVFRYGATTGGADIIGRIVEEKSGIKLGQTLLFIDAIVLTSSLVYINLQQMLYTLVASFVFSQVLTNVENGGYTVRGMIIITKESESAAATILHEINRGVTFLRGQGAYSGREHDVLYVALNPSEVRDVKEIMADLDPDAFISVINVDEVISSDFKIRRRNYDK

SEQ ID NO: 3305 - DNA, 870 bp, Streptococcus pyogenes
atggcacatcacgataaattgactaaactactaaaactgtttttgattgccctaggtgtagccatttataccttcggttttgttaattttaacatggctaatgctttggctgaaggtggtgtggcaggaataaccttgattttacacgcgcattttgggattaatcctgcttactcttctctcttatttaatcttccactttttattttaggggcaaagatttttgggaagcgttctttggctctaaccatctatggaacagttctgatgtccgcttttatctggatgtggcaaaaagttcctatcgaacttggcttggaaaatgacatgatgttggtggctgtagtggcaggtctcttttcagggattgggagtggcattgtttttcgctatggtgcaaccacaggtggaacggatattattggtcgcattgcagaagaaaaatttggagctaagctaggtcaaactttgcttttggtggatgctcttgtattgacagcttcgttgacttatgtggatttaaaacacatgctttacactttggtggcaagctttgtttttagccaaatgattagtgtggttcaaaatggtggttacactatccgtggaatgattattattaccaagcattcagaggctgccgctcaagctatcctaaccgaaatcaatcgtggagtgacttacttgaaaggtcaaggagcttactctggtaatgattacaatatcatgtatgtgaccttgaacccaactgaagttcgggaagtcaaacgtattttagctggtttggatccagatgcctttatctccattattgatgtggacgaagttattagctctgattttaaaattcgccgaagaaattatgataaa

SEQ ID NO: 3306 - protein, 290 aa, Streptococcus pyogenes
MAHHDKLTKLLKLFLIALGVAIYTFGFVNFNMANALAEGGVAGITLILHAHFGINPAYSSLLFNLPLFILGAKIFGKRSLALTIYGTVLMSAFIWMWQKVPIELGLENDMMLVAVVAGLFSGIGSGIVFRYGATTGGTDIIGRIAEEKFGAKLGQTLLLVDALVLTASLTYVDLKHMLYTLVASFVFSQMISVVQNGGYTIRGMIIITKHSEAAAQAILTEINRGVTYLKGQGAYSGNDYNIMYVTLNPTEVREVKRILAGLDPDAFISIIDVDEVISSDFKIRRRNYDK

SEQ ID NO: 3307 - DNA, 306 bp, Streptococcus agalactiae
atgccatcagaaaaagaaatattagatgctcttagtaaagtttatagcgaagaagtaatacaagcagatgattattttcgtcaagctattttcgagctcgctagtcaacttgaaaaagaggggatgaactcactcctagctacaaaaattgactcacttatcaatcaatacgtcttaacacatcaatttgatgctcctaaaagcatatttgatcttagtcgcttggtaaaaacaaaagctagccattacaagggaactgctatctcagctattatgcttggtagtttcttaagtggaggaccaaaa

SEQ ID NO: 3308 - protein, 102 aa, Streptococcus agalactiae
MPSEKEILDALSKVYSEEVIQADDYFRQAIFELASQLEKEGMNSLLATKIDSLINQYVLTHQFDAPKSIFDLSRLVKTKASHYKGTAISAIMLGSFLSGGPK

SEQ ID NO: 3309 - DNA, 324 bp, Streptococcus pyogenes
atgttacaggagaatgccatgccatcagaaaaagaaatattagatgctcttagtaaagtttatagcgaacaagtaatacaagcagatgattattttcgtcaagcgatcttcgagctcgccagtcaacttgaaaaagaggggatgagctcactcctagctacaaaaattgactcacttatcaatcaatacatcttaacacatcaatttgatgctcctaaaagcatatttgatcttagtcgcttggtaaaaacaaaagctagccattacaagggaactgctatatcagctattatgcttggtagtttcttaagtgggggaccaaaa

SEQ ID NO: 3310 - protein, 108 aa, Streptococcus pyogenes
MLQENAMPSEKEILDALSKVYSEQVIQADDYFRQAIFELASQLEKEGMSSLLATKIDSLINQYILTHQFDAPKSIFDLSRLVKTKASHYKGTAISAIMLGSFLSGGPK

SEQ ID NO: 3311 - DNA, 1722 bp, Streptococcus agalactiae
gtgactatattactaattaaaataggagataccatggatacaaaacatctaattgcgagtgaaattcaaaaagttgttccagatatggaacaatcgaccattctttctttattagaaaccccaaaaaattcgagcatgggagatttagctttcccagcattctctttggctaaaactctacgcaaagcacctcaaataattgctagtgacattgctgaacaaattaaaagcgaccaatttgaaaaggtggaagctgttggaccttacgttaactttttccttgataaagccgcaatctcaagtcaagttttaaaacaagtcttatctgatggttctgcctatgctactcaaaatattggtgaaggacgaaatgttgccattgacatgtctagtccaaatattgctaagccattctcaattggacaccttcgttcaacagttattggtgatagtttagctaatatttttgataaaattggctatcatcctgttaaaattaatcaccttggcgactggggtaaacaatttggaatgttaatcgttgcctataaaaaatggggcaatgaagaggctgtccgtgctcatcccatcgatgaacttttaaaactttatgtccgtattaatgctgaagccgagacagaccctagcgttgatgaagaggcacgtgagtggtttcgtaaacttgaagctaacgatcctgaagcaactgaattatggcaatggttccgtgacgagtcattattagaattcaaccgtctttacgatcaaatgaatgttacatttgatagctataacggcgaggcattctacaacgacaaaatggatgaagtgcttgaactgctagaatctaaaaacctcctagtcgaatctaaaggtgcacaagttgttaacctagaaaaatacggtattgaacatcctgccctcattaaaaaatccgatggagcaactctctacattacacgtgacttagctgctgcactttaccgtaaacgtacctacgattttgcaaaatcaatctacgttgtaggaaacgaacagtctgcacactttaagcaactaaaagctgtgcttaaagaaatggactacgattggtccgatgatatgactcatgttccttttggccttgtaacaaaaggaggagcaaaattatcaactcgtaaaggaaatgtaattctacttgaacctactgttgcagaagctattaatcgtgcggcatctcagattgaagctaaaaaccctaacctagcagataaagataaagttgctcaagcagttggtgtaggtgctattaaattttacgatttgaaaactgatcgtacaaatggttatgactttgacttagaagcaatggtatcatttgaaggtgaaactgggccatatgtacaatatgcacatgctcgtattcaatcaatcttacgtaaagctaactttagcccatctaatagcgataattacagtctcaacgatgttgaaagctgggaaatcatcaaactcatccaagattttcctcgtattattgtacgtgcggcagataattttgagccctctattattgcaaaattcgctattaatttagctcagtgcttcaataaatattacgcccacacacgtattttagatgaagacgctgaaatcagtagtcgtctagcactttgctatgcaactgctacagtattaaaagaatctcttcgcctcctaggagttgatgctccgaatgaaatg

SEQ ID NO: 3312 - protein, 574 aa, Streptococcus agalactiae
MTILLIKIGDTMDTKHLIASEIQKVVPDMEQSTILSLLETPKNSSMGDLAFPAFSLAKTLRKAPQIIASDIAEQIKSDQFEKVEAVGPYVNFFLDKAAISSQVLKQVLSDGSAYATQNIGEGRNVAIDMSSPNIAKPFSIGHLRSTVIGDSLANIFDKIGYHPVKINHLGDWGKQFGMLIVAYKKWGNEEAVRAHPIDELLKLYVRINAEAETDPSVDEEAREWFRKLEANDPEATELWQWFRDESLLEFNRLYDQMNVTFDSYNGEAFYNDKMDEVLELLESKNLLVESKGAQVVNLEKYGIEHPALIKKSDGATLYITRDLAAALYRKRTYDFAKSIYVVGNEQSAHFKQLKAVLKEMDYDWSDDMTHVPFGLVTKGGAKLSTRKGNVILLEPTVAEAINRAASQIEAKNPNLADKDKVAQAVGVGAIKFYDLKTDRTNGYDFDLEAMVSFEGETGPYVQYAHARIQSILRKANFSPSNSDNYSLNDVESWEIIKLIQDFPRIIVRAADNFEPSIIAKFAINLAQCFNKYYAHTRILDEDAEISSRLALCYATATVLKESLRLLGVDAPNEM

SEQ ID NO: 3313 - DNA, 1689 bp, Streptococcus pyogenes
atggatactaaaactctaatcgcaagtgaaatagctaaagttgttccagaattagaacaagatgctatttttaacttgcttgaaaccccaaaaaattctgacatgggagaccttgcctttccagcttttagcttagcaaaagtccttcgcaaagcccctcaaatgattgctagcgagttagctgaacagattgatgagagccaatttgaaaaagtcgtagctgtcggcccttacatcaactttttccttgataaagctaagatttcctcacaggtccttgaacaagtgattacagcaggttcagactatgctcagcaagacgaaggtcaagggcgaaatgttgctattgacatgtcaagcccaaacatcgctaagccattttcaatcggtcacctccgctcaacagttattggtgatagtctcgctcacatttttgccaaaatgggctataaacctgtaaaaatcaatcaccttggtgactggggtaaacaatttggtatgctcattgttgcctacaaaaaatggggagatgaagctgctgttcaggcacatcctattgatgaactcttaaaactttacgttcgtatcaatgctgaagctgaaactgatcccaccgttgatgaagaagctcgtgaatggttccgtaaattggaagatggcgacaaagaagctactgaattatggcaatggttccgtgatgaaagtttacttgagttcaaccgactttatgaccaattacatgtcaccttcgatagttacaacggtgaggccttctataatgacaaaatggatgaggttcttgacttattagaagctaaaaaccttcttgtagaatctaaaggtgcccaagttgttaatcttgaaaaatatggtattgaacaccctgccttgatcaaaaaatcagatggcgctactctttacattacccgtgacctagctgccgcactttaccgtaaacgcacttatgactttgctaaatccgtttatgttgttggtaatgagcaagctgctcacttcaaacaattaaaagcagtgctaaaagaaatgggttacgattggtcagatgatatgacacacgttgcttttggacttgtcacaaaaggcggtgctaaattatcaacacgtaaaggtaatgttattcttcttgaacctacggttgctgaagccattaaccgtgcagcttctcaaattgaagcgaaaaatccaaaccttgctgacaaagaagctgttgcacacgctgttggtgtcggcgccatcaagttttacgatctcaaaacagatcgtatgaatgggtatgactttgaccttgaggccatggtttcctttgaaggagaaactggaccttatgttcaatacgctcacgctcgtatccaatctattctacgtaaagctgactttacgccatctgcaaccaccacttacagtttagctgatgctgaaagctgggaaattatcaaacttatccaagatttcccacgcattatcaagcgaacatcagataactttgagccttctattatggctaaatttgctattaacttagcccaaagctttaacaaatattatgctcacactcgcattctcgacgacaactcagaacgtgataaccgcttagctctctgctatgcaactgctactgttcttaaagaagcgcttcgcttactcggtgttgacgcaccaaatgaaatg

SEQ ID NO: 3314 - protein, 563 aa, Streptococcus pyogenes
MDTKTLIASEIAKVVPELEQDAIFNLLETPKNSDMGDLAFPAFSLAKVLRKAPQMIASELAEQIDESQFEKVVAVGPYINFFLDKAKISSQVLEQVITAGSDYAQQDEGQGRNVAIDMSSPNIAKPFSIGHLRSTVIGDSLAHIFAKMGYKPVKINHLGDWGKQFGMLIVAYKKWGDEAAVQAHPIDELLKLYVRINAEAETDPTVDEEAREWFRKLEDGDKEATELWQWFRDESLLEFNRLYDQLHVTFDSYNGEAFYNDKMDEVLDLLEAKNLLVESKGAQVVNLEKYGIEHPALIKKSDGATLYITRDLAAALYRKRTYDFAKSVYVVGNEQAAHFKQLKAVLKEMGYDWSDDMTHVAFGLVTKGGAKLSTRKGNVILLEPTVAEAINRAASQIEAKNPNLADKEAVAHAVGVGAIKFYDLKTDRMNGYDFDLEAMVSFEGETGPYVQYAHARIQSILRKADFTPSATTTYSLADAESWEIIKLIQDFPRIIKRTSDNFEPSIMAKFAINLAQSFNKYYAHTRILDDNSERDNRLALCYATATVLKEALRLLGVDAPNEM

SEQ ID NO: 3315 - DNA, 444 bp, Streptococcus agalactiae
ttgaataacatgaataaaatagaacgccaaaaacgtattaaacgtttgatccaatcagggcagattggcacacaagaagaaattaaattacatttaaaaaatgaaggaatcgatgtcacgcaagcgactctatcaagagacttgcgtgagattggtcttttaaaattacgtagcccagaaggtaagctatattatagtttatcaacagctacttcaaatcgatttagcccagccttacgctcatatattttgaaagtatcgcgagcaagttttatgttagttttaaatactaatttaggggaggctagcgttttagcaaactttattgatgagaaagggctgccagagattttaggaacaatggcaggagcagacaccttgttggtgatttgtcaaaatgaagatattgccaaagtttttgaaaaagaactatcagtaggttta

SEQ ID NO: 3316 - protein, 148 aa, Streptococcus agalactiae
MNNMNKIERQKRIKRLIQSGQIGTQEEIKLHLKNEGIDVTQATLSRDLREIGLLKLRSPEGKLYYSLSTATSNRFSPALRSYILKVSRASFMLVLNTNLGEASVLANFIDEKGLPEILGTMAGADTLLVICQNEDIAKVFEKELSVGL

SEQ ID NO: 3317 - DNA, 435 bp, Streptococcus pyogenes
atgaataaaatggagcgtcaacagcagattaagcgaatcattcaagcagagcatattggcacacaagaagatattaaaaatcaccttcaaaaagaaggcattgtggtcacccaagcaactctatctcgggacttaagagaaattggccttttgaaattgagagatgaacaaggcaaactctattatagtttgtctgaacccgttgcaacaccatttagtcctgaggtgcgtttttatgttttgaaagttgatcgagcaggttttatgctggttctccataccaatttaggagaggctgatgttctagctaatttgattgacaatgatgccattgaagatattctaggaaccattgctggtgcggataccttgcttgtgatttgcagagacgaagagattgctaaacgctttgaaaaagatttggctgcaggccta

SEQ ID NO: 3318 - protein, 145 aa, Streptococcus pyogenes
MNKMERQQQIKRIIQAEHIGTQEDIKNHLQKEGIVVTQATLSRDLREIGLLKLRDEQGKLYYSLSEPVATPFSPEVRFYVLKVDRAGFMLVLHTNLGEADVLANLIDNDAIEDILGTIAGADTLLVICRDEEIAKRFEKDLAAGL

SEQ ID NO: 3319 - DNA, 2574 bp, Streptococcus agalactiae
atggccaagccaacgatatcaccgggaatgcaacagtatctggatataaaagagaattatccagatgcttttttgctttttagaatgggtgatttttatgaattattttatgatgatgcggtaaaagcagcacaaatcctggaaattagcttgactagtcgaaataagaacgcagaaaagccaatcccaatggcaggagttccctatcactcagctcaacagtatattgacgttttagttgaattaggttacaaagtagccattgctgagcagatggaagatcctaaaaaagctgtgggagtggtcaagcgtgaggtagtgcaagttgttaccccaggaacggttgtggagtcaacgaagccggatagtgctaataatttcttagtagcgattgattcgcaagatcaacaaacatttggtctagcatatatggatgtctcaactggagagtttcaggcaacccttttaacagattttgagtccgtccgtagtgaaatactaaatttaaaagctcgtgagattgtagtaggatatcaattgacggacgaaaaaaatcacctactgacgaagcagatgaacttgcttttatcatacgaagacgaacgacttaatgatattcatttgattgatgagcagttaactgatttggaaatatctgctgcggaaaaacttttacaatatgtgcatagaacacaaaagcgtgaacttagtcatttacagaaagtagttcattatgaaataaaggactatttacaaatgtcatatgcaacgaaaaatagtctagatttactggagaatgctagaacaagcaagaagcatggaagtctttactggttgttagatgagactaaaacagcgatgggaactcgaatgctgagaacttggattgacaggcctttggtaagtatgaatcgaatcaaggaacgtcaagatattattcaagtgtttcttgattatttttttgagagaaacgatctcacagaaagtttaaagggtgtatatgatattgaacgcctagcaagtcgagtatctttcggaaaagccaaccctaaagatctattgcaactcggacagaccttatcacaaattcctcggattaaaatgattttacagtccttcaatcaacctgagcttgacatcattgtcaacaaaattgacactatgcctgaattagaaagtttaattaatacggcgatagccccagaagcacaggctactatcactgagggaaacattatcaagtctggatttgataagcaattggataattatcgaacagtgatgcgtgaaggtacaggttggattgctgatattgaagctaaggaaagagcagcaagtggtatcggtactcttaaaattgattataataaaaaagacggttattacttccatgttaccaattccaatttatcactagtaccggagcattttttccgtaaagcgacattaaaaaattctgaacgctatggaacagctgaactagccaaaattgaaggtgaaatgctcgaagctcgcgagcaatcttcaaatttagaatatgatatttttatgcgtgttcgtgcccaagtagaatcttatattaaacgtcttcaagagttagcaaagacgattgcaaccgttgatgttctacagagtttggcagtagttgcagaaaattatcactatgttcgtcccaaatttaatgatcaacatcagattaagattaagaatgggcgtcatgcaactgttgaaaaagtgatgggagtgcaagaatatattcccaatagcatctattttgatagtcagacagatatccagttgattacaggaccaaatatgagtggtaagtcgacctatatgcgccagttagctttgacagttattatggcacaaatgggaggttttgtatcggcagacgaagttgatttgcctgtatttgatgcaatatttactaggattggtgctgctgacgacttaatttctgggcaatcaacctttatggtagaaatgatggaagcgaatcaagctgtaaaacgagccagtgataaatctttgattctttttgatgaattaggtcgagggacagccacttatgatggtatggcattagctcaatcgattatagaatatattcatgaccgtgttagggcaaaaacaatgtttgcgactcattaccatgagttgacagatttatctgaacagttgacaaggcttgtcaatgtacacgtggctactttagagagagatggagaagttaccttcttacataaaattgaatctggacctgcggataagtcttatgggatacacgtcgcaaaaatagctggtttaccaattgacttattggatagggcaactgatattttatcacagttggaagctgatgcagtacagttgatcgtatcgccctcccaagaagctgttactgctgacttaaatgaggaactagattctgagaagcaacaaggacaattatcgctttttgaagaaccttcaaatgcaggtagggttattgaggagttagaagcgatagatataatgaatctaactccaatgcaagctatgaatgctatatttgacttaaagaaattatta

SEQ ID NO: 3320 - protein, 858 aa, Streptococcus agalactiae
MAKPTISPGMQQYLDIKENYPDAFLLFRMGDFYELFYDDAVKAAQILEISLTSRNKNAEKPIPMAGVPYHSAQQYIDVLVELGYKVAIAEQMEDPKKAVGVVKREVVQVVTPGTVVESTKPDSANNFLVAIDSQDQQTFGLAYMDVSTGEFQATLLTDFESVRSEILNLKAREIVVGYQLTDEKNHLLTKQMNLLLSYEDERLNDIHLIDEQLTDLEISAAEKLLQYVHRTQKRELSHLQKVVHYEIKDYLQMSYATKNSLDLLENARTSKKHGSLYWLLDETKTAMGTRMLRTWIDRPLVSMNRIKERQDIIQVFLDYFFERNDLTESLKGVYDIERLASRVSFGKANPKDLLQLGQTLSQIPRIKMILQSFNQPELDIIVNKIDTMPELESLINTAIAPEAQATITEGNIIKSGFDKQLDNYRTVMREGTGWIADIEAKERAASGIGTLKIDYNKKDGYYFHVTNSNLSLVPEHFFRKATLKNSERYGTAELAKIEGEMLEAREQSSNLEYDIFMRVRAQVESYIKRLQELAKTIATVDVLQSLAVVAENYHYVRPKFNDQHQIKIKNGRHATVEKVMGVQEYIPNSIYFDSQTDIQLITGPNMSGKSTYMRQLALTVIMAQMGGFVSADEVDLPVFDAIFTRIGAADDLISGQSTFMVEMMEANQAVKRASDKSLILFDELGRGTATYDGMALAQSIIEYIHDRVRAKTMFATHYHELTDLSEQLTRLVNVHVATLERDGEVTFLHKIESGPADKSYGIHVAKIAGLPIDLLDRATDILSQLEADAVQLIVSPSQEAVTADLNEELDSEKQQGQLSLFEEPSNAGRVIEELEAIDIMNLTPMQAMNAIFDLKKLL

SEQ ID NO: 3321 - DNA, 2553 bp, Streptococcus pyogenes
atggcaaaaactaacatttctcctggaatgcaacagtatctggacatcaaaaaagattatccagatgcttttttgctttttaggatgggtgacttttatgaattattttacgaggacgctgtcaaagcagcacaactcttagaaattggtttgaccagtcgcaacaagaatgcggaaaatccaattcctatggcaggcgtgccacatcattctgcccaacaatacattgatgtgttaattgagttgggttacaaggttgctgtcgcagaacaaatggaagacccaaagcaagctgttggggtggtgaagcgtgaggtcgttcaagtcataactcctggaacggttgtggattcagctaagccagatagcgccaataactttttggtagctgttgactttgatggttgccgttatggattggcttatatggatgtatccacaggtgaattttgcgtgacagatttggcggactttacgagtgttcgtagcgaaatccaaaacctcaaggcgaaagaagtcttactaggttttgatttatctgaagaagaacagacgattttggtcaagcagatgaatttgctgctttcttatgaagaaacggtctatgaagataaatctttaattgacggccaattgacaacggtagaactgacagcggcaggaaaactcttgcaatacgttcacaaaacacaaatgcgagaactcagccacttgcaagcattggttcactatgagatcaaggattatttgcagatgtcgtatgccactaagtcaagtttagatttggtagaaaatgctaggactaataaaaaacatggaagtctctattggctgttagatgaaaccaagacagctatggggatgaggcttttgcgctcatggattgatcgacctttggtttctaaagaagctattttagagcgtcaagaaattattcaagtttttctgaatgcttttattgagcgaaccgatttaagcaatagtttaaaaggtgtttacgacatcgaacgcttatctagtcgcgtgtcttttggcaaggcaaatccgaaagatttacttcaattggggcataccttagctcaagtgccttatatcaaagctatcttagagtcttttgacagtccttgtgttgacaaacttgtcaatgatattgacagtttgcctgagttggaatacttgattagaacagccattgatccagatgcaccagcaactattagtgaaggaagtattatccgcaatggttttgatgagcgcttggaccattatcgtaaagtaatgcgagaggggacaggctggattgcggatattgaggccaaagagcgtcaagcaagtggcattaataacctaaaaattgattacaataaaaaagatggttattattttcacgttacgaattcaaatcttagcttagttcccgagcattttttcagaaaggcaactttaaaaaattctgaacgttatggaacagcagaattggctaagattgaaggtcagatgttagaggctagggaagagtcatctagtttagaatacgatatttttatgtgtattcgagctcaagttgaaacctatattaatcgtttacagaaactggctaaaattttggcaacggtagatgttttgcaaagtttagcagtcgttgctgaaaccaatcattatatccggccgcagttcaatgataatcatgtgattacaattcaagaaggtcgtcacgcggttgttgaaaaggttatgggagtgcaggaatacattcccaatagtatctcttttgaccaacagaccagtattcagctgattacaggtccaaatatgagtggtaagtcgacttatatgagacagctggccttaacggttatcatggcccagatgggttcatttgtggctgctgatcatgttgatttacctttatttgatgcgatttttacgcgtattggggctgctgatgatttgatttctgggcaatcaacctttatggtggagatgatggaagcaaaccaagcaatcaaacgcgcaagtgacaactctcttattctatttgatgaactgggacgaggcacggcaacttatgatggtatggctttagcccaggcaattattgaatatatccatgatagagttggtgctaagaccatatttgcaacgcattatcatgaattgacagacttgtcaactaacttgacaagtctagtcaatgttcatgtagcaacgcttgaaaaagatggcgatgttaccttccttcataagattgctgagggaccggcggataaatcttacggtattcatgtggcaaaaatagcaggactgccaaaatccctattaaagagagcagacgaagttctgacccgtttagaaacacagtcacgatctactgagataatatcagtcccttcacaagttgagtcaagcagcgctgttagacaggggcaattatccctttttggtgatgaagagaaagctcatgagattaggcaagcactggaagttattgatgtcatgaacatgaccccgcttcaagcaatgacaactctttacgaattgaaaaagttgtta

SEQ ID NO: 3322 - protein, 851 aa, Streptococcus pyogenes
MAKTNISPGMQQYLDIKKDYPDAFLLFRMGDFYELFYEDAVKAAQLLEIGLTSRNKNAENPIPMAGVPHHSAQQYIDVLIELGYKVAVAEQMEDPKQAVGVVKREVVQVITPGTVVDSAKPDSANNFLVAVDFDGCRYGLAYMDVSTGEFCVTDLADFTSVRSEIQNLKAKEVLLGFDLSEEEQTILVKQMNLLLSYEETVYEDKSLIDGQLTTVELTAAGKLLQYVHKTQMRELSHLQALVHYEIKDYLQMSYATKSSLDLVENARTNKKHGSLYWLLDETKTAMGMRLLRSWIDRPLVSKEAILERQEIIQVFLNAFIERTDLSNSLKGVYDIERLSSRVSFGKANPKDLLQLGHTLAQVPYIKAILESFDSPCVDKLVNDIDSLPELEYLIRTAIDPDAPATISEGSIIRNGFDERLDHYRKVMREGTGWIADIEAKERQASGINNLKIDYNKKDGYYFHVTNSNLSLVPEHFFRKATLKNSERYGTAELAKIEGQMLEAREESSSLEYDIFMCIRAQVETYINRLQKLAKILATVDVLQSLAVVAETNHYIRPQFNDNHVITIQEGRHAVVEKVMGVQEYIPNSISFDQQTSIQLITGPNMSGKSTYMRQLALTVIMAQMGSFVAADHVDLPLFDAIFTRIGAADDLISGQSTFMVEMMEANQAIKRASDNSLILFDELGRGTATYDGMALAQAIIEYIHDRVGAKTIFATHYHELTDLSTNLTSLVNVHVATLEKDGDVTFLHKIAEGPADKSYGIHVAKIAGLPKSLLKRADEVLTRLETQSRSTEIISVPSQVESSSAVRQGQLSLFGDEEKAHEIRQALEVIDVMNMTPLQAMTTLYELKKLL

SEQ ID NO: 3323 - DNA, 201 bp, Streptococcus agalactiae
atgacacaaggtacagtgaaatggtttaactcagaaaaaggttttggctttatttctagcgaaactggaacagacgtcttcgctcatttttcagagattaaagttgatggcttcaaaactcttgaagaaggacaaaaagtaacatttgatattcaagatggtcaacgtggaccacaagcaacaaatatcaatcttgttaaa

SEQ ID NO: 3324 - protein, 67 aa, Streptococcus agalactiae
MTQGTVKWFNSEKGFGFISSETGTDVFAHFSEIKVDGFKTLEEGQKVTFDIQDGQRGPQATNINLVK

SEQ ID NO: 3325 - DNA, 207 bp, Streptococcus pyogenes
atgtatatggcacaaggtacagtaaaatggtttaatgctgaaaaaggttttggttttatttcaactgaaaacggtcaagatgtctttgcacatttttcagccatccaaactaatggttttaaaacgttagaagaaggacaaaaagtggcatttgacgtcgaagaaggtcaacgtggacctcaagcagtcaatatcactaaattggcc

SEQ ID NO: 3326 - protein, 69 aa, Streptococcus pyogenes
MYMAQGTVKWFNAEKGFGFISTENGQDVFAHFSAIQTNGFKTLEEGQKVAFDVEEGQRGPQAVNITKLA

SEQ ID NO: 3327 - DNA, 99 bp, Streptococcus agalactiae
gtgtcatttgtttattacctttctaaaaatgttactgtaaaaaataaaaaaggtaaaaatgttaaacaaaaatacaacttcaaaacttattacgctccc

SEQ ID NO: 3328 - protein, 33 aa, Streptococcus agalactiae
MSFVYYLSKNVTVKNKKGKNVKQKYNFKTYYAP

SEQ ID NO: 3329 - DNA, 2028 bp, Streptococcus agalactiae
atggctaagatatcacaaaaaaagttacaaaaaatcataaaaaaaggagggatgaacttgtctaaaattattgaattaccggatatattagctaaccagattgctgctggtgaggttgttgaaaggcctagtagcgtcgttaaagaattagttgaaaatgccatagatgcaggaagtagccaaattaccatagaggttgaagaatctggtcttaaaaagattcaaataacggataacggtgaagggatgactagtgaggatgccgttctcagtttacgacgtcacgctacatccaaaatcaaaagccagagtgacctttttcgtattcggaccttaggttttcgtggtgaagctctaccatcaatcgcttcgattagtttaatgacgataaaaacagctacagagcaagggaaacaagggacgttacttgttgctaaagggggaaacattgaaaaacaggaagttgtttcaagtcctcgtggaacaaaaattttagttgaaaatttattctttaacacgcctgccagattgaaatacatgaagagtttacagtctgaactagctcatattattgatattgttaatagactcagtctagcgcatccggaagttgcttttacactgataaatgatggtaaagaaatgactaaaactagtgggactggcgatttgagacaggcgattgcaggtatttatggtttaaatactgcaaaaaaaatgattgagatttcaaatgcagatttagattttgaaatttcgggttatgtaagtttgcctgaattgacacgagctaaccgaaactatattaccctattaattaacggtcgttacattaaaaattttcttttgaaccgctcaattctagatggttatggttcaaagttgatggttggaagatttccaattgctgtcattgatattcagatagatccttatctagcagatgtcaacgttcatccgactaagcaagaggtgagaatttctaaggaacgagaattaatgagtttaataagcacagcaatttctgagagtcttaaacaatatgacttgattccggatgctttagagaatttagctaaaactagtacccgaagtgtagataagcctatacaaacaagcttctcactaaaacagcctggtttgtattacgatagggctaaaaatgacttttttataggtgcagatactgtatctgaacctattgctaactttacaaaccttgacaaaagtgacggttcagttgacaatgatgtaaaaaactctgttaatcaaggagcaacgcagtctcctaatataaagtatgctagtagagatcaagctgatagtgagaacttcattcattctcaggattaccttagtagtaaacagtcacttaacaaacttgttgaaaaattagattcggaagaaagttcgacttttccagagctcgaattttttggtcaaatgcatgggacctacttatttgctcaagggaatggtgggttgtatattattgatcaacatgcagctcaagagcgtgtaaaatacgagtattaccgtgaaaagataggtgaggttgataatagtcttcaacaattgttagtaccatttctatttgaattttcaagttcagattttcttcaattacaagaaaaaatgtcattattacaagatgttggtattttcttggaaccgtatggtaataatactttcattttaagggaacatccaatttggatgaaagaagaagaggtagagtctggcatttatgaaatgtgtgatatgttgttgctcactaatgaagtatcagtgaaaaaatatcgcgcagagttggctattatgatgtcttgcaagcgatctattaaagcaaaccatacgctagacgattactcagcacgtcatttattagatcagttagcgcaatgtaaaaatccttataattgccctcatggaagacctgttttagttaattttacaaaagctgatatggagaaaatgtttaaacgaatccaagaaaatcatacaagcctcagggatttaggaaaatat

SEQ ID NO: 3330 - protein, 676 aa, Streptococcus agalactiae
MAKISQKKLQKIIKKGGMNLSKIIELPDILANQIAAGEVVERPSSVVKELVENAIDAGSSQITIEVEESGLKKIQITDNGEGMTSEDAVLSLRRHATSKIKSQSDLFRIRTLGFRGEALPSIASISLMTIKTATEQGKQGTLLVAKGGNIEKQEVVSSPRGTKILVENLFFNTPARLKYMKSLQSELAHIIDIVNRLSLAHPEVAFTLINDGKEMTKTSGTGDLRQAIAGIYGLNTAKKMIEISNADLDFEISGYVSLPELTRANRNYITLLINGRYIKNFLLNRSILDGYGSKLMVGRFPIAVIDIQIDPYLADVNVHPTKQEVRISKERELMSLISTAISESLKQYDLIPDALENLAKTSTRSVDKPIQTSFSLKQPGLYYDRAKNDFFIGADTVSEPIANFTNLDKSDGSVDNDVKNSVNQGATQSPNIKYASRDQADSENFIHSQDYLSSKQSLNKLVEKLDSEESSTFPELEFFGQMHGTYLFAQGNGGLYIIDQHAAQERVKYEYYREKIGEVDNSLQQLLVPFLFEFSSSDFLQLQEKMSLLQDVGIFLEPYGNNTFILREHPIWMKEEEVESGIYEMCDMLLLTNEVSVKKYRAELAIMMSCKRSIKANHTLDDYSARHLLDQLAQCKNPYNCPHGRPVLVNFTKADMEKMFKRIQENHTSLRDLGKY

SEQ ID NO: 3331 - DNA, 2019 bp, Streptococcus pyogenes
ttgttatatcaacgtttagaaagtgttaaaaacaaaattatgacaaacattattgaattaccggaagttctcgccaaccaaattgcagctggtgaagttgtagaaaggccagcgagtgttgtcaaggaattggttgagaatgctattgatgctaaaagtagccagattaccgttgaaattgaagagtctggccttaagatgatacaggttacagacaacggtgagggaatgtctcatgaagatttacctttaagtctgcgtcgccacgctactagtaaaattaagagtcagagtgatttgtttagaattagaacacttggcttccgtggagaggctttaccgtctgttgcctctatcagtaaaatcacgataaaaacagcaacaaaagaagtcactcacggttctcttcttatagctactggtggggaaattgagacacttgaagcgatctcaactcctactggaaccaaaattaaggttgaaaaccttttttacaacacgcctgctcgtctcaaatatatgaaaagtttacaggcagaattagctcacattgtagatgtggtcaaccggttgagtttggcacatccagaagttgctttcacactgattagtgatggtcgccaattaactcagacatcaggaactggcgatttacgccaagcaattgcagggatttatggtttgaatactaccaaaaaaatgctggctatctctaatgctgatttggattttgaagtttccggctatgttagcttgccagagttgacacgcgccaaccgtaattacatgacgattttggttaatgggcgttacatcaagaatttcttgcttaatcgagcaattcttgatggttacggttctaagctcatggttggacgtttcccaattgttgtgattgatattcagattgatccctatttggccgatgtcaatgttcaccccacaaaacaagaggttcgtatttcaaaagagcgtgaattaatggctttaattagcacggctatttcagagagtcttaaggaacaagatttgattccagatgctctggaaaatttagccaaatcaagcacacgacatttctctaaaccagagcaaacacaacttcctttacagtctaggggactttattatgatcctcaaaagaatgacttttttgtcaaagagtcggctgtctcggaaaaaatacctgaaactgatttttattccggcgctgttgacaacagtgtaaaggttgaaaaagtagagctgttaccccactcagaagaagttataggaccttcttcggttaaacacgcaagtcgtccccagaatacctttaccgagactgatcatcctaatcttgacttaaaaaacagacaaaagttatctcaaatgctaacccgtttggaaaatgaagggcaatcagtgtttcccgaattggattattttggtcagatgcacggaacttatctctttgctcagggaaaagatggtttatttataattgaccaacacgctgcccaggagcgggttaaatacgaatattatcgtgataagataggtgaggttgacagtagtttacagcaattgttggtgccctatttgtttgagttttctggttctgatttcattaacttacaggagaaaatggcactcttaaatgaagttggtatcttcttagaagtttatgggcacaatactttcattttgagggagcatcctatctggatgaaagaagaagagattgcatctggtgtctatgaaatgtgtgacatgttacttctaaccaatgaggtatctattaaaacttaccgagcagagttagctattatgatgagttgtaaacgatctatcaaggcaaatcatagcttggatgattattcagcaagaaatctgctactgcaattggcccaatgtcaaaatccttataactgccctcatggtagacccgtattgattaattttagtaaggcagatatggaaaaaatgttccgtcgaattcaagaaaatcacactagcctgcgagagctaggaaaatat

SEQ ID NO: 3332 - protein, 673 aa, Streptococcus pyogenes
LLYQRLESVKNKIMTNIIELPEVLANQIAAGEVVERPASVVKELVENAIDAKSSQITVEIEESGLKMIQVTDNGEGMSHEDLPLSLRRHATSKIKSQSDLFRIRTLGFRGEALPSVASISKITIKTATKEVTHGSLLIATGGEIETLEAISTPTGTKIKVENLFYNTPARLKYMKSLQAELAHIVDVVNRLSLAHPEVAFTLISDGRQLTQTSGTGDLRQAIAGIYGLNTTKKMLAISNADLDFEVSGYVSLPELTRANRNYMTILVNGRYIKNFLLNRAILDGYGSKLMVGRFPIVVIDIQIDPYLADVNVHPTKQEVRISKERELMALISTAISESLKEQDLIPDALENLAKSSTRHFSKPEQTQLPLQSRGLYYDPQKNDFFVKESAVSEKIPETDFYSGAVDNSVKVEKVELLPHSEEVIGPSSVKHASRPQNTFTETDHPNLDLKNRQKLSQMLTRLENEGQSVFPELDYFGQMHGTYLFAQGKDGLFIIDQHAAQERVKYEYYRDKIGEVDSSLQQLLVPYLFEFSGSDFINLQEKMALLNEVGIFLEVYGHNTFILREHPIWMKEEEIASGVYEMCDMLLLTNEVSIKTYRAELAIMMSCKRSIKANHSLDDYSARNLLLQLAQCQNPYNCPHGRPVLINFSKADMEKMFRRIQENHTSLRELGKY

SEQ ID NO: 3333 - DNA, 96 bp, Streptococcus agalactiae
gtgaaaaacgtcatggcaatcaaaatagctccaaaagtgtttagagaaatattaaaaagcattccaaaaccacaaatcaagctccctaatattagt

SEQ ID NO: 3334 - protein, 32 aa, Streptococcus agalactiae
MKNVMAIKIAPKVFREILKSIPKPQIKLPNIS

SEQ ID NO: 3335 - DNA, 1254 bp, Streptococcus agalactiae
ttgttagggaagaagggagaaaaagtgaaagagttttttgctttgccaaaacagctacagttaagagaattattgcgttttatttccattacggttggttcagctatttttccttttatggcaatgtattatgttcaatattttggaaatctagttacaggaatcttgatcatcataactcaactatcagggtttgtagcgaccttatatggaggccatttgtcagatgctatggggaggaaaaaagttgtgattataggttcactgctggcaaccattggttgggctataactatagctgcaaatgttccaaatcatattacgccacacttgacctttgtaggtatccttatcattgaaatagctcaccaattttatttccctgcctatgaagctatgaccattgatttgacgaacgaacagaatcgtcgctttgtttacactataggttattggttggttaacatcgctgtaatgctaggttctggaattgctgggattttctatgatcaccatttttttgaattattaatagttcttcttattatttcagcgatttgttgtttcgtggtctacttcaagtttgatgagacaaaaccacaggagggaaccttcaagcatgataaaggagttttaggaacttttaaaaattatagtcaggttttagtggataaagcgtttgttgtttatactttaggagcaattggttccagtgttgtctggctccaggttgataattatttctcggtcaatcttaagcaaaattttgaagtagtgtccattttaggacatacaatcacaggtgctaaaatgcttagtttagcagtctttacaaacactctattaattgtcttactaatgacaactataaataaattcatagagaattggcctttgaaacgtcaactaatattagggagcttgatttgtggttttggaatgctttttaatatttctctaaacacttttggagctattttgattgccatgacgtttttcacctttggcgaaatgatttatgttccagctagtcaggttctaagggcggagatgatggtggagggaaaaattggatcatattctggatttttagctatcgcacaacctgttgcaagtgtattagcaggtgccatggtttcgctcagctattttacaggaaaaataggtgttcaaataacattgaccatttttatgttagcaggtctggttttaatcttatatgctaccaaaatgaaaaatattgagataggaaaa

SEQ ID NO: 3336 - protein, 418 aa, Streptococcus agalactiae
MLGKKGEKVKEFFALPKQLQLRELLRFISITVGSAIFPFMAMYYVQYFGNLVTGILIIITQLSGFVATLYGGHLSDAMGRKKVVIIGSLLATIGWAITIAANVPNHITPHLTFVGILIIEIAHQFYFPAYEAMTIDLTNEQNRRFVYTIGYWLVNIAVMLGSGIAGIFYDHHFFELLIVLLIISAICCFVVYFKFDETKPQEGTFKHDKGVLGTFKNYSQVLVDKAFVVYTLGAIGSSVVWLQVDNYFSVNLKQNFEVVSILGHTITGAKMLSLAVFTNTLLIVLLMTTINKFIENWPLKRQLILGSLICGFGMLFNISLNTFGAILIAMTFFTFGEMIYVPASQVLRAEMMVEGKIGSYSGFLAIAQPVASVLAGAMVSLSYFTGKIGVQITLTIFMLAGLVLILYATKMKNIEIGK

SEQ ID NO: 3337 - DNA, 1218 bp, Streptococcus pyogenes
atgcaagagtttttaaaccttcctaagcagattcagctgaggcaactggtacgctttgtgaccattaccttaggcagtagtatctttccctttatggccatgtattatacgacttactttggtacgttttggacaggcctcttaatgatgattaccagtttgatgggatttgttggaactttatacggtgggcatctgtcagatgctcttggtcgcaaaaaagtcattatgattgggtcagtaggaacaacactaggctggtttctgactattttagctaatttgcctaatgcggctattccttggttaacctttgcgggtattttattggtagagattgcttctagtttttatggtcctgcctatgaagctatgttgattgatttgactgatgagagtaatcgtcgatttgtttacaccatcaattattggtttatcaatattgccgtcatgtttggtgcagggctatctgggcttttttatgaccatcattttttagccttgttagtagccttattactcgtcaatgtactttgttttggcgttgcttactactgttttgatgaaactagaccagaaacacacgcttttgaccatggtaaaggattactggcgagttttcagaactaccgtcaggtgtttcatgatcgtgcctttgtcttgtttaccttaggtgccatcttttctggtagtatctggatgcagatggataactatgtgccagtccatttgaaactgtattttcagccaacggctgtattaggtttccaagtaactagttctaaaatgttatcattaatggttttaactaatacattgctgattgtccttttcatgacagtagtaaataaattaacggaaaaatggaaactattacctcagcttgtggttggttctttactatttactctagggatgctcttgtcatttacctttacgcagttctatgctatctggttatcagttgttttgttaacttttggggaaatgataaatgtttctgctagtcaagtcctacgtgctgatatgatggatcattcccaaataggatcttatacaggttttgtgtcaatggcacaacccctaggtgctattttggctagtctactagtatctgtcagccattttacaggtcctttaggcgtgcaatgcttatttgcagtcattgctttgctagggatttattttacggttgtttctgcaaaaatgaaaaaggtg

SEQ ID NO: 3338 - protein, 406 aa, Streptococcus pyogenes
MQEFLNLPKQIQLRQLVRFVTITLGSSIFPFMAMYYTTYFGTFWTGLLMMITSLMGFVGTLYGGHLSDALGRKKVIMIGSVGTTLGWFLTILANLPNAAIPWLTFAGILLVEIASSFYGPAYEAMLIDLTDESNRRFVYTINYWFINIAVMFGAGLSGLFYDHHFLALLVALLLVNVLCFGVAYYCFDETRPETHAFDHGKGLLASFQNYRQVFHDRAFVLFTLGAIFSGSIWMQMDNYVPVHLKLYFQPTAVLGFQVTSSKMLSLMVLTNTLLIVLFMTVVNKLTEKWKLLPQLVVGSLLFTLGMLLSFTFTQFYAIWLSVVLLTFGEMINVSASQVLRADMMDHSQIGSYTGFVSMAQPLGAILASLLVSVSHFTGPLGVQCLFAVIALLGIYFTVVSAKMKKV

SEQ ID NO: 3339 - DNA, 588 bp, Streptococcus agalactiae
atgtacgattatattaaaggaaaattgagtaaaataacggctaaatttattgttgtggaaacagctggattgggatacatgatatatgtggcaaatccctactctttttcaggttacgttaatcaagaagttaccatctacttacatcaagtcattcgcgatgatgcacatcttttatttggctttcatacggaaaatgaaaaagaaatttttcttaatttaatttcagtatcaggaattggtccaacgaccgctttagcaattattgcagtcgatgacaatgaaggtctcgtaagtgccattgataatagtgatattaagtatttgactaaatttccaaagataggaaaaaaaacagcacaacagatgatccttgatttgtcagggaagtttgtagaagcttctggtgagagtgcgactagtcgtaaggttagctctgagcagaatagcaatcttgaagaagctatggaagctttgttagcgttggggtataaggcgactgaattgaaaaaagtaaaagccttttttgaaggtacgaacgagactgtggagcaatacatcaaatctagtttgaagatgttgatgaaa

SEQ ID NO: 3340 - protein, 196 aa, Streptococcus agalactiae
MYDYIKGKLSKITAKFIVVETAGLGYMIYVANPYSFSGYVNQEVTIYLHQVIRDDAHLLFGFHTENEKEIFLNLISVSGIGPTTALAIIAVDDNEGLVSAIDNSDIKYLTKFPKIGKKTAQQMILDLSGKFVEASGESATSRKVSSEQNSNLEEAMEALLALGYKATELKKVKAFFEGTNETVEQYIKSSLKMLMK

SEQ ID NO: 3341 - DNA, 594 bp, Streptococcus pyogenes
atgtacgattatattaaaggtcaattgaccaaaattacggcaaaatacattgtcgttgaagctaatggattgggctacatgattaatgttgccaatccttatagctttacagatagtgtcaaccaattggtaaccatttatctgcatcaagtgattcgtgaggatgctcacctgttgtttgggtttcacacggaagatgaaaaagatgtttttctgaaattaatttctgtatcaggtattggtccgacaacagctcttgctattgtggcagttgatgataatgagggacttgtgaatgccattgataacagtgacattaagtacctaatgaaatttcctaaaattggtaaaaaaacagcgcagcaaatggttcttgacttagctggcaaatttgtggaggctccacaagagactggtcataccaaagcgcgcagcaataaagcaggcaatactcaactggacgaagcgattgaagccctccttgctctcggttataaagcaaaagagctgaaaaaaattcgtgccttctttgaggggacctctgagacggcagagcaatacatcaaatcagcattgaaactgttaatgaaaggg

SEQ ID NO: 3342 - protein, 198 aa, Streptococcus pyogenes
MYDYIKGQLTKITAKYIVVEANGLGYMINVANPYSFTDSVNQLVTIYLHQVIREDAHLLFGFHTEDEKDVFLKLISVSGIGPTTALAIVAVDDNEGLVNAIDNSDIKYLMKFPKIGKKTAQQMVLDLAGKFVEAPQETGHTKARSNKAGNTQLDEAIEALLALGYKAKELKKIRAFFEGTSETAEQYIKSALKLLMKG

SEQ ID NO: 3343 - DNA, 561 bp, Streptococcus agalactiae
atgaggtttcacatgaaacgatgttcttgggtgaatttagataatccattatatgtagcttaccatgataaagagtgggggagagctgttcatgacgatcatgtactctttgagttactatgtttagaaacttatcaatcgggtttatcttgggaaacagtattaaataaacgtcaggagttcagacaagtttttcatcactataatattgaaaaggtagctgcaatgtcagatgcggatttagagataatcttacaaaatcctagggttattcgtcatcgtctaaaacttttctcaacacgacaaaatgctaggtcaattatattaattcagaaagaattcggaagttttgatcgctacatttggtcttttgtagataataaagtacaggttaactcagttaacaactacaacgatgtgcctgcaagtactaccttatccgaacgcttatctaaggatttaaaaaaacgcggttttaaatttgttggtccaacttgcctctattcttttattcaggccgcgggtatggttaatgaccatgaaaatatatgtgatttcaag

SEQ ID NO: 3344 - protein, 187 aa, Streptococcus agalactiae
MRFHMKRCSWVNLDNPLYVAYHDKEWGRAVHDDHVLFELLCLETYQSGLSWETVLNKRQEFRQVFHHYNIEKVAAMSDADLEIILQNPRVIRHRLKLFSTRQNARSIILIQKEFGSFDRYIWSFVDNKVQVNSVNNYNDVPASTTLSERLSKDLKKRGFKFVGPTCLYSFIQAAGMVNDHENICDFK

SEQ ID NO: 3345 - DNA, 567 bp, Streptococcus pyogenes
gtgtttcacatgaaacgttgctcatgggttcctaaggataaccagctttactgtgattaccacgatttagaatggggtcaacccctggatgatgatagagatttttttgaattgctgtgccttgaaagttaccagtcaggcttatcctggctgactgttttgaaaaaacgccaagctttcagaactgtttttcatcattacgacattgcatcggttgcaacctttacctcggaggaaatggctgatgctttagagaatccatccattatccgccacaagctaaagctagcagcaactgtcaacaacgctatcgcagtacagaaaattcaaaaagagtttggtagtttttcaacttatctctggaattttgttgggggaaagccaattaacaaccttgtcaatcaagagaatcttgttcctgctcaaacagaattatctattcgcttagctaaggatttaaagaaaagaggatttaaatttttagggcctacaacggtttattcttttatgcaagcatcgggtctggtaaatgaccatgaagaggcttgtgttttcaatagaatcttc

SEQ ID NO: 3346 - protein, 189 aa, Streptococcus pyogenes
VFHMKRCSWVPKDNQLYCDYHDLEWGQPLDDDRDFFELLCLESYQSGLSWLTVLKKRQAFRTVFHHYDIASVATFTSEEMADALENPSIIRHKLKLAATVNNAIAVQKIQKEFGSFSTYLWNFVGGKPINNLVNQENLVPAQTELSIRLAKDLKKRGFKFLGPTTVYSFMQASGLVNDHEEACVFNRIF

SEQ ID NO: 3347 - DNA, 897 bp, Streptococcus agalactiae
ttggttgaaggctcaatacctctacaaaaccttactggtctagctgttggtggtatcgttacatctaagggagtccaatatatggttttaccaggtccgcctagtgaattaaagccaatggttatggagcaggtagtacctattttgtcaaataatggcacaaaattatattcacgtgtattgagattctttggtatcggtgagagtcagttagtcacaatcttagaagacataattaagaatcagacagacccaactatagcaccatatgcaaaggttggtgaggtaactttaaggttatcaacgaaagctgaaaatcaggatgaggccgactttaaattagatagcttagaaaaagaaatacttgctcttaagacattagataaccgtaaattaaaagatttattatatggttatggtgataataatagtatggcacgtactgttttagaattattgaaagtacaaaataaaacgattactgccgcagagagcttaacagcagggttatttcaatctcagttagcagaattttctggtgcttcgcaagtttttaatggtggttttacgacctatagtatggaagcaaaatcacaacttctcggcatccctaagaaaaaattgcaagaatatggagttgtcagtcattttacagctgaggcaatggctcagcaagctcgccaacttttaaaagcagattttggtatcggtttaacgggagttgctggtcctgatgagttggaaggataccctgcaggtacagtttttattgggattgcaacccctgaaggcgtttcttctattaaagtatcgattggagggaagagtcgctcagatgtccgtcatatcagtactttacatgcttttgacttggtgcgtagggctttattaaagata

SEQ ID NO: 3348 - protein, 299 aa, Streptococcus agalactiae
MVEGSIPLQNLTGLAVGGIVTSKGVQYMVLPGPPSELKPMVMEQVVPILSNNGTKLYSRVLRFFGIGESQLVTILEDIIKNQTDPTIAPYAKVGEVTLRLSTKAENQDEADFKLDSLEKEILALKTLDNRKLKDLLYGYGDNNSMARTVLELLKVQNKTITAAESLTAGLFQSQLAEFSGASQVFNGGFTTYSMEAKSQLLGIPKKKLQEYGVVSHFTAEAMAQQARQLLKADFGIGLTGVAGPDELEGYPAGTVFIGIATPEGVSSIKVSIGGKSRSDVRHISTLHAFDLVRRALLKI

SEQ ID NO: 3349 - DNA, 1269 bp, Streptococcus pyogenes
atgaaagctgaactgattgcagtaggtaccgaaattttgactggtcaaattgtgaataccaatgctcaatttctgtcggaaaaaatggcagagctaggtattgatgtctattttcaaacggctgttggggacaacgaggagcgtttactttcagtgattacaactgctagtcagcgtagtaacttggtaattttatgtggtggccttggtccaacgaaagatgatttaaccaaacaaactttagcaaagtaccttaggaaagacttggtttatgatgagcaagcttgtcagaaactagatgacttttttgctaagcgcaagccttcatcacggacaccaaataatgagcgacaggcacaagtgattgaagggtcaatccctttgccaaataaaactggtcttgcggttggtgggttcatcacagtcgatggtattagttatgttgtcttaccgggtcctccaagtgaattgaagccgatggtaaatgaagaattggtaccacttctgtcaaaacaatacagtacattgtattcaaaggtactacgcttttttggtattggggaaagtcagttggtaacagtcttgtcagattttattgagaatcaaactgatccaaccattgctccgtatgctaagactggcgaagtgactcttcgcttatcaacaaaaactgaaaaccaagctctggcagataaaaagttaggtcagctagaagcgcagctactatcccgaaaaactcttgaaggtcaacccttagctgatgtcttttatggctatggggaggataattccttagcgcgtgagacatttgagctcttagtaaaatatgataagacaattacagcagcagaaagtctaaccgcgggattatttcagtcaactttggcgagttttccaggagcttctcaagtattcaatggaggctttgtgacttatagcatggaagaaaaagcgaaaatgctaggccttcctttagaggagttgaaatcgcatggcgttgttagtgcttatacggccgaggggatggcggagcaagcaaggttattgactggtgctgatattggggtaagtttaacaggtgttgccggaccagatatgttggaggaacagcctgcaggtacagttttcattggtcttgccactcaaaataaggtagaatcaataaaggttttgattagcgggcgaagtcgtttggatgtgcgctatatcgctactttacatgcttttaatatggtccgtaaaactttattaaaacttgagaatttgcta

SEQ ID NO: 3350 - protein, 423 aa, Streptococcus pyogenes
MKAELIAVGTEILTGQIVNTNAQFLSEKMAELGIDVYFQTAVGDNEERLLSVITTASQRSNLVILCGGLGPTKDDLTKQTLAKYLRKDLVYDEQACQKLDDFFAKRKPSSRTPNNERQAQVIEGSIPLPNKTGLAVGGFITVDGISYVVLPGPPSELKPMVNEELVPLLSKQYSTLYSKVLRFFGIGESQLVTVLSDFIENQTDPTIAPYAKTGEVTLRLSTKTENQALADKKLGQLEAQLLSRKTLEGQPLADVFYGYGEDNSLARETFELLVKYDKTITAAESLTAGLFQSTLASFPGASQVFNGGFVTYSMEEKAKMLGLPLEELKSHGVVSAYTAEGMAEQARLLTGADIGVSLTGVAGPDMLEEQPAGTVFIGLATQNKVESIKVLISGRSRLDVRYIATLHAFNMVRKTLLKLENLL

SEQ ID NO: 3351 - DNA, 1137 bp, Streptococcus agalactiae
ttggctaaaaaaacgaaaaaagcagaagaaattactaagaaattcggtgatgaacgtcgaaaagccttagatgatgctttgaaaaatattgaaaaagattttggtaagggcgcagtgatgcgcttaggtgagcgagctgaacaaaaggttcaagtaatgagttcaggttctcttgctttagatatcgctttaggagcaggtggatatcctaaaggacgtatcgtcgaaatttatggaccagagtcatctggtaaaacaacggttgcccttcatgccgtagctcaagcccaaaaggaaggtgggattgctgcctttattgatgctgagcacgctcttgacccagcctatgctgcggctcttggagttaatattgatgagttacttttgtctcaacctgactcaggtgagcaaggtcttgaaattgcaggtaaattgattgattcaggcgcagttgatttagttgttgtcgattcagttgcagcccttgttcctcgtgctgagattgatggtgatattggtgacagccacgttggtttgcaagctcgtatgatgagtcaagcaatgcgtaaattgtcagcatccattaacaagacaaagacaatcgcaatttttatcaaccagttaagggaaaaagtaggcgttatgtttggtaaccctgaaacaacacctggtggtcgtgctttgaaattttattcatcggttcgtctagatgttcgtggtaatactcaaatcaagggaactggtgagcataaagatcataatgttggtaaagagacaaaaatcaaagttgttaaaaataaagttgctccaccattccgtgaagcttttgtcgaaattatgtatggtgaaggtatttctcgcacgggtgagttaattaaaattgctagtgatttggatattatccaaaaagcaggtgcatggtactcatataatggtgagaaaattggacaaggttctgaaaatgccaaaaaatatttagcagataatccagcaatttttgatgaaattgaccataaagtgcgcgtgcactttggaatgactgaagatgattcgccagttcagtctgagctcgttgaagaaaaaaatgaagctgatgatcttgttttagatttggacaatgctattgaaattgaggaa

SEQ ID NO: 3352 - protein, 379 aa, Streptococcus agalactiae
MAKKTKKAEEITKKFGDERRKALDDALKNIEKDFGKGAVMRLGERAEQKVQVMSSGSLALDIALGAGGYPKGRIVEIYGPESSGKTTVALHAVAQAQKEGGIAAFIDAEHALDPAYAAALGVNIDELLLSQPDSGEQGLEIAGKLIDSGAVDLVVVDSVAALVPRAEIDGDIGDSHVGLQARMMSQAMRKLSASINKTKTIAIFINQLREKVGVMFGNPETTPGGRALKFYSSVRLDVRGNTQIKGTGEHKDHNVGKETKIKVVKNKVAPPFREAFVEIMYGEGISRTGELIKIASDLDIIQKAGAWYSYNGEKIGQGSENAKKYLADNPAIFDEIDHKVRVHFGMTEDDSPVQSELVEEKNEADDLVLDLDNAIEIEE

SEQ ID NO: 3353 - DNA, 1134 bp, Streptococcus pyogenes
ttggcaaaaaaattaaaaaagaatgaagaaatcactaagaagtttggtgacgaacgtcgcaaagcccttgatgatgctttgaaaaatattgaaaaagattttggtaagggtgcagtgatgcgattaggagaacgtgcagagcaaaaagttcaggttatgagttcaggaagtctagctcttgatattgcgcttggagctggtggttatcctaaaggacgtatcatcgaaatctatggtccagagtcttccggtaaaacgactgtggctttacatgctgtagcacaagctcaaaaagaaggtggaatcgcagcctttatcgatgccgagcatgcgcttgatccagcttatgctgctgcgcttggggttaatattgatgaactcctcttgtctcaaccagattctggagaacaaggacttgaaattgcaggtaaattgattgattctggtgcggttgatctggttgttgtcgattcagtagcagctttagtgccacgtgctgaaattgatggtgatattggcgatagccatgtcggattgcaagcacgtatgatgagtcaggccatgcgtaaattatcagcttctattaataaaacaaaaactatcgctatctttattaaccaattgcgtgaaaaagttggtgtgatgtttggaaatcctgaaacaacaccaggtggtcgagctttgaaattctatgcttctgttcggctggatgtgcgtggaacaactcaaattaaaggaactggtgaccaaaaagatagcagtattggtaaggagaccaaaatcaaggttgttaaaaacaaggtcgctccgccatttaaggtagcagaagttgaaatcatgtatggggaaggtatttctcgtacaggggagcttgtgaaaattgcttctgatttggacattatccaaaaagcaggtgcttggttctcttataatggtgagaagattggccaaggttctgaaaatgctaagcgttatttggccgatcacccagaattgtttgatgaaatcgaccttaaagtacgtgttaaatttggtttgcttgaagaaagcgaagaagaatctgctatggcagtagcatcagaagaaaccgatgatcttgctttagatttagataatggtattgaaattgaagat

SEQ ID NO: 3354 - protein, 378 aa, Streptococcus pyogenes
LAKKLKKNEEITKKFGDERRKALDDALKNIEKDFGKGAVMRLGERAEQKVQVMSSGSLALDIALGAGGYPKGRIIEIYGPESSGKTTVALHAVAQAQKEGGIAAFIDAEHALDPAYAAALGVNIDELLLSQPDSGEQGLEIAGKLIDSGAVDLVVVDSVAALVPRAEIDGDIGDSHVGLQARMMSQAMRKLSASINKTKTIAIFINQLREKVGVMFGNPETTPGGRALKFYASVRLDVRGTTQIKGTGDQKDSSIGKETKIKVVKNKVAPPFKVAEVEIMYGEGISRTGELVKIASDLDIIQKAGAWFSYNGEKIGQGSENAKRYLADHPELFDEIDLKVRVKFGLLEESEEESAMAVASEETDDLALDLDNGIEIED

SEQ ID NO: 3355 - DNA, 408 bp, Streptococcus agalactiae
gtgagaaggcacatgattaagatttatactatttcaagttgcacaagttgtaaaaaagcaaaaacttggctaaatgctcatcaacttccatataaagaacaaaacctaggtaaagaatcactaacacgtgatgaaattttagaaatattaacaaaaactgaaagtggtattgaaagtatcgtttcttctaaaaatcgttatgctaaggcgctcaattgtaatattgaggagttgagtgtaaatgaagttattgatcttattcaagaaaatccacgtattttaaagagtccaattctaattgatgacaaacgtcttcaagtaggttataaggaagatgatattcgtgcttttctacctcgctctattcgtaacgttgaaaatgcagaagctcgtcttcgtgcagcactt

SEQ ID NO: 3356 - protein, 136 aa, Streptococcus agalactiae
MRRHMIKIYTISSCTSCKKAKTWLNAHQLPYKEQNLGKESLTRDEILEILTKTESGIESIVSSKNRYAKALNCNIEELSVNEVIDLIQENPRILKSPILIDDKRLQVGYKEDDIRAFLPRSIRNVENAEARLRAAL

SEQ ID NO: 3357 - DNA, 396 bp, Streptococcus pyogenes
atgattaaaatttacacgatttcaagttgtacgagctgcaagaaagccaaaacttggctaaatgcccataagcttgcttataaagaacagaacttaggaaaagaaccgctaactaaagaagaaattttagcaattttatcaaaaaccgaaaatggagtggagagcattgtttcatctaaaaatcgttatgccaaagctctcgattgcgatattgaagaattaagtgttagtgaggttattgatttgattcaagataacccgcgcatccttaaaagtcccattttgattgatgataaacgtctgcaagtaggctacaaagaagacgatattcgtgcttttttacctcgctctattcgtaatattgaaaatactgaagcacgattacgtgctgcactc

SEQ ID NO: 3358 - protein, 132 aa, Streptococcus pyogenes
MIKIYTISSCTSCKKAKTWLNAHKLAYKEQNLGKEPLTKEEILAILSKTENGVESIVSSKNRYAKALDCDIEELSVSEVIDLIQDNPRILKSPILIDDKRLQVGYKEDDIRAFLPRSIRNIENTEARLRAAL

SEQ ID NO: 3359 - DNA, 264 bp, Streptococcus agalactiae
atgggatttacagatgaaactgttcgttttagattagatgatagtaacaaagtagaaattagtgaaacattaacagctgtttatcgttcattagaagaaaaaggttacaatcccatcaatcaaattgttggttacgtattgagtggggaccctgcttatgtacctcgttacaatgatgctcgcaatcaaattcgtaaatatgaacgtgatgagattgtagaagagctcgttcgttattatttacaaggaaatggaatagatttg

SEQ ID NO: 3360 - protein, 88 aa, Streptococcus agalactiae
MGFTDETVRFRLDDSNKVEISETLTAVYRSLEEKGYNPINQIVGYVLSGDPAYVPRYNDARNQIRKYERDEIVEELVRYYLQGNGIDL

SEQ ID NO: 3361 - DNA, 267 bp, Streptococcus pyogenes
atgggatttacagatgaaacagtccgctttaagttggatgatggcgacaaacgacaaattagtgaaacattaacagcagtctatcattcacttgatgaaaagggttataatccaattaatcaaattgttggttatgtcttgagtggggacccagcttatgttcctcgttataatgatgctcgaaatcagattcgtaaatatgaacgtgatgaaattgtagaagaacttgttcgctactatttacaaggaaatggaattgatgttaaa

SEQ ID NO: 3362 - protein, 89 aa, Streptococcus pyogenes
MGFTDETVRFKLDDGDKRQISETLTAVYHSLDEKGYNPINQIVGYVLSGDPAYVPRYNDARNQIRKYERDEIVEELVRYYLQGNGIDVK

SEQ ID NO: 3363 - DNA, 417 bp, Streptococcus agalactiae
atgagaataatgggacttgacgtcggctcgaaaactgtcggcgttgcaattagtgatccactcggtttcactgcacaaggtcttgaaatcattaagatcgatgaagaatctggaaattttggttttgaccgcttagcagagttagtaaaagagtacaaagttgataaatttgtagttggtctacctaaaaatatgaataatacaagtggtcctcgtgtagaggctagtcaggcatatggcgataaaatcactgaattattcaatcttccagttgaatatcaagatgaacgtttaacgactgttcaagcagagcgtatgctagttgagcaagctgatattagtcgtggtaagcgtaagaaagttatcgataaattagcagctcaactaatcttacaaaattatttagaccgcatgttt

SEQ ID NO: 3364 - protein, 139 aa, Streptococcus agalactiae
MRIMGLDVGSKTVGVAISDPLGFTAQGLEIIKIDEESGNFGFDRLAELVKEYKVDKFVVGLPKNMNNTSGPRVEASQAYGDKITELFNLPVEYQDERLTTVQAERMLVEQADISRGKRKKVIDKLAAQLILQNYLDRMF

SEQ ID NO: 3365 - DNA, 417 bp, Streptococcus pyogenes
atgagaataatgggacttgatgttggctcgaaaacggttggtgtagctattagtgatcctcttggctttacagcccaaggacttgaaattatcaagattgatgaggaaaaagcagaatttggctttacacgtttagaagagcttgttaagcagtaccaagttgaacagtttgttattggattgccaaaaaatatgaataacaccaatggtccacgtgttgatgcaagtataacttatggaaaccacatagagcacctctttggacttccagtccattatcaagatgaacgattgacgactgttgaggcaaagcgtatgcttattgagcaagctgacattagtcgtggtaagcgaaaaaaagtcattgataaattagctgcacaactcattttacagaactatttaaatcggaatttt

SEQ ID NO: 3366 - protein, 139 aa, Streptococcus pyogenes
MRIMGLDVGSKTVGVAISDPLGFTAQGLEIIKIDEEKAEFGFTRLEELVKQYQVEQFVIGLPKNMNNTNGPRVDASITYGNHIEHLFGLPVHYQDERLTTVEAKRMLIEQADISRGKRKKVIDKLAAQLILQNYLNRNF

SEQ ID NO: 3367 - DNA, 315 bp, Streptococcus agalactiae
atggcacataatcataaccacgatcataaccatgaacatcaacatgaagtaatcactcttgtagatgagaatgggaacgaaacactttttgaaattctattaactattgatgggcgtgaagagtttggcaaaaactatgttctcctcgttcctgcaggtgcggaagaagacgaacaaggtgaaattgagattcaagcttactcatttacagaaaatgccgatggaactgaaggagaccttcagcctataccagaagattcagatgcagaatgggacatgattgaggaagttttcaacagctttctagatgaagaa

SEQ ID NO: 3368 - protein, 105 aa, Streptococcus agalactiae
MAHNHNHDHNHEHQHEVITLVDENGNETLFEILLTIDGREEFGKNYVLLVPAGAEEDEQGEIEIQAYSFTENADGTEGDLQPIPEDSDAEWDMIEEVFNSFLDEE

SEQ ID NO: 3369 - DNA, 303 bp, Streptococcus pyogenes
atgacacataatcatgaaaatgaccaccaacacgaagttatcacacttgtggatgaacaaggaaatgaaaccttgtttgaaattttattaacaattgatggtcgtgaagagtttggtaaaaattatgttctcttggttccagcgggatctgaagaagatgagtctggtgaaattgaaatccaagcctattcatttactgaaaatgaagatggtactgaaggggatttacaaccgattcctgaggattcagatgctgaatgggatatgattgaagaggtatttaatagttttctagatgagaac

SEQ ID NO: 3370 - protein, 101 aa, Streptococcus pyogenes
MTHNHENDHQHEVITLVDEQGNETLFEILLTIDGREEFGKNYVLLVPAGSEEDESGEIEIQAYSFTENEDGTEGDLQPIPEDSDAEWDMIEEVFNSFLDEN

SEQ ID NO: 3371 - DNA, 126 bp, Streptococcus agalactiae
ttgagcaattgttcagtcgtttttttttcgaataataatagtgatgatgtagtaaaaggaggtgatgttaatgtcagatactcagctaacactagaagaacaagaatttctcaaacaatatatgtc

SEQ ID NO: 3372 - protein, 42 aa, Streptococcus agalactiae
MSNCSVVFFSNNNSDDVVKGGDVNVRYSANTRRTRISQTIYV

SEQ ID NO: 3373 - DNA, 1554 bp, Streptococcus agalactiae
atgaggagaaaaatagtggtagaaaacctagaaaaaccaattggagtgagctataaaaatagcccatcaatgagtaaacgaacggctatcagaatgaagaaatctagtcgattttcaattttactatatagtgttttgtcaactctcttagcaattgcaaatcctttattgacttattttgcaaatggtttgcagactcagaatctctatacaggtttgatgatgaccaaaggacagatcccttatagtgatgtttttgctacaggaggatttttatactatgtaacgattgctctaagttaccttttagggtctagtatctggttacttattgtacagtttattgcttactatgtatctggaatttatttttataaattagtttattatgtggcacaaagtgaaattgtctcgataggcatgacgttgattttctatataatgaatattgtcttaggattcggtggtatgtacccaatacagtgggcattaccttttatgctcatttcgctatggtttttaattaaattttgtgtcgataatatcgttgatgaagcatttatattttatggcattttagcagcattctcactatttatagatccccaaacactgattttttggctttgctcttttgttctcttaacagcaaccaatattaagcaaaagcagtcactacgaggattttatcagtttttatgcgttgtttttggtatgattttaattgcttatactgttggttactttatgtttaatctacagattatctcttcttatattgacaaagctattttttacccctttacgtatttcgctaggacaaaccactcattccttcttagtttagcaattcaaattgttgtccttctagggtcaggttgtctctttggactatgggattttattcaaaatcgtaaaaaagcatcttatcaaatcggcttgaactttattgcctgtatttttattatttacgctataatggccattttttcaagagattttaacctttaccactttttacctgctttaccatttggtcttttgctaacgagtaataaaattactattctttaccaaaaagtgattgacagacgttcacatagacgtcagtatttctctggtaaatctcttatcgtagacctttttgtaaagaaaacatattatttgcccctcttactagtttccttatcgatagggttactagtttataatacttatcaaaatgttactcttagtaaagaaaggcgtgacatttcacattatttgactacaaaaattgatagagatggtaagatttatgtttgggacaaagttgctagcatttatagccagactcggttaaaatctgcttctcaatttgttttgccacatattaatacagcgcaaaaaaataatgagaaaattttgaaggacgagctgcttcagcatggggctaaatactttatcttaaataaaaatgagaagttaccaaatgaactgaaatctgatattaagaagcactaccaagaagttcctctatcaaatatcactcattttgttctatatcgtttcaaa

SEQ ID NO: 3374 - protein, 518 aa, Streptococcus agalactiae
MRRKIVVENLEKPIGVSYKNSPSMSKRTAIRMKKSSRFSILLYSVLSTLLAIANPLLTYFANGLQTQNLYTGLMMTKGQIPYSDVFATGGFLYYVTIALSYLLGSSIWLLIVQFIAYYVSGIYFYKLVYYVAQSEIVSIGMTLIFYIMNIVLGFGGMYPIQWALPFMLISLWFLIKFCVDNIVDEAFIFYGILAAFSLFIDPQTLIFWLCSFVLLTATNIKQKQSLRGFYQFLCVVFGMILIAYTVGYFMFNLQIISSYIDKAIFYPFTYFARTNHSFLLSLAIQIVVLLGSGCLFGLWDFIQNRKKASYQIGLNFIACIFIIYAIMAIFSRDFNLYHFLPALPFGLLLTSNKITILYQKVIDRRSHRRQYFSGKSLIVDLFVKKTYYLPLLLVSLSIGLLVYNTYQNVTLSKERRDISHYLTTKIDRDGKIYVWDKVASIYSQTRLKSASQFVLPHINTAQKNNEKILKDELLQHGAKYFILNKNEKLPNELKSDIKKHYQEVPLSNITHFVLYRFK

SEQ ID NO: 3375 - DNA, 1557 bp, Streptococcus pyogenes
gtgatcgagttaaacgatgaattcatccgaaaagagacgatagaactggccaacgatggcccacgagtacacaccactcaatatgaaactaaagtacctcggcttcataaatgctatctgcttttctttagcattattatcagttctttaacaattgcagtaccttttttaacagatgcagccaatggtcttcagtcccaaaacttatatataggaatgatgttaacgaaggggcaacttccctatagtgctgcttttacaacaggagggctcttttactttgttatcattgcattaagttattatttgggatcgacactttggctagtctttgttcaggtgttttgtttttacttatctggtttatatctttataaactcattaattatatgacaggctttcaaaaagtggctttaactttttcaattagctactatttattatctgttagtcttggttttgggggattgtatcctactcaactggctatgccatttatattaatatcggcttggtttttaactaagtattttgcctgtttagtgaaagatgaggcatttattctttttggctttgtaggtgctcttgcaatgctaattgacccgagtacccttatcttttggtcttttgcttgtgtgacagttttttcttataatataagccaaaagcatcttgcaagaggtttttatcaactgctagcttcgatttttggaatgattttagttttttacacagcaggatatttcattttgaacttacaagtgctaaatccttatttatcacaaacgatgatttatccttttactttttttaaatcaggaaacttatcgttgctttttggactggctattcagttgttcttcgctttggggcttggtcttttgacgggaatggagaatgtcattaggcgatttaaaaacaattctgatagggtcgtcaagtggctatttgtcatggtcattctagaatctatacttgtggctatattttcacaagactatcgcccctatcatcttttacctcttttaccttttggattaattttgactgctattcctgttggctatcagtatggtataggattaggtcagagtagtcatcgcagacgtcatggtaaaaatggtgttggtcgagtaatgatgatttatcttaagagacacttttatttgccaattttaattgtagggacaatactaatctgttctacttattgtttcattagtagtattcctcttaatcaggagcgtgatcatattgctagttatttagaacagaaactaaataaaactcaatctatttatgtttgggatgatacttctaaaatttatttggacagtaaagctaaatctgtttctcaatttagttctcctgacatcaatacgcaaaaagagagtcatcgaaaaatattagaagatgaactattagaaaataaggctgcttatatcgttgttaatcgctataaaaacctgcctaaaatcattcaaaaagtattatctactaattacaaagtagataaacagataacgacaaaaagttttattgtttatcagaaaaag

SEQ ID NO: 3376 - protein, 519 aa, Streptococcus pyogenes
VIELNDEFIRKETIELANDGPRVHTTQYETKVPRLHKCYLLFFSIIISSLTIAVPFLTDAANGLQSQNLYIGMMLTKGQLPYSAAFTTGGLFYFVIIALSYYLGSTLWLVFVQVFCFYLSGLYLYKLINYMTGFQKVALTFSISYYLLSVSLGFGGLYPTQLAMPFILISAWFLTKYFACLVKDEAFILFGFVGALAMLIDPSTLIFWSFACVTVFSYNISQKHLARGFYQLLASIFGMILVFYTAGYFILNLQVLNPYLSQTMIYPFTFFKSGNLSLLFGLAIQLFFALGLGLLTGMENVIRRFKNNSDRVVKWLFVMVILESILVAIFSQDYRPYHLLPLLPFGLILTAIPVGYQYGIGLGQSSHRRRHGKNGVGRVMMIYLKRHFYLPILIVGTILICSTYCFISSIPLNQERDHIASYLEQKLNKTQSIYVWDDTSKIYLDSKAKSVSQFSSPDINTQKESHRKILEDELLENKAAYIVVNRYKNLPKIIQKVLSTNYKVDKQITTKSFIVYQKK

SEQ ID NO: 3377 - DNA, 2196 bp, Streptococcus agalactiae
atgatggtattggaaagagaacgatttatgacagaatctgatatcaaagtgattaaacgtgacgggcgtttggtcagctttgataagtataaaatctacacggctctattaaaagctagtaataaagttatcaaaatgtctcctttagttgaggctaaacttgagatgattgcagatcatgtcatcgctgagatctacaatcgttttaaagataacatcaagatatatgaaatacaaaatatcgttgaacataaattattggaagctaatgagtacgctattgcacaagaatatatcaattatcgtacccaacgcgattttgagcgttcacaggctacagatatcaatttttctattggaaaattaattaataaggatcaaactgttgttaatgagaatgctaataaagactctgatgtgtttaatacccaacgtgatttaacagcaggtattgtagggaaatcaattggtctgaaaatgttaccttctcatgtagcaaatgcacatcaaaagggtgatatccattatcatgatttagattacagcccatacactcccatgacaaattgctgtttaatcgattttaagggaatgcttgcaaatggttttaagattggtaatgcagaagttgagagtccaaaatctattcagacagcgactgctcagatttcacagattattgcgaacgttgcttcaagtcaatatggtggctgtacagcagatcgcattgatgagtttttagctccttatgcacagttaaattatcaaaaacatttaaaagatgcaaaagaatgggttattgaagataaacaagaagactatgcgcgcgctaaaacacaaaaagatatatatgatgccatgcaatctttggagtatgaaattaatactttatttacttcaaatgggcaaacgccatttacttcgcttggttttggattaggaactaattggtttgaacgagaaattcaaaaagcgattttgaaaattcggattcaaggtttaggaagcgagcatcgtactgctatttttccaaaattaatttttacgcttaaaaaaggtcttaatttagaagaagatagccccaattatgatattaaacaattagcattagagtgtgcgacaaaacggatgtatccagatgtcctttcttatgataaaattattgacttaacgggctcttttaaagcccctatgggctgtcgttctttcctacaagggtggcgagatgcaaatggtcaggatgtaacatctggtcgtatgaatcttggagttgtaacagttaatctaccgcgtgttgccatggagtctaacggtgatatggataaattctgggagatatttaatgaacgtatgagtattgctagagatgccttggtttatcgtgtggaacgtgtcaaagaggctatcccagcaaatgcgcccattctttaccagtatggagcatttggagaacgtttaggaaaatatgacaatgttgatcgactctttaatcaccgccgtgcaacggtgtctcttggttatattggtttatatgaggtggcgagtgttttttatggtggtgactgggaagataaccatcaagctaaagcatttactgtagacatcgttcgtaagatgaagcagttatgtgcagattggtctgatgagtatgattatcatttttcagtttattcgacaccatcggagagcttgactgaccggttttgtcgtttagatactgaaaaatttggtatagtaactgatattactgataaggaatactacactaattcattccattatgatgtgcgtaagaatccaacaccttttgaaaaactagattttgagaaaatctatcctgaaacgggtgcatcaggaggatttattcactactgtgaataccctgttttgcaacagaatccaaaagctttagaagcagtttgggactatgcttatgatcgggtaggttatctaggtactaatacaccgattgataagtgttaccaatgtcaatttgaaggggattttacaccgacagatcgaggttttacttgtccaaattgtggtaacagcgaccctaagacagtagatgttgtcaaacgtacatgtggttatttaggtaatccacaggctcgtccgatggttaatggtcgtcataaggaaatctctgctcgtgtaaaacatatgaacggatcaagtattaaaaatcaaggtaat

SEQ ID NO: 3378 - protein, 732 aa, Streptococcus agalactiae
MMVLERERFMTESDIKVIKRDGRLVSFDKYKIYTALLKASNKVIKMSPLVEAKLEMIADHVIAEIYNRFKDNIKIYEIQNIVEHKLLEANEYAIAQEYINYRTQRDFERSQATDINFSIGKLINKDQTVVNENANKDSDVFNTQRDLTAGIVGKSIGLKMLPSHVANAHQKGDIHYHDLDYSPYTPMTNCCLIDFKGMLANGFKIGNAEVESPKSIQTATAQISQIIANVASSQYGGCTADRIDEFLAPYAQLNYQKHLKDAKEWVIEDKQEDYARAKTQKDIYDAMQSLEYEINTLFTSNGQTPFTSLGFGLGTNWFEREIQKAILKIRIQGLGSEHRTAIFPKLIFTLKKGLNLEEDSPNYDIKQLALECATKRMYPDVLSYDKIIDLTGSFKAPMGCRSFLQGWRDANGQDVTSGRMNLGVVTVNLPRVAMESNGDMDKFWEIFNERMSIARDALVYRVERVKEAIPANAPILYQYGAFGERLGKYDNVDRLFNHRRATVSLGYIGLYEVASVFYGGDWEDNHQAKAFTVDIVRKMKQLCADWSDEYDYHFSVYSTPSESLTDRFCRLDTEKFGIVTDITDKEYYTNSFHYDVRKNPTPFEKLDFEKIYPETGASGGFIHYCEYPVLQQNPKALEAVWDYAYDRVGYLGTNTPIDKCYQCQFEGDFTPTDRGFTCPNCGNSDPKTVDVVKRTCGYLGNPQARPMVNGRHKEISARVKHMNGSSIKNQGN

SEQ ID NO: 3379 - DNA, 2196 bp, Streptococcus pyogenes
atggtaagtttagaagaagacaaggtgactgttcaacctgatattaaagtgattaaacgagatggtcgccttgttaattttgatagtacaaaaatctatagtgctttattaaaagcaagcatgaaagtaactcggatgtcgccacttgttgaggctaaattagaggctatttctgatcgcattatagcagaaattattgagcgttttccaactaatatcaaaatttatgaaatccaaaatattgtagagcataagcttcttgcagctaatgaatatgctattgcaaaagaatacattaattatcgtactcagcgtgactttgcacgttcacaagcaacagatatcaatttttctattgataaattaattaataaagatcaaacagttgttaatgaaaatgctaacaaagatagcgatgtttttaatactcaacgagatttaactgctggaatcgtagggaaatcgattggtttaaaaatgttaccttcgcatgttgctaatgctcatcaaaaaggagatatccattaccatgatttggattacagtccttatacaccgatgacgaactgctgtttaattgactttaagggcatgttagccaatggctttaaaattggtaatgctgaagtggaaagtcccaagtctattcaaactgcaacagctcagatctcacagattattgcgaatgtagcatcaagtcagtacggcggatgcacagctgatcgcattgacgagtttttagccccatatgcggagcttaactttaaaaaacatatggctgatgctaagaaatggatcgttgagactaagagagaaagctatgcttttgaaaagactcaaaaagatatttatgatgcgatgcagtctttggagtatgaaattaatacgctctttacgtctaatggtcaaacaccatttacttctttaggatttggtttggggacgtcttggtttgaacgtgagattcaaaaagctattttgaccattcggattaatggtcttggtagtgaacatcgcacggctattttccctaaattaattttcacggttaaacgtggcttgaatttagaaccagattcaccaaactatgatattaagactttggctttagaatgtgcgactaagcggatgtacccggatatgttatcttatgataaaattattgatttgacaggatctttcaaatctccaatgggatgccgctctttccttcaaggctggaaagatgaaaatgggcaagatgtgacctcaggccgtatgaatcttggggttgtcaccctcaatttacctcgcattgccatggaatcaaatggcgatatggataagttttgggagctgtttaatgagaggatgctaattagtaaggatgctttaatttatcgtgtcgaacgtgtcacagaagcaaaaccagcaaatgctcctattctttatcaatatggtgcttttggaaagcgtttggagaagacagggaatgtaaatgatctctttaagaatcgtcgtgcaacagtctctcttggctatattggtctttatgaagtggcgtctgttttttatggtggtcaatgggaaggtaatccagatgctaaagcttttaccttgtcaattgtcaaggcaatgaaacaggcctgtgaggattggtcagatgaatatggttatcatttctctgtttattcgactccatcagaaagtttgacagatcgcttttgtcgtttagatacggaaaaatttggcattgtgacagatattacggataaagaatactatacaaattcttttcactatgatgtgcgtaagagtccgacaccttttgaaaaattagattttgaaaaagattatccagaagcaggtgcttcaggtggttttatccactactgtgagtatcctgttttgcaacaaaatccaaaggccttggaagcggtttgggactatgcttatgatcgtgtggggtatttgggaaccaatacgcctattgataaatgctataattgccaatttgaaggcgattttaccccaacagaacgtggttttacttgcccaaactgtggcaataatgaccctaaaacagttgatgtggtcaaacgtacatgtggttacttggggaatcctcaggcccgcccaatggttaacggtcgccataaggaaatctctgcgcgtgtaaaacatatgaatggttctactataaaatacccaggcctg

SEQ ID NO: 3380 - protein, 732 aa, Streptococcus pyogenes
MVSLEEDKVTVQPDIKVIKRDGRLVNFDSTKIYSALLKASMKVTRMSPLVEAKLEAISDRIIAEIIERFPTNIKIYEIQNIVEHKLLAANEYAIAKEYINYRTQRDFARSQATDINFSIDKLINKDQTVVNENANKDSDVFNTQRDLTAGIVGKSIGLKMLPSHVANAHQKGDIHYHDLDYSPYTPMTNCCLIDFKGMLANGFKIGNAEVESPKSIQTATAQISQIIANVASSQYGGCTADRIDEFLAPYAELNFKKHMADAKKWIVETKRESYAFEKTQKDIYDAMQSLEYEINTLFTSNGQTPFTSLGFGLGTSWFEREIQKAILTIRINGLGSEHRTAIFPKLIFTVKRGLNLEPDSPNYDIKTLALECATKRMYPDMLSYDKIIDLTGSFKSPMGCRSFLQGWKDENGQDVTSGRMNLGVVTLNLPRIAMESNGDMDKFWELFNERMLISKDALIYRVERVTEAKPANAPILYQYGAFGKRLEKTGNVNDLFKNRRATVSLGYIGLYEVASVFYGGQWEGNPDAKAFTLSIVKAMKQACEDWSDEYGYHFSVYSTPSESLTDRFCRLDTEKFGIVTDITDKEYYTNSFHYDVRKSPTPFEKLDFEKDYPEAGASGGFIHYCEYPVLQQNPKALEAVWDYAYDRVGYLGTNTPIDKCYNCQFEGDFTPTERGFTCPNCGNNDPKTVDVVKRTCGYLGNPQARPMVNGRHKEISARVKHMNGSTIKYPGL

SEQ ID NO: 3381 - DNA, 141 bp, Streptococcus agalactiae
atggggaaataccaattagattacaaagggcaagcacaagtacagaagttccatgagaagcactctactggagagaatgctaatcaaaaatcacgtctaaaagatttaaggaaacaatttttggaaaaggcaaagaaaaaa

SEQ ID NO: 3382 - protein, 47 aa, Streptococcus agalactiae
MGKYQLDYKGQAQVQKFHEKHSTGENANQKSRLKDLRKQFLEKAKKK

SEQ ID NO: 3383 - DNA, 144 bp, Streptococcus pyogenes
atgggaaaatatcaattagactataaaggaatgcagcaggtagaacgctttcatgagaagcattctaaaaaaaagacggataaaaaatcccgcgttcaagaacttaaggctcggtttttagagaagtcaaaaaaacaggataac

SEQ ID NO: 3384 - protein, 48 aa, Streptococcus pyogenes
MGKYQLDYKGMQQVERFHEKHSKKKTDKKSRVQELKARFLEKSKKQDN

SEQ ID NO: 3385 - DNA, 930 bp, Streptococcus agalactiae
atgttgcaacttggaattgtcggtttaggaggtatttcacagaaagcttatctaccttatatgcgtcaagtgacaggtgtgcactggcatctttttacacgccaaaaacagattttagaagaagttaatatgctttttggttcttctacagcttatgacagtttagatagtctagccgagcatcctttggatggagtcttcattcatgtcgcgactagtgctcactttgatatagcaaagctttttttaaaaaagggtattccagtttttatggataagcctttgacagaagattatacttcaactaaagcattgtatgatttggcgaaggatcataaaacatttttaatggcaggttttaatcgtcgctttgcaccacgtattatggaaatgaaaaaagtagaagataaaaaccatattcgcacctttaaaaatgctgtcaatgcaccagcggattttcaatataagctttttgatatgtttatccatcctttagatacggcgctatttttgacaaataatgttgttaaaagaggatactttgtgactaaacgtgatgggaataagatattacaagtatcagtaacgctagaaacagacagtgagataatagaagcaagcatgaacctgcagtcggggtctcgtcgagaaataattgaaatagagtcgccagaagtaacctattcattagatgatttgtcaaatctttctgttattgatggctttgaccgtcgtgctatcggttttggttcttgggcaagcactctagagaaacgtggttttgaaccaatgattgatgcttttattcaagctatcactacaggtgtcaatcctatatcaccaaagtctagtttattgagtcattttatttgtgaccagattaataaagcgaatgctccttttggaatgcttaacttgaagataatggaa

SEQ ID NO: 3386 - protein, 310 aa, Streptococcus agalactiae
MLQLGIVGLGGISQKAYLPYMRQVTGVHWHLFTRQKQILEEVNMLFGSSTAYDSLDSLAEHPLDGVFIHVATSAHFDIAKLFLKKGIPVFMDKPLTEDYTSTKALYDLAKDHKTFLMAGFNRRFAPRIMEMKKVEDKNHIRTFKNAVNAPADFQYKLFDMFIHPLDTALFLTNNVVKRGYFVTKRDGNKILQVSVTLETDSEIIEASMNLQSGSRREIIEIESPEVTYSLDDLSNLSVIDGFDRRAIGFGSWASTLEKRGFEPMIDAFIQAITTGVNPISPKSSLLSHFICDQINKANAPFGMLNLKIME

SEQ ID NO: 3387 - DNA, 939 bp, Streptococcus pyogenes
ttgagtatgcttaatattgggattgtgggactaggtgctatttcacaaaaagcctatttaccatatatgagacagctgagtgacattacttggcatctatcaacgcggaatgcagcagtacgtcagcaggtcggtcagttatttggtcacgctattctttacagtgatgtcaaggagttgtcaaaaacaaacttagatggggtctttattcatgcggccacatcggcccacgcagagttggctagtttatttttaaatcaggggatcccagtctttatggataaacctatagctgacaattacctgatgacaaagaacctctatgacttagccaaagaaaatcagacttttctgatggcaggatttaacaggcgttttacacctcgtgtcaagaagttgtcaagtttgtcaactaagcgtaaagtggctgttgaaaaaaatgacttgaaccggccaggagatatgacttttaagctctttgatttctttatccatcctttagatacagccttattcttgacagaagggaccttactaaaagggcattttcaatatcatctggaagcaggcttactgagtcaagttatggtaaccttgatgaccgaaagcatgacgactacagcttctatgaatttacaatcagggagtcgccgtgaggtaatggaagttcaacgggctgaagaaacttatcatttagagaacttagacgagttatctatttataaaggtactgaaaaaagggtgcttggctttgcttcttgggacactaccttgcacaaaagaggttttgaaacaatgatcgatgcctttttagaagctattagcacaggcgtcaatcctgtcagccctgagtctagtcttttaagccactggatttgtcaacagattgctgactctcagctttcttatggagagttaacggtagagttgcctaaggat

SEQ ID NO: 3388 - protein, 313 aa, Streptococcus pyogenes
LSMLNIGIVGLGAISQKAYLPYMRQLSDITWHLSTRNAAVRQQVGQLFGHAILYSDVKELSKTNLDGVFIHAATSAHAELASLFLNQGIPVFMDKPIADNYLMTKNLYDLAKENQTFLMAGFNRRFTPRVKKLSSLSTKRKVAVEKNDLNRPGDMTFKLFDFFIHPLDTALFLTEGTLLKGHFQYHLEAGLLSQVMVTLMTESMTTTASMNLQSGSRREVMEVQRAEETYHLENLDELSIYKGTEKRVLGFASWDTTLHKRGFETMIDAFLEAISTGVNPVSPESSLLSHWICQQIADSQLSYGELTVELPKD

SEQ ID NO: 3389 - DNA, 489 bp, Streptococcus agalactiae
atgaaattacggcgcccagtgttagaagataaagaagaaattttagccatgtataaagagtttcaaaaagaaagtagttcagtggacggtggtttttatgaaccaactatgcattttgaagactggctagatcataacctaaatatggagttaggggtaggcgttcctgataattttgttccatatattcagtttgtgtcttttgacaatgacaataatgctataggtttcttaaatttacgtttaagactaaatgatactcttttagaaaaaggtggacatattggttattccatacgacctcgccagcgtggcaaaggttatgctaaagaacagttgaagctaggaattgagcaagcacatctaaaaaatattaatgaaatacttgtgacatgccatgtagacaatgatgccagcaagtcagtaatattagctaacggtggtgttttagaagattgtcttcatcagacagagcgttattggataacc

SEQ ID NO: 3390 - protein, 163 aa, Streptococcus agalactiae
MKLRRPVLEDKEEILAMYKEFQKESSSVDGGFYEPTMHFEDWLDHNLNMELGVGVPDNFVPYIQFVSFDNDNNAIGFLNLRLRLNDTLLEKGGHIGYSIRPRQRGKGYAKEQLKLGIEQAHLKNINEILVTCHVDNDASKSVILANGGVLEDCLHQTERYWIT

SEQ ID NO: 3391 - DNA, 507 bp, Streptococcus pyogenes
atggaaataagacgaccgactttaaaagataaagacgctgtattgtcaatgattaacgaatttttagagcagaaaagtgctacagatgggttatggcattttaacgtcaatgactttaactatgaaacatggttggaagattccttgcgacaggaaatgggtttgtccagtcaaggagtgcctgctattcaatacgtcgcatttgatgagagaagtcaggctatcgggttcttaaatcttcgtttacggttaaatgagagattacttgaaaaaggtgggcatattggttactctgtccgtcccagccagcgtgggaaaggttatgccaaggagatgcttaaacaagctgtcagctatgcgatttccaagaatatcacgacaattttggtaacttgtgatgagactaatgttgcaagccgagcagttattgtggctaacgtcggtatcttggaagatagtcgaggtggaacggaacgttattggattgaagaacaaagaggcgataag

SEQ ID NO: 3392 - protein, 169 aa, Streptococcus pyogenes
MEIRRPTLKDKDAVLSMINEFLEQKSATDGLWHFNVNDFNYETWLEDSLRQEMGLSSQGVPAIQYVAFDERSQAIGFLNLRLRLNERLLEKGGHIGYSVRPSQRGKGYAKEMLKQAVSYAISKNITTILVTCDETNVASRAVIVANVGILEDSRGGTERYWIEEQRGDK

SEQ ID NO: 3393 - DNA, 615 bp, Streptococcus agalactiae
atgtcagaagaagcaagttggaatactccaaagcctggggagtggaaaagcgaagaattaagtcatggccatatcattgattataaagcttttaattttgtagatggtgaaggtgttagaaactcactctacgtagctggatgtatgttccactgtaaagggtgttataatactgctacatggtcctttcgagccggaatcccttatacaaaagagcttgaagatcaaattatgacagatttagaacaaccttacgtccaaggtttaacgttattaggtggagagccgttcttaaatacaggtattttgttgccacttcttcagcgtatccgacgtgaattgccagaaaaagatatttggtcatggacggggtatacttgggaagaaatgatgctggagactcaagataaattggagatgttatctttgattgatattttagtggatggtaggtttgatcaaagtaagcgaaatttaatgctacaatttagaggatcttcaaatcaaagaatcattgatgtacaaaaatctttaaaagaaggtgaagtcgtgatttgggaaggattaaacgatggtgacaatagttatgaacaagtcaaacgagatgatttactc

SEQ ID NO: 3394 - protein, 205 aa, Streptococcus agalactiae
MSEEASWNTPKPGEWKSEELSHGHIIDYKAFNFVDGEGVRNSLYVAGCMFHCKGCYNTATWSFRAGIPYTKELEDQIMTDLEQPYVQGLTLLGGEPFLNTGILLPLLQRIRRELPEKDIWSWTGYTWEEMMLETQDKLEMLSLIDILVDGRFDQSKRNLMLQFRGSSNQRIIDVQKSLKEGEVVIWEGLNDGDNSYEQVKRDDLL

SEQ ID NO: 3395 - DNA, 615 bp, Streptococcus pyogenes
gtgatggcagaaaagtgttggaataatcctaagccaaaggaatggcaggcagaggagttaagtcaaggccggattattgactataaggcttttaactttgttgatggtgaaggggttcgtaattccctttatgtgtctggttgtttattccattgcaaggggtgttataatgctgcgacttggtcttttaaggcgggaatgccttatacgcaagaacttgaagagcagataatgacggatttggcacagccttatgttcagggactgacacttttaggtggagaaccctttttgaatacgggtatcttaattcctctgattaagcgtattcggcgtgaattgccagaaaaagatatttggtcttggacgggttatacttgggaagaaatgatgcttgaaacaccagacaaactggaaatgctgtccttaattgatattctggtagatggtcgttttgatatcacaaaaaagaacctcatgttgcaatttagaggctcttctaaccagcgaattatcgatgttcaaaagtctttggctgctaaagaagtgattatctgggataagttaaacgatggggaccaaacctttgaacaaattagtcgggaggatttgctt

SEQ ID NO: 3396 - protein, 205 aa, Streptococcus pyogenes
VMAEKCWNNPKPKEWQAEELSQGRIIDYKAFNFVDGEGVRNSLYVSGCLFHCKGCYNAATWSFKAGMPYTQELEEQIMTDLAQPYVQGLTLLGGEPFLNTGILIPLIKRIRRELPEKDIWSWTGYTWEEMMLETPDKLEMLSLIDILVDGRFDITKKNLMLQFRGSSNQRIIDVQKSLAAKEVIIWDKLNDGDQTFEQISREDLL

SEQ ID NO: 3397 - DNA, 729 bp, Streptococcus agalactiae
atgataaaaattttgatcccaactgcaaaagaaatgaaagtgtgtcaaaacattgcatggcctaaactgagtgctcaaacgaaaattataattgattatttttctactttaactgtttcagacttagaggatatctacagaattaatacaagtgcagctcgttgtgaggctcaaagatggcaagattttaaagctaaacaacttactctgaatcctgctattaagttattcaacggtcttatgtaccgcaatatcaaaaggcacaacttatccacaagtgaagcacaatttatggaaaattctgtttttattactagtgctctttatggcatcattcctgctatgacactaatatcccctcatcgtttagattttaacactaaaatcaaaatcaacaataactctcttaaagttttttggcgtgaaaattacgatacttttatgcagtcagatgacattatggtttctttgctttctaatgaatttgaaactgtcttttctcctaaagagcgtcaaaaactaatacatcttaactttattgaagatcgagatggccaattaaaaacccactctaccatatcaaaaaaagcaagaggaaagtgtttaactgctatgatggaaaataattgccaaactctagaacacttaaagcaattacgctttgatggcttctgttatgataatgaactctcagactctaagcaattaacttttgttaaaaaacagact

SEQ ID NO: 3398 - protein, 243 aa, Streptococcus agalactiae
MIKILIPTAKEMKVCQNIAWPKLSAQTKIIIDYFSTLTVSDLEDIYRINTSAARCEAQRWQDFKAKQLTLNPAIKLFNGLMYRNIKRHNLSTSEAQFMENSVFITSALYGIIPAMTLISPHRLDFNTKIKINNNSLKVFWRENYDTFMQSDDIMVSLLSNEFETVFSPKERQKLIHLNFIEDRDGQLKTHSTISKKARGKCLTAMMENNCQTLEHLKQLRFDGFCYDNELSDSKQLTFVKKQT

SEQ ID NO: 3399 - DNA, 729 bp, Streptococcus pyogenes
atgctaacctttttaattccaaccgcaaaagaaatgacgatccctaaggaatctcacccacacctccttccacaagacagccaagccattttaaaaatcatggcagctatgaccacggaggacttggccaaatcatatcgtatcaaagaagagtcagctaaaaaagaacagcaacgctggcaagacatggcctctcaacaaagcttggcttaccctgcctaccaactgttcaatggccttatgtaccgccatatcaagcgcgataagctcactacccaagaacaggcttacctcacccagcaggtttacatcacctcatccttttacggtatcattcccgctaatcatcctatcgcagagcaccgccatgattttcacaccagaataaaaattgaaggacaaagcctcaagtcttactggcggccctgttataatcagtttgccaaagagcatccccaagtgatttcccttttatccagtgaatttgacgatgtcttttccaaagactgtaaacaattgtggataagtcccaagtttatggcagaaaaagagggccaattcaaaacccattccaccatttcaaaaaaggcacgaggtgcatttctcactgcctgtatggaaaataattgccaaactgttgacagccttaaaagccttgtctttgctggtttttactaccatccagacctatcaacagatcatgaatttgtctatatcaaaaaagaggcc

SEQ ID NO: 3400 - protein, 243 aa, Streptococcus pyogenes
MLTFLIPTAKEMTIPKESHPHLLPQDSQAILKIMAAMTTEDLAKSYRIKEESAKKEQQRWQDMASQQSLAYPAYQLFNGLMYRHIKRDKLTTQEQAYLTQQVYITSSFYGIIPANHPIAEHRHDFHTRIKIEGQSLKSYWRPCYNQFAKEHPQVISLLSSEFDDVFSKDCKQLWISPKFMAEKEGQFKTHSTISKKARGAFLTACMENNCQTVDSLKSLVFAGFYYHPDLSTDHEFVYIKKEA

SEQ ID NO: 3401 - DNA, 906 bp, Streptococcus agalactiae
atgaacggtgtaatatgttactatatagtaataataggaggattaactatgtcgtatccatacaaagccaatcattccattgaatcaatcaccttaaaagtaaatgacctcgaaaacctcgtaaacttctatagcgatatcattgggttaactgttattgacaaatcaagcactagagccttactaggggtaaatcaaaaaatccctcttattatccttgaaaaaactgaacttgaaaagcatagtacctatggcctttatcacactgctattttagtaccagatgaataccatctcagtctagctctaaatcatttattatctcagcatatccctctagagggtggagctgaccatggctatagcaatgctatctatctaagtgatcctgaaggtaatggaattgaaatttataatgataaggatatctctatgtgggatatcagagagagtggacaaattattggtattactgaaagactagatattgacaatttacttgacagccttgtcaacgttcctaataattataagctttctgaaaaaactagtattggtcatattcatttgagtgttaaagatgctaagattagctcaaaactctatcaaaatgtttttggccttgatgagaaatttgcaatcccgacagctagttggattgcatccggcaactaccatcatcatctagcctttaataattgggctggtccaaatctttctaaaaaccaagaagatagacccggaatttccttattgacaattgcttacaatgatgacaacctttttagagatagcttaaaaaaagcgcaactttaccaactgactttccttgaaaaacaagatcattattatattattgaagattttgatggcatccgaattaaagttgttctaaaaccagagaat

SEQ ID NO: 3402 - protein, 302 aa, Streptococcus agalactiae
MNGVICYYIVIIGGLTMSYPYKANHSIESITLKVNDLENLVNFYSDIIGLTVIDKSSTRALLGVNQKIPLIILEKTELEKHSTYGLYHTAILVPDEYHLSLALNHLLSQHIPLEGGADHGYSNAIYLSDPEGNGIEIYNDKDISMWDIRESGQIIGITERLDIDNLLDSLVNVPNNYKLSEKTSIGHIHLSVKDAKISSKLYQNVFGLDEKFAIPTASWIASGNYHHHLAFNNWAGPNLSKNQEDRPGISLLTIAYNDDNLFRDSLKKAQLYQLTFLEKQDHYYIIEDFDGIRIKVVLKPEN

SEQ ID NO: 3403 - DNA, 855 bp, Streptococcus pyogenes
atgatatacccttacaactcaaccatctctttaggaacggtttctctaaatgttaccgatctagcaaagatgacaaccttttacacaagtattatcggtttacaggttctctcacaagacacgacatctcgtcaattgactacagacggtaaaaccgttatcttagagttacgacaaacacctttaccaggcgataaagcttatggtctttatcacacagcctttttagttcctgatcgtcatagcttgggacttgttctcaatcatttcttaaccagaagtatctctttagaaggagcagctgatcacggccatagcgaagctatctacctcagcgatcctgagggtaatgggattgaaatttatcatgacaaagctgttgagcattgggatatccgcgacaatggtcaaattattggtgtgactgagcccacggataccaaaagcatattggagcagttgacagatatccccaagcactttttactagctcaagacacacgcattcgccatgtccatctgagtgtcaaaaatgctctggcttcttcacttctctatcaaaaggtttttgatttaggcgataaaatgaccattccaagtgctagctggattgcttcagggaactactatcatcaccttgcattcaatcactggtcagccccttacctcaaaaaacaccaagaaggtgctccaggcttagccttcttgaccattcacattgagacgcccctgcttttttcagccactctcaaaaaagcaagattacacggcctagctattttacaagaagattcttcttctttcacgacagaagacgaggaaggtatccgtgtgaacgtcatccttggacaagac

SEQ ID NO: 3404 - protein, 285 aa, Streptococcus pyogenes
MIYPYNSTISLGTVSLNVTDLAKMTTFYTSIIGLQVLSQDTTSRQLTTDGKTVILELRQTPLPGDKAYGLYHTAFLVPDRHSLGLVLNHFLTRSISLEGAADHGHSEAIYLSDPEGNGIEIYHDKAVEHWDIRDNGQIIGVTEPTDTKSILEQLTDIPKHFLLAQDTRIRHVHLSVKNALASSLLYQKVFDLGDKMTIPSASWIASGNYYHHLAFNHWSAPYLKKHQEGAPGLAFLTIHIETPLLFSATLKKARLHGLAILQEDSSSFTTEDEEGIRVNVILGQD

SEQ ID NO: 3405 - DNA, 822 bp, Streptococcus agalactiae
gtgtacaattatattttggaggataatatggtaaggctaatatttagtgatattgatggtactttaattaacagtaattttaaagtaacacctaagacacggcagggaattaaacaaatagtagctcaaggggctactttcgttcccatatcagctaggatgcctgaggcaattactccgattatggaacaaattggaatagattcttatattatttcctataatggggctttaatacaagatatgcaacaaaaaacaattgcttcccacacaatggatggtcaagttgccttacaagtttgttcttatgtaagcaagcattattcgaaaattgcatggaatgtctatcgttatcatgaatggtattcctgtgataaagaaaatgagtgggtccaaaaagaggaggagattgttggtttacaatctaaagagatgagtttgatggagttagagaagcaagataggattcataaacttctcttgatgggagaaccatctctgatgggagaattggagaacactttgaaagctcaatatccacatttatcaatcgcacaatctgctccttactttattgaaataatggctccaggtattgaaaaaggaaaatctgctaaaactttagcagactatttagatatttctcttgcagactctattgcgtttggtgataactataatgatttaaatctgcttgaaattgtgggtaaaggttttgtcatggggaatgctcctaaagatttacaagagagaattggaaatgtaactcaggataatgataacgatggtatttattatgctttagtagagtatatggaaaat

SEQ ID NO: 3406 - protein, 274 aa, Streptococcus agalactiae
MYNYILEDNMVRLIFSDIDGTLINSNFKVTPKTRQGIKQIVAQGATFVPISARMPEAITPIMEQIGIDSYIISYNGALIQDMQQKTIASHTMDGQVALQVCSYVSKHYSKIAWNVYRYHEWYSCDKENEWVQKEEEIVGLQSKEMSLMELEKQDRIHKLLLMGEPSLMGELENTLKAQYPHLSIAQSAPYFIEIMAPGIEKGKSAKTLADYLDISLADSIAFGDNYNDLNLLEIVGKGFVMGNAPKDLQERIGNVTQDNDNDGIYYALVEYMEN

SEQ ID NO: 3407 - DNA, 807 bp, Streptococcus pyogenes
atgtctatcaaactggttgctgtcgatattgatggcacattactcactgatgaccgtcgaattacagatgatgtttttcaagctgtccaagaggctaaagcccaaggggttcatgtggtgattgctactggcagacctattgccggagtgatttcattactcgaacaattagaactcaaccacaaaggaaaccacgttatcacttttaatggtggcttggtgcaagatgccgagaccggcgaagaaattgttaaagaattgatgacttacgacgattatctggaaacggaatttttgagccgaaaattaggagttcacatgcatgccattaccaaagaaggtatttacactgccaatcggaatattggaaaatacacagttcatgaatcgactttggtaaacatgcctattttctatcgcactcccgaagaaatgaccaataaagaaatcatcaaaatgatgatgattgatgaacctgaccttttggacgcggccatcaagcaaattcctcaacatttctttgataagtacaccatcgtcaagtcaacccctttttatttagagttcatgccaaaaaccgtcagcaagggtaatgccatcaaacacttagctaaaaaactcgggctagatatgtcacaaaccatggccatcggggatgctgaaaatgatcgtgctatgttagaagtcgttgccaaccctgttgtcatggaaaatggggttcctgaattgaaaaaaatagccaaatacatcaccaaatccaacaatgacagtggtgtggcacatgctattcgcaagtgggtattaaac

SEQ ID NO: 3408 - protein, 269 aa, Streptococcus pyogenes
MSIKLVAVDIDGTLLTDDRRITDDVFQAVQEAKAQGVHVVIATGRPIAGVISLLEQLELNHKGNHVITFNGGLVQDAETGEEIVKELMTYDDYLETEFLSRKLGVHMHAITKEGIYTANRNIGKYTVHESTLVNMPIFYRTPEEMTNKEIIKMMMIDEPDLLDAAIKQIPQHFFDKYTIVKSTPFYLEFMPKTVSKGNAIKHLAKKLGLDMSQTMAIGDAENDRAMLEVVANPVVMENGVPELKKIAKYITKSNNDSGVAHAIRKWVLN

SEQ ID NO: 3409 - DNA, 960 bp, Streptococcus agalactiae
atgaaaaaaataacaaagatggtaattagcagcgttttagcaactgttctgatgacagcttgttcacaatcttctcaaaatggtcaatctgatgtaaaacatattggtattttacaatatgtagaacatccctctctaactgccactaggaaaggatttataaaagaattagctaaagaaggctataaagatggcaaaaatatcaaaattgagtataagaatgctcaaggggatcagtcaaatatccaatcaatttctgaaaaactcattaaagataataaattagtattgggaattgcgactccggcggctcaatcgttgacaacggtgtcaacagaaacacctattttatttacagcagtgacagatccggtatcagccgaattagtaaaatcaatgaaaaaacctgaaggtttagcgactggtacaagtgacatgtctccaattaaaaagcaagtatcccttttgagaaaagtaatgcctaaggttaaacgtgttggtattatgtataccactagcgagcgtaactcagaagttcaggtaaaacaagcaaaaaaaatcttccaagaggcggggattaaaacaagtgttaaaggtatttcttccactaatgatgtacaagatactgctaagagtttaatgtctaaaacagaggttatttttgtaccaacagataatattatagccagctcagtaacgctgttagggaatctatcgaaagaattaaaagtgcctgttgtgggaggttcagcagatatggtaccaagtggtttgctcttttcttatggggctgattatgaggctttaggtcgtcaaacggcaagacaagctgttaaaatcctcaaaggtaaagacgtcgctaaagttccttcagaatatcctcaaaatctaaaagtagtagttaatgaagatatggcaaaagagcttggaattgatgtttcaagtattaaaaataataaa

SEQ ID NO: 3410 - protein, 320 aa, Streptococcus agalactiae
MKKITKMVISSVLATVLMTACSQSSQNGQSDVKHIGILQYVEHPSLTATRKGFIKELAKEGYKDGKNIKIEYKNAQGDQSNIQSISEKLIKDNKLVLGIATPAAQSLTTVSTETPILFTAVTDPVSAELVKSMKKPEGLATGTSDMSPIKKQVSLLRKVMPKVKRVGIMYTTSERNSEVQVKQAKKIFQEAGIKTSVKGISSTNDVQDTAKSLMSKTEVIFVPTDNIIASSVTLLGNLSKELKVPVVGGSADMVPSGLLFSYGADYEALGRQTARQAVKILKGKDVAKVPSEYPQNLKVVVNEDMAKELGIDVSSIKNNK

SEQ ID NO: 3411 - DNA, 894 bp, Streptococcus agalactiae
atgttagatattatcttatccggaatttcgcaaggattactttggtcaattatggcaattggcgtgtttatcacttttcgtatcttagacatagccgatctctctgcagagggtgctttccctatgggggctgcagtttgcgctttatgtatcgttaatgatattaatccaattgtggcaaccatagcgggcatgttaggtggtatgttggcaggactagtatcgggttttcttcatactaaaatgaaaataccagccctcctcacaggtattattacgttgacaggactttactctattaatttacttgttttaggaagatcaaacgtctcttttgctctcaaaaatactttggttacaatggtaacaagattaggtttaaataaactttcagcagttttattaattggaattgtttgtgtaggcttggttatcttaattttgtatctctttttaaatacccaactaggattagctttaagagcgacaggtgataatgaggctatgggacaagccaatagtattaaagtagatcggatgaaaatgctaggatatatgattgggaatggcctgattgctttatctggtgcacttttagcgcaaaataatggctatgcagatttgaatatgggagtgggtacaatcgttattggattagcttcaattatcttggcagaagtaatgataaaatacttacctcttggcaaaaggttatggtcaattgtattagggtctgttttataccgtatgattattgttttcatattaacaaccgatattgatgcacagatgataaagttggtttcagcaattttgttggctctcattttgtatgtcccagaattacgagctaaactaggagtaaaaacctctaaatcacttacaaaggaagga

SEQ ID NO: 3412 - protein, 298 aa, Streptococcus agalactiae
MLDIILSGISQGLLWSIMAIGVFITFRILDIADLSAEGAFPMGAAVCALCIVNDINPIVATIAGMLGGMLAGLVSGFLHTKMKIPALLTGIITLTGLYSINLLVLGRSNVSFALKNTLVTMVTRLGLNKLSAVLLIGIVCVGLVILILYLFLNTQLGLALRATGDNEAMGQANSIKVDRMKMLGYMIGNGLIALSGALLAQNNGYADLNMGVGTIVIGLASIILAEVMIKYLPLGKRLWSIVLGSVLYRMIIVFILTTDIDAQMIKLVSAILLALILYVPELRAKLGVKTSKSLTKEG

SEQ ID NO: 3413 - DNA, 801 bp, Streptococcus agalactiae
atgtcattacttgaattagtcaatctgcacaaaacttttgaaaaaggaactgtcaatgagaaccatgttttacgtggtttagatttaacgattgaagacggtgattttatttcagtaattggaggtaacggtgcgggaaaatcaaccctccttaactgtatcgctggtctgatccctattgatcagggggcaatcacattagacaaccaatcaattactaaagactctgtagaaaaacgatctaaggatattagtcgagtcttccaggatcctagaatgggaactgcaacaaatttgacgattgaagaaaatatggcaattgcacataaaagaggcaataagcgtcacatttttagacagtcagtgactgacgatgaccgtcaactatttaaaaagtctctatcacaattaggtctaggcttagaaaatcgaatgaagactgatgctgcatttttatctggcggtcagcgtcaagccctcacgttagctatggcaactcttgttcgtcccaaattattattactggatgaacatacagcggctctagatcccaaaactagcgatatggttatggaattaacacagaaagtgatagaagaacaacgattgacagccttaatgattacgcacaatatggagcatgccattgcttatggtaatcgtctcgtgatgctctaccacgggaaaattgttgttgatgttaaaggagaagcaaagagaaacttaacagttgcagaattaatggaacttttccataaaaactcaggtcaacagttgatagatgatgcccttgtcttaggt

SEQ ID NO: 3414 - protein, 267 aa, Streptococcus agalactiae
MSLLELVNLHKTFEKGTVNENHVLRGLDLTIEDGDFISVIGGNGAGKSTLLNCIAGLIPIDQGAITLDNQSITKDSVEKRSKDISRVFQDPRMGTATNLTIEENMAIAHKRGNKRHIFRQSVTDDDRQLFKKSLSQLGLGLENRMKTDAAFLSGGQRQALTLAMATLVRPKLLLLDEHTAALDPKTSDMVMELTQKVIEEQRLTALMITHNMEHAIAYGNRLVMLYHGKIVVDVKGEAKRNLTVAELMELFHKNSGQQLIDDALVLG

SEQ ID NO: 3415 - DNA, 1008 bp, Streptococcus agalactiae
atgggtatcggtattattattgccagccatggtaaatttgctgaaggtattcatcaatcaggttcaatgatctttggtgaacaagaaaaagttcaagttgtaactttcatgccaaatgaaggaccagatgatttgtatggacacttcaacaatgctatcgcacaatttgatgctgatgatgaggtgcttgtgttagctgacctttggagtgggtcaccatttaaccaagcaagccgtgttatgggagaaaatcctgaacgtaaaatggctatcatcactggtctcaatttgccaatgcttatccaagcctatactgagcgtatgatggacgctaatgcaggtgttgaacaagttgccgcaaatattattaaagagtctaaggaaggtatcaaagcccttccagaagaacttaatcctgttgtagaagctactcctgtagcaggtgttcctgcagatgttcctgcggaagttaaacaaagtggatctatccctgaaggaactgttattggagatggcaagcttaaaattaatcttgctcgtattgacacacgtcttttacatggtcaagttgcaactgcatggactccagcatcaaaagcaaaccgtattatcgttgcttctgatgaagtttctaaagatgaacttcgtaaacaattgattaagcaagctgctcctggaggagtcaaagcaaacgttgtcccaattagtaaattaattgaagtagctaaagacccacgtttcggaaacacacgtgccttgatcttatttgaaactgtacaagatgcactccgtgcaattgaaggtggtgtggaaatccctgaattgaacgttggttcaatggctcactcaactggtaaaacaatggtaaacaacgttctttcaatggataaagacgatgttgctgcctttgaaaaattacgtgacttaggtgtatcatttgatgtacgtaaagtaccaaatgacgctaaaaagaatttgtttgatttaatcaacaaagcaaacgtaaaa

SEQ ID NO: 3416 - protein, 336 aa, Streptococcus agalactiae
MGIGIIIASHGKFAEGIHQSGSMIFGEQEKVQVVTFMPNEGPDDLYGHFNNAIAQFDADDEVLVLADLWSGSPFNQASRVMGENPERKMAIITGLNLPMLIQAYTERMMDANAGVEQVAANIIKESKEGIKALPEELNPVVEATPVAGVPADVPAEVKQSGSIPEGTVIGDGKLKINLARIDTRLLHGQVATAWTPASKANRIIVASDEVSKDELRKQLIKQAAPGGVKANVVPISKLIEVAKDPRFGNTRALILFETVQDALRAIEGGVEIPELNVGSMAHSTGKTMVNNVLSMDKDDVAAFEKLRDLGVSFDVRKVPNDAKKNLFDLINKANVK

SEQ ID NO: 3417 - DNA, 990 bp, Streptococcus pyogenes
atgggtatcggtattattattgccagccatggtaaatttgctgaaggtattcatcaatctggttctatgatttttggtgaacaagagaaagttcaagttgttactttcatgccaaacgaaggaccagatgatttgtatggacacttcaacaatgctatccaacaatttgatgctgatgatgaaatccttgtgctagctgacctttggagtggttctccatttaaccaagctagtcgtgtggcaggtgaaaatcctgaccgcaaaatggcgatcatcactggtctcaacttgcctatgcttattcaagcttacactgaacgtcttatggatgctggtgcaggtgttgaacaagttgctgcaaacatcattaaggaatctaaggacggtatcaaagcccttcctgaagaccttaacccagttgaagaaactgctgcaactgaaaaagttgttaacgcacttcaaggagctattcctgctggaactgtcatcggagatggtaaattaaagatcaatcttgctcgtgttgacactcgtcttttacacggtcaagttgcaacagcatggactccagcttctaaggctgaccgtatcattgttgcttctgatgaggttgctcaagatgaccttcgcaaacaattgatcaaacaggctgcacctggtggtgtcaaagctaacgttgttccaattagcaaattgattgaagcttctaaagatcctcgttttggtaacacacacgcacttattcttttccaaacccctcaagatgcccttcgagcggttgaaggtggtgttgaaatcaacgaattgaacgttggttcaatggctcactcaactggtaaaacaatggttaacaacgttttatcaatggacaaagaagacgttgctacttttgaaaaattacgcgacctaggtgttacattcgacgtccgtaaagttcctaacgattctaagaaaaacttatttgagcttatccaaaaaactaacattaaa

SEQ ID NO: 3418 - protein, 330 aa, Streptococcus pyogenes
MGIGIIIASHGKFAEGIHQSGSMIFGEQEKVQVVTFMPNEGPDDLYGHFNNAIQQFDADDEILVLADLWSGSPFNQASRVAGENPDRKMAIITGLNLPMLIQAYTERLMDAGAGVEQVAANIIKESKDGIKALPEDLNPVEETAATEKVVNALQGAIPAGTVIGDGKLKINLARVDTRLLHGQVATAWTPASKADRIIVASDEVAQDDLRKQLIKQAAPGGVKANVVPISKLIEASKDPRFGNTHALILFQTPQDALRAVEGGVEINELNVGSMAHSTGKTMVNNVLSMDKEDVATFEKLRDLGVTFDVRKVPNDSKKNLFELIQKTNIK

SEQ ID NO: 3419 - DNA, 810 bp, Streptococcus agalactiae
atgacaaagaaaattatcgccgtagatttagacggtactctattacataataataacactatttctgactacaccgctgatacacttcgaaaagttcaagctcaaggacacaaagtaattattacaaccggacgcccataccgtatggcactcgctcattatttacgcctagatttaaaaacaccaatgataaattttaatggtgctttaactcatatccccgaaaaaaagtgggcgtttgagcgtagtgcaacgattgataaaaaattactccttgaaaccttaaatttatcagatgctatccaagccgattttattgctagcgaataccgtaaaaatttttacattactatggataatcgtgataaaattaacccacaattattcggtgtcaatgaaattactgataaaatggcattagatgttactaaaatcacacgcaatccaaatgctctattgatgcaaacacgtcataaagataagtatgagttagctaaagagttacgacaacattttaatcacgaactagaagtagattcttggggtggtccattgaatatactcgaattttcacctaaaggtgttaacaaagcttatgctctcaaacatttattaaaatcactcaatctttcacaagaaaatttgattgcctttggagatgaacacaatgacaccgagatgctggcctttgcacatacaggatatgctatgaaaaatgctaatccaactctacttccatatgccgaccaacaaatccaatggacaaacgaagaagatggtgttgctaaaactctagaaaaattattattg

SEQ ID NO: 3420 - protein, 270 aa, Streptococcus agalactiae
MTKKIIAVDLDGTLLHNNNTISDYTADTLRKVQAQGHKVIITTGRPYRMALAHYLRLDLKTPMINFNGALTHIPEKKWAFERSATIDKKLLLETLNLSDAIQADFIASEYRKNFYITMDNRDKINPQLFGVNEITDKMALDVTKITRNPNALLMQTRHKDKYELAKELRQHFNHELEVDSWGGPLNILEFSPKGVNKAYALKHLLKSLNLSQENLIAFGDEHNDTEMLAFAHTGYAMKNANPTLLPYADQQIQWTNEEDGVAKTLEKLLL

SEQ ID NO: 3421 - DNA, 810 bp, Streptococcus pyogenes
atgactaaaaaattgattgccattgatttggatggaaccttattacatcatgacaacaccatctctacctatactcaaaaaaccatcaaagctgtccaagacaagggccaccacgtcattatttcaacaggccgtccttaccgcatggcactgggctactatctgcagctcaatttaaagaccccaatcatcacttttaatggggccttgacccacatgcctgaacaaaaatgggcctatgaacataatgtcactttggacaaaggctacctactaaggttactaaaatatcaggatgatttccagatggattttattgccagtgagtatcgaaaaaatgtctacatcaccatgaccaatccagaaagtatcgacccgcaactctttggtgttgatgaaattactcaggacatggcattagagattaccaaaatcactcgaaatccaaacgccttattgatgcaaacgcatcacgaagacaagtatgccttagctaaaaacatgcgtgcttgcttcaaagatgaaattgaaattgattcttggggaggccctctcaacattcttgaaatttcgtctaagaatgtcaataaagcttacgctctgaactatctccttggaatttacaatatggataaaaaggatttaatcgcctttggtgatgaacacaatgacactgagatgctagcttttgctggaactggttatgctatgaaaaatgctagccctgtgctactgccttatgctgatcagcagcttaatttttccaacgaagaagacggtgttgccaaaaaattggaagaacttttcttg

SEQ ID NO: 3422 - protein, 270 aa, Streptococcus pyogenes
MTKKLIAIDLDGTLLHHDNTISTYTQKTIKAVQDKGHHVIISTGRPYRMALGYYLQLNLKTPIITFNGALTHMPEQKWAYEHNVTLDKGYLLRLLKYQDDFQMDFIASEYRKNVYITMTNPESIDPQLFGVDEITQDMALEITKITRNPNALLMQTHHEDKYALAKNMRACFKDEIEIDSWGGPLNILEISSKNVNKAYALNYLLGIYNMDKKDLIAFGDEHNDTEMLAFAGTGYAMKNASPVLLPYADQQLNFSNEEDGVAKKLEELFL

SEQ ID NO: 3423 - DNA, 582 bp, Streptococcus agalactiae
atgaaaaagttaatttggagtcatctttttgccatagtcagtattttagggatatggtattatcatgtaaaaattgatcatttgatggtaattctattggcatcagtcttgtcgttagagatgggattcattgcttattatagtcgtaatatttttattcgtcttttagcaagtttaggtcttttatttttttacccacagagtttagggatttttcttagtttggtgagcttagagtggtcaacaaaagacatttggcagtctaatcactttatgcaatatatggcataccttcttgcaattctttttattatctcttcagctttactaagcttgaagctattggtaaatgcatatgatattagtaaaaggtatcaattagcaactgttatacctgtaatgctttttagtagttttgccttttgcttagaaaaatcaggatcattaggtttagaaggaatcattttaaatccgtcagcattttttaatggaatacagactaatatggctaaccttgattttaaagccttgtcttgcctttttttagtacaattattactttggggaatattaatggaagac

SEQ ID NO: 3424 - protein, 194 aa, Streptococcus agalactiae
MKKLIWSHLFAIVSILGIWYYHVKIDHLMVILLASVLSLEMGFIAYYSRNIFIRLLASLGLLFFYPQSLGIFLSLVSLEWSTKDIWQSNHFMQYMAYLLAILFIISSALLSLKLLVNAYDISKRYQLATVIPVMLFSSFAFCLEKSGSLGLEGIILNPSAFFNGIQTNMANLDFKALSCLFLVQLLLWGILMED

SEQ ID NO: 3425 - DNA, 108 bp, Streptococcus agalactiae
atggggaattattggaattgtatcattagtttcaagttttggtattcatattggtcgttatgcccgtctaaattcatgggatatcttaacgaagccacaagtggtaat

SEQ ID NO: 3426 - protein, 36 aa, Streptococcus agalactiae
MGNYWNCIISFKFWYSYWSLCPSKFMGYLNEATSGN

SEQ ID NO: 3427 - DNA, 621 bp, Streptococcus agalactiae
ttggaggttagaatgaaagtaaaactatttgcgatacatctattttttattgttatttcttttgggattaaatattatcatttgcagggaccaaatttgatttggaatatgactctagccctaatagcgttagattttgcataccttactagtttatttaagaaaaaaattcttatcggtctttttgcacttgcttggttttttttctatcctaataccttttatatgttgacggatatcattcatatgcattttgtcggagacgttctttataataagacaaatttaatactttatatcttgtatgtatctagtatcttgtttggttttttatcaggtatcgaaagtttttctgtgattatgcgtaaatttagaattagcaatatatttttaagatggggaattattggaattgtatcattagtttcaagttttggtattcatattggtcgttatgcccgtctaaattcatgggatatcttaacgaagccacaagtggtaattaacgaacttttagcggttccgagtagggattcattccactttattttaggatttacatttttacaggtattgtgtcttatttttatggattattctgcagggaaaaagcttgaaaag

SEQ ID NO: 3428 - protein, 207 aa, Streptococcus agalactiae
MEVRMKVKLFAIHLFFIVISFGIKYYHLQGPNLIWNMTLALIALDFAYLTSLFKKKILIGLFALAWFFFYPNTFYMLTDIIHMHFVGDVLYNKTNLILYILYVSSILFGFLSGIESFSVIMRKFRISNIFLRWGIIGIVSLVSSFGIHIGRYARLNSWDILTKPQVVINELLAVPSRDSFHFILGFTFLQVLCLIFMDYSAGKKLEK

SEQ ID NO: 3429 - DNA, 678 bp, Streptococcus agalactiae
atgagcgttccaatggtatcaaaaatatcagtcagtgaaaaagcaagaatggccattaatacacttggtagacgtgaaggattagaaaataaagaaattaatcctttctctcctaatgcaactccaaatacttgcttcaaatctctaaaagaggccgagaggttagttgcttcccaattaatagcatctaacttaaccactcccattaaaatacctaagagggtcgttgttaatatcgatagaataatccctccacggataccctttacaataaagaagatggtaatgcttaaaccaatcaaagataataaaatggctggattatcaaacgacactagccctggcgttgctgaagaatttgctgtaatagtagccaatcctttcgcagcaccctttccaacaacatcatacgtcccaggatcaattgaaaatttcaaaaaaccagcatttttaatcccaacgtatgctaaaaaagttccgattcctgctgtaatggctgattttaaagttgttgggatagactcaataatcatctttctaactttcgttaaagtaataatcagagaaatcaaaccacaaataaataccatagctaaggcttcttgccatgtatatcccaatgcaaagacaactgtatatgtaaagaaagcatttaatcccatcccaggagcttgtgca

SEQ ID NO: 3430 - protein, 226 aa, Streptococcus agalactiae
MSVPMVSKISVSEKARMAINTLGRREGLENKEINPFSPNATPNTCFKSLKEAERLVASQLIASNLTTPIKIPKRVVVNIDRIIPPRIPFTIKKMVMLKPIKDNKMAGLSNDTSPGVAEEFAVIVANPFAAPFPTTSYVPGSIENFKKPAFLIPTYAKKVPIPAVMADFKVVGIDSIIIFLTFVKVIIREIKPQINTIAKASCHVYPNAKTTVYVKKAFNPIPGACA

SEQ ID NO: 3431 - DNA, 1419 bp, Streptococcus agalactiae
atggaaaagttttttaagctaaaggaacacgggacgacaattcggactgaaatcactgctggtctaacgactttctttgcaatgtcgtacattttgtttgtaaatccagctattttatctcagactgggatgccagcacaaggagttttcttagcgacgattattggtgccgttgtagctacatctgttatggctttctatgctaaccttccctatgcacaagctcctgggatgggattaaatgctttctttacatatacagttgtctttgcattgggatatacatggcaagaagccttagctatggtatttatttgtggtttgatttctctgattattactttaacgaaagttagaaagatgattattgagtctatcccaacaactttaaaatcagccattacagcaggaatcggaacttttttagcatacgttgggattaaaaatgctggttttttgaaattttcaattgatcctgggacgtatgatgttgttggaaagggtgctgcgaaaggattggctactattacagcaaattcttcagcaacgccagggctagtgtcgtttgataatccagccattttattatctttgattggtttaagcattaccatcttctttattgtaaagggtatccgtggagggattattctatcgatattaacaacgaccctcttaggtattttaatgggagtggttaagttagatgctattaattgggaagcaactaacctctcggcctcttttagagatttgaagcaagtatttggagttgcattaggagagaaaggattaatttctttattttctaatccttcacgtctaccaagtgtattaatggccattcttgctttttcactgactgatatttttgataccattggaacgctcattggtaccggagaaaaagttggtatcttagcaacgactggtgataatcatgaatctaagagtttagacaaagcactctattcagacttaattgggacaacttttggtgctatttgtggaacatctaacgttacaacctatgttgagtcagcagcaggaatcggagctggtggtcgtacaggattgacagccttagtagttgctggtttgtttgctatatctagtttttttagtccactagtatctatcgttccgagtcaagctactgcaccaatattggttattgttggtattatgatgctttcaaatttaaaagatatcaaatgggatgatatgtcagaagctatcccagctttctttacttctctttttatggggtttacttatagcattacttatggtattgcagctggtttcttgacctatacactagctaaagtcatcaaaggacaagcaaaagatattcatgtggtactgtggattttagatatattatttattctaaactttatcagcttggctattttg

SEQ ID NO: 3432 - protein, 473 aa, Streptococcus agalactiae
MEKFFKLKEHGTTIRTEITAGLTTFFAMSYILFVNPAILSQTGMPAQGVFLATIIGAVVATSVMAFYANLPYAQAPGMGLNAFFTYTVVFALGYTWQEALAMVFICGLISLIITLTKVRKMIIESIPTTLKSAITAGIGTFLAYVGIKNAGFLKFSIDPGTYDVVGKGAAKGLATITANSSATPGLVSFDNPAILLSLIGLSITIFFIVKGIRGGIILSILTTTLLGILMGVVKLDAINWEATNLSASFRDLKQVFGVALGEKGLISLFSNPSRLPSVLMAILAFSLTDIFDTIGTLIGTGEKVGILATTGDNHESKSLDKALYSDLIGTTFGAICGTSNVTTYVESAAGIGAGGRTGLTALVVAGLFAISSFFSPLVSIVPSQATAPILVIVGIMMLSNLKDIKWDDMSEAIPAFFTSLFMGFTYSITYGIAAGFLTYTLAKVIKGQAKDIHVVLWILDILFILNFISLAIL

SEQ ID NO: 3433 - DNA, 1458 bp, Streptococcus pyogenes
atggaaaagttttttaagttaagcgaaaatgggacaactgtctcaactgagattatggctggtttaacgaccttttttgccatgtcctatattttgtttgttaacccaagtattttaggtgcagcggggatgccctctaatgctgtctttttggctacgattatcgcagcagccatatcaaccttaattatgggactatttgccaatgtgccttatgcgttggcaccaggaatgggacttaacgcttttttcacttatacagttgtttttgctttaaggttttcatggcaagaagccttggcaatggttttcatttgtggattattcaatatttttattaccgtaaccaagtttcgtaaaagtatcatcaaggcgattccagttagtttacagcatgctattggtgggggaattggtgtctttgtagcttatttaggatttaaaaacgcaaatatcattactttttctatctctgctgaaaatatagtaatggtaaatggtgttgaaccggctaaagcatcggctaaaacatttgcagatggtctattatttgtagacgccaatggtggagttgtacctacgatttctagttttacggattccggtgtattacttgctatttttggtttacttttgacgacagctcttgtgattcgaaattttagaggtgctattttaattggtattgtcgcaacaactcttgtaggtattcctttaggaatagtggatgtgtccaacctcaattttgggatcagccatattggtgaagcttggactgaattaggtacaactttccttgcagctttcgatggtttgagttctctttttagcgattcaagtcgtttaccgctagttttcatgactatttttgcttttagtctatcagatacttttgacacaattggtacctttatcggaactggtcgtcgaacaggtattttctctcaagacgatgagaatgctttggaaaatagtataggctttagttcaaaaatggaccgtgcgctttttgcagatgctatcggtacttctattggggctttggttggaacttcaaatacgactacctatgttgaatcagcagcaggaattgctgaaggtggacgtactggactaacagcagtctccaccgcagtatgcttcttattatcaatattgctattaccgcttgtaggtattgtcccagctgctgctacggctccagctttaattattgtgggtgtcatgatggtgtcttcttttcttgatgttaattggagtaaatttgcagatgctcttccagctttttttgcagctttctttatggcgctgtgttactctatttcctatggtattgccgctgcctttattttctattgtctagtaaaagttgttgagggaaaaacaaaagatattcaccctattatttggggagcaaccttcttgttcattgtaaatttcatcatattaactatctta

SEQ ID NO: 3434 - protein, 486 aa, Streptococcus pyogenes
MEKFFKLSENGTTVSTEIMAGLTTFFAMSYILFVNPSILGAAGMPSNAVFLATIIAAAISTLIMGLFANVPYALAPGMGLNAFFTYTVVFALRFSWQEALAMVFICGLFNIFITVTKFRKSIIKAIPVSLQHAIGGGIGVFVAYLGFKNANIITFSISAENIVMVNGVEPAKASAKTFADGLLFVDANGGVVPTISSFTDSGVLLAIFGLLLTTALVIRNFRGAILIGIVATTLVGIPLGIVDVSNLNFGISHIGEAWTELGTTFLAAFDGLSSLFSDSSRLPLVFMTIFAFSLSDTFDTIGTFIGTGRRTGIFSQDDENALENSIGFSSKMDRALFADAIGTSIGALVGTSNTTTYVESAAGIAEGGRTGLTAVSTAVCFLLSILLLPLVGIVPAAATAPALIIVGVMMVSSFLDVNWSKFADALPAFFAAFFMALCYSISYGIAAAFIFYCLVKVVEGKTKDIHPIIWGATFLFIVNFIILTIL

SEQ ID NO: 3435 - DNA, 519 bp, Streptococcus agalactiae
gtgaagaaatatatgctatggggctgtcagaatcagcaaactgttggaagacagagatatttctggtataatatctctatgttttatactcaaaatgaagaagagcttattgccctagggcaaaaactgggtactgttttaaagtcaggagatatcgtattattgactggtaatttaggtgcaggcaaaacaactcttacaaaaggtattgcaaagggattagacataaaacaaatgattaagagcccaacttacactattgttagagaatatgaagggcgtgtaccactttaccatttggatgtttatcgtattggagatgatcctgattctattgacttagatgacttcttgtttggtcaaggagtaacagttattgaatggggagagttgcttagtgataaccttatcaataactacttagaaattgttattacgaggagcaatcaaggacgtcaggttcagttagaagcttatgggcatcgcgcaagagaaattattgaggcgattcaagatgtc

SEQ ID NO: 3436 - protein, 173 aa, Streptococcus agalactiae
MKKYMLWGCQNQQTVGRQRYFWYNISMFYTQNEEELIALGQKLGTVLKSGDIVLLTGNLGAGKTTLTKGIAKGLDIKQMIKSPTYTIVREYEGRVPLYHLDVYRIGDDPDSIDLDDFLFGQGVTVIEWGELLSDNLINNYLEIVITRSNQGRQVQLEAYGHRAREIIEAIQDV

SEQ ID NO: 3437 - DNA, 459 bp, Streptococcus pyogenes
atgttttatagtgaaaatgaatatactcttaaagcttacggagaaaccctaggtacttatttgtctattggagatgtgattgtattgtctggcgacttaggtgccggtaaaacaacattggcaaaaggtattgctaaagggatggggattagtcaaatgatcaaaagcccaacttatactattgttagagaatatgaaggacgtctacctctttatcacttagatatttaccgtgttggtgatgatccagactctattgatttagatgattttctttttggtaatggtgttaccgttattgagtggggagaattattaggagagggattattacaagactatttgcaaattaccattactaaacgagacaaaggtcgtcaactagacttgttagcgcatggtgagcgctctcgtcagcttctggagataatgtcacatggttcagcaaagtctcgttat

SEQ ID NO: 3438 - protein, 153 aa, Streptococcus pyogenes
MFYSENEYTLKAYGETLGTYLSIGDVIVLSGDLGAGKTTLAKGIAKGMGISQMIKSPTYTIVREYEGRLPLYHLDIYRVGDDPDSIDLDDFLFGNGVTVIEWGELLGEGLLQDYLQITITKRDKGRQLDLLAHGERSRQLLEIMSHGSAKSRY

SEQ ID NO: 3439 - DNA, 558 bp, Streptococcus agalactiae
atgggcatcgcgcaagagaaattattgaggcgattcaagatgtctaaacaatttgctgttgattttatagaagcttcgagagaggaagcatctgcgatccttgaatttttaaatactgttactgaggaaacagattttattttgcatacggtgagcaatcaactatctttgtcagaaatggaaacgtttattgaaaataccttaatgacgaaaaattgcatttgtttgattgctaaattaaaaaataaagtgatcggcttgataacaatcattagtcagtctgatattgaaattgaacacgttggggatctttttattgccgttcagaaggattattggggatatggtattggtcatattctcatggaagaagcaatagaatgggcgtcagataacgatattacacgccgcttagaactatcagtccaaggacgtaatgaacgtgctattcacctctaccaaaaattcggttttgaaatagatgggcttcaaacaagaggtattaaaagagaaaatggagaatttctagacatttacagaatgagtaagttgatagat

SEQ ID NO: 3440 - protein, 186 aa, Streptococcus agalactiae
MGIAQEKLLRRFKMSKQFAVDFIEASREEASAILEFLNTVTEETDFILHTVSNQLSLSEMETFIENTLMTKNCICLIAKLKNKVIGLITIISQSDIEIEHVGDLFIAVQKDYWGYGIGHILMEEAIEWASDNDITRRLELSVQGRNERAIHLYQKFGFEIDGLQTRGIKRENGEFLDIYRMSKLID

SEQ ID NO: 3441 - DNA, 1305 bp, Streptococcus agalactiae
atgaaaatttggaaaaaaataaccttaatgttttctgcaattattttaacaacagtaattgcattgggagtctatgttgcctcagcttataatttttcgactaatgaattgtctaagacttttaaagattttaagctagctaaatcaaaaagtcatgctattgaagaaacaaagccgttttcaatactattaatgggggtggacacaggttcagagcatcgaaaatctaagtggtcaggaaatagcgattctatgatcttagtcactataaatcctaaaactaataaaacaacgatgacaagcttagaacgtgacgtattgattaaattgagtggtcccaaaaataatggacagactggagtagaagcaaagctaaatgcagcctatgcttctggtggtgcggaaatggcattgatgactgttcaagacttattagatattaatgttgattactttatgcaaattaatatgcaaggattagttgatttagtcaatgctgttggtggtataacagtaactaataaatttgactttccaatatcaattgctgccaatgaaccagagtacaaggctgttgttgaaccagggacacataaaataaatggagaacaagcacttgtttattctcgtatgcgctatgatgatccagagggagattatgggcgtcaaaaaagacaacgtgaagtaattcaaaaagtccttaaaaaaatattggcgttaaatagtattagttcatacaaaaaaattctttccgcagtaagtaataacatgcaaactaatattgagatatcatcaaaaacgattcctaatttgttagcttataaagattcattggaacatattaaatcttatcagttgaagggtgaagacgctactttatcagatggtggctcttatcaaattttaactaagaaacatctacttgcagttcaaaatagaattaagaaagaactggataaaaagcgtagtaaaactctgaagacaagcgcgattctatatgaagattactatggtactactgctagtaatgattcttctacttattcatcaacacaagagaataattataatacaacaccttattcagaagcaccaccaagttacagtggtaatactacttatagttctgagactaatcaaacaactcatcaaaattactataatagtagcactcctgctagtaactatagcagtaacactaacacaggtcaggctgattcaagtggaagtgtcaataatcataacggggctgcaacgcctaatccaaacacaggaacgcaaccagtaccaggtcaaactaatcca

SEQ ID NO: 3442 - protein, 435 aa, Streptococcus agalactiae
MKIWKKITLMFSAIILTTVIALGVYVASAYNFSTNELSKTFKDFKLAKSKSHAIEETKPFSILLMGVDTGSEHRKSKWSGNSDSMILVTINPKTNKTTMTSLERDVLIKLSGPKNNGQTGVEAKLNAAYASGGAEMALMTVQDLLDINVDYFMQINMQGLVDLVNAVGGITVTNKFDFPISIAANEPEYKAVVEPGTHKINGEQALVYSRMRYDDPEGDYGRQKRQREVIQKVLKKILALNSISSYKKILSAVSNNMQTNIEISSKTIPNLLAYKDSLEHIKSYQLKGEDATLSDGGSYQILTKKHLLAVQNRIKKELDKKRSKTLKTSAILYEDYYGTTASNDSSTYSSTQENNYNTTPYSEAPPSYSGNTTYSSETNQTTHQNYYNSSTPASNYSSNTNTGQADSSGSVNNHNGAATPNPNTGTQPVPGQTNP

SEQ ID NO: 3443 - DNA, 294 bp, Streptococcus agalactiae
atgaaaataggtcgtttaattgcactaggtttagttagtttaggagcgcttgaactttacaaaaatagaaaaactatcaaggattcctatcaaaatacaaaaaatgagacagattcagctaaattaaaattagaacgtatcaaaaatgatcttgctattattagtcaggaaaaagaaaaaatcagattaatttctcaagaactcaatcataaattccaagtgtttaataaagatattcaacctcgtttagaagaaattaatcaacgcatggctaaatatcaagagaaagacgaa

SEQ ID NO: 3444 - protein, 98 aa, Streptococcus agalactiae
MKIGRLIALGLVSLGALELYKNRKTIKDSYQNTKNETDSAKLKLERIKNDLAIISQEKEKIRLISQELNHKFQVFNKDIQPRLEEINQRMAKYQEKDE

SEQ ID NO: 3445 - DNA, 354 bp, Streptococcus pyogenes
atgaaagttaaaaccgtgatagccgtcggattattatcttttaccgcttacaaagcatatcaaaaacgttgtaccataaaagagctgttatccatcagtagacaagcaaaagatgctgcccaacttgatttagataacattaaagcaaaccttgacctcattcacagtcaaggaaaagtaattcaaaatattagtcaggacttggcccataaatggcgctactttaaccaagagacacaagcacacctcactgaaatccaaaatcgtatggccaaatatcaagaagatagtgagctaatttctagtgaatcacctacttgccaaaccgtcattttaactaacaaccattccaga

SEQ ID NO: 3446 - protein, 118 aa, Streptococcus pyogenes
MKVKTVIAVGLLSFTAYKAYQKRCTIKELLSISRQAKDAAQLDLDNIKANLDLIHSQGKVIQNISQDLAHKWRYFNQETQAHLTEIQNRMAKYQEDSELISSESPTCQTVILTNNHSR

SEQ ID NO: 3447 - DNA, 417 bp, Streptococcus agalactiae
atggataattgtattttttgtaaaatcatcagtggagaaatcccttcatcaaaagtttatgaagatgatgaagtattagcttttctcgacattacacaaactacgaccgggcacacccttcttattcctaaaaaacatgttcgaaatgtgttagagatggatgaaaaaactgcacagataacctttgaacgcttgcctaaagtggcgcgtgctgtccaagctgctacaaaagccaaaggaatgaatattattaacaacaatgaggaaattgctggacaaactgtttttcatgcacacgtccaccttgttccccgctttgatgaatcagacggtatcaaaattcactacactactcatgaacccgactttgaggcacttgcaaaattagccaaagaaattagaaaagagattcaatta

SEQ ID NO: 3448 - protein, 139 aa, Streptococcus agalactiae
MDNCIFCKIISGEIPSSKVYEDDEVLAFLDITQTTTGHTLLIPKKHVRNVLEMDEKTAQITFERLPKVARAVQAATKAKGMNIINNNEEIAGQTVFHAHVHLVPRFDESDGIKIHYTTHEPDFEALAKLAKEIRKEIQL

SEQ ID NO: 3449 - DNA, 417 bp, Streptococcus pyogenes
atggaaaattgtattttttgcagcatcattcaaggggatatcccctcttcgaaagtctacgaagatgagcaggtcctcgcctttttagatatctcacaaactacaaaagggcatactctagtcattcctaagcaacatgttcgtaacttactagagatgactgctgagacagctagtcatctctttgctcgtattcctaaaattgctcgtgctatccagtcagctactggcgctactgccatgaatatcattaacaataacgaagccttagcgggacaaactgttttccatgctcatgttcatctcgttcctcgttataatgaagaagacggtatctcaattcaatacaccactcatgagcctgactttcctgtcttggaaaagctcgcccgacaaatcaatcaggaggttagttca

SEQ ID NO: 3450 - protein, 139 aa, Streptococcus pyogenes
MENCIFCSIIQGDIPSSKVYEDEQVLAFLDISQTTKGHTLVIPKQHVRNLLEMTAETASHLFARIPKIARAIQSATGATAMNIINNNEALAGQTVFHAHVHLVPRYNEEDGISIQYTTHEPDFPVLEKLARQINQEVSS

SEQ ID NO: 3451 - DNA, 537 bp, Streptococcus agalactiae
atgataattgagatttatcatagaaggaaaactattttgaaattaaataaaataatattatctactgcagctcttactgctctctttttaggatataatagcgttactgcggatacatataataactatcagccacatagatcaaataatatggatttaactgaggaatataactataataaccagatagaacttcaggagcgtataaaaaaactaaatataccttttaaagaaaaacttgccttacttagaaaggttaaatcaagacaagattcttatgtattagacacattaagaaaagaagttgaaaataaaaacagtgagtattcagaactagagcaagaatatcaaagaatttcagctcttattgatgctaagtttccgcaagggaaatctagtttagcagaaaaattacataaagaactaatttgggacttggatggtgttaaatatgatgagggtatttctaagagaactgctctaaaaaaattagaaggtaaaatcaacgaatatactaaaaaatacagttatttattc

SEQ ID NO: 3452 - protein, 179 aa, Streptococcus agalactiae
MIIEIYHRRKTILKLNKIILSTAALTALFLGYNSVTADTYNNYQPHRSNNMDLTEEYNYNNQIELQERIKKLNIPFKEKLALLRKVKSRQDSYVLDTLRKEVENKNSEYSELEQEYQRISALIDAKFPQGKSSLAEKLHKELIWDLDGVKYDEGISKRTALKKLEGKINEYTKKYSYLF

SEQ ID NO: 3453 - DNA, 729 bp, Streptococcus agalactiae
atgacaatgttaaaaattgaaaatgttacaggggggtatgttaatatcccagttttaaaaaatatttcttttgaagtaaatgatggagagttagttggattaattgggcttaatggtgcaggaaaatcaaccactattaacgagattattggtattttgagaccctatcaaggagatattacaattgatggtattagtcttgaagccgaccaagaactttatagaaagaaaataggctttattcctgagacaccaagtctctatgaggagctaactctcagggaacatttagaaacggtagctatggcgtatgatattgccaccgatgaagttatggcacgtgcgcaaaaactattagagatgtttcgtctaacagataaattagactggtttccaatgcatttttcaaagggaatgaaacaaaaggttatgattatttgtgcttttgttgtatctccaagtttatttattgttgatgaaccatttttaggtttggatccactagctatttcagatttgattaatcttctagcagaagaaaaagctaaagggaaatctattttgatgtcaacacacgtattagattctgccgaaaaaatgtgtgatcgttttgttattttacataaaggagaaatacgggcagttggaaccctagaggaattacgggctatttttggagacagtaatgctaatttaaatgacatctacatagctctgacaaaagaggtg

SEQ ID NO: 3454 - protein, 243 aa, Streptococcus agalactiae
MTMLKIENVTGGYVNIPVLKNISFEVNDGELVGLIGLNGAGKSTTINEIIGILRPYQGDITIDGISLEADQELYRKKIGFIPETPSLYEELTLREHLETVAMAYDIATDEVMARAQKLLEMFRLTDKLDWFPMHFSKGMKQKVMIICAFVVSPSLFIVDEPFLGLDPLAISDLINLLAEEKAKGKSILMSTHVLDSAEKMCDRFVILHKGEIRAVGTLEELRAIFGDSNANLNDIYIALTKEV

SEQ ID NO: 3455 - DNA, 723 bp, Streptococcus pyogenes
atgttaaacattaaaaatctaacaggaggatatcacaatatccctgttttaaacgatgtctcattttctgtagacaatggagagttagtcggtttgatcgggctaaatggtgctggaaagtcaacaactatcaacgaaattattggctttttgaagccttatcaaggaagtatttctattgatggtttaactctagcagaaaatgcagttgcctaccgtcaaaaaataggttttatcccagaaactcctagtctctatgaagaattgaccttatcagagcatatcaacaccgtagctatggcttatgatatcgacttagaagtggcacaaaaacgagcacaacctttcttggaaatgtttcgtttaactgacaaacttgaatggtttcctgtcaatttttctaaagggatgaaacaaaaagtcatgattatttgtgcctttgtcattgatccaagtctatttattcttgatgaaccattcttagggttagaccctttagctatttcagacttaatccaaacgctagaagtcgaaaaagcaaaaggaaaatctattttgatgagtacacatgttttggactctgctgaaagaatgtgtgatcgttttgtgattttgcatcatggacaagttcgtgcccaaggaactcttgctgacttgcaagaagcttttggtgaccgttcagcgagcttaaatgatatctatcttgcattaacaaaagaggat

SEQ ID NO: 3456 - protein, 241 aa, Streptococcus pyogenes
MLNIKNLTGGYHNIPVLNDVSFSVDNGELVGLIGLNGAGKSTTINEIIGFLKPYQGSISIDGLTLAENAVAYRQKIGFIPETPSLYEELTLSEHINTVAMAYDIDLEVAQKRAQPFLEMFRLTDKLEWFPVNFSKGMKQKVMIICAFVIDPSLFILDEPFLGLDPLAISDLIQTLEVEKAKGKSILMSTHVLDSAERMCDRFVILHHGQVRAQGTLADLQEAFGDRSASLNDIYLALTKED

SEQ ID NO: 3457 - DNA, 147 bp, Streptococcus agalactiae
ttggttggttattcaaaccttatttttagtattaatatcaccaattttgataaagttaggcttgtcagtttttatgattacattgttaatttttggtctaggaataatcaaatggttggtaataacttacaaggtaaaggtctttta

SEQ ID NO: 3458 - protein, 49 aa, Streptococcus agalactiae
MVGYSNLIFSINITNFDKVRLVSFYDYIVNFWSRNNQMVGNNLQGKGLL

SEQ ID NO: 3459 - DNA, 1032 bp, Streptococcus agalactiae
atgaaaaagttatttaataaacgtcgaagtctctttttaactcaaaatagtaaatatttgagatacgtctttaacgatcattttgtattagtattaatgtttttgtcaggttttttgttatatcagtatagccagttactaaaagactttccaaaaacacattggccaattatcgtgattgtgtcaatcattatcttaatgttactagcgatggggggaatagccagctatttagaaccggctgataaacaatttttacttataaaagaagaagcaataaaggaaattataaattctgctaaaaaacggacttatatcttttggttggttattcaaaccttatttttagtattaatatcaccaattttgataaagttaggcttgtcagtttttatgattacattgttaatttttggtctaggaataatcaaatggttggtaataacttacaaggtaaaggtcttttataacaatcaaaatttgaactgggatgcagctataaatcatgagcaggaaagaaaacagagtatattaaaatttttctctttgtttacaaatgttaaaggaatttcgacaagtgtaaaacgtcgttcatttttagatggtattttaaaacttatttctaaaacgccatcgcgtttatggactaacttatttgtgagggcatttctaagaagctcagattatcttggtttaacaataaggttggtaactttaaatatcttatcagtcatctttgttaacgaaacctacctcgcccttgctctggcatttgtatttaactacttattattgttccaactattagctttaggtcaccattttgattatcaatacatgaatcagctctatccagttagattaaatgctaaagcaagtcagctaaaaggttttctcagagtattatcatatgctgtgacagtaattgatagcatacttataagagaattgaaacctgttatattattgatagttttgatgttaattgtgacggaatattacatcccttacaaaataaagaagatgattgac

SEQ ID NO: 3460 - protein, 344 aa, Streptococcus agalactiae
MKKLFNKRRSLFLTQNSKYLRYVFNDHFVLVLMFLSGFLLYQYSQLLKDFPKTHWPIIVIVSIIILMLLAMGGIASYLEPADKQFLLIKEEAIKEIINSAKKRTYIFWLVIQTLFLVLISPILIKLGLSVFMITLLIFGLGIIKWLVITYKVKVFYNNQNLNWDAAINHEQERKQSILKFFSLFTNVKGISTSVKRRSFLDGILKLISKTPSRLWTNLFVRAFLRSSDYLGLTIRLVTLNILSVIFVNETYLALALAFVFNYLLLFQLLALGHHFDYQYMNQLYPVRLNAKASQLKGFLRVLSYAVTVIDSILIRELKPVILLIVLMLIVTEYYIPYKIKKMID

SEQ ID NO: 3461 - DNA, 1032 bp, Streptococcus pyogenes
atgaaagcattatttctgaaacgccgtcaagactttcaaaaacaacaaaacaaataccttcgttacgtcttaaatgatcactttgttttggtgttgatgtttttattaggctttgctatggtgcagtatggtcagctactaaaccattttccaacgaatcatctacctattcaggtttgccttgggatattgatcccattattgctcagtatgggatctatagcaacgtatctagaagaggcagatcagcatttcttacttccaaaagaagaagaagtgatttcttatatcaaacaagctgagcgactctcttttttgctttggggaactttgcagactgctgtattgctctttttatatcctatttttagacgtttaggtctgtctttatttatttttattatcttagttttgatattattggcactaaaaagagtagtgcttagtcgaaagacaagatattttttgagaggaaatcgtttagattgggcaaaagctgtcgcatttgaaagcaatcgcaagcaaagtattttaaagttttattctctttttacaacagtcaaaggaatttctacaaaagtgaaagaaagaacttatctaaatcctcttttaaaattagttaagcaaactccttcaaacctttggctgtccctttatgctagagcctttttacgtagttcagattatttgggcttatttttacgactaatgctattaagctcattatctgtattttttatccataatctttatttgtcagtaagtttagcactcatttttaactatttagttgtattccaattactttccctttattatcactacgattaccattatatgactagtctttatcctgaaaatagtcggagcaagaagaaaaatatgttaagttttttacgaggtttaagctttttaatgttaatcgtcaatatgctgtgttgctcatcagcgccaaaagcactcattttgattgtaggtatggttttcatagcttgtatatatctaccttataagttaaagaagatcattgac

SEQ ID NO: 3462 - protein, 344 aa, Streptococcus pyogenes
MKALFLKRRQDFQKQQNKYLRYVLNDHFVLVLMFLLGFAMVQYGQLLNHFPTNHLPIQVCLGILIPLLLSMGSIATYLEEADQHFLLPKEEEVISYIKQAERLSFLLWGTLQTAVLLFLYPIFRRLGLSLFIFIILVLILLALKRVVLSRKTRYFLRGNRLDWAKAVAFESNRKQSILKFYSLFTTVKGISTKVKERTYLNPLLKLVKQTPSNLWLSLYARAFLRSSDYLGLFLRLMLLSSLSVFFIHNLYLSVSLALIFNYLVVFQLLSLYYHYDYHYMTSLYPENSRSKKKNMLSFLRGLSFLMLIVNMLCCSSAPKALILIVGMVFIACIYLPYKLKKIID

SEQ ID NO: 3463 - DNA, 798 bp, Streptococcus agalactiae
gtgacaatatcaaatcaagaattgacgcttactcccttaagaggaaaaagtggcaaagcctatattggtacttatccaaatggtgaacgtgtctttgtcaaatataatacgacacctattttgccagccttagctaaggaacagattgcgccacaactactgtgggcacgccgtacaagtaatggcgatatgatgagtgctcaagaatggttagatggtcgaacattgactaaagaagatatgggtagtaaacagattattcatattttattgcgcctgcacaagtctcgtcccttagtaaatcagctgttacaattagggtataaaattgaaaacccttatgatttgttgatggattgggaaaaacaaactcctattcaaatccgggaaaacacttatttgcaatctattgtgactgagttaaagcgtagtttacctgagtttcgaacagaggttgcaacaatcgttcacggagatatcaaacatagcaactgggttattacaacaagtggtttaatttatttggttgattgggattctgttcgtttaacagatcgcatgtatgacgttgcatatattttaagtcattatattccacaaaaacactggaaagattggctgtcttactacggttataaagataatgagaaagtctggagcaaaattatctggtatgggcaattttcatatttatcacagataatcaaatgttttgataaacgagatatggagcatgtcaatcaagaaatttatgaattacgaaagtttagagagttaattaaaaagcataatgcgagt

SEQ ID NO: 3464 - protein, 266 aa, Streptococcus agalactiae
MTISNQELTLTPLRGKSGKAYIGTYPNGERVFVKYNTTPILPALAKEQIAPQLLWARRTSNGDMMSAQEWLDGRTLTKEDMGSKQIIHILLRLHKSRPLVNQLLQLGYKIENPYDLLMDWEKQTPIQIRENTYLQSIVTELKRSLPEFRTEVATIVHGDIKHSNWVITTSGLIYLVDWDSVRLTDRMYDVAYILSHYIPQKHWKDWLSYYGYKDNEKVWSKIIWYGQFSYLSQIIKCFDKRDMEHVNQEIYELRKFRELIKKHNAS

SEQ ID NO: 3465 - DNA, 789 bp, Streptococcus pyogenes
gtgacaacgacggaacaagaacttaccttgactcccttacgtgggaaaagtggcaaagcttataaaggcacttatccaaatggggaatgtgtctttataaaattaaatacgacccctattctacctgccttagcaaaagaacagattgcgccacagttactttgggccaaacgcatgggcaatggtgatatgatgagtgcccaagaatggcttaacggccgtacattgaccaaagaagatatgaacagtaagcaaatcattcatattctattgcgccttcacaaatctaaaaaattagtcaatcaactgcttcagctcaattataagattgaaaacccatacgatttattggttgattttgagcaaaatgcacccttgcaaattcagcaaaattcatacttacaagctatcgttaaagaattaaaacggagcttaccagagttcaaatcagaagtagcaacgattgtgcatggagatattaaacatagcaattgggtgattactactagtggtatgatttttttagtagattgggattctgttcgtctaactgatcggatgtatgatgttgcttacctgttgagccactatattccacggtctcgttggtcagaatggctgtcttattatggctataaaaataatgacaaggttatgcaaaaaattatttggtatggtcaattttctcacctgacacaaattctcaagtgttttgacaagcgtgacatggagcatgtgaatcaggagatttatgccctcagaaaatttagagaaatatttagaaagaaa

SEQ ID NO: 3466 - protein, 263 aa, Streptococcus pyogenes
VTTTEQELTLTPLRGKSGKAYKGTYPNGECVFIKLNTTPILPALAKEQIAPQLLWAKRMGNGDMMSAQEWLNGRTLTKEDMNSKQIIHILLRLHKSKKLVNQLLQLNYKIENPYDLLVDFEQNAPLQIQQNSYLQAIVKELKRSLPEFKSEVATIVHGDIKHSNWVITTSGMIFLVDWDSVRLTDRMYDVAYLLSHYIPRSRWSEWLSYYGYKNNDKVMQKIIWYGQFSHLTQILKCFDKRDMEHVNQEIYALRKFREIFRKK

SEQ ID NO: 3467 - DNA, 633 bp, Streptococcus agalactiae
atgcgagttagaaaacgtaagggtgcagaggaacacttagaaaataatcctcactatgttatttcaaatccagaagaagccaaagggcgttggcatgagatttttggaaataataaccccattcacatagaagttggttccggaaaaggggcttttatcactggtatggcagagcaaaatccagatatcaattatattggaattgatattcaattgtcagtgctttcctatgctttggataaagttctagatagcggtgctaagaatatcaaattactattagttgatggttctagtctatcaaactactttgatactggcgaagttgatttgatgtatcttaactttagtgatccatggcctaagaaaaagcatgagaaacgtcgattgacctataagactttcttggatacctataaagacatacttcctgagcagggggaaattcattttaaaacagataatagaggtttatttgaatatagccttgctagcttttctcaatacggtatgactttaaaacaagtttggttagatttacatgcaagtgattaccagcaaaatatcatgactgagtacgaacgcaaattttcaaataaaggacaggttatctatcgtgtagaagcacgattt

SEQ ID NO: 3468 - protein, 211 aa, Streptococcus agalactiae
MRVRKRKGAEEHLENNPHYVISNPEEAKGRWHEIFGNNNPIHIEVGSGKGAFITGMAEQNPDINYIGIDIQLSVLSYALDKVLDSGAKNIKLLLVDGSSLSNYFDTGEVDLMYLNFSDPWPKKKHEKRRLTYKTFLDTYKDILPEQGEIHFKTDNRGLFEYSLASFSQYGMTLKQVWLDLHASDYQQNIMTEYERKFSNKGQVIYRVEARF

SEQ ID NO: 3469 - DNA, 633 bp, Streptococcus pyogenes
atgcgagttagaaaacgaaaaggtgctgaggagcacttagctaataacccacactatgtgatattaaatccagaagatgccaagggccgttggcatgacgtttttggaaatgaccgtcctattcatatcgaagttggttcaggaaagggcggatttatcacagggatggccttgaaaaatcctgatattaactacattggcattgatattcaattatctgtcctaagctacgccttggataaggtattagcttcagaagtacccaatgtcaaacttctgcgagtggatggatcaagtttaaccaactattttgaagatggtgaggtggatatgatgtacctcaacttttcagatccttggccaaaaaccaagcatgaaaaacgtcgtttgacctacaaggatttcttagacacttacaagcgtatcttgccagaacacggtgaaattcattttaaaaccgataatcggggcttgtttgagtacagtttagctagtttttctcaatacggcatgaccttgagacagatctggcttgacttacacgctagtaactatgaaggaaatgtcatgacagaatatgaagagaagttctctaataaaggtcaagtcatttaccgagttgaggcaaatttc

SEQ ID NO: 3470 - protein, 211 aa, Streptococcus pyogenes
MRVRKRKGAEEHLANNPHYVILNPEDAKGRWHDVFGNDRPIHIEVGSGKGGFITGMALKNPDINYIGIDIQLSVLSYALDKVLASEVPNVKLLRVDGSSLTNYFEDGEVDMMYLNFSDPWPKTKHEKRRLTYKDFLDTYKRILPEHGEIHFKTDNRGLFEYSLASFSQYGMTLRQIWLDLHASNYEGNVMTEYEEKFSNKGQVIYRVEANF

SEQ ID NO: 3471 - DNA, 381 bp, Streptococcus agalactiae
atgggtggcgactatgtgctcagtattttaattgataaacccggaggcattacggttgaagatacagcacaattgacagacgttgtaagtcccttacttgacacaattcaaccagatccatttccagaacagtatatgcttgaagtctcaagtcctgggttggaaagaccacttaaaacagcagaagcattatcaaatgctgttgggtcttatatcaatgtaagtctgtataaatccattgataaagttaaaatatttgaaggtgacttattatcatttgatggtgaaaccttgacaattgattatatggacaaaacacgtcataaaactgtagatattccctatcagacggttgcaaaagcccgtcttgcggttaaactt

SEQ ID NO: 3472 - protein, 127 aa, Streptococcus agalactiae
MGGDYVLSILIDKPGGITVEDTAQLTDVVSPLLDTIQPDPFPEQYMLEVSSPGLERPLKTAEALSNAVGSYINVSLYKSIDKVKIFEGDLLSFDGETLTIDYMDKTRHKTVDIPYQTVAKARLAVKL

SEQ ID NO: 3473 - DNA, 534 bp, Streptococcus pyogenes
gtggattcccaaggaccaattatcttagagaagagcataaaaatagaggaggtaatcaaaatagcaaatacatctattatcgatatcgtaaccaagacagtaacgcctgagattaaggcaccttatgaattagtagacgttgagtatgacaaaatgggtagtgactacatccttagtattttagtcgataaggaaggtggaatcacagtggaagatacatctgacttgacgaatattattagtccgctgttagatacgattgatccagatccttttccaaaccaatatatgctagaagtctctagtccaggtttggagcgtccgctcaagacagctgacagtttaaaagcagcagttggctcttatatcaatgtgagtctttatcaagctattgataaggtgaaagtttttcaaggagacttattagcctttgatggtgaaacgttgaccattgattatcttgataaaacacgtcataagatcgtgaatataccatatcaagcagttgctaaggtgagaatggctgtcaaatta

SEQ ID NO: 3474 - protein, 178 aa, Streptococcus pyogenes
VDSQGPIILEKSIKIEEVIKIANTSIIDIVTKTVTPEIKAPYELVDVEYDKMGSDYILSILVDKEGGITVEDTSDLTNIISPLLDTIDPDPFPNQYMLEVSSPGLERPLKTADSLKAAVGSYINVSLYQAIDKVKVFQGDLLAFDGETLTIDYLDKTRHKIVNIPYQAVAKVRMAVKL

SEQ ID NO: 3475 - DNA, 1158 bp, Streptococcus agalactiae
atggacactatgagcaaagaaatgctagaagccttccgtattttggaagaagaaaaacacattaataaagaagatattattgatgcagttactgagtcactaaaatctgcctataagcgtcgttatggtcaatcagaatcatgcgttattgaatttaacgagaagaaagcagactttaccgtctatactgttcgtgaagttgttgatgaagtttttgatagccgtttggaaattagcctaaaagatgcccttgctattagctcagcgtatgaacttggtgataagattcgctttgaggaatctgttacagaatttggacgcgtggcagctcagtcagcaaaacaaactattatggaaaaaatgcgtcgtcaaatgcgtgaagtaaccttcaatgaatacaaacaacacgaaggtgaaattatgactggtactgttgaacgatttgaccaacgttttatttatgtcaatctcggttcacttgaggcgcaattatcgcatcaagatcagattcctggagagagctttaaatctcatgatatgattgatgtttatgtctataaagtggagaataatcctaaaggagtcaacgtttttgttagccgtagtcatccagagtttatcaaacgcattatggagcgagaaattccagaagtatttgatggaactgttgagattatgagcgtctctcgtgaggctggagatcgtactaaagttgctgtacgcagtcataattcaaacgttgatgcgattggaacaattgttggacgcggtggaagtaacattaaaaaagttatcagtaatttccatcctaaacgcgttgatgctaaaacaggattggagatcccggttgaagaaaacattgatgttattcaatgggttgaagatccagcggaattcatttacaatgctattgcaccagccgaagttgatatggtactttttgatgatgaagatacaaaacgtgctactgtagttgttccagatagcaagttatcgctagctattggtcgccgaggacaaaatgtgcgtttagcagctcatttgactggctatcgtattgatattaaatctgcaagtgaatacgaaaaaatggaagcgcaagaacttcaaactgaggaagtagctcaagaatctgaagttatttcagataaggcagaa

SEQ ID NO: 3476 - protein, 386 aa, Streptococcus agalactiae
MDTMSKEMLEAFRILEEEKHINKEDIIDAVTESLKSAYKRRYGQSESCVIEFNEKKADFTVYTVREVVDEVFDSRLEISLKDALAISSAYELGDKIRFEESVTEFGRVAAQSAKQTIMEKMRRQMREVTFNEYKQHEGEIMTGTVERFDQRFIYVNLGSLEAQLSHQDQIPGESFKSHDMIDVYVYKVENNPKGVNVFVSRSHPEFIKRIMEREIPEVFDGTVEIMSVSREAGDRTKVAVRSHNSNVDAIGTIVGRGGSNIKKVISNFHPKRVDAKTGLEIPVEENIDVIQWVEDPAEFIYNAIAPAEVDMVLFDDEDTKRATVVVPDSKLSLAIGRRGQNVRLAAHLTGYRIDIKSASEYEKMEAQELQTEEVAQESEVISDKAE

SEQ ID NO: 3477 - DNA, 1188 bp, Streptococcus pyogenes
ttgccaagctttacaagcaaggtagataacattatgagcaaagaaatgctagaagccttccgtattttggaagaagaaaaacacattgataaagcagatattattgacgcagtgacagaatcattaaagtctgcctataaacgtcgctatggtcaatcagaatcatgtgttattgaatttaatgaaaaaacagctgattttcaagtatttacggttcgtgaggttgttgaagaagtttttgacagccggcttgagattagtttgaaagatgctcttgctatcagttctgcctatgaattgggtgataagattcgctttgaagaatctgtcaatgaatttggacgtgtcgcagctcaatcagctaaacagactattatggaaaagatgcgccgccaaatgcgtgaagtgatgttcaatgaatacaaagagcatgaaggtgaaattatgacaggaacagttgaacggtttgatcaacgttttatttatgtcaatcttggttccttagaagcacaattgtctcaccaagaccagattccaggtgaaactttcaaatcacatgaccgtattgacgtttatgtctacaaagttgaaaataatcctaaaggagttaacgtctttgttagtcgtagccatccagaattcatcaaacgtattatggagcaagaaattcctgaagtctttgatggtactgttgaaatcatgagtgtttctcgtgaagcaggtgaccgcaccaaggttgctgtgcgcagtcataatcctaacgttgatgccatcggaacaattgttggacgtggtggaagtaatattaaaaaggtcatcagcaagttccatccaaaacgtgtagatgctaagacggggcttgaaattccagttgaagaaaatattgacgtgattcaatgggtagatgatccagctgagttcatctacaatgccattgctccggctgaagtagacatggtactttttgacgatgaagatcttaaacgtgctacggtagtagttcctgatagcaaattatcattagctatcgggcgtcgcggccaaaatgttcgtttagcggcacatttgactggctaccgtattgatatcaaatcagctagcgaatatgatcgtcttgaggcggaaaaagaagcagcaacagctgtggaagagccagttgttgacgatgttatgactgccgaggaagta

SEQ ID NO: 3478 - protein, 396 aa, Streptococcus pyogenes
LPSFTSKVDNIMSKEMLEAFRILEEEKHIDKADIIDAVTESLKSAYKRRYGQSESCVIEFNEKTADFQVFTVREVVEEVFDSRLEISLKDALAISSAYELGDKIRFEESVNEFGRVAAQSAKQTIMEKMRRQMREVMFNEYKEHEGEIMTGTVERFDQRFIYVNLGSLEAQLSHQDQIPGETFKSHDRIDVYVYKVENNPKGVNVFVSRSHPEFIKRIMEQEIPEVFDGTVEIMSVSREAGDRTKVAVRSHNPNVDAIGTIVGRGGSNIKKVISKFHPKRVDAKTGLEIPVEENIDVIQWVDDPAEFIYNAIAPAEVDMVLFDDEDLKRATVVVPDSKLSLAIGRRGQNVRLAAHLTGYRIDIKSASEYDRLEAEKEAATAVEEPVVDDVMTAEEV

SEQ ID NO: 3479 - DNA, 294 bp, Streptococcus agalactiae
atggctaaaacaaaaaaaatacctttaagaaaatcagttgtttctggtgaagtgatcgataagcgagatcttttacgaattgttaaaaataaagaaggacaggtttttatagatcctaccggaaagcaaaatggtcgaggtgcctacataaaattggacaatgatgaagctatcctagcgaaaaagaaacgagtgtttgatcgcagtttttcgatggaagtttctgatgaattctatgatgaactattggcatatgtcgaccataaggtcaaaagaagagagttaggccttgaa

SEQ ID NO: 3480 - protein, 98 aa, Streptococcus agalactiae
MAKTKKIPLRKSVVSGEVIDKRDLLRIVKNKEGQVFIDPTGKQNGRGAYIKLDNDEAILAKKKRVFDRSFSMEVSDEFYDELLAYVDHKVKRRELGLE

SEQ ID NO: 3481 - DNA, 297 bp, Streptococcus pyogenes
ttgatgtctaaagtcaaaaaaatacctttacgaaaatcacttgtttctggtgaaattattgctaaacgagatcttcttaggattgtaaaaactaaggatggtcaagttttcattgatccaactggtaaacaaaatggtcgtggtgcttatatcaaattagacaatcaagaggccttaatggccaagaaaaaacaagttttcaacaggagtttctcaatggacattccagaaagtttttacgatgacttgattgcttatgttgatcacaaaatcaaaagaagagagttaggtcttgac

SEQ ID NO: 3482 - protein, 99 aa, Streptococcus pyogenes
LMSKVKKIPLRKSLVSGEIIAKRDLLRIVKTKDGQVFIDPTGKQNGRGAYIKLDNQEALMAKKKQVFNRSFSMDIPESFYDDLIAYVDHKIKRRELGLD

SEQ ID NO: 3483 - DNA, 300 bp, Streptococcus agalactiae
ttgaataattcagaaaaagtattaaatctcattgggttagcacagcgtgcggggcgccttattacaggtgaagaattggttattaaagcaattcaaaatcaacaagtatcgctaatctttctagcaaatgatgctggcccaaatttgacgaaaaaagtaactgataaaagtaattactacaaaacagaagtctccacagtgttttcaacactggaattaagtgatgcgttaggcaaaccaagaaaagtggttgctgtcgcagacgctggattttcaaagaaaatgaggactcttatggca

SEQ ID NO: 3484 - protein, 100 aa, Streptococcus agalactiae
MNNSEKVLNLIGLAQRAGRLITGEELVIKAIQNQQVSLIFLANDAGPNLTKKVTDKSNYYKTEVSTVFSTLELSDALGKPRKVVAVADAGFSKKMRTLMA

SEQ ID NO: 3485 - DNA, 300 bp, Streptococcus pyogenes
ttgactaatttagaaagattatctagtcttattggtccagctcaacgggctggaaaagtgatttcaggtgaagaactagtagtaaaagctattcaacaccagcaggtaatattagtatttttagccaatgatgctggtcctaatgtgacaaaaaaagtgacagataaaagtaattattataatgtagaagtctccacagtgttgaatgcactggaattaagtgctgcactaggtaaaccaaggaaggttgctgccattgcagatgctggattttcaaagaaaatgaggactcttatggaa

SEQ ID NO: 3486 - protein, 100 aa, Streptococcus pyogenes
LTNLERLSSLIGPAQRAGKVISGEELVVKAIQHQQVILVFLANDAGPNVTKKVTDKSNYYNVEVSTVLNALELSAALGKPRKVAAIADAGFSKKMRTLME

SEQ ID NO: 3487 - DNA, 2781 bp, Streptococcus agalactiae
ttgtcaaagaaaagattacacgaaatcgctaaggaaattggaaaaacgagtaaggaagtggttgagcaagctcaatcgcttggcttacctgtaaaaagtcatgcttctagcgttgaagaaaatgatgctacacgtattgttgagagttttagctcttctaaaactaaagctccaacaaattctgttcaaactaatcaaggtgtgaaaacagaatctaaaactgttgaaaccaaacaaggcttgtccgatgataaaccttcaactcaacctgtagctaaaccgaaaccacaaagtcgtaactttaaggcggagcgcgaggctcgtgctaaagctgaagcggagaagcgtcaacataatggggatcaccgtaagaataatcgccataatgatacacgctctgacgacagacgccatcaaggtcaaaagcgttcaaatggtaatcgtaatgataaccgacaaggtcagcaaaataaccgtaataaaaatgatgggcgttatgctgatcataaacagaaaccccaaacgcgtcctcagcaacctgcaggcaatcgcattgactttaaagctcgagcagcagctttgaaagctgagcaaaatgctgaatactcacgtcatagtgagcagcgtttccgtgaagagcaagaagccaaacgtcaagcagctaaggagcaagaactagctaaagcagcagcgttaaaagcgcaagaagaagctcaaaaagctaaggaaaaacttgcttctaaacctgttgctaaggtaaaagaaattgtcaataaagtagccgctacgccatcacagacagcagatagtcgtcgtaaaaaacaaactcgttctgataagtctcgtcaattttcaaatgaaaatgaagatggacaaaagcaaacaagaaataagaaaaactggaataatcaaaaccaagtgagaaatcaaagaaatagtaactggaatcataataagaaaaataaaaaaggtaagactaatggagctccaaaaccagtaacagagcgtaaattccatgaattaccaaaagaatttgaatatactgagggcatgaccgttgcggaaattgcaaaacgtattaaacgcgaaccagcggaaattgttaaaaaactctttatgatgggagttatggcaacgcagaatcaatcattagatggagacactattgagctattgatggttgactacgggattgaagcacatgctaaggttgaagttgatgaagctgatattgaacgcttctttgcagatgaggattaccttaatcctgataacttaacggaacgtccgcctgttgttactatcatgggacacgttgatcatggtaaaacaactcttcttgatactctacgtaattcacgtgtcgctactggcgaagctggtggaattactcaacatattggtgcttatcagattgaagaagctggcaagaaaattactttcttggatacaccagggcatgcggcctttacttctatgcgtgcgcgtggtgcatcagtaactgatattactatccttatcgttgccgctgatgatggtgttatgccgcagacagttgaggcaattaatcactctaaagctgcgggtgtcccaattattgttgctatcaacaaaattgataaacctggtgcaaatccagaacgcgttatcagtgaattagctgagcatggtgtcatctctactgcatggggtggtgagtctgaatttgttgaaatttcagctaagtttggtaaaaatattcaagaattacttgagacagttcttttagttgctgaaatggaagaattaaaagcagatgcagatgttcgtgctattggtactgttattgaagcccgtcttgataaaggtaagggagccgttgcaacgcttcttgtccaacaaggtactttaaatgtacaagatccaatcgttgttggtaatacatttggacgtgttcgtgcgatgactaatgatcttgggcgtcgtgtcaaagttgcgggtccatctacaccagtttctattactggtttgaacgaagctccaatggctggtgatcattttgctgtttatgcagatgagaaagctgcgcgtgctgcaggtgaagaacgtgcaaaacgtgctctcttaaaacaacgccaaaacacgcaacgtgttagcctcgagaacttatttgatacccttaaagctggtgaagttaagtcagttaatgttattatcaaagctgatgtgcaaggttctgtagaagcacttgcagcttctctccttaagattgatgttgaaggagtaaaagttaacgttgttcactcagcagttggtgctattaatgagtctgatgtaacacttgctgaagcatcaaatgctgttattataggatttaacgtacgccctactccacaagctcgtcaacaagcagatgctgatgatgtcgaaattcgtcaacatagcattatctataaagttatcgaagaagttgaagaagcgatgaaaggtaaacttgatcctgaataccaagaaaaaatccttggtgaagccattattcgtgagacctttaaagtttcaaaagtgggaactattggtggatttatggttatcaatggtaaagttactcgtgattcaagtgttcgtgttatccgtgatggtgttgtcatttttgatggtaaattagcaagtcttaaacactataaagatgatgttaaagaagtcggcaatgctcaagaaggtggtctaatgattgagaattataacgatctcaaagaagatgacactattgaagcatacattatggaagaaattaaacgtaaa

SEQ ID NO: 3488 - protein, 927 aa, Streptococcus agalactiae
MSKKRLHEIAKEIGKTSKEVVEQAQSLGLPVKSHASSVEENDATRIVESFSSSKTKAPTNSVQTNQGVKTESKTVETKQGLSDDKPSTQPVAKPKPQSRNFKAEREARAKAEAEKRQHNGDHRKNNRHNDTRSDDRRHQGQKRSNGNRNDNRQGQQNNRNKNDGRYADHKQKPQTRPQQPAGNRIDFKARAAALKAEQNAEYSRHSEQRFREEQEAKRQAAKEQELAKAAALKAQEEAQKAKEKLASKPVAKVKEIVNKVAATPSQTADSRRKKQTRSDKSRQFSNENEDGQKQTRNKKNWNNQNQVRNQRNSNWNHNKKNKKGKTNGAPKPVTERKFHELPKEFEYTEGMTVAEIAKRIKREPAEIVKKLFMMGVMATQNQSLDGDTIELLMVDYGIEAHAKVEVDEADIERFFADEDYLNPDNLTERPPVVTIMGHVDHGKTTLLDTLRNSRVATGEAGGITQHIGAYQIEEAGKKITFLDTPGHAAFTSMRARGASVTDITILIVAADDGVMPQTVEAINHSKAAGVPIIVAINKIDKPGANPERVISELAEHGVISTAWGGESEFVEISAKFGKNIQELLETVLLVAEMEELKADADVRAIGTVIEARLDKGKGAVATLLVQQGTLNVQDPIVVGNTFGRVRAMTNDLGRRVKVAGPSTPVSITGLNEAPMAGDHFAVYADEKAARAAGEERAKRALLKQRQNTQRVSLENLFDTLKAGEVKSVNVIIKADVQGSVEALAASLLKIDVEGVKVNVVHSAVGAINESDVTLAEASNAVIIGFNVRPTPQARQQADADDVEIRQHSIIYKVIEEVEEAMKGKLDPEYQEKILGEAIIRETFKVSKVGTIGGFMVINGKVTRDSSVRVIRDGVVIFDGKLASLKHYKDDVKEVGNAQEGGLMIENYNDLKEDDTIEAYIMEEIKRK

SEQ ID NO: 3489 - DNA, 2859 bp, Streptococcus pyogenes
ttgtcaaagaaaagattacatgaaattgccaaggaaattggtaaaagtagtaaagaggtggttgaacacgctaaatacttaggattagatgtgaaaagccatgcatcaagtgttgaagaagcggatgcgaaaaagattatttcaagtttttcaaaggcttctaaacctgatgtgacagcttctcaaacagtcaaacccaaagaagttgctcaaccctctgtaacagtggtcaaagaaacaggttctgagcatgtagagaaaacacaggtctctaagccaaagagtcgtaattttaaagctgaaagagaggctcgtgcaaaggaacaggctgctcgaaaacaagcaaatggctcttctcatcgttctcaagaacgtcgaggaggttatcgccagcccaataatcatcaaactaacgaacaaggagataagaggattacccatcgttctcaaggtgatacaaacgataagcgtattgagcgaaaagcatcgaatgtatcacctagacatgataatcatcagctagttggtgatcgtaaccgttcctttgctaaggagaatcacaagaatggtcgattcacaaaccaaaaaaagcaaggacgacaagagcctcaatcgaaaagtcctaaaattgatttcaaagctcgtgctgctgccttaaaagctgaacaaaatgctgaatactcacgccaaagtgaaacacgttttcgtgcacagcaagaagctaagcgtttagctgagttggcaagacaagaagctaaagaagcggctctaaaagcacaagctgaggagatgagccatcgtgaagcagcattgaaatctattgaagaagcagaaactaaattaaagtcatcaaatattagtgctaaatctactgctgataatcgccgtaaaaaacaagcacgtcctgaaaagaatcgtgagttaactcatcattcacaagaaggacaaaagaaaaataagaagagttggaatagtcaaaaccaagtgagaaatcaaaaaaatagtaactggaataaaaataaaaagaccaaaaaaggcaaaaatgttaagaataccaacaccgctccaaaaccagtaaccgagcgtaaattccatgaattgccaaaagaatttgaatatactgaaggcatgacagttgccgaaatcgcaaaacgtatcaaacgcgaacccgctgaaattgttaaaaagctgtttatgatgggtgttatggcaactcaaaaccaatctttagatggtgacactatcgaattattgatggtagattatggtattgaggctaaggctaaggtagaagtagatgatgctgatatcgagcgcttctttgaggatgaaaattacctcaatcctgaaaatattgtagaacgcgcacctgttgtaactatcatgggacacgtagaccacggtaagacaactttgcttgatactttgcgtaactcacgtgtggcaacaggagaagctggaggaattactcagcatattggtgcttaccagattgaagaagctggcaagaaaattaccttcttggatactcccggacacgcggcctttacaagtatgcgcgcacgtggagcttccgttaccgatatcaccattttgattgttgcagctgatgatggtgttatgccacaaacgattgaagcgatcaatcactcaaaagctgctggtgttccaattattgttgctatcaacaaaattgataaaccaggtgctaatccagaacgtgttatcgcagaattggcagaatatggtatcatctcaactgcttggggcggagagtgcgaatttgtagagatatctgctaaatttaataaaaatattgatgaactattagaaacagtccttttggttgctgaagtggaagaattgaaagctgatccgacggttcgtgctattggtactgtaattgaagcacgcttagataaaggtaaaggtgctatcgctacgcttcttgtccaacaaggaactcttcatgttcaagatccaatcgttgttggtaatacctttggtcgtgtccgtgccatggtaaatgaccttgggcgtcgtgttaaatctgcggagccatcaacaccagtttccattactggtttgaacgaaacaccaatggctggtgatcactttgctgtttacgctgatgaaaaagctgcgcgtgcagctggtgaggagcgatcaaaacgtgccctcctcaaacaacgtcaaaatacacagcgtgttagccttgataatctctttgatacccttaaagcaggagaaatcaagactgttaatgtcatcatcaaagcagacgttcaaggttctgttgaagcccttgcagcatctcttgtaaagattgaagtggaaggtgtccgtgtcaatgtcgttcactctgctgtaggtgctatcaatgagtctgatgtgacccttgctgaagcatcaaatgctgttattatcggtttcaacgttcgccctaccccacaagctcgtcaacaagcagatacggatgatgtggaaattcgtcttcatagtattatctataaagtcattgaagaagtagaagaagccatgaaagggaaacttgaccctgtttaccaagaaaaaattcttggtgaagccattatccgtgaaaccttcaaagtttctaaagtgggaacaattggtggctttatggtaatcaacggtaaggtgacacgtgattcgagtgttcgtgttatccgtgatagtgtcgttatttttgatggtaaactggccagcttgaaacattacaaagatgacgttaaagaagtcggtaatgctcaagaaggtgggttgatgattgaaaactttaacgatcttaaagttgacgatactattgaagcctatattatggaagaaattgtgagaaaa

SEQ ID NO: 3490 - protein, 953 aa, Streptococcus pyogenes
LSKKRLHEIAKEIGKSSKEVVEHAKYLGLDVKSHASSVEEADAKKIISSFSKASKPDVTASQTVKPKEVAQPSVTVVKETGSEHVEKTQVSKPKSRNFKAEREARAKEQAARKQANGSSHRSQERRGGYRQPNNHQTNEQGDKRITHRSQGDTNDKRIERKASNVSPRHDNHQLVGDRNRSFAKENHKNGRFTNQKKQGRQEPQSKSPKIDFKARAAALKAEQNAEYSRQSETRFRAQQEAKRLAELARQEAKEAALKAQAEEMSHREAALKSIEEAETKLKSSNISAKSTADNRRKKQARPEKNRELTHHSQEGQKKNKKSWNSQNQVRNQKNSNWNKNKKTKKGKNVKNTNTAPKPVTERKFHELPKEFEYTEGMTVAEIAKRIKREPAEIVKKLFMMGVMATQNQSLDGDTIELLMVDYGIEAKAKVEVDDADIERFFEDENYLNPENIVERAPVVTIMGHVDHGKTTLLDTLRNSRVATGEAGGITQHIGAYQIEEAGKKITFLDTPGHAAFTSMRARGASVTDITILIVAADDGVMPQTIEAINHSKAAGVPIIVAINKIDKPGANPERVIAELAEYGIISTAWGGECEFVEISAKFNKNIDELLETVLLVAEVEELKADPTVRAIGTVIEARLDKGKGAIATLLVQQGTLHVQDPIVVGNTFGRVRAMVNDLGRRVKSAEPSTPVSITGLNETPMAGDHFAVYADEKAARAAGEERSKRALLKQRQNTQRVSLDNLFDTLKAGEIKTVNVIIKADVQGSVEALAASLVKIEVEGVRVNVVHSAVGAINESDVTLAEASNAVIIGFNVRPTPQARQQADTDDVEIRLHSIIYKVIEEVEEAMKGKLDPVYQEKILGEAIIRETFKVSKVGTIGGFMVINGKVTRDSSVRVIRDSVVIFDGKLASLKHYKDDVKEVGNAQEGGLMIENFNDLKVDDTIEAYIMEEIVRK

SEQ ID NO: 3491 - DNA, 375 bp, Streptococcus agalactiae
atgagcacaatgaagaaaggattaattatggctaatcatcgtattgatcgcgttggaatggaaattaaacgtgaagtcaatgagattttgcgtctccgagttaatgatccacgtgtacaagatgtcacaattactgatgttcagatgttgggtgacctttcaatggctaaagtattttatactattcattcgacacttgcttctgataatcaaaaagcacaaattggtttagaaaaagcaactggtactattaagcgtgaacttggcaaaaaccttactatgtataaaataccagatttacaatttgttaaagatgaatctattgaatacggaaataagattgatgaaatgttgcgcaatctagataaaaaagat

SEQ ID NO: 3492 - protein, 125 aa, Streptococcus agalactiae
MSTMKKGLIMANHRIDRVGMEIKREVNEILRLRVNDPRVQDVTITDVQMLGDLSMAKVFYTIHSTLASDNQKAQIGLEKATGTIKRELGKNLTMYKIPDLQFVKDESIEYGNKIDEMLRNLDKKD

SEQ ID NO: 3493 - DNA, 354 bp, Streptococcus pyogenes
atggctatggctaatcatcgtattgaccgcgttgggatggaaatcaagcgcgaagtaaatgatattcttcagaaaaaagtgcgtgatccacgcgttcagggagtaacgattacagaagtgcaaatgcagggtgacttgtcacttgctaaagtttattacactattatgagtgacttggcatctgataatcaaaaagcacaaacagggcttgaaaaagcgactggaacgattaaacgtgaacttggcaaacaattgaccatgtacaaaattccagatttggtgtttgaaaaagacaattccatcgcctatggtaataaaattgatcaactcttacgagatcttgacaacaaatcc

SEQ ID NO: 3494 - protein, 118 aa, Streptococcus pyogenes
MAMANHRIDRVGMEIKREVNDILQKKVRDPRVQGVTITEVQMQGDLSLAKVYYTIMSDLASDNQKAQTGLEKATGTIKRELGKQLTMYKIPDLVFEKDNSIAYGNKIDQLLRDLDNKS

SEQ ID NO: 3495 - DNA, 1002 bp, Streptococcus agalactiae
ttgaaaccgtccttcaaaaaactattgctactatttagtattatcaccattttatccatcgcctgtacaccacatgcaaaagcaagtgggcgttcatggaaaagttggtttatcgaacaatacttttggctaaagcgcgataaaagttattataaagttcaagatgaaagctcatttcaaaagtacttaaatgctagccgtgaacaatctgataagggttattacttagacccaaactctgttaatggagggcttgttcaagagagactttttgatatgcaagtctattcttggaatgacaacggtaaagctaatcaaaagaccattttctatttagctggtggctcttacttaaataatccaacgccttaccatatcagcatgcttaagacgctctcaactagtcttgatgcaaaaattattttaccaatttatccaaaaactcctcgttatacctatgattatgctatccctagattggttaacctttatagacactttcatgaaaaaaacgctaatctcactttgatgggtgattcagctggcggaggattagcactaggattagcgcatgcattgtctcaccaatcagggcaagaggctattcctcaacctaaaaatattatcctcttatctccatggctagatgtgacaatgaaacatccagaaattcccaaatacgaagatactgatcctatcctatctgcttggggtctcgcacgtgtaggtgaaatttgggcaaatggttctaataatactaaccatacatatgttagtcctaaaaatgcccctgctactaaactcgctcctattacgttatttactggaacacgagaaatattcttcccagatattcgcgattatgctgcacaactccaagcagctaatcaccccgttaactatattgcacaagagggaatgaatcatgtttatccaatttaccctattgaagaagctaaaacagcacagtatcaaatgattgatatcatcaataaaactcct

SEQ ID NO: 3496 - protein, 334 aa, Streptococcus agalactiae
MKPSFKKLLLLFSIITILSIACTPHAKASGRSWKSWFIEQYFWLKRDKSYYKVQDESSFQKYLNASREQSDKGYYLDPNSVNGGLVQERLFDMQVYSWNDNGKANQKTIFYLAGGSYLNNPTPYHISMLKTLSTSLDAKIILPIYPKTPRYTYDYAIPRLVNLYRHFHEKNANLTLMGDSAGGGLALGLAHALSHQSGQEAIPQPKNIILLSPWLDVTMKHPEIPKYEDTDPILSAWGLARVGEIWANGSNNTNHTYVSPKNAPATKLAPITLFTGTREIFFPDIRDYAAQLQAANHPVNYIAQEGMNHVYPIYPIEEAKTAQYQMIDIINKTP

SEQ ID NO: 3497 - DNA, 984 bp, Streptococcus pyogenes
ttgaaacatcctattcgaaaaacacttgtcaccttaggtctattactgaccttatgcctgccgactccagttgcagctagttctcgttcttggaagagctggtttatcgagcaatatttctggttaaaacgtgacaagagttactattctaaacaagatgacccaagcttccaaagataccttgatgcctgtcgtgaacaatctgataaaccttatcaactagatactaatttagtcaatggtccccttgttcaagaaaatctttatggcatgcaggtttactcttggaatgataatggaaaacctgatcaaaaaacaattatttatcttgccggtggttcttatcttaacaatccaacgacataccatattaatatgttaaagacattatccacaagtcttgacgctaaaattgttttacccatttatcctaaagccccacgttatacctataactatactatgccaaaattggtcaatctttaccaacactattaccataaaaatcagaatgttttccttatgggagattcagcaggtggaggtttagccttaggtctagctcatgccctacacaatgaatcagtccctcaaccaaagcagctcgttcttttatcaccttggttagatgttactatgtcacacccagagattccagaatacgaagatgctgatcctattctatcttcttggggattaaaacgagtgggagaattgtgggcctactctgctgataataccaaccatatttatgtcagtcctaaaaatggtccgatcacttatctaccaccaattactttatttactgggacacgagagatcttttatcctgatattcgcgattatgccgcaaaactgaaagccgctaaccacaatattacctttattacccaagaaggcatgaaccacgtttacccaatttatcctatcgaagaggcaaaaacagctcaataccaaatcattgatgccatcaacaaaactcct

SEQ ID NO: 3498 - protein, 328 aa, Streptococcus pyogenes
LKHPIRKTLVTLGLLLTLCLPTPVAASSRSWKSWFIEQYFWLKRDKSYYSKQDDPSFQRYLDACREQSDKPYQLDTNLVNGPLVQENLYGMQVYSWNDNGKPDQKTIIYLAGGSYLNNPTTYHINMLKTLSTSLDAKIVLPIYPKAPRYTYNYTMPKLVNLYQHYYHKNQNVFLMGDSAGGGLALGLAHALHNESVPQPKQLVLLSPWLDVTMSHPEIPEYEDADPILSSWGLKRVGELWAYSADNTNHIYVSPKNGPITYLPPITLFTGTREIFYPDIRDYAAKLKAANHNITFITQEGMNHVYPIYPIEEAKTAQYQIIDAINKTP

SEQ ID NO: 3499 - DNA, 414 bp, Streptococcus agalactiae
atgactatttcaagcgcagaatgggaaattatgagagtggtttgggcacagcagaatacaaccagtaatgagatactagcagttttactagagaagtatgattggactccttcaactgtcaaaaccttattaagaaggctcttagataaaggctacgtgagcagagaaaaaatgggaaaaggatttagctattctcctttaattgatgaagatttagctatgatgtcagaggtagatagtgtatttcaaaaagtttgccagaccaaacatgttgctattgttagacacttattggaaagtataccaatgacagagaaggatcgattaaatttgcaatcatcactagaagctaagaaaggcaaaacacttgaacgtgtagcttgtaattgcattcctggtcagtgtcaatgccat

SEQ ID NO: 3500 - protein, 138 aa, Streptococcus agalactiae
MTISSAEWEIMRVVWAQQNTTSNEILAVLLEKYDWTPSTVKTLLRRLLDKGYVSREKMGKGFSYSPLIDEDLAMMSEVDSVFQKVCQTKHVAIVRHLLESIPMTEKDRLNLQSSLEAKKGKTLERVACNCIPGQCQCH

SEQ ID NO: 3501 - DNA, 450 bp, Streptococcus pyogenes
gtgaatgaaggtgacgttatgcaacagatatcagctgctgaatgggaagtcatgcgtgtggtgtgggccagtggtgatattaaaagtagcgatattattactattttaaggaaaaaatatcaatggtcagattccactattaagaccctcattggtaggctagttaaaaaaaattttttaacgtcttatcggcaaggaagagcttatatttatcaagctcttttggatgagactttgctacaaaaagaagcactagcgactgttttagacggtatttgtcagcggcaacacacgcgtctacttcttgaacggctttatcacttaccgatgaccttagaggaaatcggggcattccaagagctactagaagtcaaaaaagaaaatgcagttcttgaggtgccgtgtaattgtctgcctgggcagtgccactgtcagagaaaggagacgtat

SEQ ID NO: 3502 - protein, 150 aa, Streptococcus pyogenes
VNEGDVMQQISAAEWEVMRVVWASGDIKSSDIITILRKKYQWSDSTIKTLIGRLVKKNFLTSYRQGRAYIYQALLDETLLQKEALATVLDGICQRQHTRLLLERLYHLPMTLEEIGAFQELLEVKKENAVLEVPCNCLPGQCHCQRKETY

SEQ ID NO: 3503 - DNA, 2232 bp, Streptococcus agalactiae
atggctaatagaaaagaaacatttttgattgatgggatgacttgtgcatcttgtgctttaacgatagaaaaagctgtcaacaagttagaccatgtggatagtgcagtagtaaatttagcaacagagaaaatgacagttacgtttgatgatacaaccttatcgccaaatgtgattgaagagtgtgtttctgagagtggatacgaagcatcgcttttcaaagaggaaacttctaaaagccaatctgaacggcaccaattagccattgaaaagatgtggcatcgcttttggatgtcagcagttgcaactatacctcttctctatatttccatgggaccaatgattaacttatggttaccatcatttttgatgccagataagggacctctaaactatggtatgatacaattattgttaacactaccggtgatgtattttgggcgtatcttttaccaaaatggttttaaagcactttttaaaaggcatcccaatatggattcattagttgctatagccacaacagcggctttcatttatagcttatatggattgtacgaaatattacagggtgacatacactacgctcaccagctttatttcgaatctgttgcagttattttaacacttattactctaggaaaatattttgaaatattatccaaagggcgtacttcggcctcgattgaaaaattattaactttatcagcaaaagaagcaagagttatcaaagatggtgaagactatatggttcctttggataaagttaaaataggtgaaacaattcttgtcaaacctggagaaaaaattcctcttgatggccatgttgtagcaggagaatcaagtattgatgaatccatgttaacaggtgaaagtattccagttgaaaaaaaggttggtagtaaggtttacggtgccagcattaatgggcaaggtagcttaacgattttcgttgaaaaagaagctggcggttcccttctatcacaaattattaacttagtagaagctgcacagacaagtaaggctccaattgctaacttagcagacaaagtatcaggagtctttgtcccttttgttattgtcattgcaattttatcaggcttgagttggtacttaattctggggcaaagttttgccttctctctgaagattatgattgcagtcttagtgattgcttgtccatgtgctttagggttggcaactcctacagctattatggtggctagtggtaaagcagctgagaatggtattttatttaaaggtggtgaagtgttggaaaaggctcaccacattgatacaatagtttttgataaaacaggaaccttgaccaaagggaaaccagaagtagttgctatcaaaacatatgggggagataaagaggagtttttaggtcaggtagcatcagtagaaaaactttcaaatcatccacttagccaaacaattgttaataaagcaaaagagaaagaacttcccttaagggaagtcatggcttttaaaaatattttgggttacggtttgagtgcaactattaatggtaaaactatgcttgtaggtaatgctaacttaatgactaagaacgatgttaatttagatttagcaaaggctgatatagaaatagctcaagaagaagcacaaactgtggtttacgtttccgaaaatggagtgttgagcggtttaataactttaacggaccagctaaagacagatagccaagaaacagttaagcagttacaaagattaggatttaatttagttttacttactggtgataataaggctagtgcagatgccatagcacaaaaattgggtatcacgacagttgtttcagaagttttacctgatcagaaagcaaacgttattttagaacttaaagaaaaaggcggacagattgcgatggttggtgatggcatcaatgatgctcctgcgctagctagcagtgatgtaggtatctctatgagttctggaacagatattgctattgaatcagcagatatcgtgttgatgaaacctgagttaacagatctcttaaaagcaatgactatcagtaaacaaacgattcaaattattaaggaaaatttattttgggctttcttttataacgttttagcgattccagtggcaatgggtgttttacatctttttggtggtcccttactcaatcctatgttggcaggcttagctatggcgtttagttcagtttcagtagttttaaacgcacttcgcttaaaagtcttaaaa

SEQ ID NO: 3504 - protein, 744 aa, Streptococcus agalactiae
MANRKETFLIDGMTCASCALTIEKAVNKLDHVDSAVVNLATEKMTVTFDDTTLSPNVIEECVSESGYEASLFKEETSKSQSERHQLAIEKMWHRFWMSAVATIPLLYISMGPMINLWLPSFLMPDKGPLNYGMIQLLLTLPVMYFGRIFYQNGFKALFKRHPNMDSLVAIATTAAFIYSLYGLYEILQGDIHYAHQLYFESVAVILTLITLGKYFEILSKGRTSASIEKLLTLSAKEARVIKDGEDYMVPLDKVKIGETILVKPGEKIPLDGHVVAGESSIDESMLTGESIPVEKKVGSKVYGASINGQGSLTIFVEKEAGGSLLSQIINLVEAAQTSKAPIANLADKVSGVFVPFVIVIAILSGLSWYLILGQSFAFSLKIMIAVLVIACPCALGLATPTAIMVASGKAAENGILFKGGEVLEKAHHIDTIVFDKTGTLTKGKPEVVAIKTYGGDKEEFLGQVASVEKLSNHPLSQTIVNKAKEKELPLREVMAFKNILGYGLSATINGKTMLVGNANLMTKNDVNLDLAKADIEIAQEEAQTVVYVSENGVLSGLITLTDQLKTDSQETVKQLQRLGFNLVLLTGDNKASADAIAQKLGITTVVSEVLPDQKANVILELKEKGGQIAMVGDGINDAPALASSDVGISMSSGTDIAIESADIVLMKPELTDLLKAMTISKQTIQIIKENLFWAFFYNVLAIPVAMGVLHLFGGPLLNPMLAGLAMAFSSVSVVLNALRLKVLK

SEQ ID NO: 3505 - DNA, 2151 bp, Streptococcus pyogenes
ttgcctgaagtagaacaggctgttgtgaatttagcgactgagaagctcacggttacttatcaagatgacgatttagaaacggccaaagttattcaagcggtgaaagctgctggttatggtgcacaagtctttgatgaacatgcaaaacacatgcaaacaggtcgtcgtgacgaagacctaaaggttatttggtctcaggtcttgtggtctgccctattcaccattcctatattatacctagctatgggtcacatggtgggcttatggcttcctccatttctgcaaccagatcgctatcctttcgtttacagctttagtcagctactcttgacgattccagtcttagtattaaatcgtcattattaccataatgggtttaaagctttgtttaagggacatcctaatatggactccttggtagctttagcaaccagctttgcttttgcttatagtctttatggagtggttgaaatcagtctgggccgggcgcactttgtgcactccctttattttgaatcggtggtagtgattttgacactcatcggtctaggaaagtattttgaaagtcgttctaagggccgtacttctcaagctattcaaaagctcctatccttgaaggctactgttgtgagggtatggagaaacagccaatggcaattgttaccattagaagaagttagctatgatgaccttgtcctggttcaaccaggtgaaaaagtttctattgacggtattatcgtggaaggacatagcagtttggatgaatcctttttaaccggggaaagtttgcctgttgaaaagggagaaaaagataatgtctttgcgggcagcttgaatgggccaggcgccctcacgattaaaccagataagcttggaaatgataccttgttagcacaaattatccaactagttgagaatgctcaagaaaataaagcacctattgcagctattgctgatagagtctcaggtgtctttgttccggtggttttggtattagctctgttaacaggggtgttttggttggtattcatgcaggaaagtcttcgttttagtttgacaacagccatcgctgttctagtcattgcttgcccttgtgcgcttggtttagcaacgccgacagcgattatggttggaacagggcgtgcagctgaaaatggtattctttttaaaggtggtgacatcttagaacaagcacatcaggtagatacggttgtttttgataaaacggggacgattacggaggggaaaccaagtcttcaaaagctcctaactttttcgggagatgatcaccttatcttgcaagaagctgcttccttggaggcctattctcaacaccccttaggggaggctattgttcgtgctgctcaggaagctggttacgatagtctaccagtggaagagtttgagtctttaaccggcctaggagttactggtcagcttgaagggcgtcgtttggcgattggaaatgctgctttaatgggaattcttggtatcgatttatcttgtgttcagtcggtttgtgctaaggcttctgagaaaggccaaacccttgtatattatgctaaagaggggcagctacgagctcttttcagtattgctgacgctgtcaaagaagatagtcaagctaccgtcgaagctttgcatcaactgggaattcacaccatcatgctaacaggtgaccacgatgctaccgctaaggctattgcctctcaagtggggattacagatgtgatcagtcaagtcttacctgatcaaaaagcaggcgtgatagcagacctccgctctcaagggagaaaagttgcaatggtaggtgatggtattaatgatgctccggcattggctgtagcagacattgggatagctatggggtcagggacagatattgccattgaatcggcggatgtgattctgatgaaacctgatatgctggatttggtgaaagctatgtcattgagtcgagtgactatgagaattgtcaaggaaaatttattttgggcattcatttacaatgtcctcatgattccagtggccatgggcttacttcatctttttggaggtccactattgaacccgatgttagcaggttttgccatgagttttagttcagtatcagttgttttgaatgccctgcgattaaaaggaaaaaccatt

SEQ ID NO: 3506 - protein, 717 aa, Streptococcus pyogenes
LPEVEQAVVNLATEKLTVTYQDDDLETAKVIQAVKAAGYGAQVFDEHAKHMQTGRRDEDLKVIWSQVLWSALFTIPILYLAMGHMVGLWLPPFLQPDRYPFVYSFSQLLLTIPVLVLNRHYYHNGFKALFKGHPNMDSLVALATSFAFAYSLYGVVEISLGRAHFVHSLYFESVVVILTLIGLGKYFESRSKGRTSQAIQKLLSLKATVVRVWRNSQWQLLPLEEVSYDDLVLVQPGEKVSIDGIIVEGHSSLDESFLTGESLPVEKGEKDNVFAGSLNGPGALTIKPDKLGNDTLLAQIIQLVENAQENKAPIAAIADRVSGVFVPVVLVLALLTGVFWLVFMQESLRFSLTTAIAVLVIACPCALGLATPTAIMVGTGRAAENGILFKGGDILEQAHQVDTVVFDKTGTITEGKPSLQKLLTFSGDDHLILQEAASLEAYSQHPLGEAIVRAAQEAGYDSLPVEEFESLTGLGVTGQLEGRRLAIGNAALMGILGIDLSCVQSVCAKASEKGQTLVYYAKEGQLRALFSIADAVKEDSQATVEALHQLGIHTIMLTGDHDATAKAIASQVGITDVISQVLPDQKAGVIADLRSQGRKVAMVGDGINDAPALAVADIGIAMGSGTDIAIESADVILMKPDMLDLVKAMSLSRVTMRIVKENLFWAFIYNVLMIPVAMGLLHLFGGPLLNPMLAGFAMSFSSVSVVLNALRLKGKTI

SEQ ID NO: 3507 - DNA, 204 bp, Streptococcus agalactiae
atgaaacatacctatcgagttagtggcatgaaatgtgatggttgtgccaaaacagtttctgataagttatcaagtgtgattggtgttgacgaggttaatgttgatttgactaaaaatcaagttgtcgtaagtggaaaaacattcaaatggcttttaaaacgttctttaaaagacacaaagtattcactagaagaggaaataaat

SEQ ID NO: 3508 - protein, 68 aa, Streptococcus agalactiae
MKHTYRVSGMKCDGCAKTVSDKLSSVIGVDEVNVDLTKNQVVVSGKTFKWLLKRSLKDTKYSLEEEIN

SEQ ID NO: 3509 - DNA, 201 bp, Streptococcus pyogenes
atggaaaaacattatcaggttacaggaatgacatgtgacggttgcgcaagaacggtcactgaaaaattatcagctgtccccggtgtgcaatcggtccaggtaaatttggaaaaaggagaggctaaggtgacaggacgtcctttaacgttcctaatcaagcgtgctttgaaggataccaaatttgaattatataaatggtct

SEQ ID NO: 3510 - protein, 67 aa, Streptococcus pyogenes
MEKHYQVTGMTCDGCARTVTEKLSAVPGVQSVQVNLEKGEAKVTGRPLTFLIKRALKDTKFELYKWS

SEQ ID NO: 3511 - DNA, 618 bp, Streptococcus agalactiae
gtgcagatgtcaattgatatttggaacattttaagtttggttggaaccgtagcttttgcaagttcgggagctattgtggcgattgaggaagaatttgatattctagggctttttatcttaggttttgtaacggcatttggtggtggagctattagaaatgtactaattggcttgcctattgaaacactttggagtcaaggaattgctttttatgcagcagcagcagctattttatttattatgattttccctaatttgttgagtggtaagggacgggatgccgaagttgtatcagatgctattgggttagcagcgtttagtgttcaaggagcactatatgcgactcaatctcatcaacctcttagtgctgtcattgtcgcagcagtactaactggtgcaggtggtggtattgtcagagatgttctggctggccgaaaacctggagtactaagaagtgaaatatatgcaggttggtcaatattagtggggatcattttatattttaaaattgctaaaacaacaactgactattatttgttagtgttagttgtaactagcctaaggatgttgggttataagaaacaatggcacttgccagttgtcagaccacgtaagaaa

SEQ ID NO: 3512 - protein, 206 aa, Streptococcus agalactiae
MQMSIDIWNILSLVGTVAFASSGAIVAIEEEFDILGLFILGFVTAFGGGAIRNVLIGLPIETLWSQGIAFYAAAAAILFIMIFPNLLSGKGRDAEVVSDAIGLAAFSVQGALYATQSHQPLSAVIVAAVLTGAGGGIVRDVLAGRKPGVLRSEIYAGWSILVGIILYFKIAKTTTDYYLLVLVVTSLRMLGYKKQWHLPVVRPRKK

SEQ ID NO: 3513 - DNA, 615 bp, Streptococcus pyogenes
atgacaattgatatgtgggaaattttaaatatcatcgggaccattgcctttgctctttctggtgctattgttgccatggaagaagaatttgatattttagggatttttattttaggtttcgtgacagcctttggaggcggagccattcgaaacaccctaattggtttacctatagaggccttatgggggcaaaagccagaattcacttgcgctttctttgctatggttttgattatgctttttcctaagctaatggctagaggttgggtacgggcagctgttttgactgatgccattggtctggcagcttttagtgtccaaggagccttgcatgctgtccgtcttaaccagcctttaagtgctgtcattgtaacagctgtgttgactggtgcaggcggtggtgttgtcagagatattctggcagggcgaaaacctagtgttttgcgtagtgaaatctatgctgggtggtctattcttgcagctattgttttgcattttaaactagcagattcaacgattgaatgttatgccttggttgttttactcacgactttacgcatgattggcaaccgtaaaaaatggaacctccctaaaatcaaatggaaagaggaaaga

SEQ ID NO: 3514 - protein, 205 aa, Streptococcus pyogenes
MTIDMWEILNIIGTIAFALSGAIVAMEEEFDILGIFILGFVTAFGGGAIRNTLIGLPIEALWGQKPEFTCAFFAMVLIMLFPKLMARGWVRAAVLTDAIGLAAFSVQGALHAVRLNQPLSAVIVTAVLTGAGGGVVRDILAGRKPSVLRSEIYAGWSILAAIVLHFKLADSTIECYALVVLLTTLRMIGNRKKWNLPKIKWKEER

SEQ ID NO: 3515 - DNA, 828 bp, Streptococcus agalactiae
atgatagaggagaaaaagatgataaaattaattgctattgatatggatggaacgcttttaaatgatgaaaagaaaattccaaaggaaaatatccaagctattaaagaagcaactcaagcaggtattaaaattgtactgtgtactgggcgaccgatgtcaggtatacttccttattttaatgaactaggtttaacaaaagaggagtatattatcatgaataatggttgtagcacttatagcacgaaagattggcaattgattgattctgcaactttaacacatgatgaactcatctttcttgaggaggttgttaaagaatttcccaacgtttgtttaacattaacagctgaaaatacattttacgctgttggagaggaagttcctgaaattgttgcttatgatgctgatttagtttttacaaaagcaaagtcaacaagtttagatgctcttcgcaatcaagaagaaattgtctttcaagcaatgtacatgggattagatgcagatgtaactgcttttcaagaagctgttgaagaagccttaatctcgaaatttagtggagttcgaagccaagactatatttatgagattatgcctcaaggagtaacaaaagcaagaggcttaaaatccttgatagcaaaattaggactggatattaatcaagttatggccatcggtgatgctcctaacgatattgaattattagatttagttcccaatagcgttgctatggggaatgcatcagatgagattaaatctagatgtaaatatataacggtggataataacaaagcaggggttgctaaagctatttatgactatgctttacgt

SEQ ID NO: 3516 - protein, 276 aa, Streptococcus agalactiae
MIEEKKMIKLIAIDMDGTLLNDEKKIPKENIQAIKEATQAGIKIVLCTGRPMSGILPYFNELGLTKEEYIIMNNGCSTYSTKDWQLIDSATLTHDELIFLEEVVKEFPNVCLTLTAENTFYAVGEEVPEIVAYDADLVFTKAKSTSLDALRNQEEIVFQAMYMGLDADVTAFQEAVEEALISKFSGVRSQDYIYEIMPQGVTKARGLKSLIAKLGLDINQVMAIGDAPNDIELLDLVPNSVAMGNASDEIKSRCKYITVDNNKAGVAKAIYDYALR

SEQ ID NO: 3517 - DNA, 879 bp, Streptococcus pyogenes
ttggcaaccgtaaaaaatggaacctccctaaaatcaaatggaaagaggaaagataggatgattcaactaattgcaattgatttggacggcaccttattaaaccaggacaaacagattccaaaagagaatatcacagccatccaagaagcagctcagtcaggcttaaaaattgtcttatgcacaggccggcctcagtcagggacaagaccctattttgaccaattaggtttgacacaagaggaattcctcattatcaataatggctgtagtacttatagtagtcctgactggcaattacgccattcaaaaatgttgaaggtttcagatattgaattgctggaagagctaagccaaagttttccagatatttacctgactttaactgaggaaaacgattatttggtgcttgaagaagaagtgccagaccttgtgcaggaagatggagatttggtatttaccattgtcaagcctgtctccttagcagagctgtcggacactcctcgcctgatttttcaagccatgtacttaggagaaaaagctgcgctagatgcctttgaacgtgcggtgagaaatcagcttagtcagagttttcatgttgttcgtagccaagataatattttagaaattctccctcagggagtcagcaaggcatcggctctcaaagaattagtagaagatttgggtttaactgctgaccaagtgatggctattggggatgctcccaatgacattgagatgttaacttatgctggtttaggagttgctatggaaaatgcttcagcagctatcaagccattagctgacaaagtcactttgactaatgatatggcgggtgtggcccaggctatccgtcagtttgcacttgtagctcaaaaagac

SEQ ID NO: 3518 - protein, 293 aa, Streptococcus pyogenes
LATVKNGTSLKSNGKRKDRMIQLIAIDLDGTLLNQDKQIPKENITAIQEAAQSGLKIVLCTGRPQSGTRPYFDQLGLTQEEFLIINNGCSTYSSPDWQLRHSKMLKVSDIELLEELSQSFPDIYLTLTEENDYLVLEEEVPDLVQEDGDLVFTIVKPVSLAELSDTPRLIFQAMYLGEKAALDAFERAVRNQLSQSFHVVRSQDNILEILPQGVSKASALKELVEDLGLTADQVMAIGDAPNDIEMLTYAGLGVAMENASAAIKPLADKVTLTNDMAGVAQAIRQFALVAQKD

SEQ ID NO: 3519 - DNA, 2640 bp, Streptococcus agalactiae
atgacaaacaagaataaattacttttaattgatggctcatctgtagcctttcgtgctttttttgctctttataatcaaattgaccgctttaaaaacaattctggacttcatactaatgccatatatggtttccatttgatgttgaatcatattttaggtcgtgtccagcctagtcatattttagtggcttttgatgccggaaaaactactttccgtacggaaatgtatgcagattataaaggtgggcgtgctaaaactccggatgaatttcgtgaacaatttccttacattcgtcaacaattagatgtcttaggcatcaaacattatgaattggaacattatgaagccgatgatatcattggtactcttgcaaaacaagccgaagctagtaatgaacattttgatataacggtggtttctggggataaagatttaattcaattaacagacactaacacggtagtagaaatctctaaaaagggagttgctgagtttgaagaattcacgccagcttaccttatggaaaaaatgggaattacgccgagtcaatttattgatttaaaagctttgatgggagataaatcagataatattcctggggttactaaaatcggtgaaaaaactggcttgaagttgctatcagaatatggttccttagaagggatctatgaaaatattgaggctatgaaacagtctaagatgaaagaaaaccttatcaatgataaggagcaagctttcttatcaaagaccctagctacaatcaacatagcatcacctataacaatcggcttagaagatatcctttatagtggaccgcaagatataaaagccttgtctcaattttatgatgagatggattttaaacagtttaaagcagctctgggtgaggagacaagtcaggaagattttgaggttgactttactgaagtggagcaattaaaaacagaaatgttctccgataatgatttttattactttgagatgttgggtgataactaccatgtagaagatttaattgggatagcttggggaaatagcgatacaatctacgctactagtaatgtatcgttattgcaagaagctttatttaaaaaagctttatcaaaacctatcaaaacttatgattttaaaagaagtaaggtccttttaaatcgttttaatattgatttaccagagccagcctttgatactagattggccaagtaccttttgtctactactgaggataatctagtatcaacaattgctaggttatatacaaatctgccactggatactgatgatgctgtttatgggaaaggtgctaaacgcgctataccagaaaaaacacgatttcttgagcatctagctaaaaaagtaaaagttttagtggattctgaggctaatattatgcaacagcttaaagctaatgagcaagaagaattgctgtttgaaatggagcaacctttagcgaatgttttagctaaaatggaaattcgaggtattaaggttaagaaaaataccttgaatgaaatggccattgaaaatcaaaaagtcatcgaaacattaacacaagaaatctatgaattggctgggcaagagtttaatattaattctccaaaacagttaggaaagttgttgtttgaaacgttaggtcttcctgtagaaatgactaaaaaaacaaaaacaggttattcaactgcagtagatgtattagagcgcttagctccgatttctcctcttgtaactaaaattttagagtaccgtcaaatcactaaattgcaatcaacctatattattggtttacaagattatattttagaagatggtaaaattcatacacgttatgttcaagatttgactcagacaggtcgtctttcaagttctgacccaaaccttcaaaatataccagttagactagagcaaggacggcttatccgaaaagcttttgttccatcagaagacaatgctgttttattgagttcagattattctcaaatagaattgcgcgtgttagcacatatttcaaaagacgaacatttgatcgctgcctttaaagagggagctgatattcatacttcaacagctatgcgtgtttttggtatcgaaaaacctgagaatgtcactcccaatgatcgtcgaaatgctaaggctgttaattttggaattgtttatggtatttcagattttggtctatcgcataatttaggaatacctcgtaaactagcgaagcaatatattgacacctattttgagcgttatcctggaataaaaaactatatggaaacagttgttcgtgaagcaaaagataagggttacgttgaaacacttttccatcgtcgtcgttcattaccagatattaattctcgtaattttaacattcgccaatttgcagagcgcacagcaatcaattcaccaatccaaggaagtgcagctgatattcttaaaattgcaatgataaatttagatagggtacttgataaaggtggttataaatcaaaaatgctgttgcaagttcatgatgaaattgtacttgaagtccctaacgaggagataggagcaatcagggagttggttacaaaaacaatggagtcagcaattagtttatcggtacctttgattgcagatgagaacgcaggtgagacttggtatgaagcgaag

SEQ ID NO: 3520 - protein, 880 aa, Streptococcus agalactiae
MTNKNKLLLIDGSSVAFRAFFALYNQIDRFKNNSGLHTNAIYGFHLMLNHILGRVQPSHILVAFDAGKTTFRTEMYADYKGGRAKTPDEFREQFPYIRQQLDVLGIKHYELEHYEADDIIGTLAKQAEASNEHFDITVVSGDKDLIQLTDTNTVVEISKKGVAEFEEFTPAYLMEKMGITPSQFIDLKALMGDKSDNIPGVTKIGEKTGLKLLSEYGSLEGIYENIEAMKQSKMKENLINDKEQAFLSKTLATINIASPITIGLEDILYSGPQDIKALSQFYDEMDFKQFKAALGEETSQEDFEVDFTEVEQLKTEMFSDNDFYYFEMLGDNYHVEDLIGIAWGNSDTIYATSNVSLLQEALFKKALSKPIKTYDFKRSKVLLNRFNIDLPEPAFDTRLAKYLLSTTEDNLVSTIARLYTNLPLDTDDAVYGKGAKRAIPEKTRFLEHLAKKVKVLVDSEANIMQQLKANEQEELLFEMEQPLANVLAKMEIRGIKVKKNTLNEMAIENQKVIETLTQEIYELAGQEFNINSPKQLGKLLFETLGLPVEMTKKTKTGYSTAVDVLERLAPISPLVTKILEYRQITKLQSTYIIGLQDYILEDGKIHTRYVQDLTQTGRLSSSDPNLQNIPVRLEQGRLIRKAFVPSEDNAVLLSSDYSQIELRVLAHISKDEHLIAAFKEGADIHTSTAMRVFGIEKPENVTPNDRRNAKAVNFGIVYGISDFGLSHNLGIPRKLAKQYIDTYFERYPGIKNYMETVVREAKDKGYVETLFHRRRSLPDINSRNFNIRQFAERTAINSPIQGSAADILKIAMINLDRVLDKGGYKSKMLLQVHDEIVLEVPNEEIGAIRELVTKTMESAISLSVPLIADENAGETWYEAK

SEQ ID NO: 3521 - DNA, 2640 bp, Streptococcus pyogenes
atggaaaacaagaataaattactattaattgatgggtcatctgttgcctttcgtgccttttttgccctctacaatcaaattgaccgctttaaaaaccatagcggtcttcataccaatgccatttatggctttcatttgatgctagaccacatgatgaagcgagtccagcccacacacgtgctggtggcttttgatgcgggcaaaaccaccttccggacagaaatgtatgccgattataaggcgggtcgcgctaaaaccccagaggaatttcgtgagcagtttccttatattcgtgagatgttgacagcccttgggattgcttattatgagttggaacactacgaagcagacgatattatcgggacgcttgataaaatggcggagcgcacagaagtgccttttgatgtgaccattgtcagtggtgataaagatttgatccagttaactgacgaaaataccgtggttgaaatttctaaaaaaggggtagccgaatttgaagaattcacaccggcttacctcatggaaaaaatgggattgacgccaaaccagtttattgacctcaaagccttgatgggagataaatcggataatattccaggagtgaccaaaatcggtgaaaaaactgggctcaagctccttcatgaatttggtagtttagaaggtatctacgagcatattgatggattcaagacctcaaaaatgaaagaaaacttgattaatgatcgtgaccaagctttcctatctaaaacgctcgccactatcaatacagcatctcctatcacaattggcttagatgatattgtctacaatggtccagatgttgctagtctctctcaattttacgatgagatggattttgtgcaactcaagaaaggtcttgctagccagatgcctcaagagccagtagctgtcatttcctatcaagaagtgaccaatgtgtctgctgatttgtttagcgcagaagacatcttctactttgaaacgcttcgggacaattaccatcgtgaggccatcattggttttgcttggggacatggtgagcagatttacgcatccacagaccttggcctattagcgacggatagttttaagcaggtcttccaaaaacccattgccacttatgattttaaacgtagcaaggtcttgttgagccacttaggaattgagttggtagcacctagctatgatgctagattagctaattaccttctgtcaactgtagaagacaatgagcttagcaccattgcccgcatttttactgacatctctttggaagaagacgatacagtctatggtaaaggtgctaaacgggctgttcctgataaagacgtcttactagaacacttagctcgtaaggtcaaagtattattagatagcaagtctcaaatgctagacaagctcactgcccatgagcaactagacctctatcagaatattgaattgcctttggctaatgtccttgctaaaatggaaattgaagggatcaaggttaatagggcgactttgcaagatatggcagagcaaaacaaggtcattattgaagcgctcacccaagagatttatgatatggctggccaagaatttaatatcaattcgcctaaacagttaggcagtatcttgtttgagaagatgcaactacctcttgagatgactaagaagaccaaaacaggttattctacagctgttaatgttttggaacgtttggcaccgattgctccaattgtggctaaaattttggattaccgccagattaccaaattacagtctacttatgtgattggtttacaggattatattctggctgatggcaagattcatacccgctatgtgcaggatctcacgcagacagggcgtttgtctagtgtggaccctaatcttcaaaacattcccattcgtttggaacaggggcgtttgattcgtaaggcctttaccccatctcatgaagatgccgtcttgttgagttcagattactcacagattgaattgcgggtactggcacatatttcaggggatgagcatttgattgctgcctttaatgaaggggcagacattcatacctcaacggctatgcgtgtgtttgggattgacagggcagcagatgttactgccaatgaccgccgtaatgccaaggctgttaactttggaattgtgtatgggatttctgattttggtttgtcaaataaccttggtatcacccgtaaacaggccaagtcttacattgatacctattttgaacgctatcctgggattaaagcctatatggaaaatgtggtgcgtgaggctaaagacaagggctatgtagagaccctctttaagcgtcgtcgtgaattaccggatatcaactctcgtaatttcaacgttcgctcttttgcggagcgtacagccatcaactcgcccattcaaggaagcgcagctgatattctcaaaatcgctatgattaatctggataaggccttgcaagcaggtggttttagagctaaaatgctgcttcaagtgcatgatgaaatcgttttggaagtgccaaatgatgagttgactgctataaaaaaacttgtcaaagacaccatggaagctgctgttgatttagctgttcctttatgtgtcgatgaaagtactgggcatagctggtacgaagccaaa

SEQ ID NO: 3522 - protein, 880 aa, Streptococcus pyogenes
MENKNKLLLIDGSSVAFRAFFALYNQIDRFKNHSGLHTNAIYGFHLMLDHMMKRVQPTHVLVAFDAGKTTFRTEMYADYKAGRAKTPEEFREQFPYIREMLTALGIAYYELEHYEADDIIGTLDKMAERTEVPFDVTIVSGDKDLIQLTDENTVVEISKKGVAEFEEFTPAYLMEKMGLTPNQFIDLKALMGDKSDNIPGVTKIGEKTGLKLLHEFGSLEGIYEHIDGFKTSKMKENLINDRDQAFLSKTLATINTASPITIGLDDIVYNGPDVASLSQFYDEMDFVQLKKGLASQMPQEPVAVISYQEVTNVSADLFSAEDIFYFETLRDNYHREAIIGFAWGHGEQIYASTDLGLLATDSFKQVFQKPIATYDFKRSKVLLSHLGIELVAPSYDARLANYLLSTVEDNELSTIARIFTDISLEEDDTVYGKGAKRAVPDKDVLLEHLARKVKVLLDSKSQMLDKLTAHEQLDLYQNIELPLANVLAKMEIEGIKVNRATLQDMAEQNKVIIEALTQEIYDMAGQEFNINSPKQLGSILFEKMQLPLEMTKKTKTGYSTAVNVLERLAPIAPIVAKILDYRQITKLQSTYVIGLQDYILADGKIHTRYVQDLTQTGRLSSVDPNLQNIPIRLEQGRLIRKAFTPSHEDAVLLSSDYSQIELRVLAHISGDEHLIAAFNEGADIHTSTAMRVFGIDRAADVTANDRRNAKAVNFGIVYGISDFGLSNNLGITRKQAKSYIDTYFERYPGIKAYMENVVREAKDKGYVETLFKRRRELPDINSRNFNVRSFAERTAINSPIQGSAADILKIAMINLDKALQAGGFRAKMLLQVHDEIVLEVPNDELTAIKKLVKDTMEAAVDLAVPLCVDESTGHSWYEAK

SEQ ID NO: 3523 - DNA, 468 bp, Streptococcus agalactiae
gtggacaacatacgtaaaggagtcattaatatggtttatcattttcaaaatccaagtgattttatgttaaaaaattatttaacaaaagcaaagaccatcgcagttgtaggactgtcagaccgtcaagaaactgcagcttatcaagtatcaaaaataatgcaagaagcaggttatcaaattattccagttaatcctaaaaatgcaggacagaaaatacttgggcaaatgacatatgcctcacttaaggatgtcactgaacatattgatattgttaatatttttcgacgtagcgagtatttacctgatattgcaagagaatttttagaagtagacgctgatattttctgggctcagcttggacttgaaagtcaagaagcagagacaattctaaagcaagcaggacacaaacagattgtcatgaataaatgtctgaaagttgaatgccaaaaattacactcagaaactaac

SEQ ID NO: 3524 - protein, 156 aa, Streptococcus agalactiae
MDNIRKGVINMVYHFQNPSDFMLKNYLTKAKTIAVVGLSDRQETAAYQVSKIMQEAGYQIIPVNPKNAGQKILGQMTYASLKDVTEHIDIVNIFRRSEYLPDIAREFLEVDADIFWAQLGLESQEAETILKQAGHKQIVMNKCLKVECQKLHSETN

SEQ ID NO: 3525 - DNA, 453 bp, Streptococcus pyogenes
gtgatttattcgtttcaaaatccctcagaggatgtcctaaaagcttacttggagtcagccaaaaccattgcggttgttggtctttctgaccgcaaagacacagcagcttatggtgtcgccaaatttatgcaggctatggattatcggatcattccagtcaatcccaaattagcaggtcagcttattttgggagagaaggtctatgccagtatcaaggcaattccctttgaggttgacattgtagatgtctttcgcagaagtgagtttttaccagaagttgccagagactttttagcaggtcaggccaaagtcttttgggcgcaattaggccttgaaaaccaagaagcacaaaccattttacggtcggcaggcaaagaggctattgtgatgaaccgctgcctaaaaatagactatttgcaattagtcgctaaaccagaatgcatcacaaatcat

SEQ ID NO: 3526 - protein, 151 aa, Streptococcus agalactiae
VIYSFQNPSEDVLKAYLESAKTIAVVGLSDRKDTAAYGVAKFMQAMDYRIIPVNPKLAGQLILGEKVYASIKAIPFEVDIVDVFRRSEFLPEVARDFLAGQAKVFWAQLGLENQEAQTILRSAGKEAIVMNRCLKIDYLQLVAKPECITNH

SEQ ID NO: 3527 - DNA, 495 bp, Streptococcus agalactiae
gtgctggaaaggagtcctatggacagtcattcacatggtcatagacctctcgatgcttatgaaaacgtcctagagcatctccgtgaaaaacgtattcgaattactgagactcgaaaagctattatttcctatatggttaatagtcgtgagcatccgagtgcagaaaagatttacaatgatttattaccagaatatcctaacatgagcttggcaacagtttacaataaccttaaggtccttgtggatgaggggtttgtgacagagctaaaactttgcaattatagtacaacttattatgattttatggggcatcagcacctaaacattgcctgtgaagattgtgggaaaatcgttgattttgtcgatgttgacttattggatatttctagagaagcacaccaacaaacaggttttgaagtgactagagttcagttagtagcttatggtatctgtccggagtgtcagaggaagcgtaaggataaatataaaaaagat

SEQ ID NO: 3528 - protein, 165 aa, Streptococcus agalactiae
MLERSPMDSHSHGHRPLDAYENVLEHLREKRIRITETRKAIISYMVNSREHPSAEKIYNDLLPEYPNMSLATVYNNLKVLVDEGFVTELKLCNYSTTYYDFMGHQHLNIACEDCGKIVDFVDVDLLDISREAHQQTGFEVTRVQLVAYGICPECQRKRKDKYKKD

SEQ ID NO: 3529 - DNA, 465 bp, Streptococcus pyogenes
atggacattcattcacatcagcaagccctagatgcctatgaaaatgtcctagagcatctacgggaaaaacatattcgaattacagagacacgtaaagccattatttcttacatgattcagtccacagaacaccctagtgccgataagatttaccgtgacttacagcctaactttcctaacatgagccttgccacagtctataataatttgaaagttttagttgatgaaggttttgtctcagaattgaaaatcagcaatgatttaaccacctactatgactttatgggccatcaacacgtcaatgtggtttgtgaaatatgtgggaagattgctgactttatggatgttgatgttatggatattgccaaagaagcccatgagcaaacaggttataaggtcacgcgtatcccagttattgcttacgggatttgtccggattgccaagcaaaagaccaacctgatttt

SEQ ID NO: 3530 - protein, 155 aa, Streptococcus pyogenes
MDIHSHQQALDAYENVLEHLREKHIRITETRKAIISYMIQSTEHPSADKIYRDLQPNFPNMSLATVYNNLKVLVDEGFVSELKISNDLTTYYDFMGHQHVNVVCEICGKIADFMDVDVMDIAKEAHEQTGYKVTRIPVIAYGICPDCQAKDQPDF

SEQ ID NO: 3531 - DNA, 1563 bp, Streptococcus agalactiae
atgaaaatatcacaatacaataaatggtcaattcgccgattgaaagttggagctgcatctgtaatgattgctagtggaagcattgttgctttagggcaatctcatattgtttcagcagatgagatgtcccaacctaaaacaaccattacagctccaacagctaacacttctacaaatgtagaaagtagtactgataaggcattatcaaaagttactacgatggagacaagttcagaaatgcctaaaatgcaaaatatggcaaaagttgaaaaaacgagtgacaaacctatgatggtggctacctctgttagaaaaatgatggcaacgccgacacctgtagcgatgaccaaaacgactagtgtagatgaggtaaagaaatcaactgatactgcttttaaacagacagtagacgttccggctcattatgttaatgcagcaaaagggaatggcccatttctagcaggtgtaaatcaaacgattccatatgaagcgtttggtggagatggcatgttaacgcgtttaatccttaaatcttctgaaggagcaaaatggtcagataatggtgttgataaaaatagtccattattaccattgaaaggcttaactaaaggtaaatatttctatcaagtttctttaaatggtaatacgacaggtaaagagggacaagctctcttagatcaaattaaagctaatgataaacatagctaccaagccacaattagagtttatggtgctaaagatggtaaagttgatttaaaaaacatgattagcccaaaaatggtaaccattaacattcctcacattacaactgatatggaagtaaaaaattctctaaagatggcctttaaagaaaaagtagacgtcccagcaaaatatgttagtgctgcaaaagctaaaggtccatttttagcaggtgttaacgaaacgattccatatgaagcgtttggtggggatggcatgttaacgcgtttaatccttaaagcttcagagggagcaaaatggtcagacaatggtgttgataaaaatagtccattattaccgttaaaagatttaactaagggtaaatacttctaccaagtctctcttaatggcaatacagccggtaaaaaaggccaagctctcttagatcaaattaaggcaaatggaagccatacttatcaagcaactatcactatttatggtacgaaagatggcaaagttgatatgaatactattttaggacaaaagacagtgatgattcatattaatgtcgctaaaaaagatatgaatagcacatcaatgatgatgaaaaaagataagatgacaatgcctatgaagaaagaaatgacttcatctaaaataaataccggtatgatgatgtctaacaacaagatgtcagctaatatgcaaatgtcatcacaagccaaatcaaatgataaagctggtaaaaaaatgtctatgatgtctaaaaatttacctaatacaggtgaaacaaagcaacaaaatgtaggtgtgctaggtatgcttagtctagcctttgcgacaggtctaactgcgctaggtcttaaaaaatctaaacaaaga

SEQ ID NO: 3532 - protein, 521 aa, Streptococcus agalactiae
MKISQYNKWSIRRLKVGAASVMIASGSIVALGQSHIVSADEMSQPKTTITAPTANTSTNVESSTDKALSKVTTMETSSEMPKMQNMAKVEKTSDKPMMVATSVRKMMATPTPVAMTKTTSVDEVKKSTDTAFKQTVDVPAHYVNAAKGNGPFLAGVNQTIPYEAFGGDGMLTRLILKSSEGAKWSDNGVDKNSPLLPLKGLTKGKYFYQVSLNGNTTGKEGQALLDQIKANDKHSYQATIRVYGAKDGKVDLKNMISPKMVTINIPHITTDMEVKNSLKMAFKEKVDVPAKYVSAAKAKGPFLAGVNETIPYEAFGGDGMLTRLILKASEGAKWSDNGVDKNSPLLPLKDLTKGKYFYQVSLNGNTAGKKGQALLDQIKANGSHTYQATITIYGTKDGKVDMNTILGQKTVMIHINVAKKDMNSTSMMMKKDKMTMPMKKEMTSSKINTGMMMSNNKMSANMQMSSQAKSNDKAGKKMSMMSKNLPNTGETKQQNVGVLGMLSLAFATGLTALGLKKSKQR

SEQ ID NO: 3533 - DNA, 684 bp, Streptococcus agalactiae
atgacacaaaaattattattagttgacgatgaatttgaaattattgatattaatagacgttatctagagcaagcaggatatgaagtgtcagtagctgcggatggcatagaagcactcaaagaggtagatgagaatcgttttgacctaattattagtgatattatgatgcctaaaatggatggctatgattttattagtgaagttctagttcgagaacccaaccaaccttttctctttataaccgctaaagtatctgaaccagataaaatttactctttgagtatgggtgcagatgactttatttccaagcctttcagtcctagggaattagttttacgtgttaaaaatattctaagacgtatctatgggaatcatcaacaatctgaagtgttgacgattggtgatttggttatcgaccaaaaacaacgtttggtaatggtggactgcaatacaatttccttaaccaataaatcatttgacttgctttggatattagcaaatcatttgaatcgtgttttttcaaaaacagagctttatgaacgtgtctggggcgaagaatttttagatgacactaatactttgaatgttcatatccatgccttacgcaatgaccttgctaaatttagtacagacaataccccaactatcaaaacagtttggggattagggtataaattagaggaa

SEQ ID NO: 3534 - protein, 228 aa, Streptococcus agalactiae
MTQKLLLVDDEFEIIDINRRYLEQAGYEVSVAADGIEALKEVDENRFDLIISDIMMPKMDGYDFISEVLVREPNQPFLFITAKVSEPDKIYSLSMGADDFISKPFSPRELVLRVKNILRRIYGNHQQSEVLTIGDLVIDQKQRLVMVDCNTISLTNKSFDLLWILANHLNRVFSKTELYERVWGEEFLDDTNTLNVHIHALRNDLAKFSTDNTPTIKTVWGLGYKLEE

SEQ ID NO: 3535 - DNA, 1035 bp, Streptococcus agalactiae
atgaaattaaaatattatattgttattggttaccttatttctatgttaataactgtagcaggtgttttctttgggcttaatcatatgctgattgagactcgaggtgtttactacatcctttcagttacaattattgcctgtattgtaggtggtatagttaatttgttcttattatcaagtgtatttacatctttgaaaaagttaaaacaaaaaatgaaggatatttctcaaagatgttttgatacaaaagcacaaatttgttcaccacaagaattcaaggatttagagacagcctttaaccaaatgtcttcggagttagagtcaacgtttaaatctctaaacgagagtgaacgcgaaaaaacaatgatgattgcacaactttcacatgatatcaagactccaattacttctatacaatcaacagtagaaggtattttagatggtattatatctgaagaagaagttaactattatctcaataccatttctcgtcaaacaaaccgtcttaaccatctggttgaagaattaagttttattacattagagactatgtcagacacggctgaacctcataaagaagaaacaatttatctggataaactactgattgatattttatctgaatttcaattggtgtttgaaaaagaaaatcgccaagtaatgattgatgttgcgccagatgtttcgaaattatctagtcaatatgataaattatcacgaattttattgaatttgattagcaatgcagtcaaatattctgatcctggaagtcccttgactatcaaggcctattcaaatcgtcaagatatcgttatcgatattattgaccaaggctatgggataaaagatgaagatcttgcttctatttttaatcgtctttatcgtgtagaatcttcacgaaatatgaagacaggaggacatggtctaggtctttatattgcgcgacaacttgcacatcaactgaatggggatattttggtcgaaagtcagtatcaaaaaggcagtaagttctctttagtacttaaattacaaaaa

SEQ ID NO: 3536 - protein, 345 aa, Streptococcus agalactiae
MKLKYYIVIGYLISMLITVAGVFFGLNHMLIETRGVYYILSVTIIACIVGGIVNLFLLSSVFTSLKKLKQKMKDISQRCFDTKAQICSPQEFKDLETAFNQMSSELESTFKSLNESEREKTMMIAQLSHDIKTPITSIQSTVEGILDGIISEEEVNYYLNTISRQTNRLNHLVEELSFITLETMSDTAEPHKEETIYLDKLLIDILSEFQLVFEKENRQVMIDVAPDVSKLSSQYDKLSRILLNLISNAVKYSDPGSPLTIKAYSNRQDIVIDIIDQGYGIKDEDLASIFNRLYRVESSRNMKTGGHGLGLYIARQLAHQLNGDILVESQYQKGSKFSLVLKLQK

SEQ ID NO: 3537 - DNA, 783 bp, Streptococcus agalactiae
atgtgttataatgaaatgaattgtacttttgtgtatggaggagatatgacgaattcagaaattaaaaatgaggcaaaaactatattaagcaatcttcaaggtaagaatcaactttttttactcccgattctccttagtattattacgttatatatatcattttattatcaatataataatatgacactacttgatttttttgtacctcttccagtttatttcttttacacactttttattatttcagtcagttttgtaatgttagatgtcgtcaaaaatcagaaactaaacgttagattctcggacaatacttatgtattttcaagccatattttctggaaattactctcagtacttgttctaaaaggactaattttatctttcttttatctactaagtacttttggtctactaatcatcatttcaagttttaggctacttttgagtggtaaccttatccttgcccctgttttaatagttgttagtagcctaattactactaaggcagttataaaactcgttcaacaatattactcctatagtatctcaactttagtattttacactcaattagaaagtggaaactatgagggaccgtctaaagtactggttgctagtcgagaactaatgaatggtaataaacttagactcttccttttagacttaagttttattggttggcagttccttacaatcttcagtttcggattagtctatatctatctccttccttaccaaactactgcgcgcttaatcttttatagaaacattacaaaaaatagc

SEQ ID NO: 3538 - protein, 261 aa, Streptococcus agalactiae
MCYNEMNCTFVYGGDMTNSEIKNEAKTILSNLQGKNQLFLLPILLSIITLYISFYYQYNNMTLLDFFVPLPVYFFYTLFIISVSFVMLDVVKNQKLNVRFSDNTYVFSSHIFWKLLSVLVLKGLILSFFYLLSTFGLLIIISSFRLLLSGNLILAPVLIVVSSLITTKAVIKLVQQYYSYSISTLVFYTQLESGNYEGPSKVLVASRELMNGNKLRLFLLDLSFIGWQFLTIFSFGLVYIYLLPYQTTARLIFYRNITKNS

SEQ ID NO: 3539 - DNA, 861 bp, Streptococcus pyogenes
atgtcaattaaagcaatcaaaggccaggctagagacacgttaaaaaatctctctggcaagtatttactatttttaattccaacccttctctttatgtttcatttcggtattgagattcatcaaggttacgtcctatctagtggtattgaagtctcgctagcggctagttatttcccattactactaggacttatccttagccttttcattttatcagcatcctttacgatgattgatgttgttaggcattttcgtcagaaagtttcttttgccgaatcaacaacagccttctcaaaagaattctttgggaacctgctggttttagcgatcactaagtggctattctttctcatctggtcactaatttggttttttggcctctttattttcctttccggactttcagcgtttttggtcaatgctaaatcaggtagctcaacagtcatttcactgatctttttactatttggagcagttttgtccttaattggttttggtatttatatcaaccgttattacgcttatagtctatcagaataccttctctacgatgaggttaaagaggggacttatctaggagctatagccgtcattgaaacaagtgtagctatgatgaaaggttataaatggaagctttttttcctacaacttagcttcaccggttggtttctactgaatattgttacttttgggttacttaatatctatcttttaccatattttacaacagccaatgtcattttttatgatcaactcaagaaacgtttcaaagacaaagatgacccaattgaaggagaacatttaagccttcatcagcttaataaaaatcctactcctatgatgtatgacgatcaaaaagac

SEQ ID NO: 3540 - protein, 287 aa, Streptococcus pyogenes
MSIKAIKGQARDTLKNLSGKYLLFLIPTLLFMFHFGIEIHQGYVLSSGIEVSLAASYFPLLLGLILSLFILSASFTMIDVVRHFRQKVSFAESTTAFSKEFFGNLLVLAITKWLFFLIWSLIWFFGLFIFLSGLSAFLVNAKSGSSTVISLIFLLFGAVLSLIGFGIYINRYYAYSLSEYLLYDEVKEGTYLGAIAVIETSVAMMKGYKWKLFFLQLSFTGWFLLNIVTFGLLNIYLLPYFTTANVIFYDQLKKRFKDKDDPIEGEHLSLHQLNKNPTPMMYDDQKD

SEQ ID NO: 3541 - DNA, 1173 bp, Streptococcus agalactiae
atgactgtttttcatggaagcaaggagaaaacgatgactgatcatccaataaaatatcgattaattaaacaggaaaaacacacaggagccagacttggtgaaataatcacaccacatggtacatttccgacaccaatgtttatgcctgttgggacacaagcaactgttaagacacaatctcctgaagaactaaaagaaatgggttcaggaattattctatcaaatacctaccatttatggttacgtccaggtgatgaattgattgctaaagctggaggtttacataaattcatgaactgggatcaggctattctaacagacagtggaggctttcaggtttattctttggctgatagtcgaaacatcactgaagaaggagtaacctttaaaaaccatttaaatggtgcgaaaatgtttttatcaccagaaaaagctatttcaattcaaaataaccttggttctgatattatgatgagttttgatgagtgtccacaattttaccagccttatgattatgtaaaaaaatcaattgagcgaacaagccgttgggcagaacgtggattaaatgcccaccgccgtcctcatgatcaaggactatttggtattgttcaaggggcagggtttgaggatttacgtcgtcaatcagcacgagatttagtatcgatggattttccaggttattcaattggagggcttgcggtcggagaaacacatgatgagatgaatgcagttcttgattttactgttccaatgcttccgaatgataagcctcgttatttgatgggagttggtgcaccagatagtttaatagacgccgttatccgaggagtagatatgtttgattgcgtcttacctactcgtattgctcgaaatgggacatgtatgacaagtcaaggtcgcttagttgttaagaatgctaaatttgcagaagattttacgcctcttgatccaaattgcgattgctatacttgtaaaaattatacacgcgcttatattcgtcacttattgaaagcagatgaaacttttggtattcgtttgactagttaccataatctttatttccttgtcaatcttatgaaagatgtcagacaagctattatggatgataatcttctagaattccgtcaagattttatggagcgctatggctatggcatgaataaccgtaatttt

SEQ ID NO: 3542 - protein, 391 aa, Streptococcus agalactiae
MTVFHGSKEKTMTDHPIKYRLIKQEKHTGARLGEIITPHGTFPTPMFMPVGTQATVKTQSPEELKEMGSGIILSNTYHLWLRPGDELIAKAGGLHKFMNWDQAILTDSGGFQVYSLADSRNITEEGVTFKNHLNGAKMFLSPEKAISIQNNLGSDIMMSFDECPQFYQPYDYVKKSIERTSRWAERGLNAHRRPHDQGLFGIVQGAGFEDLRRQSARDLVSMDFPGYSIGGLAVGETHDEMNAVLDFTVPMLPNDKPRYLMGVGAPDSLIDAVIRGVDMFDCVLPTRIARNGTCMTSQGRLVVKNAKFAEDFTPLDPNCDCYTCKNYTRAYIRHLLKADETFGIRLTSYHNLYFLVNLMKDVRQAIMDDNLLEFRQDFMERYGYGMNNRNF

SEQ ID NO: 3543 - DNA, 1140 bp, Streptococcus pyogenes
atgacagattatccgattaagtatcgccttatcaaagcagaaaagcacaccggtgcacgcttgggcgaaattatcacccctcacgggacctttccgacaccaatgtttatgccagtgggaactcaggctactgttaaaacacagtctccagaagagttaaaagcaattggatcagggattattttatcaaacacttatcacctctggttgcgtccaggagatgagttgattgctcgctctggtggtctgcacaagtttatgaactgggatcagccaatcttaaccgattcgggtggttttcaagtttactctttagccgattcacgaaacatcactgaagaaggagtgactttcaaaaatcacttgaatggctcaaaaatgtttctatcacccgaaaaagccatttccattcagaataaccttggctcagacatcatgatgagttttgacgagtgcccgcaattttaccaaccttatgattacgtgaaaaaatccattgaacgtactagccgttgggcagaacgtggcttgaaagcccatcgtcgtcctcatgaccaaggattatttggaattgtgcaaggagctggatttgaggaccttcgtcgtcagtctgcggcagatttggtggctatggatttcccaggttattctattggtggtttagctgttggggagagccatgaagaaatgaatgccgtccttgactttacgactcccctcttaccagaaaataaacctcgttacctgatgggagtgggagcaccagatagcttgattgatggtgtgattcgtggtgtcgatatgtttgactgtgtcttgccaacgcgtatcgcccgtaacggaacttgtatgactagtgaggggcgtcttgtgattaaaaatgccaaattcgctgaagattttaccccacttgatcatgactgtgactgctacacttgtcaaaactatagccgtgcctacattcgtcacttgctaaaagcggacgaaacttttggtattcgtttgacaagctaccacaacctttatttcttggttaacttgatgaaaaaagtacgtcaggctattatggacgataacttacttgaattccgccaagattttcttgaacggtatggttataataaatcaaaccgtaatttc

SEQ ID NO: 3544 - protein, 380 aa, Streptococcus pyogenes
MTDYPIKYRLIKAEKHTGARLGEIITPHGTFPTPMFMPVGTQATVKTQSPEELKAIGSGIILSNTYHLWLRPGDELIARSGGLHKFMNWDQPILTDSGGFQVYSLADSRNITEEGVTFKNHLNGSKMFLSPEKAISIQNNLGSDIMMSFDECPQFYQPYDYVKKSIERTSRWAERGLKAHRRPHDQGLFGIVQGAGFEDLRRQSAADLVAMDFPGYSIGGLAVGESHEEMNAVLDFTTPLLPENKPRYLMGVGAPDSLIDGVIRGVDMFDCVLPTRIARNGTCMTSEGRLVIKNAKFAEDFTPLDHDCDCYTCQNYSRAYIRHLLKADETFGIRLTSYHNLYFLVNLMKKVRQAIMDDNLLEFRQDFLERYGYNKSNRNF

SEQ ID NO: 3545 - DNA, 297 bp, Streptococcus agalactiae
  misc_feature (1)..(297): n = a, c, g, or t
atgatgcaagagtactttggtattggtcttgatagtagcagccgctgttaccactatcatactaaattggatattgtcgctttaaaatgtgctgtttgtcaaaaatattatgcttgttataaatgtcatgatgcactcgaggagcattgttttgcagcaacaaaatctgatgaaacgtttcctgtcttatgcggttcttgtcgtcagatgttgacattaaaagagtataaaactggtttttgtccttattgtcgtatgctttttaatccaaattgtcaacgccnnnnnttaattaat

SEQ ID NO: 3546 - protein, 99 aa, Streptococcus agalactiae
  MISC_FEATURE (1)..(99): Xaa = Any Amino Acid
MMQEYFGIGLDSSSRCYHYHTKLDIVALKCAVCQKYYACYKCHDALEEHCFAATKSDETFPVLCGSCRQMLTLKEYKTGFCPYCRMLFNPNCQRXXLIN

SEQ ID NO: 3547 - DNA, 309 bp, Streptococcus pyogenes
atgacggactgttttggaattgaccttgaccaagagtatcggtgcctacattatcataccccgcttgatattgttgggctcaaatgtgcttcttgtcagacttattatgcttgttaccattgccatgaccagttaacagatcatgcctttgtgccaacaggacatcaagaaacatctcctgttatttgtgggcattgtcgaaagctcttgagtcgagctgagtatggttgtggatgctgtccttattgtcaaagtccctttaatccagcctgtcataggcacaaggatatctattttttaaaggagtcg

SEQ ID NO: 3548 - protein, 103 aa, Streptococcus pyogenes
MTDCFGIDLDQEYRCLHYHTPLDIVGLKCASCQTYYACYHCHDQLTDHAFVPTGHQETSPVICGHCRKLLSRAEYGCGCCPYCQSPFNPACHRHKDIYFLKES

SEQ ID NO: 3549 - DNA, 972 bp, Streptococcus agalactiae
atggattttttatacaaaggaggaatcgccatgaagcaaatgtttctttcaacggcaattgaatttaaagaaattgaaacattcgagccaggtgcttggataaatctggttaatccctcccaggaagaatccgaacaagtagctgatcaatttggtattgatattgatgatttacgtgctcccctcgatgtggaagaaacttcccgtatctcggttgaagatgattatactttagttattgttgacgttcctacctatgaagaacgcaataacaaaagttattatatgactattcctatgggcattatcgttactgacaacgctgttattactacttgcctagaacatttgacgctgtttgatcacttttatagacgacgtgtcaaaaatttttatacctttatgaagacacgttttgttttccaattgctttatcgcaatgccgaattatacttacaggctttgcgtactatcgataggcagagcgataaaattgaagcacaactagagagtgcaactcgaaatgagcaattgatcgatatgatggaattggaaaaatctattgtctatctaaaggcctctttaaaatttaatgagcgaatcgtcaaaaaattgaccagtagtaccagtagtttaaaaaaatacattgaagatgaagatctgcttgaagatacattgatcgaaactcagcaggctattgaaatggcaaatatctatgaaaatgtcttaaatgccatgacagaaacgactgcttcaatcatcggtaataatcagaataccattatgaaaaccttagccctagtaactatgacattggatattccaacggttattttttcggcgtatgggatgaactttcaaaataattggatgcctttgaatggtctcgcacatggctttatctatgttgttcttttggcctttttgatgagttcatttgttgtattttattttattcgtaaaaaatggttt

SEQ ID NO: 3550 - protein, 324 aa, Streptococcus agalactiae
MDFLYKGGIAMKQMFLSTAIEFKEIETFEPGAWINLVNPSQEESEQVADQFGIDIDDLRAPLDVEETSRISVEDDYTLVIVDVPTYEERNNKSYYMTIPMGIIVTDNAVITTCLEHLTLFDHFYRRRVKNFYTFMKTRFVFQLLYRNAELYLQALRTIDRQSDKIEAQLESATRNEQLIDMMELEKSIVYLKASLKFNERIVKKLTSSTSSLKKYIEDEDLLEDTLIETQQAIEMANIYENVLNAMTETTASIIGNNQNTIMKTLALVTMTLDIPTVIFSAYGMNFQNNWMPLNGLAHGFIYVVLLAFLMSSFVVFYFIRKKWF

SEQ ID NO: 3551 - DNA, 669 bp, Streptococcus agalactiae
atgactttacaagacttaactaaaaagaatcaagagtttgttcatattgcaactaatcaacttttagctgatggaaaatcagatgcagaaatcaaagctattttagaagaacatctcccagagattatagataatcagaaaaaaggaattaccgcacgctcactcttaggagcaccaactacttgggcagcctcattcactgagcgacctgaggataaagctagagtatctgtacaaaaaaataccaatccttggttgatgtggttagatacttccttactatttcttggcttagtaactgctttgaatggtttaatgttgctatttggtcaatctaatgtcaatacagggcttatttcaattttaactcttggttttggtggtggtgcggccatgtacgttacttattactatatttatcgccatatgggtaaaccaaaatctgaaagaccaggctggcttaaatctttcgcagtactggcactagttatgttagtttggtttgccttatttgcagtagtacctcttctacctgcaactattaatcctaaacttcctgaggttgttttgtttattattgctttagcatcgtttggtttgcgcttttatttacaacgtaaatataatattcaaagctcaatggcaccagtggcaccacaacaaagaaga

SEQ ID NO: 3552 - protein, 223 aa, Streptococcus agalactiae
MTLQDLTKKNQEFVHIATNQLLADGKSDAEIKAILEEHLPEIIDNQKKGITARSLLGAPTTWAASFTERPEDKARVSVQKNTNPWLMWLDTSLLFLGLVTALNGLMLLFGQSNVNTGLISILTLGFGGGAAMYVTYYYIYRHMGKPKSERPGWLKSFAVLALVMLVWFALFAVVPLLPATINPKLPEVVLFIIALASFGLRFYLQRKYNIQSSMAPVAPQQRR

SEQ ID NO: 3553 - DNA, 654 bp, Streptococcus pyogenes
atggaattacaagaacttaccaaaaaaaatcaagaatttatccacaccgctacgaacaaattaatccaagacggcaagtctgatgaggacattaagctgattctcgaagaagccattccagctattctcgaaaaccagaaaaaaggagtcaccgctcgaaatctattaggcactccgactgcttgggcagcttcttttagccaagaccctagtcaaaaagcagcagaaactgacaaaaacaccaatccttggttgatgtggctagatacctctttgctattcatcggaattgttgcccttttaaatggcatcatgaccttcttcaacacaaacgctacagttacaggattgatttccttactggcacttggttttggtggaggagcatccatgtacgctacttattactttatttaccgtcatctcggaaaagataagagccttcgtccaagttggttcaaaatcatcgcagccttatcattagccatgttgatttggattgccttgtactctgcaactgcctttttaccaacctctcttaacccacagttgcctcctcttgccttgctcattattggtggtgtttcccttgctttacgctattacctacaacgcaaatacaacattcaaaacactatgtcacctgttaacaaa

SEQ ID NO: 3554 - protein, 218 aa, Streptococcus pyogenes
MELQELTKKNQEFIHTATNKLIQDGKSDEDIKLILEEAIPAILENQKKGVTARNLLGTPTAWAASFSQDPSQKAAETDKNTNPWLMWLDTSLLFIGIVALLNGIMTFFNTNATVTGLISLLALGFGGGASMYATYYFIYRHLGKDKSLRPSWFKIIAALSLAMLIWIALYSATAFLPTSLNPQLPPLALLIIGGVSLALRYYLQRKYNIQNTMSPVNK

SEQ ID NO: 3555 - DNA, 99 bp, Streptococcus agalactiae
atgaaatttaaaactaaaaaaatactgactttattaaaatttgatataataagtcaacactattcaaaaaggagtgctgaggcacaacattatgcaaga

SEQ ID NO: 3556 - protein, 33 aa, Streptococcus agalactiae
MKFKTKKILTLLKFDIISQHYSKRSAEAQHYAR

SEQ ID NO: 3557 - DNA, 2844 bp, Streptococcus agalactiae
gtgctgaggcacaacattatgcaagataaattaatgataagaggagcaagagctcacaatttaaaaaatataagtgtcgacattccacgagacaagttagttgtcgttacgggactatcaggatcaggtaagtctagtttggcctttgacactatctatgcagaaggacaacgtcgttacgttgaaagtctttctgcttacgcgcgccaatttttgggaaatatggaaaagcctgatgtagattctattgatggccttagtccagctatttctattgatcagaaaacaacaagtaagaatcctcgctctactgttgggactgtaacagaaattaacgattatttacgtttgctttatgctcgtgttggaaccccatattgtatcaatggtcacggagccatcacagcatcttctgtagagcaaattgtggataaggtactagcgcttccagagcgaacaaagatgcaaattttagccccaattatacgtcgaaaaaaaggacaacacaaatcaacatttgagaaaatacaaaaagatggttacgttcgtgttcgtattgatggtgatattcacgatgttactgaggtgcctgaattatcaaaaagtaagatgcacaatattgatattgtagtagatcgattaattaataaagagggcattcgttcccgcttatttgattccgttgaagcggctctacgtttgtcggatggttatgtcgttattgatacaatggatggcaatgagttattgttttcagaacattattcttgtcctgaatgtggttttactgttcctgaattagagccacgccttttttcttttaatgctccctttggttcttgtccgacctgtgatggcttaggaattaagttagaagtagatatagatttggttattccagatagaagtaagacccttagagaaggggccttagttccttggaatccaatttcatcaaattattatccaacgatgctagagcaagctatgactcaatttggtgttgatatggatacgccatttgaaaaattaagcaaggcggagcaggacctagccctatatggttcaggcgaacgagagttccatttccattatattaacgattttggaggcgagagaaatattgatttgccttttgaaggggttgtcaataatattaatcgtcgttaccatgaaactaatagcgattacacacgcaatgttatgcgagaatatatgaacgagctaaaatgtaacacttgtcatggctatcgtctcaatgatcaagcactttgcgtaagagttgggggagaagaaggtcttaatattgggcaagtctcagatttatcgatagcagaccatttagaacttttagaaacattgcgtttatcttcaaatgaacaattaattgctcgaccaattatcaaagaaatccatgaccgtctaagtttcttaaataatgttggacttaattatttaaatctgtcacgttctgcaggaacactttccgggggcgagagtcaacgtattcgtttggctactcaaattgggtctaatttatcaggtgtcctttatgtacttgatgagccgtccattggacttcatcagcgagacaatgaccgtttgattgatagtcttaagaaaatgcgtgatttgggtaatacgcttattgttgttgaacatgatgaagatacaatgatggcagctgattggttaatcgatgtgggacctggcgctggtgcgtttggtggtgagattgtggcctctggtacaccgaagcaagtagctaaaaatactaaatctattacaggacaatatttgtcaggtaagaaagtgattcctgtgccatctgaacgaagagtaggtaatggtcgctttttagaaatcaaaggtgcggcagaaaacaacctacaaaatttagatgtcaagttccctctcggtaaatttattgccgtaactggtgtctcaggttctggaaaatcaaccttaattaatagtattttgaaaaaagctgttgcgcagaagcttaaccgtaactcagataaaccaggtaaatatgtttctttagaaggcattgaatatgttgatcgattgattgatattgatcaaagtccaattggtcggactccacgttctaatcccgcaacctatacaggtgtttttgatgatattcgtgatctttttgctcaaactaatgaggcaaagattcgaggttataaaaaaggacgcttctcatttaacgtcaaaggtggacgttgtgagtcttgttctggcgatggtatcatcaaaattgagatgcattttttaccagatgtctacgttccttgtgaagtatgccacggcacgcgctataatagtgagactctggaagtacattacaaagaaaaaaatattgcacaaattcttgatatgacagtgaatgatgcagttacattttttgcagctattcctaaaattgctcgtaagttacagactattaaggatgttggtttgggatatgtcactttggggcaaccagctacaaccttatcaggaggagaagctcagcgaatgaagctggcaagtgaattacataagcgttcgacaggtaagagtctttacatattagacgaaccaacaacggggcttcatgcagatgatattgctcgtttacttaaggttttggatcgttttgtagatgatggtaatacagtgcttgttattgagcataaccttgatgttattaaaactgctgaccacattattgatcttggccctgaaggaggtattggtggcggacaaattgtagctatcggaacaccagaagaagttgctgaaaatcctaaatcctatacaggatattatttaaaagagaagttagcaaga

SEQ ID NO: 3558 - protein, 948 aa, Streptococcus agalactiae
MLRHNIMQDKLMIRGARAHNLKNISVDIPRDKLVVVTGLSGSGKSSLAFDTIYAEGQRRYVESLSAYARQFLGNMEKPDVDSIDGLSPAISIDQKTTSKNPRSTVGTVTEINDYLRLLYARVGTPYCINGHGAITASSVEQIVDKVLALPERTKMQILAPIIRRKKGQHKSTFEKIQKDGYVRVRIDGDIHDVTEVPELSKSKMHNIDIVVDRLINKEGIRSRLFDSVEAALRLSDGYVVIDTMDGNELLFSEHYSCPECGFTVPELEPRLFSFNAPFGSCPTCDGLGIKLEVDIDLVIPDRSKTLREGALVPWNPISSNYYPTMLEQAMTQFGVDMDTPFEKLSKAEQDLALYGSGEREFHFHYINDFGGERNIDLPFEGVVNNINRRYHETNSDYTRNVMREYMNELKCNTCHGYRLNDQALCVRVGGEEGLNIGQVSDLSIADHLELLETLRLSSNEQLIARPIIKEIHDRLSFLNNVGLNYLNLSRSAGTLSGGESQRIRLATQIGSNLSGVLYVLDEPSIGLHQRDNDRLIDSLKKMRDLGNTLIVVEHDEDTMMAADWLIDVGPGAGAFGGEIVASGTPKQVAKNTKSITGQYLSGKKVIPVPSERRVGNGRFLEIKGAAENNLQNLDVKFPLGKFIAVTGVSGSGKSTLINSILKKAVAQKLNRNSDKPGKYVSLEGIEYVDRLIDIDQSPIGRTPRSNPATYTGVFDDIRDLFAQTNEAKIRGYKKGRFSFNVKGGRCESCSGDGIIKIEMHFLPDVYVPCEVCHGTRYNSETLEVHYKEKNIAQILDMTVNDAVTFFAAIPKIARKLQTIKDVGLGYVTLGQPATTLSGGEAQRMKLASELHKRSTGKSLYILDEPTTGLHADDIARLLKVLDRFVDDGNTVLVIEHNLDVIKTADHIIDLGPEGGIGGGQIVAIGTPEEVAENPKSYTGYYLKEKLAR

SEQ ID NO: 3559 - DNA, 2856 bp, Streptococcus pyogenes
atgaggagggtgcctttaggcacattcaagatgcaaaataaaataataattcatggggcaagagcccacaatttaaaaaatattgacgtggaaattccacgagacaaattagttgtcgtgacagggttatcagggtcaggaaaatctagtctagcctttgatactatttatgcggaagggcaacgtcgttacgtagaaagtttatcagcttatgctagacagttcttgggtaatatggaaaaaccagatgtggattccattgacggtcttagccctgctatttccattgaccaaaaaaccaccagtaagaaccctcgctcaacggttggtacggttacggaaatcaatgattatttacgtctactatatgcgcgtgtgggcacaccttactgtatcaatgggcatggtgctatcacggcgtcttctgcagaacaaattgtagagcaggtcttagccctccctgaacggacacgcatgcagattttagctcctgttgttcgtcggaagaaggggcaacacaaaacagtttttgagaaaattcaaaaagacggctatgtccgtgtgcgcgttgacggggatatttttgacgtgacagaagtgccagagttgtccaaaagtaagatgcacaacattgaggtggttattgaccgtctggttaataaggatggtattcgtagccgtttatttgattcggttgaagcagctttaaggctgggagatggctaccttatgattgacactatggatggcaatgaactgctcttttctgagcattattcctgtcctgtctgtggatttacggttcctgaattagaaccaagactcttctcttttaatgcgccgttcggctcttgtccgacctgtgatgggctaggcattaagttggaagtggatttggacttggttgttcctgacccaagtaagtctttgagagagggagctttggcgccttggaatcctatttcctccaattattacccaaccatgcttgagcaagctatggcaagttttggggtggatatggatacaccttttgaggccttgactgaggaagaaagagatttagtgctttatggttcaggtgatagagaatttcattttcactatgtgaatgattttggtggtgagcgtaacattgacattccttttgaaggtgttgtaactaatgttaatcgccgttatcacgaaactaatagtgattatacgcgcaatgtgatgcgtggttatatgaacgaattgacctgtgcgacttgtcatggttaccgtttgaatgaccaagctttgtgtgtgcatgtgggtggcgaagaaggaactcatattggtcaaatttcagaattatcgattgccgaccacttgcagttattggaagaattggaactcacagaaaatgaaagtaccattgctaaaccgattgtcaaagaaatccatgaccgtctgacattcttaaataatgtgggactgaattatctgaccttgtcacgggctgctgggactttatcaggtggtgaaagtcaacgaatcaggttagcaacacaaattggttctaacctatcaggggtgctctatatcttggatgagccttctattggattgcatcaaagagacaatgaccgtttgatcgagagcctgaaaaaaatgcgtgatttgggtaatacgttaattgtggtagaacacgatgaagacaccatgatgcaggcagactggctgattgatgtgggaccgggggcaggtgagttcggtggagaaattactgcctctggaacgccgaaacaagtggctaagaataaaaaatccatcacgggtcaatatttgtctggtaaaaaattcattccagtgcctttagagcgccgttctggtaatggccgattcattgaaataaaaggagcagcgcagaataatcttcaaagcctcgacgtgagattcccactgggtaaatttattgcggtcacaggggtatcaggctcagggaaatcaaccttggttaatagtattttgaaaaaggctgtcgcccaaaaattaaaccgtaatgctgataagcctggtaaatatcactctatttctggtattgaacatattgaacgcttgattgacattgaccaaagtccgattggaaggacgccacggtcaaatccagccacctatacgggtgtctttgatgatattcgagacttgtttgcccaaaccaacgaagctaagattcgtggttacaaaaaaggccgtttctcttttaatgtcaaaggtgggcgttgtgaggcttgttcaggtgatgggattatcaaaatcgaaatgcactttttgccagatgtttatgtgccttgtgaggtttgccacggcagacggtataattctgagacgcttgaggtgcattacaaaggaaaaaatatcgcagaagtccttgatatgactgtcgatgatgccttggtatttttctctgctattcctaaaatcgctcgaaaaattcaaacgattaaggatgttggacttggttatgtgaccttaggtcaaccagctaccaccctctctgggggagaagctcaacggatgaagttggctagtgaattgcacaaacgctcgacaggtaagagcttgtatatcctagatgagccaacgactggtttacacacagatgatattgcaaggctattaaaagttttggaacgctttgtagacgatggtaatacggttcttgtgattgagcataatttggacgttatcaaatctgctgaccatattattgacttaggaccagaaggtggtgacggaggtggtcagattgttgccacggggacaccagaagaggtagctcaagttaaagaaagctatactggtcattatttgaaagtaaaactacaacaa

SEQ ID NO: 3560 - protein, 952 aa, Streptococcus pyogenes
MRRVPLGTFKMQNKIIIHGARAHNLKNIDVEIPRDKLVVVTGLSGSGKSSLAFDTIYAEGQRRYVESLSAYARQFLGNMEKPDVDSIDGLSPAISIDQKTTSKNPRSTVGTVTEINDYLRLLYARVGTPYCINGHGAITASSAEQIVEQVLALPERTRMQILAPVVRRKKGQHKTVFEKIQKDGYVRVRVDGDIFDVTEVPELSKSKMHNIEVVIDRLVNKDGIRSRLFDSVEAALRLGDGYLMIDTMDGNELLFSEHYSCPVCGFTVPELEPRLFSFNAPFGSCPTCDGLGIKLEVDLDLVVPDPSKSLREGALAPWNPISSNYYPTMLEQAMASFGVDMDTPFEALTEEERDLVLYGSGDREFHFHYVNDFGGERNIDIPFEGVVTNVNRRYHETNSDYTRNVMRGYMNELTCATCHGYRLNDQALCVHVGGEEGTHIGQISELSIADHLQLLEELELTENESTIAKPIVKEIHDRLTFLNNVGLNYLTLSRAAGTLSGGESQRIRLATQIGSNLSGVLYILDEPSIGLHQRDNDRLIESLKKMRDLGNTLIVVEHDEDTMMQADWLIDVGPGAGEFGGEITASGTPKQVAKNKKSITGQYLSGKKFIPVPLERRSGNGRFIEIKGAAQNNLQSLDVRFPLGKFIAVTGVSGSGKSTLVNSILKKAVAQKLNRNADKPGKYHSISGIEHIERLIDIDQSPIGRTPRSNPATYTGVFDDIRDLFAQTNEAKIRGYKKGRFSFNVKGGRCEACSGDGIIKIEMHFLPDVYVPCEVCHGRRYNSETLEVHYKGKNIAEVLDMTVDDALVFFSAIPKIARKIQTIKDVGLGYVTLGQPATTLSGGEAQRMKLASELHKRSTGKSLYILDEPTTGLHTDDIARLLKVLERFVDDGNTVLVIEHNLDVIKSADHIIDLGPEGGDGGGQIVATGTPEEVAQVKESYTGHYLKVKLQQ

SEQ ID NO: 3561 - DNA, 1497 bp, Streptococcus agalactiae
atgactacaaaagcaaaacatgatattcatggcaaaccatataatcgtacagccatgatcaccttattgttgattgctacatttgcaggggtattaaatcagacaagtttgggaacggctatcccaactttgatgaatagctttaacatttcgttgtcaacggctcaacaagcaacaacatggtttttattagcgaatgggattatgattcctgtttcagcttatttagcgacacgtttttcaacaaaatggttgtatgtgacatcctacgttgttttacttattggactgttaatgacgacgttagcacctacatctaactggaacctttttttagtaggacgtattattcaagcgatttctgtagggatttctatgcctttgatgcaggttgttatggtgaatgtttttcctccagagcagcgtggtgccgctatgggacttaatggtttggtggttggtcttgccccagctattgggcctacattagcagggtggattttaaaacaagaatttcattttgcagggcatgatttaacatggcgtgcaattttccttcttcctttactaattttaacggtcactacaattttatccccctttgttctaaaagatgtggttgataataagtcagttaaattggaagtgccttcccttatcctttcaataattggctttggtagctttttgtggggcttcacaaatgtggcaacttatggatggggagatattggatatgttatttctcctattatggttggtattatttttatcgccttattcattcatcgtcaattaaaactagaaacaccgttcttagatatccgtgttttcaaaaataaacaattctcagtaacaacagcagctattgcactttcaatgatggcgatgatgggtgttgaaatgatgctaccgctttacttgcaaaatgttcatggtctctctgcacttgattctggtttagctttattaccaggtgccttgatgatggggatagttagtccaatttctggagctgtatatgataaagttggtgcaagacgtatggctatgattggttttaccatactaggtgtagcgacgttaccttttgttttcttaacgactacaacaccagatcattttattaccctcttatatgcagtacgtatgtttggtattgctatggttatgatgccattgacagcaagtgcgatgagcgcacttccaccacatgaggccgcacatggaacagcagctaataatactgctcgtcaaattgcttcagcagttgtagttgcattgctttcaagtgttgctcaaaatattatcaccaacaataaaccatcaaaagatttgctaacaatgaatcctttaaaatatgcaaatcagatgttgaatgctagtcttgatggcttccatgtttcttttgccattggttttgtatttgcggttcttggtttactggtatctcttttcctgagaaaagggaaaattattgagacggaaaaggaggta

SEQ ID NO: 3562 - protein, 499 aa, Streptococcus agalactiae
MTTKAKHDIHGKPYNRTAMITLLLIATFAGVLNQTSLGTAIPTLMNSFNISLSTAQQATTWFLLANGIMIPVSAYLATRFSTKWLYVTSYVVLLIGLLMTTLAPTSNWNLFLVGRIIQAISVGISMPLMQVVMVNVFPPEQRGAAMGLNGLVVGLAPAIGPTLAGWILKQEFHFAGHDLTWRAIFLLPLLILTVTTILSPFVLKDVVDNKSVKLEVPSLILSIIGFGSFLWGFTNVATYGWGDIGYVISPIMVGIIFIALFIHRQLKLETPFLDIRVFKNKQFSVTTAAIALSMMAMMGVEMMLPLYLQNVHGLSALDSGLALLPGALMMGIVSPISGAVYDKVGARRMAMIGFTILGVATLPFVFLTTTTPDHFITLLYAVRMFGIAMVMMPLTASAMSALPPHEAAHGTAANNTARQIASAVVVALLSSVAQNIITNNKPSKDLLTMNPLKYANQMLNASLDGFHVSFAIGFVFAVLGLLVSLFLRKGKIIETEKEV

SEQ ID NO: 3563 - DNA, 738 bp, Streptococcus agalactiae
ttgagacggaaaaggaggtatagcatgattattttgattattgcactggcaactattttgacatttgtcacatggatgttgattcgtccaaaagctctacggtatattctaggtcttctctcattagctttgttgtttgcctcagtttggatgttaacggatcactttattaatcatacaggtatgactattgaaactaagacaaagacacgtgagatttatagtgcgggtgatagtaaggctccatttggtctcatgatttataaagagattggtactcattcgagtaataatgttttagtttatcgaacagatttaaatcaaaaagaagcaaaagctcactttgttccaaatacaaaagaagtgacaagtgctgtgaaaaaatctgctagctaccaattagctgatgtgaaaaaagccacagtaacaacaaagactaaacgttatgtgtggaaagatagtctttcgaaactactttatggctttgcaggtgaaaatggagaattgatttctcagaaatcagttgctaaaataccacgaaaaacttggctagttttgactaaagagcagtccgaacacttagaatcggctgcggctaaactaaaagaacaaatgacttcgcaagcaaaagtaaacccagtgaaagctatggagataaagacattagctaagacaaatccagaagcttatgctgagatgcaagttaaagcattaaaagaagctcttaatataaaagaa

SEQ ID NO: 3564 - protein, 246 aa, Streptococcus agalactiae
MRRKRRYSMIILIIALATILTFVTWMLIRPKALRYILGLLSLALLFASVWMLTDHFINHTGMTIETKTKTREIYSAGDSKAPFGLMIYKEIGTHSSNNVLVYRTDLNQKEAKAHFVPNTKEVTSAVKKSASYQLADVKKATVTTKTKRYVWKDSLSKLLYGFAGENGELISQKSVAKIPRKTWLVLTKEQSEHLESAAAKLKEQMTSQAKVNPVKAMEIKTLAKTNPEAYAEMQVKALKEALNIKE

SEQ ID NO: 3565 - DNA, 399 bp, Streptococcus agalactiae
atgggttttgaacaacgtctaactagatgtcaaacagcaatttcacaattatcatgtgacgcactcttaataacaaatttaacaaatattttttatttgactggtttttcaggaactaatgcaacggtactcattagtccaaaacaccggatttttgttacagattcacgatatgccttgatagcaaagaatactgtaagagagtttgatattatcattagcagagaaccacttgcggctattttgaaaattattcgcgatgacgcattgatagcgattggttttgaaactgatatttcttatcatatgtacaaacatatggtggaagtttttgaagattatcgcttgatagaagctccatctgttgttgaaaagttacgtatgattaaagatgtaaca

SEQ ID NO: 3566 - protein, 133 aa, Streptococcus agalactiae
MGFEQRLTRCQTAISQLSCDALLITNLTNIFYLTGFSGTNATVLISPKHRIFVTDSRYALIAKNTVREFDIIISREPLAAILKIIRDDALIAIGFETDISYHMYKHMVEVFEDYRLIEAPSVVEKLRMIKDVT

SEQ ID NO: 3567 - DNA, 1110 bp, Streptococcus pyogenes
atgctacaatattctcaaaagttaccaaaggagttcgcgatgtcaggatttttagaacaacgattaggtcactgcctaaggcagatggcagagaaggggctagaggctcttctagtcacccatttaaccaatagttattacttgacaggtttttctggaactgcagcaactgttttgataacggccaaacgtcgtgttttgatcacagattcacgttataccttgcttgctaaagctagtgttgagggatttgatattatcgaaagccgcacgccgcttaaggttgtggcagaattgttagaggctgatcaaatagattgccttggttttgaggaccaggtatcgttttctttttaccaggccatgcaagcagaactgtcaggaataaccttgcttgctcagtcaggttttgtggagcatttacgtcttattaaggacgcctctgaaatcgataccattgctaaagcgtgctcgatctcagacaaagcatttgaagatgctcttgattttattaaaccagggacaaccactgaacgtgacctggctaattttttagattttcgtatgcgtcagtatggtgccagcggcacatcatttgatatcattgtagcttcaggctatctctctgccatgcctcatggacgcgccagtgacaaggttatccagaataaagagagcttgaccatggactttgggtgttactacaatcactatgttagtgatatgacgaggaccattcatattggccaagttactgatgaagaacgtgagatttatgctcttgttcttgctgctaataaggctttaattgctaaagctagcgctggcatgacttatagtgactttgacggtattccgcgccaactcatcactgaggcgggttatggcagtcgcttcacacatggcattggtcatggcatcgggcttgacatccatgagaatccattttttgggaaatctgagcaacttctccaagctggaatggtggtaacagatgagccaggtatctatttggataacaaatatggtgtccgtattgaagatgacttggttatcacaaaaactggttgtcaagtcttgaccttggcacccaaagaattaattgtattg

SEQ ID NO: 3568 - protein, 370 aa, Streptococcus pyogenes
MLQYSQKLPKEFAMSGFLEQRLGHCLRQMAEKGLEALLVTHLTNSYYLTGFSGTAATVLITAKRRVLITDSRYTLLAKASVEGFDIIESRTPLKVVAELLEADQIDCLGFEDQVSFSFYQAMQAELSGITLLAQSGFVEHLRLIKDASEIDTIAKACSISDKAFEDALDFIKPGTTTERDLANFLDFRMRQYGASGTSFDIIVASGYLSAMPHGRASDKVIQNKESLTMDFGCYYNHYVSDMTRTIHIGQVTDEEREIYALVLAANKALIAKASAGMTYSDFDGIPRQLITEAGYGSRFTHGIGHGIGLDIHENPFFGKSEQLLQAGMVVTDEPGIYLDNKYGVRIEDDLVITKTGCQVLTLAPKELIVL

SEQ ID NO: 3569 - DNA, 612 bp, Streptococcus agalactiae
gtgttggattttataaagcctgatcgaacaactgaattgcaagttgctaattttttagactttcgcatgagagaattaggagcaactggtccttcatttgattttattgtagcatctggatatcgatcagcgatgccacatggggttgcgagtcagaagactattcaatcgggagaaactctgactttagattttggttgttactatcagcactatgttagtgatatgacacgtacgattcatatcggtcatgtcactgatcaggaacgcgagatttacgatatcgttttgaaaagtaatcaagctattattggtaatgtaaaatcaggaatgaagcgttgtgattatgattacttggcgcgacaagtcattgaaaattctggatacggtaatcattttacccacggtatagggcatggtatggggcttgatgttcatgaaattccttattttggtaagtcagagggagtgattgcatctgggatggtagtgactgacgagccaggaatatatctcgataataaatacggtgttcgtattgaagatgatttattaataacggaaacaggttgcgaagtattgacatctgcacctaaagaattaattgtactt

SEQ ID NO: 3570 - protein, 204 aa, Streptococcus agalactiae
MLDFIKPDRTTELQVANFLDFRMRELGATGPSFDFIVASGYRSAMPHGVASQKTIQSGETLTLDFGCYYQHYVSDMTRTIHIGHVTDQEREIYDIVLKSNQAIIGNVKSGMKRCDYDYLARQVIENSGYGNHFTHGIGHGMGLDVHEIPYFGKSEGVIASGMVVTDEPGIYLDNKYGVRIEDDLLITETGCEVLTSAPKELIVL

SEQ ID NO: 3571 - DNA, 450 bp, Streptococcus agalactiae
atgaatagactttcttgggaagattattttatggcaaatgcagagttgatttctaaacgttctacctgtgaccgtgcttttgttggagctgttttagtcaaaaataatcgcatcattgctacaggttataacggaggagtctctgagacagataactgtaacgaagtgggacattatatggaagatggtcactgtattaggactgttcatgctgagatgaatgcccttattcagtgtgctaaagaaggtatttctactaataatacagaaatttatgtgacgcattttccttgtatcaattgcaccaaggcgctcttgcaagccggggttaagaaaattacttataaagctaattatcgcccacacccatttgctattgaacttatggaagcaaaaggagttgcttatgttcaacatgatgttccagaggtaacactagggatggaagag

SEQ ID NO: 3572 - protein, 150 aa, Streptococcus agalactiae
MNRLSWEDYFMANAELISKRSTCDRAFVGAVLVKNNRIIATGYNGGVSETDNCNEVGHYMEDGHCIRTVHAEMNALIQCAKEGISTNNTEIYVTHFPCINCTKALLQAGVKKITYKANYRPHPFAIELMEAKGVAYVQHDVPEVTLGMEE

SEQ ID NO: 3573 - DNA, 504 bp, Streptococcus pyogenes
ttgtattgtaaaagaatggttcaggaaaggattaggggagaagcaatgacaaatcgtttatcatggcaagactattttatggccaatgcagagctgatttccaagcgctctacctgtgatcgcgcctttgtgggagctgttttggtaaaggataaccgcattattgccacaggttacaatggcggagtttctgctacggataactgcaacgaagcgggtcattatatggaagacggacattgtattcgcactgttcatgctgaaatgaatgctttgattcaatgtgcgaaagaaggaatttcaacggacggaactgaaatttacgtgactcattttccttgtattaactgcactaaggcgcttttgcaggcggggattacaaagattacctataaagcacattaccgtccgcacccctttgccattgaactgatggagaaaaaaggggttgcctatgtgcaacatgatgtgcctcaaattgttttaggaggcgataaggaacaa

SEQ ID NO: 3574 - protein, 168 aa, Streptococcus pyogenes
LYCKRMVQERIRGEAMTNRLSWQDYFMANAELISKRSTCDRAFVGAVLVKDNRIIATGYNGGVSATDNCNEAGHYMEDGHCIRTVHAEMNALIQCAKEGISTDGTEIYVTHFPCINCTKALLQAGITKITYKAHYRPHPFAIELMEKKGVAYVQHDVPQIVLGGDKEQ

SEQ ID NO: 3575 - DNA, 162 bp, Streptococcus agalactiae
ttgttgctgacctcaatagatgtaaatccagtttatgctaatatggcatttgattgggtgtatgataactataaagatgatatcatcaattatggacaagaaactatcaaaaatattggtaaatccatttcagctaataatagtttaggtactttatataat

SEQ ID NO: 3576 - protein, 54 aa, Streptococcus agalactiae
MLLTSIDVNPVYANMAFDWVYDNYKDDIINYGQETIKNIGKSISANNSLGTLYN

SEQ ID NO: 3577 - DNA, 168 bp, Streptococcus agalactiae
ttgaataagatattagcaattggtactgaaattgcacctgtgataggagcagttgcttcgattggtgtaaaagcattgtataataattctaaatcatttagaaatgttataagtagtacaggaaatgtaattaacaatattgataaacattttacaaaaataaatagt

SEQ ID NO: 3578 - protein, 56 aa, Streptococcus agalactiae
MNKILAIGTEIAPVIGAVASIGVKALYNNSKSFRNVISSTGNVINNIDKHFTKINS

SEQ ID NO: 3579 - DNA, 297 bp, Streptococcus agalactiae
atgttattaccagtagggagtgttgtctatcttattgatggcaatcaaaaattagttattgtaaatagaggtgcaattgttgagcaagaaggacaagaagtttattttgattacctaggtggaatttttcctgagggtttaaatcttgaacaagtttactattttaatcaagaagatattgatgaggttgtttttgaaggttaccatgatgaggaggaagaaagagtttctcgtctcattgaaaaatggaaaaatacagagggaaagaatcttccaaagggaaagactagtgtagaa

SEQ ID NO: 3580 - protein, 99 aa, Streptococcus agalactiae
MLLPVGSVVYLIDGNQKLVIVNRGAIVEQEGQEVYFDYLGGIFPEGLNLEQVYYFNQEDIDEVVFEGYHDEEEERVSRLIEKWKNTEGKNLPKGKTSVE

SEQ ID NO: 3581 - DNA, 144 bp, Streptococcus agalactiae
gtgaatatgctattgatagatgtcatgatacacttatcagaagaaaacgaaaagggctttactaaattacaattctttactcgacaaattgtggttggtgtaaactggtatgtacttcccaaaattgataactatttcaacccc

SEQ ID NO: 3582 - protein, 48 aa, Streptococcus agalactiae
MNMLLIDVMIHLSEENEKGFTKLQFFTRQIVVGVNWYVLPKIDNYFNP

SEQ ID NO: 3583 - DNA, 558 bp, Streptococcus agalactiae
atgattgaagcaagtaagcttaaagcaggcatgacttttgaaacggctgatgggaaattaatccgtgttcttgaagctagccaccacaaaccaggtaaaggtaacacaatcatgcgtatgaaattgcgtgatgttcgtactggttcaacttttgatacaagttaccgtcctgaagaaaaatttgagcaagctattattgaaactgtacctgctcaatacctttataagatggatgatacagcttacttcatgaataatgaaacttacgatcaatatgaaattccaactgttaacattgaaaatgaattactctacattcttgaaaactcagaagtaaaaattcaattctatggaacagaagttattggtgttcaaattccaacaactgttgaattgacagttgctgaaactcaaccatcaatcaaaggtgctactgtaactggttcaggaaaacctgcaactatggaaacaggacttgttgttaacgttccagattttattgaagctggacaaaagttagtaatcaatacagcagaaggaacttacgtttcacgcgcc

SEQ ID NO: 3584 - protein, 186 aa, Streptococcus agalactiae
MIEASKLKAGMTFETADGKLIRVLEASHHKPGKGNTIMRMKLRDVRTGSTFDTSYRPEEKFEQAIIETVPAQYLYKMDDTAYFMNNETYDQYEIPTVNIENELLYILENSEVKIQFYGTEVIGVQIPTTVELTVAETQPSIKGATVTGSGKPATMETGLVVNVPDFIEAGQKLVINTAEGTYVSRA

SEQ ID NO: 3585 - DNA, 555 bp, Streptococcus pyogenes
atgattgaagcaagtaagcttaaagcaggtatgacatttgaagcagaaggaaaattaatccgtgtccttgaagctagccaccacaaaccaggtaaaggaaacactatcatgcgtatgaaactacgtgatgtgcgtacaggttctacttttgacacaacttaccgcccagatgaaaaatttgagcaagccatcattgaaactgtcccagcacaatacctatacaaaatggatgacactgcttacttcatgaacactgacacttatgatcagtacgaaattccagttgctaacgttgagcaagaattgctttacattcttgaaaactcagacgtgaaaatccaattttatggaagtgaagtgattggggtaacggttccaacaactgttgaattgaccgttgcggaaacacaaccatctattaaaggagcgacagtgacgggttcagggaaacctgcaactcttgagacaggacttgttgttaacgttccagactttatcgaagctggccaaaaactaatcattaacactgcagaaggtacttacgtttctcgtgct

SEQ ID NO: 3586 - protein, 185 aa, Streptococcus pyogenes
MIEASKLKAGMTFEAEGKLIRVLEASHHKPGKGNTIMRMKLRDVRTGSTFDTTYRPDEKFEQAIIETVPAQYLYKMDDTAYFMNTDTYDQYEIPVANVEQELLYILENSDVKIQFYGSEVIGVTVPTTVELTVAETQPSIKGATVTGSGKPATLETGLVVNVPDFIEAGQKLIINTAEGTYVSRA

SEQ ID NO: 3587 - DNA, 387 bp, Streptococcus agalactiae
atgacaactgaaaatcttggagaaattgtcatttcaccacgtgtacttgaggtaattacaggtattgctgcaactaaagttgatggtgttcattcgttacgtaacaaagcggtaacggatagccttagtaagaaatctctaggtagaggtgtctaccttaaaaatgaagaagatgatacagtagctgcagatatttatgtttacttgcagtatggtgtaaatgtaccagcagtttcaattgctattcaacaagctgtcaaaacagctgtatatgacatggcagaagtaaaaatttcttcggtcaatatccatgttgaaggtattgttccagagaaaacaccaaaaccagacttgaagtcattgtttgatgaggatttcttagatgac

SEQ ID NO: 3588 - protein, 129 aa, Streptococcus agalactiae
MTTENLGEIVISPRVLEVITGIAATKVDGVHSLRNKAVTDSLSKKSLGRGVYLKNEEDDTVAADIYVYLQYGVNVPAVSIAIQQAVKTAVYDMAEVKISSVNIHVEGIVPEKTPKPDLKSLFDEDFLDD

SEQ ID NO: 3589 - DNA, 387 bp, Streptococcus pyogenes
atgacaactgaatatatcggtgaaatcgtcatttcaccacgagtgcttgaggttattacggggattgctacgacacaagttgagggcgtccactcactccataacaagaaaatggcagatagctttaacaaagcaagtcttggtaaaggggtttatctccagacagaagaagatggaagtgttacagcagatatttatgtttacttgcaatatggagtcaaggtcccgactgtatctatgaatattcaaaaaacagtcaaatctgctgtgtacgatatggcagaagtgcctatttctgcagttaatatccatgttgaaggtattgttgcggaaaagacaccaaaaccagatttgaagtcactttttgatgaggatttcttggatgac

SEQ ID NO: 3590 - protein, 129 aa, Streptococcus pyogenes
MTTEYIGEIVISPRVLEVITGIATTQVEGVHSLHNKKMADSFNKASLGKGVYLQTEEDGSVTADIYVYLQYGVKVPTVSMNIQKTVKSAVYDMAEVPISAVNIHVEGIVAEKTPKPDLKSLFDEDFLDD

SEQ ID NO: 3591 - DNA, 432 bp, Streptococcus agalactiae
atgactagtgtatttaaagattcaagacgtgatttacgtgaacgtgcttttcaaacactatttagcttagaaactggtggagagtttattgatgcggctcactttgcttatggttatgataaaacagtatctgaagacaaagttttagaggttccaatctttttacttaatcttgttaatggtgttgtagatcacaaagatgaattagatactttgatttctagtcacttaaaatcaggatggagcttagaacgtctaacattggttgataaatctctcttacgcttaggcctctatgaaattaaatattttgatgaaacgcctgatcgtgtagctctaaatgagattatcgagattgctaaaaaatattcagatgagacgtcagcaaaatttgtcaatggtttattaagtcaatttataacaaatgaaaat

SEQ ID NO: 3592 - protein, 144 aa, Streptococcus agalactiae
MTSVFKDSRRDLRERAFQTLFSLETGGEFIDAAHFAYGYDKTVSEDKVLEVPIFLLNLVNGVVDHKDELDTLISSHLKSGWSLERLTLVDKSLLRLGLYEIKYFDETPDRVALNEIIEIAKKYSDETSAKFVNGLLSQFITNEN

SEQ ID NO: 3593 - DNA, 468 bp, Streptococcus pyogenes
ttgatgaggatttcttggatgactaacagctttcaaaattcaagaagagatttgcgtgaacgtgcctttcaggctttatttaacatagagatgggagctgagttattggcagcttctcagtttgcctatggttatgataaagtaacaggggaggacgctcaagtattggagctgccgatttttttattaagtcttgtgacgggtgtcaataatcataaagaagagttggataacttgatatcaactcatttgaaaaaaggttggtcgttagaacgcttgacactaacagacaaaacgttattacgactaggtctttttgaaatcaagtattttgacaaaacaccagatcgtgttgcactaaacgaaatcattgaagtagttaaaaaatattctgatgaaacctctgctaaatttattaatggcttacttagccaatatgtctcgggagctccttcagcaaataaatca

SEQ ID NO: 3594 - protein, 156 aa, Streptococcus pyogenes
LMRISWMTNSFQNSRRDLRERAFQALFNIEMGAELLAASQFAYGYDKVTGEDAQVLELPIFLLSLVTGVNNHKEELDNLISTHLKKGWSLERLTLTDKTLLRLGLFEIKYFDKTPDRVALNEIIEVVKKYSDETSAKFINGLLSQYVSGAPSANKS

SEQ ID NO: 3595 - DNA, 960 bp, Streptococcus agalactiae
atggttgcaaaattaacagatgttgctgcacttgccggtgttagcccaacgactgtatcacgcgttattaacaaaaaaggctatttatctcaaaaaacagtcaccaaagtcaatgaagccatgagaacccttggttataaacctaataatttagcacgtagcttacagggaaagtccgctaaattaattggactcattttccccaacatccgtaacattttttacgctgaattaattgaacaccttgaaattgagttgtttaagcatggttataaaactatcttatgtaatagtgaaaaggatcctatcaaagaaaaagaatacctcgaaatgctaggagcaaatcaagtagacggtatcatttcaagtagtcacaacctaggaattgatgattacgagaaagttgaggctcccatagtagcattcgatagaaatttagctccacacatccctatcgtctcatctgataatttctttggaggaaaaatggctgctcaaacccttaaaaaacatggctgtcaaaagatgattatgattacagggaatgataattcagattctcctactggacttaggcggctaggtttttcctatgaatcaaaggaatccaaagttatcacagtcacaaatgggctatctaacatgagacgtgagatggaattaaaatcaattatctcgactcacaaaccagatggtatttttacatcagacgacttaactgctttattagtaatcaaacttatcagccaactagggttgtccattccagaagatatcaaagtgattggatatgatggtacaagtttcattcaagattacgtcccacatctaaccactattaaacaacctattcgagaaattgcgcaattgatggttgagatactcctagctaagattgaggggcaaaagacaaataaggattatattttaccagtcagtctcatccctggtagtagcgtt

SEQ ID NO: 3596 - protein, 320 aa, Streptococcus agalactiae
MVAKLTDVAALAGVSPTTVSRVINKKGYLSQKTVTKVNEAMRTLGYKPNNLARSLQGKSAKLIGLIFPNIRNIFYAELIEHLEIELFKHGYKTILCNSEKDPIKEKEYLEMLGANQVDGIISSSHNLGIDDYEKVEAPIVAFDRNLAPHIPIVSSDNFFGGKMAAQTLKKHGCQKMIMITGNDNSDSPTGLRRLGFSYESKESKVITVTNGLSNMRREMELKSIISTHKPDGIFTSDDLTALLVIKLISQLGLSIPEDIKVIGYDGTSFIQDYVPHLTTIKQPIREIAQLMVEILLAKIEGQKTNKDYILPVSLIPGSSV

SEQ ID NO: 3597 - DNA, 963 bp, Streptococcus pyogenes
gtggtcgcaaaattaacagacgtggcagccttggcgggtgtcagtccaacaactgtttcgcgagtaatcaacaaaaaaggctacctttcccaaaaaacagtgaataaggtgaataaggccatgcgtgaattgggctacaagcctaacaatctcgctagaagtttgcaaggtaaatcaacccaactcattgggcttatcttccccaacattagcaatatcttttacgctgaattaattgaacatttggaaattgaattgtttaaacagggctacaaaactattatttgcaatagtgaacataatcccgtcaaagaacgcgaatatttagaaatgcttgcggccaatcaagtggacggcattatttcttccagtcataatttgggaattgaggattatgagcgtgtcgaagctcctattgtagcttttgaccgtaatctagcgccaaatatcccggttatttcttcagataattttgaaggtggtaaattagccgcacaaactttgcaaaaacacggttgtcaaaacattgtcatgattacaggtaatgacaattctgattcgcccacagggttgcgccagctagggtttaactaccagctcaaacgaagtgcagaaatcatcaaattaccaaataacctatctcctgttagacgcgaaatggaaattaaatccattttggcaacccgaaaacctgatggccttttcgtttctgatgatttaactgctatcctcattatgaaagtagccaaacaacttcacattactattccagaggatatgaaagtcataggttatgatggaacgacatttatccagcaatatgttcctcaattagcgaccattcgtcaacctattgatgagattgctaaattgagtgtcgaaatactcatcaaaaaaattaaaaaagaaaaaaccagtaaagactatattttaccgattacgctacttccaggagcaagtatt

SEQ ID NO: 3598 - protein, 321 aa, Streptococcus pyogenes
VVAKLTDVAALAGVSPTTVSRVINKKGYLSQKTVNKVNKAMRELGYKPNNLARSLQGKSTQLIGLIFPNISNIFYAELIEHLEIELFKQGYKTIICNSEHNPVKEREYLEMLAANQVDGIISSSHNLGIEDYERVEAPIVAFDRNLAPNIPVISSDNFEGGKLAAQTLQKHGCQNIVMITGNDNSDSPTGLRQLGFNYQLKRSAEIIKLPNNLSPVRREMEIKSILATRKPDGLFVSDDLTAILIMKVAKQLHITIPEDMKVIGYDGTTFIQQYVPQLATIRQPIDEIAKLSVEILIKKIKKEKTSKDYILPITLLPGASI

SEQ ID NO: 3599 - DNA, 1437 bp, Streptococcus agalactiae
atgaatttacccactgaaatccgctatcgtccttatgatgaatggactgaagaagataaggaaaatattgtaaagaatgtctcaaaatccccttggagagcaacttatcacttagaagctaaaacagggcttttaaatgacccaaatggcttctcttactttaatggaaaattccatcttttttaccaaaattggccctttggagctgcacatggtttaaaacaatgggtacatacagaatcagatgatttagttcatttcaaagaaacaggaatcaagcttaaacctgaccatgtcaatgatagccatggtgcatactccggttctgcattagccattgacgataagctttttcttttttatactggtaatgtccgtgacatgaaatggaaccgtgacccccgccaaattggagcatggatgacaaatgatggcaagattacaaaatttgataaagtccttatttcacaaccaaatgatgtcactgagcattttcgtgaccctcagattttcaattatgataatcaattctatgctgttatcggggcgcaaaatagtaaaaaatgcggattcattaaattatataaagcacttaataatgacatccatcattgggagtttgtgggagatttagattttggtggtactggatctgagtatatgattgaatgtccaaatattatttttgtcaaaggaaaacctgtattactttatagtcctcaaggactagataaaaacgaattggactaccaaaacatttatccaaatacctacaaaatcggacaatatttcgatgctaactcatctaagatagttgaaccatcccctatctataatttagattatggttttgaagcctatgctactcaaggatttaacacttctgatggtcgtgcctttatcgtgagttggataggcttgccagatattgattatcctagcgatcaatttgattatcaaggagctatgagtttagttaaagagttaagcataaaaaatgggaacctttatcaatatcccgttcctgctatgaaaaatcttcgtcaacatcaagcagaatttaaaacacaacttcaaactaacaacacctatgaattagaattactggttcctagaaatgatctttcttcatttgttctctttgctaatccgaaaggacaaggactatccattactattgatactgtaaaggggaaagttatcattgaccgctcacaagccggacagcagtacgccacagaatttggtactagtcgccagtgtgacattccaaaagatgctactagtatcaatatttttatcgataagtccatctttgaaatctttataaataaaggagaaaaagtatttacgggacgagtctttccagatgcagaacaatcagggattcaactaaaagaagggcacgttcatggtaaatattttgaattaaaatat

SEQ ID NO: 3600 - protein, 479 aa, Streptococcus agalactiae
MNLPTEIRYRPYDEWTEEDKENIVKNVSKSPWRATYHLEAKTGLLNDPNGFSYFNGKFHLFYQNWPFGAAHGLKQWVHTESDDLVHFKETGIKLKPDHVNDSHGAYSGSALAIDDKLFLFYTGNVRDMKWNRDPRQIGAWMTNDGKITKFDKVLISQPNDVTEHFRDPQIFNYDNQFYAVIGAQNSKKCGFIKLYKALNNDIHHWEFVGDLDFGGTGSEYMIECPNIIFVKGKPVLLYSPQGLDKNELDYQNIYPNTYKIGQYFDANSSKIVEPSPIYNLDYGFEAYATQGFNTSDGRAFIVSWIGLPDIDYPSDQFDYQGAMSLVKELSIKNGNLYQYPVPAMKNLRQHQAEFKTQLQTNNTYELELLVPRNDLSSFVLFANPKGQGLSITIDTVKGKVIIDRSQAGQQYATEFGTSRQCDIPKDATSINIFIDKSIFEIFINKGEKVFTGRVFPDAEQSGIQLKEGHVHGKYFELKY

SEQ ID NO: 3601 - DNA, 1440 bp, Streptococcus pyogenes
ttgatggatctaccacaagctattcgctaccgcccttacaaagagtggagctcaaaagactaccaagctattactgaaaaaatggcccaatccccatggcacagccaatttcatgtcgaacctaagacaggattactcaatgaccccaatgggttttcttatttcaacggtcgctaccatcttttttatcaaaactggccttatggcgctgcgcacggtctgaaacaatgggtacacatgacatccacagacctcgtccattttacggaaacaaggagccgccttctgccagaccacgctcacgatagtcatggggcttactcaggttctgcatatgctattgatgacaagctcttcctcttttacactggtaatgttcgcgatgccaattgggtcagaacaccattacaggttggcgcatggatggataaacaaggaaatatttccaaaataccacaggttttgattgaacagcccgatgatgttacagaacattttcgggatcctcagcttttttcttatcaaggtcaattctatgctattattggcgcccaaggtttagatggcaaaggaaaaatcaaactttacaaagctgtggacaatcatgtggacaactggcgatttatagccgatttggactttgacgattctggtacggaatacatgattgaatgccccaaccttgtgtttgtcgatgacaagcctgttttgattttcagcccacaaggactggctaaagctgatttagattatcaaaatatctaccccaatacctataaaatttttgaaagcttcaatccagaaactggccaattgctgggtggaggggcccttcaaaatcttgactttggttttgaagcttatgccactcaagcctttagtagtccagatggcagggttctagccgtgtcttggattgggttaccagatattgattatccgacagatcgttatgactatcaaggagctcttagtttagtgaaagaattaaggattaaagacggaattctctatcaaacacctgtttcagccctacaaaatcttcgagggccagcagaattatttcataataaaatagacagttctaactgttatgaattggaattgacgattccaggccaaaaaaagcttgacctgctcctatttgccgaccaaaaagggaatggcctaagattgaaagtggatacaacaaaaggacagttaagcattgaccgaagtcgggcaggggttcaatatgcccaagactatggtacggtgcgctcttgccaaatcccacaaggccatgttacacttaatgtctatgtggacaattccattcttgaaatctttattaaccaagggcaaaaagtcctaactagtcgggttttcccaacccacggacaaacaggtatccaagtagtagaaggacaagcttttggacattattatgaaatgaggtat

SEQ ID NO: 3602 - protein, 480 aa, Streptococcus pyogenes
LMDLPQAIRYRPYKEWSSKDYQAITEKMAQSPWHSQFHVEPKTGLLNDPNGFSYFNGRYHLFYQNWPYGAAHGLKQWVHMTSTDLVHFTETRSRLLPDHAHDSHGAYSGSAYAIDDKLFLFYTGNVRDANWVRTPLQVGAWMDKQGNISKIPQVLIEQPDDVTEHFRDPQLFSYQGQFYAIIGAQGLDGKGKIKLYKAVDNHVDNWRFIADLDFDDSGTEYMIECPNLVFVDDKPVLIFSPQGLAKADLDYQNIYPNTYKIFESFNPETGQLLGGGALQNLDFGFEAYATQAFSSPDGRVLAVSWIGLPDIDYPTDRYDYQGALSLVKELRIKDGILYQTPVSALQNLRGPAELFHNKIDSSNCYELELTIPGQKKLDLLLFADQKGNGLRLKVDTTKGQLSIDRSRAGVQYAQDYGTVRSCQIPQGHVTLNVYVDNSILEIFINQGQKVLTSRVFPTHGQTGIQVVEGQAFGHYYEMRY

SEQ ID NO: 3603 - DNA, 171 bp, Streptococcus agalactiae
atgggatgggcatcacctgaggccactgcccaagcgtttggaagggcagagttgaccatcatcaatcctaatacgagaccgataacaggatttccaccaaaaactctaaaagctgaccaagaaatcaaggcaggaaaaaaagcaaaggccgtgtcagtcaaaacgacagta

SEQ ID NO: 3604 - protein, 57 aa, Streptococcus agalactiae
MGWASPEATAQAFGRAELTIINPNTRPITGFPPKTLKADQEIKAGKKAKAVSVKTTV

SEQ ID NO: 3605 - DNA, 1917 bp, Streptococcus agalactiae
atggcttcaaatacagaaattgctaaacaagtcattaatgcgattggtggtgctagtaatgtgcgtagcgtagcacactgtgccactcgtcttcgcgttatggtaaaagatgagacagtcattgataaaaatactgttgaaaatatcgaaaaagttcagggagcatttttcaattcaggtcaatatcaaattatttttggaactggtactgttaataagatttatgatgaagtagtggctcaaggtttgccaacttcgtcaacctctgatcaaaaggcagaagcagctaaacaagggaatgctttccaacgagctattcgtactttcggtgatgtttttgttccattgttgccagccattgttgctactggtttatttatggggattcgcggtgcgattaataatgatacagttttagctttatttgggacgacttcaaaagcattttcaagttctaatttttatacctatactgtcgttttgactgacacggcctttgctttttttcctgccttgatttcttggtcagcttttagagtttttggtggaaatcctgttatcggtctcgtattaggattgatgatggtcaactctgcccttccaaacgcttgggcagtggcctcaggtgatgcccatcccataaaatttttcggttttattccagtagttggttatcaaaattcagtattgccggcattctttgtaggtttacttggtgctaaacttgaaaaatggttgcataagaaaatcccagatgttcttgatttactattagtgccgttcctaacttttacagttatgtcaattttagcactttttgtcattggtcctattttccattcagttgaaaactatgttttagcagggacaaaatttgtccttaatttacctcttggcctgtcaggtcttattttaggtggtgttcatcagataatcgttgttacaggtgttcatcatatctttaatttacttgaagctcagttaattgctgctgatgggaaagatccatttaatgctattattacagctgctatgacagcacaagcaggtgccactttggcagttggtgttaaaacaaaaaataaaaaattaaaagcccttgcttttccggcagcgctttcagctggacttggtattacagaaccggctatatttggagtaaacttacgttttggtaagccatttattatgggattaattgcaggagcagcaggtggctggttagcttcaatattgaaattagcaggaactggttttggtattaccattatcccaggaacattactttatttaaatggtcaaattgttaagtaccttattatggtaattggaactacgtctttggcttttgtattaacttatatgtttggatatgaagataaagatgaaaaagcagtagctgaagttagtcctttggttgaagaaacagatgacgatccaacaattactcaaactagccaattaagggcagaaacgattgttagccctcttgatggacaggttattgctcttgatacagtaagtgacccagttttttcatcaggtattatgggagatggccttgctattaaaccaagaggtaatacaatttactcacctgttgatggttttgtccaaattgcttttgaaacaggtcatgcttacggtatcaaatcagataaaggtgcagaaattttgattcatataggtattgatactgtcaccatgaatggcacagggtttacttctaaagtcaaggcagaccaaaaagtgaaaaaaggtgatattcttggcacctttgattcagccaagattgcagaagcaggtctggataatacagctatgattattgtgactaatacagctgattttgctgatgttgtaccattggtaaaagagggtgttgttactacaggtgacatgattattgatgttaag

SEQ ID NO: 3606 - protein, 639 aa, Streptococcus agalactiae
MASNTEIAKQVINAIGGASNVRSVAHCATRLRVMVKDETVIDKNTVENIEKVQGAFFNSGQYQIIFGTGTVNKIYDEVVAQGLPTSSTSDQKAEAAKQGNAFQRAIRTFGDVFVPLLPAIVATGLFMGIRGAINNDTVLALFGTTSKAFSSSNFYTYTVVLTDTAFAFFPALISWSAFRVFGGNPVIGLVLGLMMVNSALPNAWAVASGDAHPIKFFGFIPVVGYQNSVLPAFFVGLLGAKLEKWLHKKIPDVLDLLLVPFLTFTVMSILALFVIGPIFHSVENYVLAGTKFVLNLPLGLSGLILGGVHQIIVVTGVHHIFNLLEAQLIAADGKDPFNAIITAAMTAQAGATLAVGVKTKNKKLKALAFPAALSAGLGITEPAIFGVNLRFGKPFIMGLIAGAAGGWLASILKLAGTGFGITIIPGTLLYLNGQIVKYLIMVIGTTSLAFVLTYMFGYEDKDEKAVAEVSPLVEETDDDPTITQTSQLRAETIVSPLDGQVIALDTVSDPVFSSGIMGDGLAIKPRGNTIYSPVDGFVQIAFETGHAYGIKSDKGAEILIHIGIDTVTMNGTGFTSKVKADQKVKKGDILGTFDSAKIAEAGLDNTAMIIVTNTADFADVVPLVKEGVVTTGDMIIDVK

SEQ ID NO: 3607 - DNA, 1860 bp, Streptococcus pyogenes
atggataatcgtcagattgcagctgaagtgattgaggctttaggtggccgagaaaatgtgagaagtgttgcccactgtgcaactcgccttcgcgtgatggtttatgatgaaggaaagattgataaggaaaaagcagaagctattgacaaggttaaaggagctttctttaactctggtcaatatcagatgatttttggaactggtaccgttaataacatttatgacgaagttgttgctcttggtttacccacgtcatcaaccagtgagcaaaaggcagaagcaggcaaacatggcaatatcttccaacgggcgattcgtacgtttggagatgtctttgttcccattattccagctattgtagcaacgggtctctttatgggggttcgtggtttggtgacccagccagctattatggatttatttggggtgcatgagtacggggaaaattttctcatgtacactcgtattctaacggatacagcctttgtctacttgccagctttggtggcttggtcagcctttagggtctttgggggtaatcctattatcggtattgttttaggattgatgctggtttccaatgagttgcctaatgcttgggtagttgcctctggtggagatgttaagccgctaaccttctttggatttgttcctgttgttggttatcaaggtaccgttttacccgccttctttgttggtctggtaggagctaagttggagaaatggttgcacaaaaaggttccagaagctttggacttattggtcacaccgtttttaacgtttgctattatgagtaccttgggactatttgtgattggaccagttttccattctcttgaaaaccttgttctggctgggacacaggccgtcttgcatttgccgtttggcattgcaggcttgattgttgggggaatccaacaattaatcgtagtgactggtattcaccatatctttaacttcctagaagcgcagctgattgccaataccggaaaagatcctttcaatgcttacctaacagcagcaacagctgctcaagctggagctaccttagctgttgctgttaaaaccaaatcaacaaaactaaaaggtctggcctttccatcaaccttgtcagctcttttagggattactgaaccagctatttttggggtcaacctccgttatccaaaagtctttgtttcaggtcttattggtggtgccttaggtggttgggtcgctgggctctttggcattgcaggaactggttttgggattacggtcttaccaggaactctcctttacttgaatggccaattattacaataccttgtgactatgcttgtcggtcttggggtagcctttgcaattgcttatacttggggttatcaagatagagaaacccttccgttaccagctgtcgaagttgatcaaacggctgatcagccagccttagcagaggaaactttatatagtcctttgaatggaacagttgtagacttatctgcggtttcagaccctgttttttcatcaggtgctatgggtcaaggcttagcaattaagccagaagataataccctatactcaccagttgatggtaaagttgaaattgtctttgaaacaggtcatgcctatgctataacgtcaagtcaaggagcagaagtgttacttcatattggtattgataccgagtcgatggcaggagatggctttgaatctcttgtagcagtaggtcaggcggttaaaaaaggggatcttcttggacactttgatcctagcaagattgcagaagctggactagatgacaccaccatgatgattgtgagcaatatcgctgactatcaaagcgtggacattcttgctcaaggacatgttttgaggtgg

SEQ ID NO: 3608 - protein, 620 aa, Streptococcus pyogenes
MDNRQIAAEVIEALGGRENVRSVAHCATRLRVMVYDEGKIDKEKAEAIDKVKGAFFNSGQYQMIFGTGTVNNIYDEVVALGLPTSSTSEQKAEAGKHGNIFQRAIRTFGDVFVPIIPAIVATGLFMGVRGLVTQPAIMDLFGVHEYGENFLMYTRILTDTAFVYLPALVAWSAFRVFGGNPIIGIVLGLMLVSNELPNAWVVASGGDVKPLTFFGFVPVVGYQGTVLPAFFVGLVGAKLEKWLHKKVPEALDLLVTPFLTFAIMSTLGLFVIGPVFHSLENLVLAGTQAVLHLPFGIAGLIVGGIQQLIVVTGIHHIFNFLEAQLIANTGKDPFNAYLTAATAAQAGATLAVAVKTKSTKLKGLAFPSTLSALLGITEPAIFGVNLRYPKVFVSGLIGGALGGWVAGLFGIAGTGFGITVLPGTLLYLNGQLLQYLVTMLVGLGVAFAIAYTWGYQDRETLPLPAVEVDQTADQPALAEETLYSPLNGTVVDLSAVSDPVFSSGAMGQGLAIKPEDNTLYSPVDGKVEIVFETGHAYAITSSQGAEVLLHIGIDTESMAGDGFESLVAVGQAVKKGDLLGHFDPSKIAEAGLDDTTMMIVSNIADYQSVDILAQGHVLRW

SEQ ID NO: 3609 - DNA, 879 bp, Streptococcus agalactiae
atgacaaagttatatggtagtattgaagcaggtgggacaaagtttgtttgtgcagttggtgatgaggaattaaaagttgtagaaaaaatgcaatttccaacaacgacgcctcaagaaacgattaaaaagactgttgatttctttaaaagatttgaaaagaagttagaggcagttgctattggttcttttggtcccattgatattgataaaaaatcaaagacatacggttatatcacaacgaccccaaagttgcattgggctaatgttgatttactcggcttaatttctaaagatttcaatgttccattttatttcacaacagatgttaatagctctgcctatggtgaagttatagctcgtaacaatattgattcacttgtttattacaccattggtacgggaattggtgcaggagctatacaaaagggtgaatttataggaggaactggtcatactgaagcaggtcatacttatatggcgatgcatccgcaggaccaagcaaatgattttaaaggtatctgtccgtttcataatagctgtttagaaggtttggcatctggtccaactctagaagctaggactggtattcgtggtgaattgattgaagaaaattcaatggtttgggatgttcaagcctattatattgctcaggctgcaatacaagcaactgtattatatcgtccacaagtcattgtatttggtggaggcgtcatggcacaagagcacatgttaagacgtgttcgccagacatttgcaactttattaaatgggtatttaccagttcccgatttgtctgattatattgtgacaccagctatagaagaaaatggttctgcaacgttaggaaattttgctttagcaaagaaaatatcaaaaggt

SEQ ID NO: 3610 - protein, 293 aa, Streptococcus agalactiae
MTKLYGSIEAGGTKFVCAVGDEELKVVEKMQFPTTTPQETIKKTVDFFKRFEKKLEAVAIGSFGPIDIDKKSKTYGYITTTPKLHWANVDLLGLISKDFNVPFYFTTDVNSSAYGEVIARNNIDSLVYYTIGTGIGAGAIQKGEFIGGTGHTEAGHTYMAMHPQDQANDFKGICPFHNSCLEGLASGPTLEARTGIRGELIEENSMVWDVQAYYIAQAAIQATVLYRPQVIVFGGGVMAQEHMLRRVRQTFATLLNGYLPVPDLSDYIVTPAIEENGSATLGNFALAKKISKG

SEQ ID NO: 3611 - DNA, 882 bp, Streptococcus pyogenes
atgggaaaattatatggaagcattgaagctggtgggacaaagtttgtctgtgccgtgggtgatgaggagtttacagtggtggataaaacacaatttccgaccaccacaccagaagaaaccatcgcgcgaaccatcgcttattttaaagcttttgaggcagatttggctggaatggcgattggttcttttggaccaattgatattgatccgtcgtcagagacttacggttatatcacaaccactcctaaatcaggctgggctaatgtggatttgttaggacaactttcggctgcttttaagattccttttgatgtgacaacagatgttaatagctctgcttatggtgaggtgcttgctcgtcctggtgtggaaagtttggtctattacaccataggtactggtattggggcgggagctattcaacatggccactttattgggggtttaggtcatacagaagcgggtcatacctatgtcatgccccatcctgatgatatggccaagggatttttaggtgtttgcccttttcataaagggtgtctggaagggatggcagcaggtccaagtattgaggccagaacgggagtgagaggtgaacggcttgatcaggaagctgatgtttgggacattcaagccttctacattgcccaagcagcgctgcaagcaactatgctttaccgtcctcaagtgattgtttttggcggaggtgtcatggcgcaagaacatatggtgttgcgcgtgcatgataaattcactgcccttttaagcggttatttgccagtccctgatttgacagactacattgttactccagctgttgctgataatggctccgctactctgggaaattttgctttggccaagttggctgcacaaggaaaa

SEQ ID NO: 3612 - protein, 294 aa, Streptococcus pyogenes
MGKLYGSIEAGGTKFVCAVGDEEFTVVDKTQFPTTTPEETIARTIAYFKAFEADLAGMAIGSFGPIDIDPSSETYGYITTTPKSGWANVDLLGQLSAAFKIPFDVTTDVNSSAYGEVLARPGVESLVYYTIGTGIGAGAIQHGHFIGGLGHTEAGHTYVMPHPDDMAKGFLGVCPFHKGCLEGMAAGPSIEARTGVRGERLDQEADVWDIQAFYIAQAALQATMLYRPQVIVFGGGVMAQEHMVLRVHDKFTALLSGYLPVPDLTDYIVTPAVADNGSATLGNFALAKLAAQGK

SEQ ID NO: 3613 - DNA, 945 bp, Streptococcus agalactiae
atgtcggaaccattatttttagaagcaagcatgcacgataaaatctggggtggaacaaagttaagggatgaatttggctatgatattccaagtgaaacaacaggagaatattgggctatttcagctcatcctaacggtgtctcaagagttaagaatggtcgctttaaaggttgttttttagataagctgtatcaaggtgaaaaaagcttatttggcaaccctgatgatactgtctttcctttactaactaaaatcttagatgctaatgactggcttagtgtacaggttcatccggatgatgcttatgctcttaaacatgaaggtgaacttggtaaaacagaatgttggtatattatttctgctgatgaaggatctgaaattatctatggtcataatgctaaaactaaagaagaacttcgccaaatgattgaatctggagattgggaacatcttttaacccgaattcctgttaaatcaggggatttttactacgttccaagtgggacaatgcatgctataggtaaagggatattaattttagaaacacagcaatctagtgatactacttatcgtgtttatgattttgatcgtccagatgcttcaggaaaattacgtgatttacacattgaacaatcaatagatgttctcacgattggtaaacctgccaatactgttcctgccaatatgaagttaaaacatctatcttcaactttattagtttcaaatgatttctttacagtttataaatgggaaatttctggtgttaccaactttaaacaatttgcaccctaccttttggttagtgtcttagacggagcgggtcacattacagtagataacaaagtttatacacttaaaaaaggtgaccactttatcttgccaaatgatgttgtcaaatgggatattgatggacagttagaaattatagcaagtcatgttaaaaaa

SEQ ID NO: 3614 - protein, 315 aa, Streptococcus agalactiae
MSEPLFLEASMHDKIWGGTKLRDEFGYDIPSETTGEYWAISAHPNGVSRVKNGRFKGCFLDKLYQGEKSLFGNPDDTVFPLLTKILDANDWLSVQVHPDDAYALKHEGELGKTECWYIISADEGSEIIYGHNAKTKEELRQMIESGDWEHLLTRIPVKSGDFYYVPSGTMHAIGKGILILETQQSSDTTYRVYDFDRPDASGKLRDLHIEQSIDVLTIGKPANTVPANMKLKHLSSTLLVSNDFFTVYKWEISGVTNFKQFAPYLLVSVLDGAGHITVDNKVYTLKKGDHFILPNDVVKWDIDGQLEIIASHVKK

SEQ ID NO: 3615 - DNA, 951 bp, Streptococcus pyogenes
atgtcagaaccattatttctaaaatcaaccatgcacgacaggatttggggtggcaccaagttgagagatgtctttgcttacaacatcccaagtgacaccacaggtgagtattgggctatttctgctcatcctaatggtgtttcgacagttactaatggacgttatcaaggacaacctttaaacacattatatgcgcaagagccggccttgtttgggaatccaaaggaagaagtttttccactgttaactaagattttagatgctaatgactggctaagtgtccaagttcatcctgatgatgcttatggacgtgaacatgaaggagaattaggcaagacagaatgctggtatattatttctgccgaagagggttctgaaattgtatacggccatcaggccaagtccaaagaagaccttcgtgccatgattgaagcaggcgcttgggatgatttgctgactcgtgtcccagtcaaagcaggcgattttttctatgttccaagtggcaccatgcatgcgatcggcaagggaattcttattttagaaacccagcagtcatctgataccacttatcgggtttatgattttgaccgtaaggacgttaatggtaatcttcgtgaccttcatattgaaaagtctattgatgtcttaacgattggtaagccagaaaatagcgtgccagccactatggttttggataatatggtagcaacaactttagtctcaacaccatttttcactgtttacaaatgggtaactagtcaaatggttgacatgaaacaagctgcgccttatcttttagtgagtgttttaaaaggtcaaggaaaactctatgtggaccagaaggcttatgagctagaaaaaggcatgcactttatcttgcctaacgatgttaaatcgtggtcatttgatggtcaattagaaatgattgtgagtcaccccaatcaactcgtt

SEQ ID NO: 3616 - protein, 317 aa, Streptococcus pyogenes
MSEPLFLKSTMHDRIWGGTKLRDVFAYNIPSDTTGEYWAISAHPNGVSTVTNGRYQGQPLNTLYAQEPALFGNPKEEVFPLLTKILDANDWLSVQVHPDDAYGREHEGELGKTECWYIISAEEGSEIVYGHQAKSKEDLRAMIEAGAWDDLLTRVPVKAGDFFYVPSGTMHAIGKGILILETQQSSDTTYRVYDFDRKDVNGNLRDLHIEKSIDVLTIGKPENSVPATMVLDNMVATTLVSTPFFTVYKWVTSQMVDMKQAAPYLLVSVLKGQGKLYVDQKAYELEKGMHFILPNDVKSWSFDGQLEMIVSHPNQLV

SEQ ID NO: 3617 - DNA, 2556 bp, Streptococcus agalactiae
gtggtgataagagtatcgaaaggaattagaatggcaaatattctacgcactgttattgaaaatgacaagggtgaattaaaaaaattagataaaatagctaagaaagttgactcttacgcagatcatatggctgcgttatcagatgaagctttacaagcaaaaactccagaatttaaagaacgttatcaaaatggtgaaactttagatcaattgttaccggaagcgtttgcggtagttcgtgaagcttctaaacgtgtattaggtttatacccataccacgtccaaattatgggtggtatcgttcttcaccatggtgatattccagaaatgcgtactggtgagggaaaaactttaacagcgacaatgcctgtttatctaaatgctatctcaggattaggtgttcatgttattactgttaatgagtatttatcaacacgtgatgcgaccgaaatgggtgaggtttatagttggcttggattatctgtagggattaacttagcagctaagtcaccatttgaaaaacgcgaagcttacaattgtgatatcacatactcaactaacgcagaagtcggatttgactaccttcgagacaatatggttgttcgccaagaagatatggtgcaacgcccactcaactatgctttggttgatgaggttgactctgtattaatcgatgaagctaggacgccattgattgtttcaggtcctgtaagctctgagatgaaccaactgtatacacgtgcggacatgtttgtaaaaacgcttaatagcgatgattatatcattgatgttccaacaaaaacaattggtttatcagatacaggtattgacaaggctgaaaactatttccatctaaataacttgtatgatctcgaaaatgttgccttaactcactacattgataacgctcttcgagctaactatattatgttgttaaatattgattatgtggttagtgaagaacaagagattttaattgtggaccaatttaccggtcgtacgatggaaggacgtcgtttctcagatggcttacaccaagctattgaagcaaaagagtcagtgccaatccaagaagaatcaaaaacgagcgcttcaattacttaccaaaatatgttccgtatgtaccataaattagcaggaatgactggtactggtaagactgaggaagaagagtttcgtgaaatttataatatgcgcgttattcctatcccaacaaatcgtcctgttcaacgtatagatcattcagatctactttatccaactcttgactctaaatttagagcggtggtagcagatgtcaaagaacgttatgaacaaggacaacctgtactggttggtacagtagctgttgaaacgtcagacttaatttctagaaaattagttgctgctggagtaccacatgaagttttgaatgctaaaaatcactttaaagaagctcaaatcattatgaatgctgggcaacgtggtgctgttacaatcgcaaccaacatggctggtcgtggtactgatatcaagcttggtgaaggggttcgtgaacttggtggtttatgtgttattggtacagagcgtcatgaaagccgtcgtattgataaccagcttcgtggtcgttcgggtcgtcaaggagatccaggtgaatcacaattctatctttcgttagaagatgatttgatgcgtcgctttggtacagatcgtattaaagtggttcttgagcgaatgaatttagctgaagatgatacagttattaaatcaaaaatgttgacacgacaagttgaatcagctcaacgccgcgttgaaggtaataactatgacacacgtaaacaagtcttgcaatacgatgatgttatgcgtgaacaacgtgagattatttatgctaaccgtagagaagtgattactgctgagcgtgatttaggaccagagctcaaagggatgattaaacgtacgattaaaagagcagttgatgcacatagcagaagcgataaaaatactgcagcagaagctattgttaattttgcaagatcggcgttattagatgaagaagctatcacagtttcagaacttcgtggtctaaaagaggctgaaattaaagaacttctttatgaacgtgccttagctgtttatgagcaacaaattgctaaattaaaagatccagaagctattatcgaattccaaaaagtcttaatcttgatggtagtggataatcaatggacagagcatattgatgccttagatcaattacgtaactccgttggacttcgtggttatgctcaaaataacccaatcgttgagtatcaatcagaaggtttccgtatgttccaagatatgattggttcgattgagtttgatgtgacacgtacattgatgaaagctcaaattcatgaacaagagcgtgaacgtgcttctcaacatgctacgacaacagcagagcaaaatatctcggcacaacatgtacctatgaataatgaatcaccagaataccaagggattaaacgtaatgataaatgtccttgtggctctggcatgaagtttaaaaattgtcatggtctgagatgtttacaa

SEQ ID NO: 3618 - protein, 852 aa, Streptococcus agalactiae
MVIRVSKGIRMANILRTVIENDKGELKKLDKIAKKVDSYADHMAALSDEALQAKTPEFKERYQNGETLDQLLPEAFAVVREASKRVLGLYPYHVQIMGGIVLHHGDIPEMRTGEGKTLTATMPVYLNAISGLGVHVITVNEYLSTRDATEMGEVYSWLGLSVGINLAAKSPFEKREAYNCDITYSTNAEVGFDYLRDNMVVRQEDMVQRPLNYALVDEVDSVLIDEARTPLIVSGPVSSEMNQLYTRADMFVKTLNSDDYIIDVPTKTIGLSDTGIDKAENYFHLNNLYDLENVALTHYIDNALRANYIMLLNIDYVVSEEQEILIVDQFTGRTMEGRRFSDGLHQAIEAKESVPIQEESKTSASITYQNMFRMYHKLAGMTGTGKTEEEEFREIYNMRVIPIPTNRPVQRIDHSDLLYPTLDSKFRAVVADVKERYEQGQPVLVGTVAVETSDLISRKLVAAGVPHEVLNAKNHFKEAQIIMNAGQRGAVTIATNMAGRGTDIKLGEGVRELGGLCVIGTERHESRRIDNQLRGRSGRQGDPGESQFYLSLEDDLMRRFGTDRIKVVLERMNLAEDDTVIKSKMLTRQVESAQRRVEGNNYDTRKQVLQYDDVMREQREIIYANRREVITAERDLGPELKGMIKRTIKRAVDAHSRSDKNTAAEAIVNFARSALLDEEAITVSELRGLKEAEIKELLYERALAVYEQQIAKLKDPEAIIEFQKVLILMVVDNQWTEHIDALDQLRNSVGLRGYAQNNPIVEYQSEGFRMFQDMIGSIEFDVTRTLMKAQIHEQERERASQHATTTAEQNISAQHVPMNNESPEYQGIKRNDKCPCGSGMKFKNCHGLRCLQ

SEQ ID NO: 3619 - DNA, 2517 bp, Streptococcus pyogenes
atggccaatattctacgcaaagttatcgaaaatgacaaaggcgaactaagaaaattagaaaaaattgcaaaaaaagtagaatcctacgcagaccaaatggcgtcattgtcggatagagatctacaaggaaaaacacttgaatttaaagaacgctatcaaaaaggtgagaccctcgaacaactattacctgaagctttcgcagttgttcgtgaagcagcaaaacgtgtgttgggcttgttcccttatcgtgttcaaattatgggaggaattgttcttcataacggggatgtccctgaaatgcgtactggtgaaggaaaaactcttacagccaccatgccagtttatctcaatgctattgctggtgagggtgttcacgttattactgttaatgagtatctttcaacgcgtgacgctaccgaaatgggtgaagtgtatagctggttaggtctttcagttgggatcaacctagctgctaagtctcctgctgaaaaacgtgaagcttataattgtgatattacttattcaaccaactctgaagtcggttttgattaccttcgtgacaacatggttgttcgccaggaagacatggtacaacgcccactcaattttgccttggttgatgaagtggactcagtcttaattgacgaggcaaggacacctttaattgtttctggtgctgttagctctgaaaccaatcaattgtatattcgtgctgacatgtttgtaaaaactctgacgtcagtggattatgttattgatgtgcccactaaaacgattggattaagcgattcaggtattgataaagctgagagttactttaacttgagcaatctttacgatattgaaaatgtagccttgactcactttatagacaacgcccttcgtgcaaactatattatgttgttagatatcgattatgtggtcagcgaagatggtgagattcttattgttgaccaatttacaggtcgtacgatggaagggcgtcgcttctcagacggcttgcaccaagctattgaggcaaaagaaggcgttcgtattcaggaagaatcaaaaaccagcgcctcaatcacttaccaaaatatgtttcgtatgtacaaaaaattggcaggtatgactggtactgcgaagaccgaggaagaagaatttcgcgaagtttataacatgcgtattattccaattccaaccaatcgtccaattgcccgtattgatcacactgatttgctttacccgaccttagaatcaaagtttagagcagttgtggaagacgttaaaacgcgtcatgcaaaaggacaacctatccttgtaggtacggttgctgttgaaactagtgatttgatttcacgcaagctggttgaagcagggattcctcatgaggttttgaatgctaaaaatcactttaaagaagctcaaatcattatgaatgctgggcaacgtggtgctgttacaatcgcaactaacatggctggtcgtggtactgatatcaagcttggtgaaggtgttcgtgaacttggtgggttatgtgtcattggtacagagcgtcatgaaagccgtcgtatcgataaccagcttcgtggacgttcaggtcgtcaaggagatccaggtgaatcccaattctatctttcattagaagatgatttgatgagacgtttcggctctgatcgtataaaagcctttttggatcggatgaaattagatgaagaagacactgttattaaatcaggtatgttagggcgtcaagtggaatctgctcaaaaacgggttgaaggaaataactatgatacccgtaaacaggtcttacaatatgatgatgtgatgcgtgaacagcgtgaaattatctatgctaaccgtcgtgatgtcataactgctaatcgagatcttggcccagaaattaaagctatgatcaagcgtactatcgaccgtgctgtagatgctcatgcacgtagcaatcgtaaagatgctatagatgctattgtaacttttgctaggacctcgctggtaccagaagagtttattagtgctaaagagttacgtggtttaaaagatgatcaaatcaaagagaagctttatcaaagagcgcttgctatctacgaccagcaactatcaaaacttcgtgatcaagaagctattattgaattccaaaaagtactcattttgatgattgtggataacaaatggactgaacacattgatgccttagatcaacttcgtaatgctgttggacttcgggggtatgctcaaaataaccctgtggtggaataccaagcagaaggtttcaagatgttccaagatatgattggtgctatcgagtttgatgtaacacgtaccatgatgaaagcacaaattcacgaacaagaacgtgaacgtgcaagtcaacgtgccacaacagcagcacctcaaaacatccaatcgcagcagtcagctaacaccgatgatttacccaaagtggagcgtaacgaagcttgtccatgtggttcaggcaaaaaattcaaaaattgtcacggtcgtaaatccttctca

SEQ ID NO: 3620 - protein, 839 aa, Streptococcus pyogenes
MANILRKVIENDKGELRKLEKIAKKVESYADQMASLSDRDLQGKTLEFKERYQKGETLEQLLPEAFAVVREAAKRVLGLFPYRVQIMGGIVLHNGDVPEMRTGEGKTLTATMPVYLNAIAGEGVHVITVNEYLSTRDATEMGEVYSWLGLSVGINLAAKSPAEKREAYNCDITYSTNSEVGFDYLRDNMVVRQEDMVQRPLNFALVDEVDSVLIDEARTPLIVSGAVSSETNQLYIRADMFVKTLTSVDYVIDVPTKTIGLSDSGIDKAESYFNLSNLYDIENVALTHFIDNALRANYIMLLDIDYVVSEDGEILIVDQFTGRTMEGRRFSDGLHQAIEAKEGVRIQEESKTSASITYQNMFRMYKKLAGMTGTAKTEEEEFREVYNMRIIPIPTNRPIARIDHTDLLYPTLESKFRAVVEDVKTRHAKGQPILVGTVAVETSDLISRKLVEAGIPHEVLNAKNHFKEAQIIMNAGQRGAVTIATNMAGRGTDIKLGEGVRELGGLCVIGTERHESRRIDNQLRGRSGRQGDPGESQFYLSLEDDLMRRFGSDRIKAFLDRMKLDEEDTVIKSGMLGRQVESAQKRVEGNNYDTRKQVLQYDDVMREQREIIYANRRDVITANRDLGPEIKAMIKRTIDRAVDAHARSNRKDAIDAIVTFARTSLVPEEFISAKELRGLKDDQIKEKLYQRALAIYDQQLSKLRDQEAIIEFQKVLILMIVDNKWTEHIDALDQLRNAVGLRGYAQNNPVVEYQAEGFKMFQDMIGAIEFDVTRTMMKAQIHEQERERASQRATTAAPQNIQSQQSANTDDLPKVERNEACPCGSGKKFKNCHGRKSFS

SEQ ID NO: 3621 - DNA, 1005 bp, Streptococcus agalactiae
atgggatttcatcagttaagtgataaaattaatattgaaatattgaagcagaaaactagcttagatctagaagttagccaaaaaaaattagccaaagaagaagagttaaaaaatatcataaaaggtgaggatcagcggtttctagtaatagtaggtccttgttctgcggataatccaaaggcggtgctaacttatgcaaagcgtttagctaaattggaagctgcctttaaagataaaatgtttttggttatgagagtttataccgctaagccaagaacgaatggtgatggttataaaggcttagttcaccattctgacaaactaggagttttttttcaagcacgtaagatgcactatgacatcattcgagagactggactcctgacagctgatgaattactttatccagagatgttatcagtgatggatgatttagtttcttactatgctattggtgcgcgttcagtggaagatcagggacaccgttttatatcttcaggtatagatgcaccagtaggtatgaaaaatccaacgtctggtaatttaagagtcatgtttaatgcggtctatgcagcacaaaatcaacaggaattattctatcaaaataagcaagttagaacagatggtaatttgctgtcacatgttattttgagaggatatcataatgccgactatcgaagtatccctaattatcattatgaaaaccttttagaaactattactcattatgaagagactgatttgcaaaatccctttattgttgttgatacaaatcatgacaattcaggtaagcaatttttagaacaaattcgcattgtgaaatcagtacttgcagaccgacagtggcatactaaaattagaaactatgttcgtggttttttgatagaatcttatttagaagatggaagacaagataaaccagatgtttttggtaagtctatcacagatccatgtctaggttgggataaaacagaaatgctaattagggatatttacaatagtttg

SEQ ID NO: 3622 - protein, 335 aa, Streptococcus agalactiae
MGFHQLSDKINIEILKQKTSLDLEVSQKKLAKEEELKNIIKGEDQRFLVIVGPCSADNPKAVLTYAKRLAKLEAAFKDKMFLVMRVYTAKPRTNGDGYKGLVHHSDKLGVFFQARKMHYDIIRETGLLTADELLYPEMLSVMDDLVSYYAIGARSVEDQGHRFISSGIDAPVGMKNPTSGNLRVMFNAVYAAQNQQELFYQNKQVRTDGNLLSHVILRGYHNADYRSIPNYHYENLLETITHYEETDLQNPFIVVDTNHDNSGKQFLEQIRIVKSVLADRQWHTKIRNYVRGFLIESYLEDGRQDKPDVFGKSITDPCLGWDKTEMLIRDIYNSL

SEQ ID NO: 3623 - DNA, 750 bp, Streptococcus pyogenes
atgattgacattatgtctgactttcaaaataagacttgttctaagaataattttattgttggaccttgttccattgaatcttatgatcacattagattagcagcttcaagtgccaaaaaacttggttacaactattttagaggaggcgcctataaaccaagaacatctgctgcttcttttcaaggccttggcctgcaaggaattcgttacttgcatgaggtttgtcaggaatttggcttactatcggtcagtgaaatcatgtccgagcgccaattagaagaagcctatgactatctcgatgtcattcaggttggtgcccgcaacatgcaaaattttgaatttttaaaaaccttgtcacacatcgataagcctattttgtttaaacgaggcttgatggctactatcgaggaatatttgggcgccctttcctacttacaagacactggaaaatctaacattatcttatgcgaacgtggcgttcgtggctacgatgtggagactagaaatatgcttgatattatggcagtccctattattcaacaaaagacagatttaccgattattgtggacgtatctcattcgacaggcagacgagatttactcttacctgctgctaagatagcgaaggctgtcggtgccaatggcatcatgatggaggttcatcctgatcccgaccatgcgctgtcagatgctgcccagcaaattgattataagcaattagaacagttggggcaggaactttggcaagat

SEQ ID NO: 3624 - protein, 250 aa, Streptococcus pyogenes
MIDIMSDFQNKTCSKNNFIVGPCSIESYDHIRLAASSAKKLGYNYFRGGAYKPRTSAASFQGLGLQGIRYLHEVCQEFGLLSVSEIMSERQLEEAYDYLDVIQVGARNMQNFEFLKTLSHIDKPILFKRGLMATIEEYLGALSYLQDTGKSNIILCERGVRGYDVETRNMLDIMAVPIIQQKTDLPIIVDVSHSTGRRDLLLPAAKIAKAVGANGIMMEVHPDPDHALSDAAQQIDYKQLEQLGQELWQD

SEQ ID NO: 3625 - DNA, 357 bp, Streptococcus agalactiae
atgattgttggacacggaattgatttacaagagatagaggcgattactaaagcatatgagcgtaatcaacgttttgcagaacgcgttttgaccgaacaagaattgcttctttttaaaggaatttccaatcccaagcgtcagatgtcttttttaacagggcgatgggcagcaaaagaggcttatagcaaagcacttggaacaggaattgggaaagttaattttcatgatatcgaaattttatcggatgataaaggagcgcctttgattacaaaagaaccgtttaatggaaaatcttttgtttcaatatctcatagtggtaattatgcacaagctagtgttattttggaggaagaaaaa

SEQ ID NO: 3626 - protein, 119 aa, Streptococcus agalactiae
MIVGHGIDLQEIEAITKAYERNQRFAERVLTEQELLLFKGISNPKRQMSFLTGRWAAKEAYSKALGTGIGKVNFHDIEILSDDKGAPLITKEPFNGKSFVSISHSGNYAQASVILEEEK

SEQ ID NO: 3627 - DNA, 354 bp, Streptococcus pyogenes
atgattgttggacatggaatagacttacaagagatttcagctattgaaaaagtttatcaaagaaatcctcgctttgctcaaaaaattttaactgagcaggaattggctatttttgagagttttccttacaaacgtcgactcaactatttggcaggacgctggtcaggtaaggaagcttttgctaaggctatagggacaggtattgggcggttaacctttcaagatattgagattttaaatgatgttagaggatgtcccattctgacaaaatctccgtttaaaggaaatagttttattagcatctcacatagtggcaattatgtacaggctagtgttattttggaggataaaaaa

SEQ ID NO: 3628 - protein, 118 aa, Streptococcus pyogenes
MIVGHGIDLQEISAIEKVYQRNPRFAQKILTEQELAIFESFPYKRRLNYLAGRWSGKEAFAKAIGTGIGRLTFQDIEILNDVRGCPILTKSPFKGNSFISISHSGNYVQASVILEDKK

SEQ ID NO: 3629 - DNA, 1098 bp, Streptococcus agalactiae
atgatttcaagttatcatagaccaaccagagccttgatagatttagaggcgattgcaaataacgttaaatctgtacaagagcacattccaagtgataaaaaaacatttgctgtagttaaggctaatgcttatgggcatggtgctgttgaagtttcaaaatacattgagtctattgtagatggtttttgcgtatccaatttagatgaggctattgagctacgtcaagcaggaattgtaaaaatgatattggtattaggtgttgttatgcctgagcaggttatactagccaaaaatgaaaatattactctaacagttgctagcttggagtggttacgtttatgtcagacatcagcagtagatttatctggtctagaagtacatatcaaagttgatagtggaatgggacgtataggtgttcgccagttagatgaaggaaataagctaatttctgaattgggggaaagtggtgcctctgtcaaggggattttcacccattttgcaacagctgatgaagccgataactgtaaattcaatcaacaacttactttttttaaagactttatttcaggattagataattgtccggaccttgttcatgctagtaattctgctacaagcctttggcatagtgagacaatttttaatgccgttagattgggtgttgttatgtacggcttaaatccaagtggaactgatttagacttaccttaccctataaaccctgctttaagtttagagtctgagctagtacatgttaaacaactacacgatggttctcaagttggctatggcgcaacctatcaagttactggagacgaatttgttggaacagtaccgattggctacgctgatggatggacacgagatatgcaaggattttcagttatagtaaatggagaactttgtgaaattattgggcgtgtctcgatggatcaaatgactatccgtttacctcaaaaatatactatcggaactaaagtaaccttgattggtcaacaaggtagttgtaacattacaactacggacgtcgctcaaaaaagacagacgattaattatgaagtactttgtcttttaagcgatcgtattccgagatattat

SEQ ID NO: 3630 - protein, 366 aa, Streptococcus agalactiae
MISSYHRPTRALIDLEAIANNVKSVQEHIPSDKKTFAVVKANAYGHGAVEVSKYIESIVDGFCVSNLDEAIELRQAGIVKMILVLGVVMPEQVILAKNENITLTVASLEWLRLCQTSAVDLSGLEVHIKVDSGMGRIGVRQLDEGNKLISELGESGASVKGIFTHFATADEADNCKFNQQLTFFKDFISGLDNCPDLVHASNSATSLWHSETIFNAVRLGVVMYGLNPSGTDLDLPYPINPALSLESELVHVKQLHDGSQVGYGATYQVTGDEFVGTVPIGYADGWTRDMQGFSVIVNGELCEIIGRVSMDQMTIRLPQKYTIGTKVTLIGQQGSCNITTTDVAQKRQTINYEVLCLLSDRIPRYY

SEQ ID NO: 3631 - DNA, 1098 bp, Streptococcus pyogenes
atgatttcaagtttccatcgcccaacagttgcaagggtcaacttacaagctattaaggagaatgttgccagtgttcaaaagcatattccactaggggtaaaaacgtatgcagttgtcaaggctgatgcttatggtcatggtgctgtccaggtgtcaaaagcactcctacctcaagtggatgggtactgtgtgtcaaatcttgatgaggctttgcaattacgtcaagcaggtattgataaagagattttaattcttggggttttgctgccaaatgaattagagttagcagttgctaatgctattactgttacaatcgctagtttagactggatagctttagctagactggagaaaaaagaatgtcaaggcttaaaagttcatgtaaaagttgattctggtatggggcggatcgggcttcgttcttcaaaagaagtcaatttattgattgatagtctaaaagagttgggtgctgatgtagaaggtattttcactcattttgccacagctgatgaggcagatgatactaaatttaaccagcagttacagttttttaaaaagctgatagctggacttgaggataagcctcgtttagtacatgctagtaattcagccacaagtatctggcatagtgataccatttttaatgctgttcgtttaggaattgtcagttatggtttgaatccaagtggttctgatctaagcttaccgtttccactgcaagaggctttatctctagaatctagcttagtgcatgtcaagatgatttcagctggtgatacagtcggttatggagctacttatactgccaaaaagtctgaatatgtagggactgtcccaatcggttatgcagatggctggaccaggaacatgcaaggcttttcggtgttagttgatggacaattctgcgaaattatagggcgtgtatcgatggatcaactgaccatacgacttcccaaagcatatcctttaggaacaaaagtcactttgattggcagcaatcagcaaaaaaatatttctacaacagatatcgcaaattaccgtaatacaatcaattatgaagttctatgccttttaagtgaccgtattcctcggatatat

SEQ ID NO: 3632 - protein, 366 aa, Streptococcus pyogenes
MISSFHRPTVARVNLQAIKENVASVQKHIPLGVKTYAVVKADAYGHGAVQVSKALLPQVDGYCVSNLDEALQLRQAGIDKEILILGVLLPNELELAVANAITVTIASLDWIALARLEKKECQGLKVHVKVDSGMGRIGLRSSKEVNLLIDSLKELGADVEGIFTHFATADEADDTKFNQQLQFFKKLIAGLEDKPRLVHASNSATSIWHSDTIFNAVRLGIVSYGLNPSGSDLSLPFPLQEALSLESSLVHVKMISAGDTVGYGATYTAKKSEYVGTVPIGYADGWTRNMQGFSVLVDGQFCEIIGRVSMDQLTIRLPKAYPLGTKVTLIGSNQQKNISTTDIANYRNTINYEVLCLLSDRIPRIY

SEQ ID NO: 3633 - DNA, 1536 bp, Streptococcus agalactiae
atgtcaaaacaaaaagtaatggcaactttgttgttatccactttagtcttatcgctatcatcacctttagtgaccttagcagaaactattaatccagaaacaagcctgacaatggcaacagcatcaacagaaagttcttctgaagcagagaaacaggaaaaaacacaacctacagattcagaaactgcttcaccttcagccgaaggaagtatctcaacagaaaaaacagagattggtacgacagagacatcatcaagcaatgaatcatcatcaagttcatcacatcaatcttcttccaacgaagatgctaaaacatctgattctgcttcaacagcatctactcctagcactaatactacaaacagtagtcaagcagacagtaagccaggtcaatcaacaaagactgaattaaaacctgagcctaccttaccattagtagagcctaaaataactcccgctccgtctcagatagaaagtgttcagacaaatcagaatgcttctgttcctgctttatcctttgatgataacttattatcaacaccgatttcaccagtgacagcaacgccattctacgtagaacactggtctggtcaggatgcctactctcactatttattgtcacatcgttacggtatcaaagctgaacaattagatgggtacttaaaatctttagggattcaatatgattctaatcgtatcaatggtgctaagttattacaatgggaaaaagatagtggtttagatgtccgtgctattgtagctattgctgtccttgaaagttcattgggaactcaaggagtggctaagatgccaggtgctaatatgtttggttatggtgcctttgatcatgactctagccatgctagtgcttataatgatgaagaagcaattatgttgttgacaaaaaatacaattattaaaaacaacaactctagctttgaaatccaagatttgaaagcacagaaattatcttctggacaacttaatacagttactgagggtggtgtttattatacagataactctggaactggtaaacgtcgtgcccagattatggaagatttagaccgctggattgatcaacatggagggacaccagaaattcctgctgccttgaaagctttatcgacagcaagtttagcagatttaccaagtggttttagcttatcaacagcagttaacacagctagctatattgcatcaacttatccatggggtgaatgtacatggtatgtctttaaccgcgctaaagagttaggttatacatttgatccatttatgggtaatggtggagattggcaacataaggctggttttgaaacaacacattcaccaaaagtaggctatgctgtatcattttcaccaggacaagctggtgctgatggcacttacggtcacgtagctattgttgaagaagttaaaaaagatggttcagttcttatttcagaatctaatgcaatgggacgtggtattgtctcttaccgtacttttagttcagcacaagctgcacaattaacttatgttattggccataaa

SEQ ID NO: 3634 - protein, 512 aa, Streptococcus agalactiae
MSKQKVMATLLLSTLVLSLSSPLVTLAETINPETSLTMATASTESSSEAEKQEKTQPTDSETASPSAEGSISTEKTEIGTTETSSSNESSSSSSHQSSSNEDAKTSDSASTASTPSTNTTNSSQADSKPGQSTKTELKPEPTLPLVEPKITPAPSQIESVQTNQNASVPALSFDDNLLSTPISPVTATPFYVEHWSGQDAYSHYLLSHRYGIKAEQLDGYLKSLGIQYDSNRINGAKLLQWEKDSGLDVRAIVAIAVLESSLGTQGVAKMPGANMFGYGAFDHDSSHASAYNDEEAIMLLTKNTIIKNNNSSFEIQDLKAQKLSSGQLNTVTEGGVYYTDNSGTGKRRAQIMEDLDRWIDQHGGTPEIPAALKALSTASLADLPSGFSLSTAVNTASYIASTYPWGECTWYVFNRAKELGYTFDPFMGNGGDWQHKAGFETTHSPKVGYAVSFSPGQAGADGTYGHVAIVEEVKKDGSVLISESNAMGRGIVSYRTFSSAQAAQLTYVIGHK

SEQ ID NO: 3635 - DNA, 2013 bp, Streptococcus agalactiae
atgctattacaatcaccaatttctaatcttaagggatttggaccaaaatcagcagaaaaatttcagaaattagatatttatacagtagaagatttacttctttattatccgtttcgctatgaagattttaaatcaaaatctgtttttgatttagtggatggtgaaaaagcagtcattacaggcctagtcgttactccagctaatgtacaatattatggttttaaacgtaaccgtttaagttttaagttgcgtcaaggggaagctgtcttaaatgttagtttttttaatcaaccctatttagctgataaaatagaacttggtcaagaggtagctgtctttggtaaatgggatgcaactaaatcagctattactgggatgaaggttttagctcaagttgaagatgacatgcaacctgtttatcgcgtagctcagggaatttcacagtctactttgattaaagctattaagtcagcttttgaaatcagtgcgcatttggaattgaaggaaaatttaccagctactttattggaaaaataccgattgatgggtcgtagtcaggcttgtttagctatgcatttcccaaaagatatcacagagtataagcaagcgctccgtcggattaaatttgaagaattattttactttcaaatgaaccttcaagttttgaaatccgaaaataaatctgaaacaaatggtttgcctattctttatagtaaacatgctatggagacaaaaatttcctctttaccttttattctaacgaatgctcaaaagcgctctttagatgaaatattatctgatatgtcatcgggagctcatatgaatcgtttattgcaaggagatgtaggatcaggaaagacagtcattgctggtctatcaatgtatgcagcttatacagcaggttttcaatcggctttgatggttccaacggaaatcctagctgaacaacactacattagtctgcaagagttatttccagatttatcaatcgctatattaacttcgggtatgaaagcagctgttaagcgtacggttttagcagctattgcaaatggctcggttgatatgattgtaggaactcatgctcttatccaggactcggtacagtaccataaactggggcttgtaattacagacgagcaacatcgttttggtgttaaacagcgtagaattttccgtgaaaagggagaaaatcctgatgttttaatgatgacagccaccccaattccccgaactctagcaatcacagcttttggagaaatggatgtttctattattgatgaattacctgccggtcgtaaacctattattacacgctgggtgaaacacgagcagctaggtactgtgttggaatgggtaaaaggtgaattgcaaaaagatgctcaagtgtatgtcatttcaccgttgattgaagagtcagaagctttagatttaaagaatgcagtagcattgcatgctgaattatctacttattttgaaggaattgctaaggttgctcttgtacatggacgtatgaaaaatgatgaaaaagatgctataatgcaagatttcaaggataaaaaaagtcatattttagtatctacaacagttattgaagtaggggtaaatgtcccaaatgcaacgatcatgattattatggatgccgatcgttttggattaagccagctacatcaacttcgtgggcgtgttggtcgtggatataaacaatcatacgctgttttagtggctaatcccaaaactgattctgggaaaaaacgaatgacaatcatgacagaaacgacagatggtttcgttttagctgagtcggatttaaaaatgcgtggttctggtgaaatctttggtactcgtcagtctggaattccagaatttcaagtagctgatatcgttgaggattatcctattttagaagaagccagacgtgttgctagtgatattgtcaaagataataattggaaagaaaatacagaatgggcacttattctagataatttacgccaacattcagattttgat

SEQ ID NO: 3636 - protein, 671 aa, Streptococcus agalactiae
MLLQSPISNLKGFGPKSAEKFQKLDIYTVEDLLLYYPFRYEDFKSKSVFDLVDGEKAVITGLVVTPANVQYYGFKRNRLSFKLRQGEAVLNVSFFNQPYLADKIELGQEVAVFGKWDATKSAITGMKVLAQVEDDMQPVYRVAQGISQSTLIKAIKSAFEISAHLELKENLPATLLEKYRLMGRSQACLAMHFPKDITEYKQALRRIKFEELFYFQMNLQVLKSENKSETNGLPILYSKHAMETKISSLPFILTNAQKRSLDEILSDMSSGAHMNRLLQGDVGSGKTVIAGLSMYAAYTAGFQSALMVPTEILAEQHYISLQELFPDLSIAILTSGMKAAVKRTVLAAIANGSVDMIVGTHALIQDSVQYHKLGLVITDEQHRFGVKQRRIFREKGENPDVLMMTATPIPRTLAITAFGEMDVSIIDELPAGRKPIITRWVKHEQLGTVLEWVKGELQKDAQVYVISPLIEESEALDLKNAVALHAELSTYFEGIAKVALVHGRMKNDEKDAIMQDFKDKKSHILVSTTVIEVGVNVPNATIMIIMDADRFGLSQLHQLRGRVGRGYKQSYAVLVANPKTDSGKKRMTIMTETTDGFVLAESDLKMRGSGEIFGTRQSGIPEFQVADIVEDYPILEEARRVASDIVKDNNWKENTEWALILDNLRQHSDFD

SEQ ID NO: 3637 - DNA, 2013 bp, Streptococcus pyogenes
atgatattaacagctcctatgtccaacttaaagggatttggaccaaaatcagcagaaaaatttcagaaattagatatttatacagtagaagatttactgctttattatccgtttcgctatgaagattttaaatcaaaatctgtttttgatttagtggatggtgaaaaagcagtcattacaggcttagtcgttactccagctaatgtacaatattatggttttaaacgtaaccgtttaagtttcaaattgcgtcaaggggaagctgtcttaaatgttagtttttttaatcaaccctatttagctgataaaatagaacttggtcaagaggtagctgtttttggtaaatgggatgccactaaatcggctattactgggatgaaggttttagctcaagttgaagatgacatgcaacctgtttatcgcgtagctcagggaatttcacagtctactttgattaaagctattaagtcagcttttgaaatcgatgcgcatttggaattgaaggaaaatttaccagctactttattggaaaaataccgattgatgggtcgtagtcaggcttgtttagctatgcatttcccaaaagatatcacagagtataagcaagcgctccgtcggattaaatttgaagaattattttactttcaaatgaaccttcaagttttgaaagccgaaaataaatctgaaacaaatggtttgcctattctttatagtaaacgtgctatggagacaaagatttcctctttaccttttattctaacgaatgctcaaaagcgctctttagatgacatattatctgatatgtcatcgggagctcatatgaatcgtttattgcaaggagatgtaggatcaggaaagacagtcattgctggtctatcaatgtatgcagcttatacagcaggttttcaatcggctttgatggttccaacggaaatcctagctgaacaacactacattagtctgcaagagttatttccagatttatcaatcgctatattaacttcgggtatgaaagcagctgtcaagcgtacggttttagcagctattgcaaatggctcggttgatatgattgtaggaactcatgctcttatccaagactcggtacagtaccataaactggggcttgtcattacagacgagcaacatcgttttggtgttaaacagcgtagaattttccgtgaaaagggagaaaatcctgatgttttaatgatgacagccaccccaattccccgaactctagcaatcacagcttttggagaaatggatgtttctattattgatgaattacctgccggtcgtaaacctattatgacacgctgggtgaaacacgagcagctaggtactgtgttggaatgggtaaaaggtgaattgcaaaaagatgctcaagtgtatgtcatttcaccgttgattgaagaatcagaagctttagatttaaagaatgcagtagcattgcatgctgaattatctacttattttgaaggaattgctaaggttgctcttgtacatggacgtatgaaaaatgatgaaaaagatgctataatgcaagatttcaaggataaaaaaagtcatattttagtatccacaacagttattgaagtaggggtaaatgtcccaaatgcaacgatcatgattattatggatgccgatcgttttggattaagtcagttacatcaacttcgtgggcgtgttggtcgtggatataaacaatcatacgctgttttagtggctaatcccaaaactgattcggggaaaaaacgaatgacaatcatgacagaaacgacagatggtttcgttttagctgagtcggatttaaaaatgcgtggttctggtgaaatctttggtactcgtcagtctggaattccagaatttcaagtagctgatatcgttgaggattatcctattttagaagaagcacgcaaagtttctgcagcgattgtttctgatcctaactggatatatgaaaaacagtggcaattagtggcacaaaatattagaaaaaaagaagtttatgat

SEQ ID NO: 3638 - protein, 671 aa, Streptococcus pyogenes
MILTAPMSNLKGFGPKSAEKFQKLDIYTVEDLLLYYPFRYEDFKSKSVFDLVDGEKAVITGLVVTPANVQYYGFKRNRLSFKLRQGEAVLNVSFFNQPYLADKIELGQEVAVFGKWDATKSAITGMKVLAQVEDDMQPVYRVAQGISQSTLIKAIKSAFEIDAHLELKENLPATLLEKYRLMGRSQACLAMHFPKDITEYKQALRRIKFEELFYFQMNLQVLKAENKSETNGLPILYSKRAMETKISSLPFILTNAQKRSLDDILSDMSSGAHMNRLLQGDVGSGKTVIAGLSMYAAYTAGFQSALMVPTEILAEQHYISLQELFPDLSIAILTSGMKAAVKRTVLAAIANGSVDMIVGTHALIQDSVQYHKLGLVITDEQHRFGVKQRRIFREKGENPDVLMMTATPIPRTLAITAFGEMDVSIIDELPAGRKPIMTRWVKHEQLGTVLEWVKGELQKDAQVYVISPLIEESEALDLKNAVALHAELSTYFEGIAKVALVHGRMKNDEKDAIMQDFKDKKSHILVSTTVIEVGVNVPNATIMIIMDADRFGLSQLHQLRGRVGRGYKQSYAVLVANPKTDSGKKRMTIMTETTDGFVLAESDLKMRGSGEIFGTRQSGIPEFQVADIVEDYPILEEARKVSAAIVSDPNWIYEKQWQLVAQNIRKKEVYD

SEQ ID NO: 3639 - DNA, 918 bp, Streptococcus agalactiae
gtgcatatgttacaaaacattggacaaacaggcattcaagcaactcgaattgctttaggttgtatgagaatgagtgacttgaaaggaaaacaagctgaagaagtagttggaacagcattagatttgggtattaatttttttgatcatgctgatatttatgggggagggctatctgaattacgctttcgagatgcaatcaaacatttaaatgtcaatcgtgacaaaatgattattcaatctaaatgtgggatacgagaaggttactttgatttttctaaagagtatattttatcatcagtagatggtattttagaaagattagggacagaatatttagattttctcattcttcatcgtccagatgtattagttgagcctgaagaagtagcagaagcatttaccaaactgagggcagaaggtaaagtaaaacactttggtgttagcaatcaaaaccggtttcaaatggagttgttacaatcctaccttgacgagcccttagcagtgaatcaacttcagttatcgccagcacatacaccaatgtttgatgcagggttaaatgttaacatgttaaataaagcttcaattgaacatgatgatggcattgttgattattgtcgtcttaaaagagttaccattcaagcttggtctccatttcaaattgatttatctcgtggtttatttgttaatcatccggattataaggaattaaatgaaaccatagctaaactggcaaaaaactacaatgttagcagcgaagctattgtgattgcatggattttacgtcatcctgccaaaatgcaggcgattgttggttcaatgaatccatctcgtttaaaggcgattgataaggctaatgatatcgctttaacccgtaaagaatggtatgatatttaccgtagtgcaggtaatatattgcct

SEQ ID NO: 3640 - protein, 306 aa, Streptococcus agalactiae
MHMLQNIGQTGIQATRIALGCMRMSDLKGKQAEEVVGTALDLGINFFDHADIYGGGLSELRFRDAIKHLNVNRDKMIIQSKCGIREGYFDFSKEYILSSVDGILERLGTEYLDFLILHRPDVLVEPEEVAEAFTKLRAEGKVKHFGVSNQNRFQMELLQSYLDEPLAVNQLQLSPAHTPMFDAGLNVNMLNKASIEHDDGIVDYCRLKRVTIQAWSPFQIDLSRGLFVNHPDYKELNETIAKLAKNYNVSSEAIVIAWILRHPAKMQAIVGSMNPSRLKAIDKANDIALTRKEWYDIYRSAGNILP

SEQ ID NO: 3641 - DNA, 876 bp, Streptococcus agalactiae
atgaattcattaaatggggaaactttactaactggtctaattgccaatcctgcacgccactctctatccccgttaatgtggaatacctcttttcaagaaaaaaacatgaattatgcctatctgacatttgaagtagaagagggtaaattaacagaagctgttcgaggtgtcagggcattgggtattcgtggtgttaatgtttcaatgccatttaaacagagtgttatccctttgctagatgatttatctcctcaagctaaattagtgggtgctgtaaatactatcgttaatcaaggtggaaccggacgtttagtaggccatatgacagatggcattggttgttttaaagctttagcagctcaaggtttcagtgctaaaaataaaataattacaatagctggtattggtggttcaggtaaagcagttgcagttcaagcagctatggagggagttgcggaaattagattatttaatcgtaacagctcaaattacgataaggtcattgacttatcagataaaattaaaaaacagtttcaaataaaggtagtcgttgattatctagaaaataagacagcatttaaagacgctattagaactagtcatttttatattgatgctactagtttaggaatgaggccattagataattatagtttaattaacgatccagaaattttaacaccgaatttagtagttgtcgacttggtttacaagcctaaagaaacagcattgttacgatttgttagacaaaatggagtgaaacatgcttataatggtctagggatgctgatttatcaaggagcagaagcatttcaattaataacgaatcaagaaatgcctattagcagtgttgagagagtattacaaactgaaaat

SEQ ID NO: 3642 - protein, 292 aa, Streptococcus agalactiae
MNSLNGETLLTGLIANPARHSLSPLMWNTSFQEKNMNYAYLTFEVEEGKLTEAVRGVRALGIRGVNVSMPFKQSVIPLLDDLSPQAKLVGAVNTIVNQGGTGRLVGHMTDGIGCFKALAAQGFSAKNKIITIAGIGGSGKAVAVQAAMEGVAEIRLFNRNSSNYDKVIDLSDKIKKQFQIKVVVDYLENKTAFKDAIRTSHFYIDATSLGMRPLDNYSLINDPEILTPNLVVVDLVYKPKETALLRFVRQNGVKHAYNGLGMLIYQGAEAFQLITNQEMPISSVERVLQTEN

SEQ ID NO: 3643 - DNA, 876 bp, Streptococcus pyogenes
atgtcagaacgtttatcaggccacaccctgttggtctctttgcttgctacccctattcgtcatagtttgtctcccaaaatgcacaatgaagcctatgctaaactggggctggattatgcctaccttgcttttgaagtagggacagagcaattagcagatgccgtgcaagggattcgtgccttaggaattcgtggctccaatgtgtctatgccaaataaagaagctattttacccttattggatgacttgtccccagctgctgagttggtcggtgcagtcaatacggttgtcaataaggatggtaaaggacatctcgtggggcatattacagacggtataggagcgctcagagccttggctgacgaaggagtgtcggtaaagaacaaaatcattaccctagcaggagttggtggggctgggaaagctatcgctgtccagctcgcttttgacggcgccaaagaggttcgtttgtttaaccgacaagctacacgtctaagtagcgttcaaaagcttgtgacaaaactgaaccagctaacaaggactaaagtaacccttcaagacttggaagatcagactgcctttaaggaggccatcagggaatctcatctatttattgatgctacaagtgtaggaatgaagcctttagaaaatctaagtttgattaccgaccccgagctcattcgcccagacttggtggtctttgacatcgtgtacagcccagcagaaaccaagttactagcctttgcccgtcaacatggcgcccaaaaagtcattaatgggctaggaatggtgctttatcaaggagcagaagcttttaaattaatcactggtcaagacatgccagttgacgctattaaacctcttttaggtgatgag

SEQ ID NO: 3644 - protein, 292 aa, Streptococcus pyogenes
MSERLSGHTLLVSLLATPIRHSLSPKMHNEAYAKLGLDYAYLAFEVGTEQLADAVQGIRALGIRGSNVSMPNKEAILPLLDDLSPAAELVGAVNTVVNKDGKGHLVGHITDGIGALRALADEGVSVKNKIITLAGVGGAGKAIAVQLAFDGAKEVRLFNRQATRLSSVQKLVTKLNQLTRTKVTLQDLEDQTAFKEAIRESHLFIDATSVGMKPLENLSLITDPELIRPDLVVFDIVYSPAETKLLAFARQHGAQKVINGLGMVLYQGAEAFKLITGQDMPVDAIKPLLGDE

SEQ ID NO: 3645 - DNA, 282 bp, Streptococcus agalactiae
atgataccactatcacccatgccagcatatgctttcacgataggaacagttcctgtaattttatctaaatcaaaacgaactctctcttcagttgctttaaagaaaagcaggtcttgtttcataataatcccaagggggccatgtgtaggggtttggaatgtcgaaacgtttgttgtatgtgtttttgtgacatatttagcagcatgtatctcatcattcatgacaactagcacccccttgtcggcagctttagtactattagcgacacggagggctgatagg

SEQ ID NO: 3646 - protein, 94 aa, Streptococcus agalactiae
MIPLSPMPAYAFTIGTVPVILSKSKRTLSSVALKKSRSCFIIIPRGPCVGVWNVETFVVCVFVTYLAACISSFMTTSTPLSAALVLLATRRADR

SEQ ID NO: 3647 - DNA, 960 bp, Streptococcus agalactiae
atgaaaaaaatccttgttctacacacaggtggaacgatttccatgaatgctaacgagaagggacaggtcatgtccagcgccgataacccaatgaaatacgttgatttatcattagatgaccttgatttgactgttgtagattttctaaatcttcccagtcctcaaatcacccctcatcatatgcttgatatctatcactatctgaagcaacatgccagtaattttgatggtgttgtcattacgcatgggactgacactttagaagaaacagcatattttttagacacaatgatactccctaaaatcccaatcatcattaccggtgctatgagaagcacaaatgaacttggtagcgatggcgtttataattacctatcagccctccgtgtcgctaatagtactaaagctgccgacaagggggtgctagttgtcatgaatgatgagatacatgctgctaaatatgtcacaaaaacacatacaacaaacgtttcgacattccaaacccctacacatggcccccttgggattattatgaaacaagacctgcttttctttaaagcaactgaagagagagttcgttttgatttagataaaattacaggaactgttcctatcgtgaaagcatatgctggcatgggtgatagtggtatcattagctttttaaattctcaaaatattagcggattagttattgaagcactcggtgcagggaatatgcccccaaaagctgcacaagaaatcgaagaattaattgagcaaggtgtccctgttgttctagtgtctcgctgttttaatggtattgctgagccagtttacggatatgaaggtggcggagcaaaattacaagaatctggtgtcatgtttgttaaagaactaaacgctcccaaagccagactcaaattactcattgcactcaatgcaggtctcacagggcaaaatctaaaagactatattgaaggt

SEQ ID NO: 3648 - protein, 320 aa, Streptococcus agalactiae
MKKILVLHTGGTISMNANEKGQVMSSADNPMKYVDLSLDDLDLTVVDFLNLPSPQITPHHMLDIYHYLKQHASNFDGVVITHGTDTLEETAYFLDTMILPKIPIIITGAMRSTNELGSDGVYNYLSALRVANSTKAADKGVLVVMNDEIHAAKYVTKTHTTNVSTFQTPTHGPLGIIMKQDLLFFKATEERVRFDLDKITGTVPIVKAYAGMGDSGIISFLNSQNISGLVIEALGAGNMPPKAAQEIEELIEQGVPVVLVSRCFNGIAEPVYGYEGGGAKLQESGVMFVKELNAPKARLKLLIALNAGLTGQNLKDYIEG

SEQ ID NO: 3649 - DNA, 963 bp, Streptococcus pyogenes
atgaaaaaaatcctagtcttacacactggtggaaccatttctatgcaagctgataactctggtagggttgttccaaatcaagataatcctatgacgaaaatacatgctgcagcccaagatattcagcttaccgttagtgattttctaaatcttccgagtcctcacatcacgcctcaccacatgttatctatttatcatcatattcaagaaagaactgatgtctttgatggtatagtcatcacacatggaacagataccttagaagaaacagcttattttttagataccatggcattgcctactaatatacctgttgtcctaacaggtgctatgaggtcttctaatgaagttggtagtgatggcatatataattaccttaccgcacttagagttgcaagtagtgataaagctaaagaaaaaggggtacttgttgttatgaacgatgaaatccatgctgctaaatatgttactaaaacacatacaaccaatatttcaactttccaaacacccacacacggaccgcttggtatcatcatgaaaaatgacctactttttttcaaaactgctgaacctcgtattcgttttgacttgagatgcatttctggaaccatccccattatcaaagcatacgcaggtatgggcgatggtagtatcttgagtctattaactccaggtagcattcaaggtctagttatcgaagctctaggggcaggaaatgtcccaccattagcagttggggagatcgagcacttaattgctttaggtattcctgtcattcttgtttcccgttgtttcaatggtatggcagaacctgtctatgcttatgaaggtggtggtgcgatgctacaagaagcaggtgttatgtttgtaaaagaattgaatgctccaaaagcccgtctaaagttattaattgctctcaacgccggacttactggtcaagagctaaaagattatattgaagga

SEQ ID NO: 3650 - protein, 321 aa, Streptococcus pyogenes
MKKILVLHTGGTISMQADNSGRVVPNQDNPMTKIHAAAQDIQLTVSDFLNLPSPHITPHHMLSIYHHIQERTDVFDGIVITHGTDTLEETAYFLDTMALPTNIPVVLTGAMRSSNEVGSDGIYNYLTALRVASSDKAKEKGVLVVMNDEIHAAKYVTKTHTTNISTFQTPTHGPLGIIMKNDLLFFKTAEPRIRFDLRCISGTIPIIKAYAGMGDGSILSLLTPGSIQGLVIEALGAGNVPPLAVGEIEHLIALGIPVILVSRCFNGMAEPVYAYEGGGAMLQEAGVMFVKELNAPKARLKLLIALNAGLTGQELKDYIEG

SEQ ID NO: 3651 - DNA, 1380 bp, Streptococcus agalactiae
gtggcaattaaggcagtattttttgatattgatggtacacttcttaatgatcgtaagaatgtacaaaagtcaacaattaaagcaattcgaaatttgaaagaccaaggaatactagtcggtttagcaacggggcgaggtcctagttttgtacaaccttttttagaaaaccttggtttagattttgctgtaacctataatggtcaatatatctatagtagaagtgaaattatttataccaatcaattatctaagacaactgtctatcgtctgattcgttatgctggagcaagaagaagagaaatttcattaggaacagcctcaggattactcggttcaggtattattggtctaggaactagccgtttggggcagattgtatctagccttgttccgagaaaatgggcaaaagcgattgaacgaagctttaagcattttattcgtcggattaaacctcaaaatattgatagcctcatggttatcttacgagaacctatttatcaggtcgttttagttgcaacagagggcgaatcagagcgaattcaaaaacaatttcctcgtgttaaattaacaagaagcagtccttactcaatggatgtcatttctgaagggcagtcaaaagttaagggaattgaacgtgttggtcaacgctatggttttgatctatccgaagtgatagcatttggagattctgataatgatattgagatgttatctcaagttggcattggtgttgccatggggaacgctagtcagcaagtgagagaaaatgcacgttatacaactgctgacaataatgatgatggtatctctaaggcattagcccattatggacttatccaatttgagattgaaaaaacattcagtagtcgtgacgagaatttcaataaagtaaaatccttccatctattaatggatggtgaaactattgaaacgccacgcttatatgacagtaaggaagctggtttcaggtcagactttaaagtagaagaaatcgttgagttcttgtatgctgctagtcaaggtaaccaaaaagtatttgaccaatctatccgtaatttacacttagctattgataaagcaagagataaggttatttctaaagaccatccagaaacaccattagtgggagaagtggatgccttaacagatttactttatctgacttatggctcctttgttcttatgggagtcgacccaaaacctctttttgatacagtacatgaggccaatatggggaaaatctttccagatggcaaagctcattttgatcctgttactcataaaattttaaaaccagacgactgggaagaacatttcgctcctgagccatcaattcgacgtgaattagatagccaaattcagaaatccttaaatcgaaaa

SEQ ID NO: 3652 - protein, 460 aa, Streptococcus agalactiae
MAIKAVFFDIDGTLLNDRKNVQKSTIKAIRNLKDQGILVGLATGRGPSFVQPFLENLGLDFAVTYNGQYIYSRSEIIYTNQLSKTTVYRLIRYAGARRREISLGTASGLLGSGIIGLGTSRLGQIVSSLVPRKWAKAIERSFKHFIRRIKPQNIDSLMVILREPIYQVVLVATEGESERIQKQFPRVKLTRSSPYSMDVISEGQSKVKGIERVGQRYGFDLSEVIAFGDSDNDIEMLSQVGIGVAMGNASQQVRENARYTTADNNDDGISKALAHYGLIQFEIEKTFSSRDENFNKVKSFHLLMDGETIETPRLYDSKEAGFRSDFKVEEIVEFLYAASQGNQKVFDQSIRNLHLAIDKARDKVISKDHPETPLVGEVDALTDLLYLTYGSFVLMGVDPKPLFDTVHEANMGKIFPDGKAHFDPVTHKILKPDDWEEHFAPEPSIRRELDSQIQKSLNRK

SEQ ID NO: 3653 - DNA, 1386 bp, Streptococcus pyogenes
ttgacagtaaaagcagtcttttttgatattgatgggacccttctcaatgatcgtaaaaatatccaaaaaacaacgcaaaaagccatccaacaactcaaaaaacaaggcattatggtcggtttagcaactggtcgtggaccgggatttgtacaaccttttctagaaaattttggattagattttgccgttacttacaatgggcaatatatcttaacaagagataaggtcttatatcagaatcaattgccaaagtcgatgatttacaaagtgattcgctatgccaacgaaaaaaagcgagaaatttctcttggaacagcttctggattagcaggatcgcgtattattgatatggggactagcccatttggacaagtcattagtagttttgtgcccaaaagttgggcaagaacagttgagggtagttttaagcatttgattcgccgaatcaagcctcagagttttagaaatttagtaactattatgcgggagcctatttatcaggttgttctggtagcgtcacaagctgaaactaagaaaatacaagagaagttccctcatataaaaattacaagaagtagtccttattccttggatctgatctctgttgatcaatcaaaaataaaaggaattgaacgtttgggagagatgtttggatttgacttgtctgaagtgatggcttttggagattcagataatgaccttgaaatgttatcaggagttggtatcggtattgctatgggaaatgctgaaactgtggtaaaagatggagcccatttcactaccgactctaataataatgatgggatttccaaagccttagctcactacggtctcatccattttgatatagagaagagctttaaaagccgtgatgaaaattttaataaagtcaaagattttcatcgtctgatggactcagatactattgaaacaccgcgtagttataccatttcagaagctggttataggtcaggctttaaagtagaagaaattgttgagtttctttacgcagcaagcaagggagaccaacaacaatttacacaggctattttcgatttgcatggtgctgttgaccaagcagctaataaggtacaagctaaaaaacatgttgaaacgcccctgattgggcaagttgatgccttagcggatttgctttattttacttatggttcttttgtactgatgggagtagatccacaacctatatttgaagcagtacatgaagcaaatatggctaaaatttttccagatggcaaggcacactttgaccccgttacccataaaattcaaaaacctgactattggcaagagcgtcacgcacctgaagtagccataaaaaaagagttagacaaacaattacaaaaatcactacaacgattcgataaa

SEQ ID NO: 3654 - protein, 462 aa, Streptococcus pyogenes
LTVKAVFFDIDGTLLNDRKNIQKTTQKAIQQLKKQGIMVGLATGRGPGFVQPFLENFGLDFAVTYNGQYILTRDKVLYQNQLPKSMIYKVIRYANEKKREISLGTASGLAGSRIIDMGTSPFGQVISSFVPKSWARTVEGSFKHLIRRIKPQSFRNLVTIMREPIYQVVLVASQAETKKIQEKFPHIKITRSSPYSLDLISVDQSKIKGIERLGEMFGFDLSEVMAFGDSDNDLEMLSGVGIGIAMGNAETVVKDGAHFTTDSNNNDGISKALAHYGLIHFDIEKSFKSRDENFNKVKDFHRLMDSDTIETPRSYTISEAGYRSGFKVEEIVEFLYAASKGDQQQFTQAIFDLHGAVDQAANKVQAKKHVETPLIGQVDALADLLYFTYGSFVLMGVDPQPIFEAVHEANMAKIFPDGKAHFDPVTHKIQKPDYWQERHAPEVAIKKELDKQLQKSLQRFDK

SEQ ID NO: 3655 - DNA, 501 bp, Streptococcus agalactiae
ttgagtgcaagaggttatctcttttggttatatttagaggaggacaggcttatgtcacaaaaatatgaacgcatccttgtcgctattgatggatcaacagaatctgaacttgcttttgaaaaggcagttaacgttgctcttcgcaatgattctgaattaatcttgacacatgttatagatacacgtgctttacaaagctttgcgacatttgatacttatatctatgaaaaattagaaaaagaagcaaaagatgtccttgaggaatatgaaaaacaagctcgtgaaaaaggagcagataaagttagacaagtcattgaatttggtaatcccaaaacattacttgcacatgatattccagaaaaagaaaaagtagacttgattatggttggtgcaacaggtcttaatacctttgaacgtttccytatcggatcttcctcagaatacatccttcgtcacgctaaagtagatttactcattgtacgtgaccctaataaaacaatg

SEQ ID NO: 3656 - protein, 167 aa, Streptococcus agalactiae
  MISC_FEATURE (1)..(167): Xaa = Any Amino Acid
MSARGYLFWLYLEEDRLMSQKYERILVAIDGSTESELAFEKAVNVALRNDSELILTHVIDTRALQSFATFDTYIYEKLEKEAKDVLEEYEKQAREKGADKVRQVIEFGNPKTLLAHDIPEKEKVDLIMVGATGLNTFERFXIGSSSEYILRHAKVDLLIVRDPNKTM

SEQ ID NO: 3657 - DNA, 540 bp, Streptococcus pyogenes
atggatcgctttcaaaatgactcaaaaaagagtataatgaaaaaaagaataaaagctattcttgtcaaactgttaaaggaggacagttctatgtcactaaaatataaacgtatcctcgttgctattgatggctcttatgagtctgaattagctttcaataaaggcgttaacgtagcactacgtaacgacgctaccttactactagtacacgttattgatacccgtgccttgcaaagcgtagctacttttgatacttacatctatgaaaaattagaacaagaagctaaggatgttttagatgattttgaaaaacaagcacagatagcaggaattacaaacatcaaacaaattattgaatttggcaaccccaaaaacttactagctcacgatattccagatcgtgagaacgctgatttaattatggtaggagctactggtcttaatacctttgaacgcctccttattggctcatcttctgagtacattatgcgacacgctaagattgacttacttgtagtccgagatagcactaaaacactc

SEQ ID NO: 3658 - protein, 180 aa, Streptococcus pyogenes
MDRFQNDSKKSIMKKRIKAILVKLLKEDSSMSLKYKRILVAIDGSYESELAFNKGVNVALRNDATLLLVHVIDTRALQSVATFDTYIYEKLEQEAKDVLDDFEKQAQIAGITNIKQIIEFGNPKNLLAHDIPDRENADLIMVGATGLNTFERLLIGSSSEYIMRHAKIDLLVVRDSTKTL

SEQ ID NO: 3659 - DNA, 654 bp, Streptococcus agalactiae
atgaagatatttgataaatcaatgaagctggaacatgtagcttatgatattagaggccctgttttagaagaggcggaccgcatgagggcaaatggtgaaaagatattgcggttaaatactggaaatccagctgcctttggcttcgaagcgccagatgaagtcattcgtgatttaattacgaatgcgcgtgaatcagaaggttactctgattcgaaaggtattttttcagctcgtaaggctgttatgcagtattaccagttacaaaacatccatgttgacatggatgatatatacattgttaatggtgttagtgagggaatctctatgtcaatgcaagctttgcttgataatgatgacgaggttctagttccaatgccagattacccgttatggacagcttgtgttagccttgctggtggaaatgctgtgcattatatttgtgatgaggaagctaattggtatcctgatattgatgatatcaaatcaaaaatcacatccaaaacaaaagcaattgtcctcattaatccaaataatccaactggagcagtctatccgcgtgaaattctgcaagagattgtggatatcgctagacaaaatgacttgattattttttcagacgaggtttatgaccgtttctctagagtacgagaagat

SEQ ID NO: 3660 - protein, 218 aa, Streptococcus agalactiae
MKIFDKSMKLEHVAYDIRGPVLEEADRMRANGEKILRLNTGNPAAFGFEAPDEVIRDLITNARESEGYSDSKGIFSARKAVMQYYQLQNIHVDMDDIYIVNGVSEGISMSMQALLDNDDEVLVPMPDYPLWTACVSLAGGNAVHYICDEEANWYPDIDDIKSKITSKTKAIVLINPNNPTGAVYPREILQEIVDIARQNDLIIFSDEVYDRFSRVRED

SEQ ID NO: 3661 - DNA, 1248 bp, Streptococcus pyogenes
ttggtttataatatggaatacgaggtgtatgagactatgaaaattattgaaaaatcatcaaaattagaacatgttgcctatgatattcgagggcctgttttggatgaagctaatcgcatgattgcgagtggtgaaaaaattctgcgtttaaatactggcaatcctgctgcttttggttttgaagcaccagatgaagtgattcgtgatttaattgtcaacgcgaggctaagtgagggctattctgacagtaaagggattttttcagcgcgtaaggctatcatgcagtattgccaactcaagggcttcccagatgttgacattgaagatatttatttgggaaatggcgtgtcagagttgatatccatatcccttcaagctttgctagataatggcgatgaagttttagtaccaatgccggattatcctttatggacggcttgtgtgagtcttggtggaggaaaagcggtccattatctttgtgatgaagaagctggttggtatcctgatattgctgatatcaaatcaaaaatcacgagtcgcaccaaagctattgtggtcatcaatcctaataacccaacaggagccctttatcctaaggagattttagaagacatcgttgctttggcaagagaacaccagctgattatttttgccgatgaaatctatgatcgtttggtgatggatggtaaagagcatattgctattgcaagtttggcacctgatgttttttgtgtatctatgaatggtctttccaaatctcatcgtattgctggttttcgtgttggatggatggtcttatcaggtcctaaagaccatgttaaaggttacattgaagggttaaacatgcttgccaatatgcggttatgctccaatgttttagcccaacaagttgttcaaacttccttaggaggtcatcaatcagttgatgcactgttactgccaggagggcgtatttttgagcaacgtaattttatttatgaagctattaatgctatccctggcttatcggcagttaaacctgaagcaggtctttatttatttccgaaaattgatcgtcagatgtatcgtattgatgatgatgaagaatttgtcttacagttattaaagcaagaaaaagtgatgttggtacatggacgtggttttaactggaaagatccagatcacttccgtattgtttacctaccaagtgtagaagaattagaagatgtccaagaaaagattacacgtgtcttataccagtatagacgt

SEQ ID NO: 3662 - protein, 416 aa, Streptococcus pyogenes
LVYNMEYEVYETMKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISISLQALLDNGDEVLVPMPDYPLWTACVSLGGGKAVHYLCDEEAGWYPDIADIKSKITSRTKAIVVINPNNPTGALYPKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 3663 - DNA, 267 bp, Streptococcus agalactiae
  misc_feature (1)..(267): n = a, c, g, or t
atggcgaaaaaaccatgggaaaaaaaagttgtggaaaacaatagtcatagaaaagacaaaattacaagaacgagtagaggtgtggtgtcaagtactccttggattaccgctttcttgagtgcattctttgttattgtcgttgctattttatttatagtattttatacttcaaatagaggagaagacagagcaaaagaaacttctggtttttatggtgcttcaagccaaaaagttaatagttctaaaacgaaaaaagcatctnnnnnt

SEQ ID NO: 3664 - protein, 89 aa, Streptococcus agalactiae
  MISC_FEATURE (1)..(89): Xaa = Any Amino Acid
MAKKPWEKKVVENNSHRKDKITRTSRGVVSSTPWITAFLSAFFVIVVAILFIVFYTSNRGEDRAKETSGFYGASSQKVNSSKTKKASXX

SEQ ID NO: 3665 - DNA, 474 bp, Streptococcus pyogenes
atggctaaagaaccatgggaagaaaaaattgttgatgatactatagggacacgaacacgtaaatcaagaaatgctttcattagcacgccttggttgactgctttattaagtgtattctttgtcatcattgttgctatactttttattttcttctatacatcaaatagcggtagtaatagacaagctgaaacaaatggtttttatggagcatccactcataaaaaaacaaggaaagcttctaacgctaaaaaaacatcaagtagttcaacaactacagacacaacaccttctagcgaagaaacacttgcttctagtgaaggaactggcgaaacccttactgtattggcaggtgagggggcagcttctattgcagctcgtgcaggtatttctgtggagcagttacaagcacttaatccagagcacatgactcaaggatattggtatgccaatccaggagatcaagtcactattaaa

SEQ ID NO: 3666 - protein, 158 aa, Streptococcus pyogenes
MAKEPWEEKIVDDTIGTRTRKSRNAFISTPWLTALLSVFFVIIVAILFIFFYTSNSGSNRQAETNGFYGASTHKKTRKASNAKKTSSSSTTTDTTPSSEETLASSEGTGETLTVLAGEGAASIAARAGISVEQLQALNPEHMTQGYWYANPGDQVTIK

SEQ ID NO: 3667 - DNA, 195 bp, Streptococcus agalactiae
atgaaagttgcactaattccagaaaaatgtattgcctgcgggctttgccaaacatattcaaatatttttgattatcaagatgatggtatcgttaaattttccgatacagataacctagaaaaagaaattccaagttctgatcaagatactgttttagcagttaaatcatgtcccaccaaagctcttacgattttg

SEQ ID NO: 3668 - protein, 65 aa, Streptococcus agalactiae
MKVALIPEKCIACGLCQTYSNIFDYQDDGIVKFSDTDNLEKEIPSSDQDTVLAVKSCPTKALTIL

SEQ ID NO: 3669 - DNA, 195 bp, Streptococcus pyogenes
atgaaagtatctatcattccagaaaaatgcatcgcttgtggtctatgccaaacctattcatcactttttgattatcatgacaatggtatcgtcacattttcaagctcatctgaaacaagtcagtcaatttgtccttcagataaggacgctattttagctgtcaaatcttgcccaactaaagctcttaccctcgag

SEQ ID NO: 3670 - protein, 65 aa, Streptococcus pyogenes
MKVSIIPEKCIACGLCQTYSSLFDYHDNGIVTFSSSSETSQSICPSDKDAILAVKSCPTKALTLE

SEQ ID NO: 3671 - DNA, 489 bp, Streptococcus agalactiae
atgataaaattatttgggaagatacgttatcactggcaacctgaactttcttgggctattatttattggtcaatagccattgcaccaatttttattggtttatctctgctatatgaaagaactgagattccgagtcaggtatttgttctatttgccatctttattgttttagtgggcattggatttcatcgctattttgttattgaagaagacggatatcttaggattgtatcttttaactttttaagacgaactaagtttccaattgaagatattgctaaaattgaggtcactaaatcaagtgttactatcaaatttaataataaccatgagcgtattttttacatgcgaaaatggcctaaaaaatattttttagatgcactagctattgaacctacatttaagggagaagtggagcttctcgataatttgattaaaatggattattttgaatgttatcgctacgataaaaaagctcttacaaaatcg

SEQ ID NO: 3672 - protein, 163 aa, Streptococcus agalactiae
MIKLFGKIRYHWQPELSWAIIYWSIAIAPIFIGLSLLYERTEIPSQVFVLFAIFIVLVGIGFHRYFVIEEDGYLRIVSFNFLRRTKFPIEDIAKIEVTKSSVTIKFNNNHERIFYMRKWPKKYFLDALAIEPTFKGEVELLDNLIKMDYFECYRYDKKALTKS

SEQ ID NO: 3673 - DNA, 486 bp, Streptococcus pyogenes
atgattaaactatttggtaaaataaggtatcactggcagccagagttgtcttggtctattatttattggtctattgcgtttgcacctatttttgtaggtttatctttgttgtatgagcgcactgaaatacctagtcgggtttttattctatttgctatttttgctgtcctagttggcattggattacatcgttatttcattattgaaaataatggtattttaagaatcgtatcttttaaattgtttggtccacgtaagctacttatttccactattactaagattgaggtgaccaaatcaacactttgtctgcacgttgaagataaaagttatctcttttatatgcgcaaatggcctaaaaaatattttcttgatgccttagcggttaatccatacttccaaggagaagttatattaagtgataactttattaaattagactattttgaagtttatcagcatgataaaaaagcccttactcgaggg

SEQ ID NO: 3674 - protein, 162 aa, Streptococcus pyogenes
MIKLFGKIRYHWQPELSWSIIYWSIAFAPIFVGLSLLYERTEIPSRVFILFAIFAVLVGIGLHRYFIIENNGILRIVSFKLFGPRKLLISTITKIEVTKSTLCLHVEDKSYLFYMRKWPKKYFLDALAVNPYFQGEVILSDNFIKLDYFEVYQHDKKALTRG

SEQ ID NO: 3675 - DNA, 1218 bp, Streptococcus agalactiae
atgtcttacgaaaagcttttagaacgatttttaacatacgtcaaaataaatacaagaagtaatcctaatagtacacaaacgccaacaactcaaagtcaagttgactttgctttaacagttttaaaaccagaaatggaagcaattggtttaaaagatgttcattatttaccttctaatgggtatttggttggaaccttacctgctacaagcgaccgcttacgccataaaataggttttatatcccatatggatacagctgatttcaatgctgaaaatattactccacaaattgttgactataaaggtggagatattgaacttggagactcaggttacattttaagtccaaaagattttccaaatttaaataattaccatgggcaaacactgattacaacagatggtaaaaccttactgggagcagacgataagtctggtatagcagaaatcatgacagctatggaatatttggcttcgcatccagaaattgagcattgtgaaattagagttggctttggaccagacgaagaaattggtataggtgcagataaatttgatgttaaagattttgatgttgattttgcctatacagtggatggtggaccactaggagaattacagtatgaaacctttagtgcagctggtttggagcttacatttgaaggacgaaacgttcaccctggaactgcaaaaaatcaaatgattaatgctttacagcttgctatggattttcatagtcaattaccagaaaatgaacgtcctgaacaaacagatggctatcaaggattttatcacttatatgatttaagtggaacagttgatcaagctaaaagttcatatatcattcgagattttgaggaagttgatttcttaaagcgtaagcacttggctcaagatatcgctgataatatgaatgaagcattacaatctgaacgtgtaaaggttaaactatacgatcaatattacaacatgaagaaagttattgaaaaagacatgacacctatcaacattgctaaagaagtaatggaagagttagacatcaagccaatcatagaaccgattcgtggtggtacagatggctctaaaatttcctttatgggaatccctactcctaatctttttgcaggtggtgaaaacatgcatggacgctttgaattcgttagtctacaaacaatggaaaaagcagttgatgttattttaggcatcgttgctaaggat

SEQ ID NO: 3676 - protein, 406 aa, Streptococcus agalactiae
MSYEKLLERFLTYVKINTRSNPNSTQTPTTQSQVDFALTVLKPEMEAIGLKDVHYLPSNGYLVGTLPATSDRLRHKIGFISHMDTADFNAENITPQIVDYKGGDIELGDSGYILSPKDFPNLNNYHGQTLITTDGKTLLGADDKSGIAEIMTAMEYLASHPEIEHCEIRVGFGPDEEIGIGADKFDVKDFDVDFAYTVDGGPLGELQYETFSAAGLELTFEGRNVHPGTAKNQMINALQLAMDFHSQLPENERPEQTDGYQGFYHLYDLSGTVDQAKSSYIIRDFEEVDFLKRKHLAQDIADNMNEALQSERVKVKLYDQYYNMKKVIEKDMTPINIAKEVMEELDIKPIIEPIRGGTDGSKISFMGIPTPNLFAGGENMHGRFEFVSLQTMEKAVDVILGIVAKD

SEQ ID NO: 3677 - DNA, 1233 bp, Streptococcus pyogenes
ttgaggtggcctatgaagtacgataacttgttagatcgatttataaaatatgtcaaagtgaatacaagaagcgttccagacagtgagactactcctagtacggagagtcaagaagcatttgccttaacgattttaaagcctgaaatggaggcaattggtttgcaagatgttcattataatccagttaatggctatcttattggaactctgcctgccaataatccaaccttgacgcgtaaaattggttttatagcccatatggatacggctgatttcaatgctgaaaatgttaatccgcagattattgacaattatcaaggaggggacattacacttggcagttctaattataagttggatccaaaagcatttccaaatcttaataattatatcggtcaaacattgattaccactgatgggactacacttttaggggcagatgataaatctggtattgctgaaatcatgacagcaatagaattcttgacatcacaaccacaaatagagcactgtgacattaaagtggcttttggccctgatgaagagattggggtcggagctgataagtttgaggtggctgattttgaggtggattttgcttatactatggatggcggtcctttaggcgaattgcaatatgaaactttcagcgctgcagctctagaagtgacttttttaggcagaaatgttcatcctggtacggctaaggatcaaatgattaatgcccttgagttagcaatagattttcatgagaagctacctgctaaagatcggcctgaatacacagatggttatcaaggtttctatcacttaacgggactaactggaacagttgaagaggcacgcgcatcttacattattcgtgattttgaagaagcatcatttgaagctagaaaagtgaaagttgaaaatatagctcaatcgatgaatgctcagctaggaacaaaacgtgtcttggtagagcttaatgaccaatactacaatatgaaaaaagttatcgaaaaagatatgaccgctattgagttagctaaagaagtaatggaagagcttgctatcaagcctgtaatcgaacccatacgtggaggaacagatggctctaaaatttcatttatgggtattcccactcctaatatttttgcagggggtgagaatatgcacgggcgttttgagtttgttagcttacaaacgatggagagagctgtcgatgtcattattggacttgtttgcaaagcc

SEQ ID NO: 3678 - protein, 411 aa, Streptococcus pyogenes
LRWPMKYDNLLDRFIKYVKVNTRSVPDSETTPSTESQEAFALTILKPEMEAIGLQDVHYNPVNGYLIGTLPANNPTLTRKIGFIAHMDTADFNAENVNPQIIDNYQGGDITLGSSNYKLDPKAFPNLNNYIGQTLITTDGTTLLGADDKSGIAEIMTAIEFLTSQPQIEHCDIKVAFGPDEEIGVGADKFEVADFEVDFAYTMDGGPLGELQYETFSAAALEVTFLGRNVHPGTAKDQMINALELAIDFHEKLPAKDRPEYTDGYQGFYHLTGLTGTVEEARASYIIRDFEEASFEARKVKVENIAQSMNAQLGTKRVLVELNDQYYNMKKVIEKDMTAIELAKEVMEELAIKPVIEPIRGGTDGSKISFMGIPTPNIFAGGENMHGRFEFVSLQTMERAVDVIIGLVCKA

SEQ ID NO: 3679 - DNA, 1665 bp, Streptococcus agalactiae
atgctaaataatattgaaaatagaaagtttaccatgtcacaaaaaacaacaaaagttagtcagcaagaacaaatggtcaaagggacggcttggttaacagcagggaatttcattagtcgcttgctgggagccatctatattatcccttggtatgcttggatgggaaagcatgctgccgaagcaaatgctttatttgggatgggatatgaaatctatgctttatttcttttgatatcaactgttggaattccagtagcagttgcaaaacaggtatctaagtataacactttaggtaaagaagagatgagcatttatctggttcggaaaatcttgcagtttatgctgattttaggtggaatttttgcattaattatgtatattggttcacctctatttgcttcacttagtaaaggagggcaagaactcgttccaatattgcgtagtctaactctagctgttttagtttttccttcaatgagtgttttacgtggtttttttcaaggttttaataatttaaaaccgtatgccattagtcaagtcgctgagcagattatacgtgtcatatggatgttattaactgctttctatattatgcgtctaggatcaggagattatattgccgctgtgacacagtcaacattcgccgcctttgtcggtatgtttgctagtatagctgtgctgctttatttcttatggcgttataatatgctatctgccttgattggtaaaactccaaagcacattaaattagatactaaagaaatcctaattgagactattaaggaagcaatcccttttattattactggtgcagcaattcaaattttcaaactgattgatcagttttcatttgggaatacgatggcgctctttacgaattattcaagtgaagaattacgggttatgtttgcttacttttcaagcaaccctggtaaagttacgatgattctaattgctgttgctaccgcaattgctggagttggtattccattgttaacagagaattttgttaagaatgataaaaaagccgccgctcgtttggttgttaataatctacaaatgttactaatgtttttactgccagctgttgcaggatccgttattttagcaaaacctttgtatacagtcttttatgggttaccgcagggacaagctttaggactttttgtcatatctcttattcaaacaattattttatctatttatactgttttagcaccaatgctacaagcattgtttgaaaatcgtaaagctattatttacttcctatatggtctggtggcaaaagttattttacaacttccctccattttccttttccatgcctatggaccacttttctcaacgacagtagctctttgtatcccagtaattcttatgtatttgaaaatacatgaaattacaggatttaaacgccaagctattcgtcgtacaagtgctttagtccttattctaacgctattgatgagctttattatttctatgataatatggttaatgaatctggttattgtacccgatagtagactggtaagtctagtttacattatcgttatcggtgcaataggtttaggggtatatggctttatggcactggccacccatctacttgataaaatgattggtagtcgtgctcaagacttacgccgaaagttgcaccttaac

SEQ ID NO: 3680 - protein, 555 aa, Streptococcus agalactiae
MLNNIENRKFTMSQKTTKVSQQEQMVKGTAWLTAGNFISRLLGAIYIIPWYAWMGKHAAEANALFGMGYEIYALFLLISTVGIPVAVAKQVSKYNTLGKEEMSIYLVRKILQFMLILGGIFALIMYIGSPLFASLSKGGQELVPILRSLTLAVLVFPSMSVLRGFFQGFNNLKPYAISQVAEQIIRVIWMLLTAFYIMRLGSGDYIAAVTQSTFAAFVGMFASIAVLLYFLWRYNMLSALIGKTPKHIKLDTKEILIETIKEAIPFIITGAAIQIFKLIDQFSFGNTMALFTNYSSEELRVMFAYFSSNPGKVTMILIAVATAIAGVGIPLLTENFVKNDKKAAARLVVNNLQMLLMFLLPAVAGSVILAKPLYTVFYGLPQGQALGLFVISLIQTIILSIYTVLAPMLQALFENRKAIIYFLYGLVAKVILQLPSIFLFHAYGPLFSTTVALCIPVILMYLKIHEITGFKRQAIRRTSALVLILTLLMSFIISMIIWLMNLVIVPDSRLVSLVYIIVIGAIGLGVYGFMALATHLLDKMIGSRAQDLRRKLHLN

SEQ ID NO: 3681 - DNA, 1632 bp, Streptococcus pyogenes
atgtcgacagaaaaaaaacaactgacacaagaagaattgatggttcagggagcagcctggtccacagctggtaatttcattagccgacttttgggagtgttatacattattccctggtacatttggatggggcaatacgcgattcaagccaacgctcttttcaatatggggtataatgtttatgcttattttttattgatttcaaccacaggactcaatgttgcgattgctaagcaggttgccaagtacaattccatgggacaaactgagcatagctatcaattaatccgaagtaccctaaaactcatgcttggtctgggccttattttttcagccattatgtatctgggctctcctttatttgcgagcttatctggtggtgatgacacacttgttcccattatgcacagcctttctttagcagtttttatttttcctgtaatgagtgtgattcgaggcatctttcaaggccacaataatatcaagccttatgcagttagtcagattgctgagcaactcattcgggttatctggatgcttttgaccaccttttttatcatgaagttgggttctggtgattacgcttcagcagtgactcagtcaacttttgcagcctttatcgggatggtggctagtatgggtgttctggggtactatctttggaaacagggacttctagcagctatttttagtaagccagatcatactgtttctattgatatcaagggcttgttgcttgaaaccttaaaagaatccatcccctttatcgtaacaggaagtgccattcaagcctttcaattgattgatcaatggacttttgtcaatacgatgactctttttacagattatagccgttctcaattgcttgttttatttggttactttaacgcaaacccagccaaaattacaatggtcttaattgcagtagcagcatctattggtggtgtaggtattgccttgttaactgaaaattatgtcaaaaaagacatgaaagcagctgctcgtttaatcattaacaacattgaaatgttagtgatgtttttgttacctgctcttactggggcaattattttagcaagacctctatattctgttttttacggagctagcgaggagcgtgccattcacctctttgtggcggttctctttcaaaccttgctactggcgctttacaccctcttttcaccgatgcttcaagctctttttgaaaatcgaaaagcgatttactactttgcctatggtatcttgattaagttagttttacagataccgcttatttatttgctacatgcttatggtcctttactagcgacgacgattgctttagtggtgccgatttatttgatgtatcgacgcctatatcaggttactcattttaaccgcaaactgttgcaaaaacgtttattattaaccttaattgaaaccttattaatgggactggtcgtgtttgtggccaactggctattgggctatgcctttaaaccgacaggccgcttgaccagccttctttacctcctcattattggtggcttgggaatgacggtttacacggcactcaccttgctgacgcatcaactggataaattaattggtagcaaagctagtcgccttcgtcagaaattaggctggcat

SEQ ID NO: 3682 - protein, 544 aa, Streptococcus pyogenes
MSTEKKQLTQEELMVQGAAWSTAGNFISRLLGVLYIIPWYIWMGQYAIQANALFNMGYNVYAYFLLISTTGLNVAIAKQVAKYNSMGQTEHSYQLIRSTLKLMLGLGLIFSAIMYLGSPLFASLSGGDDTLVPIMHSLSLAVFIFPVMSVIRGIFQGHNNIKPYAVSQIAEQLIRVIWMLLTTFFIMKLGSGDYASAVTQSTFAAFIGMVASMGVLGYYLWKQGLLAAIFSKPDHTVSIDIKGLLLETLKESIPFIVTGSAIQAFQLIDQWTFVNTMTLFTDYSRSQLLVLFGYFNANPAKITMVLIAVAASIGGVGIALLTENYVKKDMKAAARLIINNIEMLVMFLLPALTGAIILARPLYSVFYGASEERAIHLFVAVLFQTLLLALYTLFSPMLQALFENRKAIYYFAYGILIKLVLQIPLIYLLHAYGPLLATTIALVVPIYLMYRRLYQVTHFNRKLLQKRLLLTLIETLLMGLVVFVANWLLGYAFKPTGRLTSLLYLLIIGGLGMTVYTALTLLTHQLDKLIGSKASRLRQKLGWH

SEQ ID NO: 3683 - DNA, 1452 bp, Streptococcus agalactiae
atgattacaatagataaaattttagaaattttaaaaaatgaccataatttcagagagattttgtttcatgagcattattattataactggacacaaaatgtaacttttaatgccttatcatatgatagtcgtcaaatttcatctgatactttatttttcgctaagggtgctacttttaaaaaagaatatctagattctgcaatcacagcaggcctttctttttacgtttctgagacagattacggcgccgatattccagtgatattagtcaatgatatcaaaaaagccatgagtttgatatctatgtctttctataataacccacaaaacaaacttaaacttctagcttttactggaacaaaaggaaaaacaactgcggcttactttgcttatcatatgttaaaagtaaaccatcgtcctgctatgctctcaactatgaacacaacattagatggtaaatctttctttaaatcacatctcacaacccccgagagtcttgatttatttcggatgatggctacagccgttgagaatcaaatgacacacttaattatggaagtatcaagccaagcatacctaaccaaacgtgtttatggtttaacctttgacgttggcgttttcttaaatattagtcccgatcatattggtcctatcgagcaccctacattcgaagattattttttccacaaacggctcttgatggagaatagcaatgctgttgttgtaaatagtcagatggatcattttaatattgtcaaagaacaggtcgaatatattcctcatgatttctatggagattattctgaaaatgttatcacagaatcaaaggccttttctttccatgtcaaaggaaagttggagaacacctacgatatcaagctgattggaaaattcaatcaagaaaatgctatcgcagctggacttgcttgtctccgacttggtgtttcaattgaagatataaaaaacggaattgcacaaactaccgtccctggccgcatggaagtcctaacacaaaccaacggcgcaaagattttcgttgactatgcccacaacggagacagtttgaagaaattattagctgttgttgaggaacaccaaaaaggggatattatattagtactcggagctcctggtaataaaggtcaaagccgtcgtaaagactttggagatgtcattaatcaacatcctaatctacaagtgatactcactgcagatgatcctaattttgaagatcccttagttatctcacaagaaatagcaagccatattaatcgtccggttactatcatcattgatcgagaagaagcaattgctaatgccagtactcttactaattgcaaactagatgcaattattatcgctggtaaaggagcagatgcttatcaaattatcaaaggaaatcgtgacaattactctggagatttagaagttgcgaaaaaataccttaaacga

SEQ ID NO: 3684 - protein, 484 aa, Streptococcus agalactiae
MITIDKILEILKNDHNFREILFHEHYYYNWTQNVTFNALSYDSRQISSDTLFFAKGATFKKEYLDSAITAGLSFYVSETDYGADIPVILVNDIKKAMSLISMSFYNNPQNKLKLLAFTGTKGKTTAAYFAYHMLKVNHRPAMLSTMNTTLDGKSFFKSHLTTPESLDLFRMMATAVENQMTHLIMEVSSQAYLTKRVYGLTFDVGVFLNISPDHIGPIEHPTFEDYFFHKRLLMENSNAVVVNSQMDHFNIVKEQVEYIPHDFYGDYSENVITESKAFSFHVKGKLENTYDIKLIGKFNQENAIAAGLACLRLGVSIEDIKNGIAQTTVPGRMEVLTQTNGAKIFVDYAHNGDSLKKLLAVVEEHQKGDIILVLGAPGNKGQSRRKDFGDVINQHPNLQVILTADDPNFEDPLVISQEIASHINRPVTIIIDREEAIANASTLTNCKLDAIIIAGKGADAYQIIKGNRDNYSGDLEVAKKYLKR

SEQ ID NO: 3685 - DNA, 1443 bp, Streptococcus pyogenes
atgataaccattgaacaattattagacattttaaaaaaagaccataattttcgtgaggttcttgatgccgacggataccactaccattatcaaggctttagttttgagcgcttgagttacgatagccgtcaagtagatggcaagacccttttttttgctaaaggggcaactttcaaagctgactaccttaaagaagcaatcactaacggattacaactctatatttcagaggtagattacgagcttggtattcccgttgttttggtcactgatatcaaaaaagctatgagtctaattgccatggctttctatggcaaccctcaagaaaagctcaaactactagcttttacaggtactaagggaaagacgacggctgcttattttgcctaccacatgttgaaagaatcctataaacctgccatgttttctaccatgaataccaccttagatggcaagacctttttcaaatcacaactcacaactcctgagagcttggatctttttgctatgatggctgagtgtgtgactaatggcatgacccacttgattatggaagtttctagtcaggcttacctcgttgaccgtgtctatgggcttacgttcgatgttggggttttcctaaatattagtcctgatcatattggcccaatcgagcatccaacgtttgaagattatttctatcataagcgtcttttaatggagaatagcagagctgttgtgatcaatagcgggatggatcatttttcatttctagcggatcaggtagcggatcaagagcatgtgttttatggtcccttgtctgacaaccagatcaccactagccaagccttctcctttgaagctaaaggacaattagctggccattatgacattcaattaattggccattttaaccaagaaaatgctatggcagctggacttgcctgccttcgtttgggtgctagcctagctgatattcaaaaaggtatcgctaagactcgcgtcccaggccgtatggaagtcctcactatgacaaatcatgctaaagtttttgttgattatgcccataatggtgacagcttagaaaaattactcagcgttgtggaagaacatcagacaggcaaattaatgttgattttaggtgcaccaggaaataaaggcgagagcagacgagctgattttggtagggtgattcatcagcatccaaacctcaccgtcattctcactgctgatgaccctaatttcgaggatccagaagatatttcaaaagaaattgccagccatatcgcacgcccagtagagattattagtgaccgtgagcaagctattcaaaaagccatgtctctttgccaaggagcaaaagatgctgtgattatcgctgggaaaggcgcagatgcttatcaaattgttaaaggacaacaagtagcttatgctggtgatttagcaatcgccaaacactacctc

SEQ ID NO: 3686 - protein, 481 aa, Streptococcus pyogenes
MITIEQLLDILKKDHNFREVLDADGYHYHYQGFSFERLSYDSRQVDGKTLFFAKGATFKADYLKEAITNGLQLYISEVDYELGIPVVLVTDIKKAMSLIAMAFYGNPQEKLKLLAFTGTKGKTTAAYFAYHMLKESYKPAMFSTMNTTLDGKTFFKSQLTTPESLDLFAMMAECVTNGMTHLIMEVSSQAYLVDRVYGLTFDVGVFLNISPDHIGPIEHPTFEDYFYHKRLLMENSRAVVINSGMDHFSFLADQVADQEHVFYGPLSDNQITTSQAFSFEAKGQLAGHYDIQLIGHFNQENAMAAGLACLRLGASLADIQKGIAKTRVPGRMEVLTMTNHAKVFVDYAHNGDSLEKLLSVVEEHQTGKLMLILGAPGNKGESRRADFGRVIHQHPNLTVILTADDPNFEDPEDISKEIASHIARPVEIISDREQAIQKAMSLCQGAKDAVIIAGKGADAYQIVKGQQVAYAGDLAIAKHYL

SEQ ID NO: 3687 - DNA, 111 bp, Streptococcus agalactiae
ttgtcaaattgccaaggtatttttggtgtgggaaccgtccataagatattagttcataaactgttatcccttcagttgcttctaacacctgtgggagaagtgcaatcttct

SEQ ID NO: 3688 - protein, 37 aa, Streptococcus agalactiae
MSNCQGIFGVGTVHKILVHKLLSLQLLLTPVGEVQSS

SEQ ID NO: 3689 - DNA, 810 bp, Streptococcus agalactiae
ttgctagaaaggttctctatgtctcacataaaagcagaaaacattatcgtatcttacgatcagaaagaaatcatcaataatctttccctcagtatacttaaccaaaaaataacaacgattattggtgccaatggatgtggaaagtctactcttttgaaggctctcacacgcatccataaaataaaagatggtactatcactattgatggtcatgatattgcacatttacccacaaaggaaattgctaagaagattgcacttctcccacaggtgttagaagcaactgaagggataacagtttatgaactaatatcttatggacggttcccacaccaaaaataccttggcaatttgacaaatgacgatcgcagtaaaatccattgggcgatggaaatgactaacgtagcgcaatttgctaatagagatgttgatgacctttcaggaggtcagaggcaaaaagtatggattgctatggctttagcacaagatacagatactatctttttagacgaacctacaacttatcttgacatgaatcatcaattagaagtcttagaattgctcaaaaaacttaatgacgaaacgcaaaaaacaattattatggtcctacacgacctaaacctgtctgcgcgctattctgattatctagttgcaatgaaaaccggtaaaattatctatgaaggtagtcctagtcagatcatgactaaagatattatcaaagatatttttaagattgatgctcatatcattcaggaccctattagtaaacaacctgttttgttatcttatcaattatcaactgatcaaaat

SEQ ID NO: 3690 - protein, 270 aa, Streptococcus agalactiae
MLERFSMSHIKAENIIVSYDQKEIINNLSLSILNQKITTIIGANGCGKSTLLKALTRIHKIKDGTITIDGHDIAHLPTKEIAKKIALLPQVLEATEGITVYELISYGRFPHQKYLGNLTNDDRSKIHWAMEMTNVAQFANRDVDDLSGGQRQKVWIAMALAQDTDTIFLDEPTTYLDMNHQLEVLELLKKLNDETQKTIIMVLHDLNLSARYSDYLVAMKTGKIIYEGSPSQIMTKDIIKDIFKIDAHIIQDPISKQPVLLSYQLSTDQN

SEQ ID NO: 3691 - DNA, 930 bp, Streptococcus agalactiae
atgaaaaaaattggaattattgtcctcacactactgaccttctttttggtatcttgcggacaacaaactaaacaagaaagcactaaaacaactatttctaaaatgcctaaaattgaaggcttcacctattatggaaaaattcctgaaaatccgaaaaaagtaattaattttacatattcttacactgggtatttattaaaactaggtgttaatgtttcaagttacagtttagacttagaaaaagatagccccgtttttggtaaacaactgaaagaagctaaaaaattaactgctgatgatacagaagctattgccgcacaaaaacctgatttaatcatggttttcgatcaagatccaaacatcaatactctgaaaaaaattgcaccaactttagttattaaatatggtgcacaaaattatttagatatgatgccagccttggggaaagtattcggtaaagaaaaagaagctaatcagtgggttagccaatggaaaactaaaactctcgctgtcaaaaaagatttacaccatatcttaaagcctaacactacttttactattatggatttttatgataaaaatatctatttatatggtaataattttggacgcggtggagaactaatctatgattcactaggttatgctgccccagaaaaagtcaaaaaagatgtctttaaaaaagggtggtttaccgtttcgcaagaagcaatcggtgattacgttggagattatgcccttgttaatataaacaaaacgactaaaaaagcagcttcatcacttaaagaaagtgatgtctggaagaatttaccagctgtcaaaaaagggcacatcatagaaagtaactacgacgtgttttatttctctgaccctctatctttagaagctcaattaaaatcatttacaaaggctatcaaagaaaatacaaat

SEQ ID NO: 3692 - protein, 310 aa, Streptococcus agalactiae
MKKIGIIVLTLLTFFLVSCGQQTKQESTKTTISKMPKIEGFTYYGKIPENPKKVINFTYSYTGYLLKLGVNVSSYSLDLEKDSPVFGKQLKEAKKLTADDTEAIAAQKPDLIMVFDQDPNINTLKKIAPTLVIKYGAQNYLDMMPALGKVFGKEKEANQWVSQWKTKTLAVKKDLHHILKPNTTFTIMDFYDKNIYLYGNNFGRGGELIYDSLGYAAPEKVKKDVFKKGWFTVSQEAIGDYVGDYALVNINKTTKKAASSLKESDVWKNLPAVKKGHIIESNYDVFYFSDPLSLEAQLKSFTKAIKENTN

SEQ ID NO: 3693 - DNA, 930 bp, Streptococcus pyogenes
atgaaaaaattaactctactattaacactctgtttgacaactattaccttaatcgcctgtggtaatcaagcaactaatcattctaacaccgcctcaaaaagtttatcgcctatgcctcaaattgctggtgtgacttattacggagatattcctaaacagcctaagcgagtagtcagtctggcttcaacttacactggttacctcaaaaaattagatatgaatctagtcggggttacttcttatgacaagaaaaaccccatcttagcaaagactgtaaaaaaagcaaagcaagttgctgcaactgatttagaagccgttacaacgcttaagcctgacctcattgttgttggctctacagaagaaaatattaaacaattggcagaaattgcgcctgttatctcgattgaataccgcaaacgtgattatttacaagtgttatctgacttcggccgcatctttaacaaagaagacaaagccaagaagtggttaaaagattggaaaactaaaacagcagcttatgaaaaagaagtcaaggccgttacaggtgacaaagcaacctttactattatggggctttatgaaaaagacgtttacctttttggtaaagactggggacgtggcggagagattatccatcaagctttccattatgatgctcctgaaaaagtgaagactgaagtttttaaacaaggttacctgtcattgtcgcaggaagtcttgccagactatattggtgattatgtcgtcgttgctgcagaagatgataagactggttctgctctatatgaaagcaagctatggcaatccattccagctgtgaaaaaacaccatgtgatcaaagtcaatgccaatgttttttactttactgatcctctttctttagaatatcaattagagactttacgagaggcaatcttatcaagtgaaaac

SEQ ID NO: 3694 - protein, 310 aa, Streptococcus pyogenes
MKKLTLLLTLCLTTITLIACGNQATNHSNTASKSLSPMPQIAGVTYYGDIPKQPKRVVSLASTYTGYLKKLDMNLVGVTSYDKKNPILAKTVKKAKQVAATDLEAVTTLKPDLIVVGSTEENIKQLAEIAPVISIEYRKRDYLQVLSDFGRIFNKEDKAKKWLKDWKTKTAAYEKEVKAVTGDKATFTIMGLYEKDVYLFGKDWGRGGEIIHQAFHYDAPEKVKTEVFKQGYLSLSQEVLPDYIGDYVVVAAEDDKTGSALYESKLWQSIPAVKKHHVIKVNANVFYFTDPLSLEYQLETLREAILSSEN

SEQ ID NO: 3695 - DNA, 123 bp, Streptococcus agalactiae
ttgggaataaaaagcttaataaaatgtggaataatcaatccaatgaaagaaacggttcctatcaaagcgactgatgaagctgataaaaacaaaacaataagtaatagaaacgcagtcattaat

SEQ ID NO: 3696 - protein, 41 aa, Streptococcus agalactiae
MGIKSLIKCGIINPMKETVPIKATDEADKNKTISNRNAVIN

SEQ ID NO: 3697 - DNA, 1023 bp, Streptococcus agalactiae
atgtttaaagcttcaaaaaaactcgttcaaaaaaataagtcaaatcatttttggcttgtttttttcataacacttatactatttcttattggttgttacgccagcttacgatttggtgctatcaatttcaagactagtgatttaataactgttttaaaaaatcccttaaaaaactctaatgctcaggatgttatttttgacattagactaccacgcataattgcagctatcttagtaggtgcagctatgtcacaagcaggtgctattatgcagggagtcactcgaaacgccattgctgatcctggactactaggtattaacgccggagctgggttagcccttgttgtagcatatgcttttttagggagcatgcactatagtacgattctcatagtctgcttactagggtctgtcatttcttgtcttttagtcttcacactctcttatacaaagcaaaagggttaccaccaactacgactcattttagccggagcgatgatctccacactttttacgtctgttggacaagtggttacattatactttaaactcaatcgaactgttatcggttggcaagcaggtggtttatcccaaattaactggaaaatgctaatcataatagcacctatcattattttaggtttacttatttcacaactcctagcacatcaattaactatcttgagccttaatgaatctgtggccaaagcattgggacaaaaaactcaattaatgactgcgtttctattacttattgttttgtttttatcagcttcatcagtcgctttgataggaaccgtttctttcattggattgattattccacattttattaagctttttattcccaaagattatcgtctgttattacctttaataggattttcaggggctactttcatgatctgggtagacttatcatctcgtattataaatcccccttcagagacatcaattagttctataatcagtatcgtagggcttccatgtttcctatggttaattagaaaagggaaaaatcta

SEQ ID NO: 3698 - protein, 341 aa, Streptococcus agalactiae
MFKASKKLVQKNKSNHFWLVFFITLILFLIGCYASLRFGAINFKTSDLITVLKNPLKNSNAQDVIFDIRLPRIIAAILVGAAMSQAGAIMQGVTRNAIADPGLLGINAGAGLALVVAYAFLGSMHYSTILIVCLLGSVISCLLVFTLSYTKQKGYHQLRLILAGAMISTLFTSVGQVVTLYFKLNRTVIGWQAGGLSQINWKMLIIIAPIIILGLLISQLLAHQLTILSLNESVAKALGQKTQLMTAFLLLIVLFLSASSVALIGTVSFIGLIIPHFIKLFIPKDYRLLLPLIGFSGATFMIWVDLSSRIINPPSETSISSIISIVGLPCFLWLIRKGKNL

SEQ ID NO: 3699 - DNA, 939 bp, Streptococcus pyogenes
gtgaaaactaagcatccctttttgtgtctcgagcgtttttgcttaaaaaaaacgcagataatcactaagtcacatatcttttggcttgtctttgtgctacttagttttagcttatgtgttgctatttactgtcatctgcgctttggagccgttgctttatcacatcaggatcttaactctattttatttggaaagcaaaacggccataaagccaatgttttactcgctatacgattaccgagactttttggtgctaccttaactggctctgcgttagctgtttctggaactatcatgcaagcaatcacacgtaatcctatcgctgagcctggccttttaggcattaatgctggagcaggactagccttggtactggcttatgcgtttgtacctcacttgcactattccctcattattctgctttcgttgttagggtctagcctggcagcaaccttagtctttggcctttcttatcaatctggcaaaggctaccatcagctccgccttgtcttagcaggagctatggtttccatactgctatcagcattaggtcaaggtattaccaattactatcatctggcaaatgctgttatcggctggcaagcaggaggtcttgtcggggtcaattggcaaatgatcggctatattgctcctcttattattcttagtctttgtttagcccagctattatcttatcacctgaccgtccttagtctaagtgagtctcaggcaaaagctcttgggcaaaaaaccaacttgatcagtgcagtctttatgattttggttcttattttatcatcagcagctgtagccattgctggaagcatttcttttatcggcttagtcattcctcatcttatgaaacattttacacctcatcattaccgataccttttgccgctttgtgcagtttctggcgctagtttcaatggtatgggt

SEQ ID NO: 3700 - protein, 313 aa, Streptococcus pyogenes
VKTKHPFLCLERFCLKKTQIITKSHIFWLVFVLLSFSLCVAIYCHLRFGAVALSHQDLNSILFGKQNGHKANVLLAIRLPRLFGATLTGSALAVSGTIMQAITRNPIAEPGLLGINAGAGLALVLAYAFVPHLHYSLIILLSLLGSSLAATLVFGLSYQSGKGYHQLRLVLAGAMVSILLSALGQGITNYYHLANAVIGWQAGGLVGVNWQMIGYIAPLIILSLCLAQLLSYHLTVLSLSESQAKALGQKTNLISAVFMILVLILSSAAVAIAGSISFIGLVIPHLMKHFTPHHYRYLLPLCAVSGASFNGMG

SEQ ID NO: 3701 - DNA, 252 bp, Streptococcus agalactiae
ttgctaacattaaatgttcctatggttagagcgattactaatccagctccagcattgataccaagaataccggaatcagctagtggatttttggttaacgtctgtaatagcaacccagcaattcctaaagaagctcccccaaagatacagacaataatacgaggtaaacgaatgttagtaatgataaaaaggaaggcatcatcagattttccacttattagttttaaaacgtcaataacggaagtattagca

SEQ ID NO: 3702 - protein, 84 aa, Streptococcus agalactiae
MLTLNVPMVRAITNPAPALIPRIPESASGFLVNVCNSNPAIPKEAPPKIQTIIRGKRMLVMIKRKASSDFPLISFKTSITEVLA

SEQ ID NO: 3703 - DNA, 999 bp, Streptococcus agalactiae
atgattcaaaaaaataaagctccttttgttttaatatcatctgtcattatcctactattattaatactagtatcaatttcacttggctatgctaatacttccgttattgacgttttaaaactaataagtggaaaatctgatgatgccttcctttttatcattactaacattcgtttacctcgtattattgtctgtatctttgggggagcttctttaggaattgctgggttgctattacagacgttaaccaaaaatccactagctgattccggtattcttggtatcaatgctggagctggattagtaatcgctctaaccataggaacatttaatgttagcaatccaactatattatactttttacccctatttgctatgtttggagggttggtaactatttttcttatctatcttatgtcatacagaagaaatcacaatattagccctacacgattaatcgtcactggtatcggaatatctacaattatttcaggcgttatgattttgattattagtcagtctaataatcaaaaaatggatatgatcgttgaatggcttagtggaaaaattacaattagttcctggactaccattatcacttttatcccgattctcattttgttatggggattagcatatagtcgcagtcgccaccttaatattatgaacctaaacgagcagactgctctcgctctaggacttcatttaaaaaaggaaagaatatatactttgatgctgacaagtagcctcgctgctattagcgtcgtcttaattggtaatattacttttataggcttactcgctgggcacttaagtagacgactattaggaaataaccataaaattatactacctagctgtcttcttattggtgctattatcctattggtatcagatactataggtcgtctcctcttagttggtacgggtattcccactggattggttgtatcaataattggtgccccctattttctctggttgatgacaaaagttgac

SEQ ID NO: 3704 - protein, 333 aa, Streptococcus agalactiae
MIQKNKAPFVLISSVIILLLLILVSISLGYANTSVIDVLKLISGKSDDAFLFIITNIRLPRIIVCIFGGASLGIAGLLLQTLTKNPLADSGILGINAGAGLVIALTIGTFNVSNPTILYFLPLFAMFGGLVTIFLIYLMSYRRNHNISPTRLIVTGIGISTIISGVMILIISQSNNQKMDMIVEWLSGKITISSWTTIITFIPILILLWGLAYSRSRHLNIMNLNEQTALALGLHLKKERIYTLMLTSSLAAISVVLIGNITFIGLLAGHLSRRLLGNNHKIILPSCLLIGAIILLVSDTIGRLLLVGTGIPTGLVVSIIGAPYFLWLMTKVD

SEQ ID NO: 3705 - DNA, 651 bp, Streptococcus agalactiae
atgatattaacgtttaatccaggaaagttagaaagacaagagttttttaaggagcttattaactatctttggatacatgatgatgtaacactaagaaaaataaagtcccactttacagactattctaaaattgaccgtttgttagaagaatatattaatcatggatatatccttcgccaaaataaacgctacagccttaatcttccttttctgagttcgctagatggattagtattagatgatttggttttcatagattctgatagtcaaatctatcagttattacagaagcgaaaatttgtgacaaatttagataacccaaccaatcacttggtatttgtagaagagacagattttgaaagaaacactttgactctttctaattatttctataaactaactaacggttatccactttcaagagaacaaaaaaagctttatcaacttttaggagatgttaattcggaatatgctttaaaatatatgtcaagctttatattgaaatttcttcgcaaggatagtgttaagcaaaaacgtacagttatttttatccaagctttagaattacttggatatattagcttaaaccaagatactacctatcgtttaaatgctaaacttgatgttgaagctttaaagatttacttaaca

SEQ ID NO: 3706 - protein, 217 aa, Streptococcus agalactiae
MILTFNPGKLERQEFFKELINYLWIHDDVTLRKIKSHFTDYSKIDRLLEEYINHGYILRQNKRYSLNLPFLSSLDGLVLDDLVFIDSDSQIYQLLQKRKFVTNLDNPTNHLVFVEETDFERNTLTLSNYFYKLTNGYPLSREQKKLYQLLGDVNSEYALKYMSSFILKFLRKDSVKQKRTVIFIQALELLGYISLNQDTTYRLNAKLDVEALKIYLT

SEQ ID NO: 3707 - DNA, 651 bp, Streptococcus pyogenes
atgataacagtatttcattcagataaactcaccagacaacctttctttcaagaccttatcaattatctcgaccagcatgatcacgttatattacgagagatcaaaaaagcctttcctaatgtgacaggtattgacaaggccatcgaaagctatgttcaagctggctatattcgccgtgaaaataagcgttatggcatcaatcttcctttggtgagttctgatcagcagctggccttagacactatgctttttgtggacacctgttcagctatgtatgaaaatattttagcggttgtttttgagactcagctaacaaaccaaaccaatcgcgtgatgatcaaggaaaagaccaacatcacgagagacgatttgaccctggctaattatttttaccgtctcaaaagaggtgagaagccatcagctgagcagatggacttgtatgacctcttgggggatgtgaatcaggaatatgcccttaaatatatgacaacttttttgcttaaattcacgcgcaaagactttgtgatgcaaaaacgtcctgatatatttgtggaagctctggttacacttggttacctaaaacaagtggagcctacaacataccagctgctaatgaccttggataaagaaagtttaacctttatagcacca

SEQ ID NO: 3708 - protein, 217 aa, Streptococcus pyogenes
MITVFHSDKLTRQPFFQDLINYLDQHDHVILREIKKAFPNVTGIDKAIESYVQAGYIRRENKRYGINLPLVSSDQQLALDTMLFVDTCSAMYENILAVVFETQLTNQTNRVMIKEKTNITRDDLTLANYFYRLKRGEKPSAEQMDLYDLLGDVNQEYALKYMTTFLLKFTRKDFVMQKRPDIFVEALVTLGYLKQVEPTTYQLLMTLDKESLTFIAP

SEQ ID NO: 3709 - DNA, 933 bp, Streptococcus agalactiae
atgtctaaaattttagtctttggtcaccaaaatccagattcagatgctattggatcatcagttgcttttgcatatctagctaaagaagcttgggggcttgacacagaggccgttgctttaggaactccaaatgaagaaacagcatatgttttagattattttggtgttcaagcacctcgagtagtagaatctgcaaaagcagagggtgtagagacagtcattttaactgaccataacgaattccaacaatctatttctgatattaaagatgtgacagtttatggtgttgttgatcatcatcgtgttgctaactttgagactgccaatccgttatatatgcgtttggaaccagttggctcagcatcatcgattgtttaccgtatgtttaaggaaaatggagtatcagtacccaaagagttggctggtttattattatcaggtttgatttcagatactcttcttttgaaatcaccaacaactcatgcttcagatattccagttgcaaaagaactagcagagcttgcaggtgtaaacttagaagaatatggtttagaaatgcttaaagcaggtactaacctctcaagtaagactgcagcggagttgattgatattgatgctaaaacatttgaattaaatggagaagctgttcgtgttgcacaagttaatactgtggacattaacgatattttagcacgtcaagaagagattgaagttgctattcaagaagcaattgtcacagaaggttattctgattttgtattgatgattactgacattgttaattcaaattcagagattttagctctcggttcaaatatggctaaagttgaagcagcttttgaatttacacttgaaaataaccacgcttttcttgctggggcagtatcacgcaaaaaacaagttgttcctcaattgacagaaagctacaatgct

SEQ ID NO: 3710 - protein, 311 aa, Streptococcus agalactiae
MSKILVFGHQNPDSDAIGSSVAFAYLAKEAWGLDTEAVALGTPNEETAYVLDYFGVQAPRVVESAKAEGVETVILTDHNEFQQSISDIKDVTVYGVVDHHRVANFETANPLYMRLEPVGSASSIVYRMFKENGVSVPKELAGLLLSGLISDTLLLKSPTTHASDIPVAKELAELAGVNLEEYGLEMLKAGTNLSSKTAAELIDIDAKTFELNGEAVRVAQVNTVDINDILARQEEIEVAIQEAIVTEGYSDFVLMITDIVNSNSEILALGSNMAKVEAAFEFTLENNHAFLAGAVSRKKQVVPQLTESYNA

SEQ ID NO: 3711 - DNA, 939 bp, Streptococcus pyogenes
atgattatgtcaaaaattttagtttttggtcatcaaaatcctgatacggatgctattgcatcatcttatgcttttgattacttatcccaaaaagcgtttggtttggatactgaagtcgtagctttaggaacacctaacgaagaaacagcttttgcccttgattattttggtgttgaggcaccacgtgtggtagagtctgctaaagcacaagggtctgaacaagtgattttgacagaccacaatgaattccaacaatccattgcagatatccgtgaggttgaggtatatggtgtggttgatcaccaccgtgtggctaattttgaaactgcaaatcctttatacatgcgtgtggaaccagtaggatcagcctcatctattgtttaccgtatgtttaaagaaaatggcatcgaggtgccaaaagcgattgcagggatgctcttgtctggtttgatttcagataccttgttgttgaaatctccaacaactcatgtgtctgatcaccttgtcgctgaagaattggcagagctggcagaagtgaacttggaagactatggaatggctcttttaaaagcaggtacaaaccttgcaagcaaatcagaagtagaattgattggtattgatgccaaaacatttgaattaaatggcaatgctgtgcgcgtggcacaagtgaacactgttgacattgcagaagtcttagaacgtcaagaagctattgaagcagccattaaagatgccatggctgcagaaggttattcagattttgttttgatgatcacggatattgttaactcaaactctgaaattctagctattggagcaaacatggacaaggttgaagcagcctttaacttcacccttgacaacaatcatgccttcttagcaggtgccgtttctcgtaaaaaacaagtggttccacaattgacagaaagttttggagct

SEQ ID NO: 3712 - protein, 313 aa, Streptococcus pyogenes
MIMSKILVFGHQNPDTDAIASSYAFDYLSQKAFGLDTEVVALGTPNEETAFALDYFGVEAPRVVESAKAQGSEQVILTDHNEFQQSIADIREVEVYGVVDHHRVANFETANPLYMRVEPVGSASSIVYRMFKENGIEVPKAIAGMLLSGLISDTLLLKSPTTHVSDHLVAEELAELAEVNLEDYGMALLKAGTNLASKSEVELIGIDAKTFELNGNAVRVAQVNTVDIAEVLERQEAIEAAIKDAMAAEGYSDFVLMITDIVNSNSEILAIGANMDKVEAAFNFTLDNNHAFLAGAVSRKKQVVPQLTESFGA

SEQ ID NO: 3713 - DNA, 786 bp, Streptococcus agalactiae
atggcagaaatagactataaaaaagtaacaggaatgatccattctacagaaagtttcggctctgtggatgggccaggtattcgttttatcatttttatgcaaggatgtaaaatgcgttgtcaatactgtcataatcctgatacttgggaaatggaaactaacaattcaaaggaacgtaccgttgaggatgttctaaaggaagctctccgttataaacatttttggggaaaagatggaggtatcacagtttcaggtggtgaagcaatgctgcaaattgactttattacagccctctttattgaggctaagaaactaggtattcatacgacgctagatacttgtggttttgcttatcgagcaacaccagaataccatgctatccttgaaaaattgttagatgttactgatttggtactccttgacttaaaagaaattgattcagaacaacataaaattgtaactcgtcagtctaacaaaaatattttacagtttgctagatatttatctgatagaggtactccggtatggattcgtcatgttttagttcctggattgactgatattgatgaccatttaaaacgtttgggtgaatttgtccaaacacttgataatgtcgataaatttgaagtattgccttatcatactatgggagagttcaaatggcgtgaattaggaattccgtatccattagctggtgtgaaaccaccaactccagaacgtgttaaaaacgctaaagatatcatgaaaacagaatcctatacagaatatctaaaaaggattcaaaat

SEQ ID NO: 3714 - protein, 262 aa, Streptococcus agalactiae
MAEIDYKKVTGMIHSTESFGSVDGPGIRFIIFMQGCKMRCQYCHNPDTWEMETNNSKERTVEDVLKEALRYKHFWGKDGGITVSGGEAMLQIDFITALFIEAKKLGIHTTLDTCGFAYRATPEYHAILEKLLDVTDLVLLDLKEIDSEQHKIVTRQSNKNILQFARYLSDRGTPVWIRHVLVPGLTDIDDHLKRLGEFVQTLDNVDKFEVLPYHTMGEFKWRELGIPYPLAGVKPPTPERVKNAKDIMKTESYTEYLKRIQN

SEQ ID NO: 3715 - DNA, 861 bp, Streptococcus pyogenes
atgcctagtctttttgatgaaaagtgttataatgaaaatgtaaaaacgtttacaagtaatgaaggagatgcaatgactgagaaagattatggacaagtaacagggatggtgcattcgacagaaagttttggttctgtagatggtccaggcattcgttttatcattttcttgcaaggctgtaaattacgttgccaatattgccataatccggatacttgggagatggaaaccaacaattcaaaaatcagaacagtcaatgatgtcttgaaagaagcccttcagtacaaacatttctggggaaaaaaaggaggaattaccgtatctggtggtgaagctatgcttcaaattgattttatcactgccttattcatcgaagctaaaaaattaggtatccataccacactagacacctgtggctttacctatagaccgacacctgaataccatcaggttcttgataacttattggcagtgaccgatttgattttattggacttaaaagaaattgatgaaaaacaacataaaattgtcacgcgtcagcctaataaaaacatattgcaatttgctaggtatttatccgacaagcagattcctgtctggattcgacatgtcttggttccaggcttgactgatattgatgatcatttgacacgattgggtgagtttgtcaaaaccttgaaaaatgtcgataaatttgaagttttgccttaccataccatgggagaattcaagtggcgtgagctaggtattccttatcagttagaaggtgttaaaccaccaactaaggaacgcgttcaaaatgctaaaaatctgatgcagaccgaatcttacacagaatatatgaatcggattcatcagtca

SEQ ID NO: 3716 - protein, 287 aa, Streptococcus pyogenes
MPSLFDEKCYNENVKTFTSNEGDAMTEKDYGQVTGMVHSTESFGSVDGPGIRFIIFLQGCKLRCQYCHNPDTWEMETNNSKIRTVNDVLKEALQYKHFWGKKGGITVSGGEAMLQIDFITALFIEAKKLGIHTTLDTCGFTYRPTPEYHQVLDNLLAVTDLILLDLKEIDEKQHKIVTRQPNKNILQFARYLSDKQIPVWIRHVLVPGLTDIDDHLTRLGEFVKTLKNVDKFEVLPYHTMGEFKWRELGIPYQLEGVKPPTKERVQNAKNLMQTESYTEYMNRIHQS

SEQ ID NO: 3717 - DNA, 1332 bp, Streptococcus agalactiae
atgcaagaccctggcagtcagagtttgttactacaatttgttattttattaatattaaccctatttaacgccttcttttcagcatctgaaatggctttagtatcgctaaaccgctctaaagtagaacagaaagctgaagaaggggacaaaaggtatcgacgtcttttggacgttcttgaaaatcccaataattttttatcaacaattcaagttggtattacttttattagccttttgcaaggggctagtttatctgcctcactaggacatgtgatttcagggtggctaggaaattcagcaacagcccgtacagcagggagtattattgcgctaatctttttaacatatgtctctattgttctaggagaattatatcctaagcgtattgctatgaatttgaaagatcgtctagcaattgtttcagctcccattattatctttctagggaaaatcgtaagcccctttgtatggttgctctcagcttcaactaacttattgagtagaatcactccgatgacttttgatgatgctgacgagaagatgacacgtgatgaaattgaatatatgttgacgaatagtgaagaaactttggaagctgaagaaattgagatgctgcaagggattttctcgctagatgaaatgatggcgcgtgaagttatggttccgcgcactgatgctttcatgattgacatcaacaatgatgcacaatcaaatattgaaggaattttatcacaaaacttttctcgtgtccctgtttttgatgacgataaagatagagttgttggtgttttacataccaagcgcttattggaagcgggctttaaaactggttttgatactatcgacttgcgaaaaatacttcaggaacctctttttgttccagaaacgatttttgtagatgaccttttaaaagcattacgcaacactcaaaatcaaatggccattttactagatgaatatggtggcgttgctggtttagtaactctagaggatttattggaagaaattgtcggcgaaattgatgatgaaacagatacagctgaacaatttgtcagggaaatcgatgagaatatctatattgttctaggaactatgacgcttaatgaatttaatgattattttgagacagagttagaaagtgatgatgttgatacaattgcgggttattatttaactggtgtgggtagtattccaaaccaagaggaaaaagtagcttacgaagtagacagcaaagataaacacatcactttgattaatgataaagttaaagatggtcgtataacaaaattgaaggtgctattgtctgatatagaacagaatattgaaaaagac

SEQ ID NO: 3718 - protein, 444 aa, Streptococcus agalactiae
MQDPGSQSLLLQFVILLILTLFNAFFSASEMALVSLNRSKVEQKAEEGDKRYRRLLDVLENPNNFLSTIQVGITFISLLQGASLSASLGHVISGWLGNSATARTAGSIIALIFLTYVSIVLGELYPKRIAMNLKDRLAIVSAPIIIFLGKIVSPFVWLLSASTNLLSRITPMTFDDADEKMTRDEIEYMLTNSEETLEAEEIEMLQGIFSLDEMMAREVMVPRTDAFMIDINNDAQSNIEGILSQNFSRVPVFDDDKDRVVGVLHTKRLLEAGFKTGFDTIDLRKILQEPLFVPETIFVDDLLKALRNTQNQMAILLDEYGGVAGLVTLEDLLEEIVGEIDDETDTAEQFVREIDENIYIVLGTMTLNEFNDYFETELESDDVDTIAGYYLTGVGSIPNQEEKVAYEVDSKDKHITLINDKVKDGRITKLKVLLSDIEQNIEKD

SEQ ID NO: 3719 - DNA, 1371 bp, Streptococcus pyogenes
atgaagtcactatattatttttttaggagttacattaacatggaagaccctgtgagtcagtccttagtgattcaatttttattgttagttgttttaaccttgttaaatgcttttttttcagccagtgaaatggccttagtttctctcaatcgttctcgggtggaacaaaaagcagcagacggtgataaaaaatacgctcgtttgttgcgggttttagaggaacctaatcattttttatcaacgattcaagttgggattacctttattagtttactatcaggagcaagtttatcagcttctttgggtaaggtgatctcaggttggctaggtaattcagcgaccgcaaggacagctggtactatcatctccttggttttcttgacttatgtctctattgttttaggagaattgtatccaaaacggattgccatgaacctcaaagacaagttggcgattgtttcagcccctattatcattgggttagggagactggttagtccctttgtatggctcttatcagcttctactaatttactgagccgacttacccctatgacctttgatgatgcagatgagcaaatgacacgtgatgaaatcgagtatatgttatcaaaaagtgaggcgacccttgatgctgaagaaattgagatgttgcaaggagttttctcacttgatgaaatgatggcgcgtgaagtcatggtcccaaggaccgatgctttcatgattgacattaacgatgatccgcttgaaaatattcaggaaatcttaaaacaaagtttttcacgcattcctgtttatgatgtggataaagataaaattatcggtctcatccacactaagcgtctcttggagtcaggtttccgccagggatttgatcagattaacatgcgaaaaatgttacaagaacctctttttgttcccgaaaccatttttgtagatgatctcttacgccagctgcgcaatacccaaaatcagatggctattttgctagatgaatatggtggtgtggcaggacttgtgactttggaagacttgcttgaagaaatcgtcggtgaaatcgatgatgaaaccgataaagcagaacaatttgttcatgagattggagacaatacctatattgttgttggtactatgactttaaatgagtttaatgactattttgataccgaactagaatcagatgatgtagataccattgctggtttttatttgacaggtatcggaaccattccaagccaggagcaaaaagaagcctacgaaatagataacaaagacaaacatttagttctaatcaacgataaagtcaaagatggccgtattacgaaattaaaattaatcctgtctaatatagaacagattattgaggaagac

SEQ ID NO: 3720 - protein, 457 aa, Streptococcus pyogenes
MKSLYYFFRSYINMEDPVSQSLVIQFLLLVVLTLLNAFFSASEMALVSLNRSRVEQKAADGDKKYARLLRVLEEPNHFLSTIQVGITFISLLSGASLSASLGKVISGWLGNSATARTAGTIISLVFLTYVSIVLGELYPKRIAMNLKDKLAIVSAPIIIGLGRLVSPFVWLLSASTNLLSRLTPMTFDDADEQMTRDEIEYMLSKSEATLDAEEIEMLQGVFSLDEMMAREVMVPRTDAFMIDINDDPLENIQEILKQSFSRIPVYDVDKDKIIGLIHTKRLLESGFRQGFDQINMRKMLQEPLFVPETIFVDDLLRQLRNTQNQMAILLDEYGGVAGLVTLEDLLEEIVGEIDDETDKAEQFVHEIGDNTYIVVGTMTLNEFNDYFDTELESDDVDTIAGFYLTGIGTIPSQEQKEAYEIDNKDKHLVLINDKVKDGRITKLKLILSNIEQIIEED

SEQ ID NO: 3721 - DNA, 564 bp, Streptococcus agalactiae
atgattaaaagaccaattcatctttctcatgattttttagcagaagttattgataaagaagcaataacgcttgatgcaactatgggaaatgggaatgatactgtttttttagcgaaaagttctaaaaaagtttatgcatttgatattcaagaagaagcaatagcaaaaacgaaagcaaagctcacggagcaagggatctctaacgctgaacttatcttggatgggcatgaaaatttggaacaatatgttcatacacctttaagagcggctatatttaatctgggatacttaccctcagcggataaaacagttattacaaaaccacacacaactatcaaggcaatcaaaaacgttttagacattttagaagtaggtggacgtctatcacttatggtttattatggtcatgatggtggaaaaagtgagaaagatgcggtgatagcattcgtggaacaattaccacagaataatttcgctacaatgctttatcaaccactcaatcaagttaatacgcctccctttttaattatggtagaaaagttacaatcatatgaaaatgaggtg

SEQ ID NO: 3722 - protein, 188 aa, Streptococcus agalactiae
MIKRPIHLSHDFLAEVIDKEAITLDATMGNGNDTVFLAKSSKKVYAFDIQEEAIAKTKAKLTEQGISNAELILDGHENLEQYVHTPLRAAIFNLGYLPSADKTVITKPHTTIKAIKNVLDILEVGGRLSLMVYYGHDGGKSEKDAVIAFVEQLPQNNFATMLYQPLNQVNTPPFLIMVEKLQSYENEV

SEQ ID NO: 3723 - DNA, 579 bp, Streptococcus pyogenes
ttgacggatttggataggagaaaagtgatgctaaaacgccccattcatctctcgcatgattttttagcggaggttgtggataagtctagtgtggttgttgatgccacgatgggtaatggaaatgatactgcctttttggcacaattagctaaaaaggtttatgcttttgatgtgcaagaacaagctattagaaaaacaagtgagcggttagcgcagctaggattatcgaacgctgagctgattttagcgggtcatgaagcggttgatcagtatgtgacagagccggtgcgcgcagcgatttttaaccttggttatttgcccagcgcagataaatctattattaccttaccaaataccacactccaagctttatcaaaactactaacgttattaatggtaggtgggcgtattgctattatggtctattatgggcatgatggaggcagtttggaaaaagatgctttattagattttgtcaagcaattagaccaaagaaaggtttctgcaatgctttatcagcctcttaatcaggtgaataccccaccttttttaatcatgttggagaaattagcagacttt

SEQ ID NO: 3724 - protein, 193 aa, Streptococcus pyogenes
LTDLDRRKVMLKRPIHLSHDFLAEVVDKSSVVVDATMGNGNDTAFLAQLAKKVYAFDVQEQAIRKTSERLAQLGLSNAELILAGHEAVDQYVTEPVRAAIFNLGYLPSADKSIITLPNTTLQALSKLLTLLMVGGRIAIMVYYGHDGGSLEKDALLDFVKQLDQRKVSAMLYQPLNQVNTPPFLIMLEKLADF

SEQ ID NO: 3725 - DNA, 933 bp, Streptococcus agalactiae
atgaaaaaacgttatcgtgcgattaatgattattatcgagaactctttggagaaaaaatatttaaattacctatagatgctggttttgactgtcctaacagagacggaacagttgctagaggagggtgcactttttgcacagtttctggttcaggggatgctatagttgctccagaagctcctattcgtgaacaattctataaagaaattgatttcatgcatagaaagtggcctgaggttaataaatacttagtctattttcaaaattttaccaatacccatgctaagttagagataattaaagagcgttacgaacaggctattaatgagccaggagttatcggaatcaacatcggaacaaggccggattgcttacctgatgaaactatatactatctcgctgaactttctgaaagaatgcatgtgactttagaattaggccttcagacaacttatgaagcaacttctgcattaataaatagagcacattcatatgacctttacaaaaaaactgttaagagaatacgagaattagctcctaaagtagaaatcgtttctcacctaataaatggccttccaggggagacacatgatatgatggtggaaaatgttcgtcgatgtgttacggataatgatattcagggtataaaattacaccttctgcatcttatgactaatacaagaatgcagagagattaccatgaaggtcgtttacgtttgttaagtcaagaagactatatttcgattatttgtgaccaactggagattattccaaaacatattgttattcaccgaattactggtgatgcgccacgtcatatgttaattggaccgatgtggagccttaataaatgggaagtgcttaatgccattgacaaagaaatggagaaaagacagtcatatcaaggatgtaaagctgaggtaaaacatgat

SEQ ID NO: 3726 - protein, 311 aa, Streptococcus agalactiae
MKKRYRAINDYYRELFGEKIFKLPIDAGFDCPNRDGTVARGGCTFCTVSGSGDAIVAPEAPIREQFYKEIDFMHRKWPEVNKYLVYFQNFTNTHAKLEIIKERYEQAINEPGVIGINIGTRPDCLPDETIYYLAELSERMHVTLELGLQTTYEATSALINRAHSYDLYKKTVKRIRELAPKVEIVSHLINGLPGETHDMMVENVRRCVTDNDIQGIKLHLLHLMTNTRMQRDYHEGRLRLLSQEDYISIICDQLEIIPKHIVIHRITGDAPRHMLIGPMWSLNKWEVLNAIDKEMEKRQSYQGCKAEVKHD

SEQ ID NO: 3727 - DNA, 936 bp, Streptococcus pyogenes
ttgtgctacaatagaaacatgaaaaaaagatatcagacattaaatgagcattaccgtcaactatttggcgcaaaaatgtttaaagttccgattgatgccggctttgattgtcccaatcgtgatggaacggtagctcatggaggatgtactttttgcacagtatcaggttctggagatgctattgtagcaccagatgctccaattaaagagcaattttataaagaaattgattttatgcaccgtaaatggcctgatgtcaatcgctatttggtttattttcaaaactttaccaatactcatgatacagttgatgtgattcgcgaccgttacgaacaagctattaacgaacctggagttgttggtattaatattggcacacggcctgactgtctaccagatgataccattgcttacttagcagaattatcagaacgcatgcatgtgacagtggagctaggcttacagacaacttatgaagaaacttctaggctaattaacagagcacattcttatgatttgtataaagaaacggtgaggcgactaaggcattaccccaacattaatattgtttcgcacttgattaatggattgccaaaagaaactcatgacatgatgcttgaaaatgtgagacgctgtgtaacagacaatgacattcaaggaattaaattgcatttgctgcatttgatgaccaatactagaatgcaaagagattatcatgaaggacgcttaaagttgttgagtcaaaaggactatgtttcgattatttgtgaccagctagagattatccctaagcatattgtgattcaccgtattacaggagatgccccacgcgatatgttgattgggcccatgtggagtctaaataagtgggaagtattgaatgccattgataaagaaatggaaagacgaggaagctttcagggctgtaaagttgac

SEQ ID NO: 3728 - protein, 312 aa, Streptococcus pyogenes
LCYNRNMKKRYQTLNEHYRQLFGAKMFKVPIDAGFDCPNRDGTVAHGGCTFCTVSGSGDAIVAPDAPIKEQFYKEIDFMHRKWPDVNRYLVYFQNFTNTHDTVDVIRDRYEQAINEPGVVGINIGTRPDCLPDDTIAYLAELSERMHVTVELGLQTTYEETSRLINRAHSYDLYKETVRRLRHYPNINIVSHLINGLPKETHDMMLENVRRCVTDNDIQGIKLHLLHLMTNTRMQRDYHEGRLKLLSQKDYVSIICDQLEIIPKHIVIHRITGDAPRDMLIGPMWSLNKWEVLNAIDKEMERRGSFQGCKVD

SEQ ID NO: 3729 - DNA, 639 bp, Streptococcus agalactiae
atgttatctcgtcaaaatagtaaacttattcaagcatttattgctattatcttatttttcagtttaggattggtcatcaaatattggcccgacactgtaatttcatttgaccaaactattcaagaaagtgttagaggacagttgccaaatctttctacaagatttttcaagttaatcactgtgattggtaatactgtaagccagatagctattgcgattatgagcgtcactttctgttaccttaagaagtggtatcctcaagctagatttatcgcagtaaatgctattatctctggtatatgtatactttctttaaaacttatttttcaaagagtaagaccaactttaacccatttagtatttgcaggtggctattcgtttcccagtgggcactcgatgggaacatttatgatatttgggagtattattattttattgcagtactatatgcctaagagtatatggaaactgttgtgccaaggtactttgggtttgctcatttttttaattgggttatctcgtatttacctaggggttcattttccgacagatgttttagctggttttatacttgcttatggtattttgaatctaactgcgtatatctttttagccaaggattggttaaagaaagtgaag

SEQ ID NO: 3730 - protein, 213 aa, Streptococcus agalactiae
MLSRQNSKLIQAFIAIILFFSLGLVIKYWPDTVISFDQTIQESVRGQLPNLSTRFFKLITVIGNTVSQIAIAIMSVTFCYLKKWYPQARFIAVNAIISGICILSLKLIFQRVRPTLTHLVFAGGYSFPSGHSMGTFMIFGSIIILLQYYMPKSIWKLLCQGTLGLLIFLIGLSRIYLGVHFPTDVLAGFILAYGILNLTAYIFLAKDWLKKVK

SEQ ID NO: 3731 - DNA, 666 bp, Streptococcus agalactiae
atgggagaagacaaaggttttttcgcgtacatacgcttacctttggagcttctttcaatttatttaaattggaggaatttttttatgacaaatacacgtaaaatggtgacaatcgccattctttctgccttatcttttgtattgatgatggtttcatttccattaataccaggagcagaatttttaaaggttgatttttcaatccttccgatgttagttgcttttattttatttgatttgaaatcaagttatggtgtactcttattaagatcacttttaaaagttatacttgctaatcgtggtccagaaacgtttattggtttaccgatgaatatggttgctctagctttatttttagcaagtttcgctattttctggaaaaatagagagagtgcaaaagattttattaaagctagtctatttggtacagttagcttgaccgtatctatggtagctctcaactatgtctttgcgattcctttgtatgctatatttgctaactttgatatcagaacatttattggtgtaggcaattaccttttaacaatggttattccatttaatatcgttgagggaattttaatttcgattgttttctatctaacttacgtggcttgtttgccaatattagaaagatataaaaagactaatgttatctcgtcaaaa

SEQ ID NO: 3732 - protein, 222 aa, Streptococcus agalactiae
MGEDKGFFAYIRLPLELLSIYLNWRNFFMTNTRKMVTIAILSALSFVLMMVSFPLIPGAEFLKVDFSILPMLVAFILFDLKSSYGVLLLRSLLKVILANRGPETFIGLPMNMVALALFLASFAIFWKNRESAKDFIKASLFGTVSLTVSMVALNYVFAIPLYAIFANFDIRTFIGVGNYLLTMVIPFNIVEGILISIVFYLTYVACLPILERYKKTNVISSK

SEQ ID NO: 3733 - DNA, 561 bp, Streptococcus pyogenes
atgtcaaaaacacataaaatgattatgattggtatactttctgcgatatcatttctattgatgctagttagctttgccattattccaggcgcagcttttttaaaaattgaatttagtattattcctgttttatttggtttaatgattatggacttaaagagtgcttacttaattttgttattgaggtccttattgaaactctttttgaacaatcgtggggttaatgattttattggtctcccaatgaatattatcgctatcgctttatttgtgacggcttttgccttagtttggaaccgtcaaaaaacgcttagtcaatatgtatttgctagcttactaggcacagggttattaacgtttggcatggttgttcttaattatacttttgccattcctttatatgctatatttgcaaatattgatatcagagcttatattggtgttactaagtatatgatgactatggttattccgtttaatcttgttgaagggttgatatttgcaattaccttttattttgtgtatattgcaagtaaaccaattttagaaagatacttacac

SEQ ID NO: 3734 - protein, 187 aa, Streptococcus pyogenes
MSKTHKMIMIGILSAISFLLMLVSFAIIPGAAFLKIEFSIIPVLFGLMIMDLKSAYLILLLRSLLKLFLNNRGVNDFIGLPMNIIAIALFVTAFALVWNRQKTLSQYVFASLLGTGLLTFGMVVLNYTFAIPLYAIFANIDIRAYIGVTKYMMTMVIPFNLVEGLIFAITFYFVYIASKPILERYLH

SEQ ID NO: 3735 - DNA, 924 bp, Streptococcus agalactiae
atgaaaaagattagaaaaagtttaggacttctactatgttgctttttaggattggtacaattagcgtttttttcggtagccagtgtaaatgctgatacccctaatcaactaacaatcacacagataggacttcagccaaatactacagaggaggggatttcttatcgtttatggactgtgactgacaacttaaaagttgatttattgagccaaatgacagatagcgaattgaaccagaagtataagagtatcttgacttctcctactgatactaatggtcagacaaagatagcactcccaaatggttcgtactttggtcgtgcttataaagctgatcaaagcgtttcaacaatagtacctttttatattgaattaccagatgataagttatcaaatcaattacagataaatcctaagcgaaaagttgaaacaggccgattaaaacttattaaatatacaaaagaaggaaagataaagaaaaggctatccggagtaatatttgtattatacgataaccagaatcagccagttcgctttaaaaatggacgatttacgaccgatcaagatgggattacttcattagtaactgatgataagggagaaattgaggttgaaggtttattacctggtaagtatatttttcgagaagcaaaagcactaactggttaccgtatatctatgaaggatgctgtagttgctgtagttgctaataaaacacaggaagtagaggtagaaaacgaaaaagaaactcctccaccaacaaatcctaaaccatcacaaccgctttttccacaatcatttcttcctaaaacaggaatgattattggtggaggactgacaattcttggttgtattattttgggaattttgtttatctttttaagaaaaactaaaaatagcaaatctgaaagaaacgatacagta

SEQ ID NO: 3736 - protein, 308 aa, Streptococcus agalactiae
MKKIRKSLGLLLCCFLGLVQLAFFSVASVNADTPNQLTITQIGLQPNTTEEGISYRLWTVTDNLKVDLLSQMTDSELNQKYKSILTSPTDTNGQTKIALPNGSYFGRAYKADQSVSTIVPFYIELPDDKLSNQLQINPKRKVETGRLKLIKYTKEGKIKKRLSGVIFVLYDNQNQPVRFKNGRFTTDQDGITSLVTDDKGEIEVEGLLPGKYIFREAKALTGYRISMKDAVVAVVANKTQEVEVENEKETPPPTNPKPSQPLFPQSFLPKTGMIIGGGLTILGCIILGILFIFLRKTKNSKSERNDTV

SEQ ID NO: 3737 - DNA, 882 bp, Streptococcus agalactiae
atgggaggaaaatttcagaaaaaccttaagaaatcggtcgttttaaatcgatggatgaatgtaggcttgatactattgttcttagttggtcttttgataacctcatatccttttatttcaaattggtactataatattaaagctaataatcaagtaactaactttgataatcaaacccaaaaattaaatactaaagagattaatagacgatttgagttagcaaaagcttataatagaacactggacccaagccgcctatcagatccctatactgaaaaagaaaaaaaaggtattgctgaatacgcccacatgcttgagattgctgaaatgattggatatattgatataccgtctatcaagcaaaaattacctatctatgcggggactaccagtagtgttcttgaaaaaggagcaggacaccttgaaggaacctccttgccaattggtggaaaaagttcacatactgttatcacagctcatcgcggcttacctaaagctaagttatttacagatttagataaacttaaaaaaggaaaaattttttatattcataatatcaaagaagttttagcctataaggttgatcaaataagtgttgtaaagccagataatttttctaaattattggttgttaaaggtaaggattatgcgactttgctaacatgtacaccttattcgattaattcacatcgtttactagttagagggcatcgaatcaagtatgtacctcctgttaaagaaaagaactatttaatgaaagaattgcaaacacactataaactttatttcctcttatcaatcctagttattcttatattagtcgctttactattatatttaaaacgaaaatttaaagagagaaagagaaagggaaatcaaaaa

SEQ ID NO: 3738 - protein, 294 aa, Streptococcus agalactiae
MGGKFQKNLKKSVVLNRWMNVGLILLFLVGLLITSYPFISNWYYNIKANNQVTNFDNQTQKLNTKEINRRFELAKAYNRTLDPSRLSDPYTEKEKKGIAEYAHMLEIAEMIGYIDIPSIKQKLPIYAGTTSSVLEKGAGHLEGTSLPIGGKSSHTVITAHRGLPKAKLFTDLDKLKKGKIFYIHNIKEVLAYKVDQISVVKPDNFSKLLVVKGKDYATLLTCTPYSINSHRLLVRGHRIKYVPPVKEKNYLMKELQTHYKLYFLLSILVILILVALLLYLKRKFKERKRKGNQK

SEQ ID NO: 3739 - DNA, 753 bp, Streptococcus pyogenes
gtggaatgctatcgtgatcgtcaattgttatcaacttatcacaaacaagtgactcaaaagaagccctcagaaatggaggaggtgtggcaaaaggctaaggcgtataacgctaggcttgggattcagcctgttccagatgctttttcatttagggatggcattcatgataaaaactacgaaagcctacttcaaattgaaaacaatgatattatgggatatgttgaagtgccctctattaaagtgacgttacccatataccactatacgacagacgaggtgctaactaaaggagcaggtcacttatttggaagtgccttaccagttggtggtgacgggactcacacggttatttctgctcatagaggccttccatcggcagaaatgtttactaatttgaatttagtgaaaaagggagatactttttactttcgtgtgttaaataaagtattggcttataaagttgatcagatactaactgttgaaccagatcaagtcacatcactttctggagtcatggggaaagattatgctactttggttacctgcacaccatatggtgttaacaccaagcgtctattggtccgaggtcatagaattgcatatcattataaaaagtatcaacaggctaaaaaagcaatgaaactcgtggataaatcaagaatgtgggcagaagtagtgtgtgctgctttcggggtggttatagctattattttagtgtttatgtattcgcgagtaagtgctaagaaaagcaag

SEQ ID NO: 3740 - protein, 251 aa, Streptococcus pyogenes
VECYRDRQLLSTYHKQVTQKKPSEMEEVWQKAKAYNARLGIQPVPDAFSFRDGIHDKNYESLLQIENNDIMGYVEVPSIKVTLPIYHYTTDEVLTKGAGHLFGSALPVGGDGTHTVISAHRGLPSAEMFTNLNLVKKGDTFYFRVLNKVLAYKVDQILTVEPDQVTSLSGVMGKDYATLVTCTPYGVNTKRLLVRGHRIAYHYKKYQQAKKAMKLVDKSRMWAEVVCAAFGVVIAIILVFMYSRVSAKKSK

SEQ ID NO: 3741 - DNA, 879 bp, Streptococcus agalactiae
gtgaagactaaaaaaatcatcaaaaaaacaaaaaaaaagaagaagtcaaatcttccttttatcattctttttctaataggtctatctattttattgtatccagtggtatcacgtttttactatacgatagaatctaataatcaaacacaggattttgagagagctgctaaaaaacttagtcagaaagaaatcaatcgacgtatggctctagcacaagcttataatgattctttaaataatgtccatcttgaagatccttatgagaaaaaacgaattcaaaagggggtagcagagtacgcccgtatgttagaggtaagtgaaaaaatcggaacaatttcagttcctaagataggtcaaaaactccctatatttgcaggttcaagtcaagaagttctatctaaaggagcagggcatttagaaggtacctctcttccaattgggggcaatagtacacatactgttataacagcgcattcaggaattccagataaagaactcttttctaaccttaaaaagttaaaaaaaggagataagttttatattcaaaacataaaagaaacgatagcatatcaagtagatcagataaaagtcgttacacccgataacttttcagatttgttggttgttcctggacatgattatgcaaccttattgacttgcaccccgattatgatcaatacacacagacttttagtaaggggacatcgtatcccttataaaggtcctattgatgaaaaattaataaaagacggtcatttaaacacgatttatagatatctattctatatatctttagttattattgcttggttactttggttaataaaacgtcaacgtcaaaaaaatcgtttagcaagtgttagaaaaggaattgaatca

SEQ ID NO: 3742 - protein, 293 aa, Streptococcus agalactiae
MKTKKIIKKTKKKKKSNLPFIILFLIGLSILLYPVVSRFYYTIESNNQTQDFERAAKKLSQKEINRRMALAQAYNDSLNNVHLEDPYEKKRIQKGVAEYARMLEVSEKIGTISVPKIGQKLPIFAGSSQEVLSKGAGHLEGTSLPIGGNSTHTVITAHSGIPDKELFSNLKKLKKGDKFYIQNIKETIAYQVDQIKVVTPDNFSDLLVVPGHDYATLLTCTPIMINTHRLLVRGHRIPYKGPIDEKLIKDGHLNTIYRYLFYISLVIIAWLLWLIKRQRQKNRLASVRKGIES

SEQ ID NO: 3743 - DNA, 2115 bp, Streptococcus agalactiae
atgaaaagaatcaacaaatattttgcaatgttctcggcattgttactgactttaacgtcattgctctcagttgcaccagcgtttgcggatgaagcaacaactaatacagtgactttgcacaagattttgcaaaccgaatcaaatcttaacaaaagtaacttcccaggaactacaggtcttaacggaaaagactacaaaggtggagctatttctgaccttgctggttactttggcgagggatctaaagaaatcgaaggtgcgttctttgctttagctttgaaagaagataaaagtggtaaagtgcaatatgttaaggcaaaagaaggtaacaaattaacaccagccttaattaataaagatggtactcctgaaataacagtaaatattgatgaggccgtgtctggattgacaccagagggagatactggacttgttttcaacaccaaaggattgaaaggcgagtttaaaattgttgaagttaaatcaaaatctacttacaacaataatggttccctcctggctgcttcaaaagcggttccagttaacatcactcttccattggtaaatgaagatggtgttgttgctgatgcccatgtttatccaaagaacactgaagaaaaaccagaaattgataaaaactttgctaaaacaaacgatttgacagcattgacagatgttaatagacttttgacagctggcgcaaattatggtaattatgcacgtgacaaagcaactgctactgctgaaatcggtaaagttgttccttatgaagttaaaacaaaaattcacaaaggttctaaatacgaaaacttggtttggacagatataatgtcaaatggtttgacaatgggttcaactgttagccttaaagcttcaggaactacagaaacttttgctaaggatacagactatgaacttagcattgatgcccgtggtttcacattaaaattcacagctgatggattgggcaaattggaaaaagcagctaaaacagctgatattgaatttacattgacttatagtgctactgttaatggtcaagcaattattgataatccagaatccaatgatatcaaattgtcgtatggtaacaaaccaggtaaagacttgactgaacttcctgttacaccttcaaagggtgaagtaacagttgctaaaacttggtctgacggaattgcacctgatggtgtaaacgttgtttacacattgaaagataaagataaaactgttgcttcagtatcattgacaaaaacatctaaaggtacaatcgaccttggaaatggtatcaaatttgaagtatctggtaacttctcgggtaaattcactggtctagaaaacaaatcatacatgatctcagaacgtgtttctggttacggaagtgcaataaatctagaaaatggtaaagtaaccattaccaataccaaagattctgataacccaacaccattgaacccaactgaaccaaaagttgaaactcatggtaagaaatttgtcaaaactaatgaacaaggtgaccgtttggctggtgcacaattcgttgtgaaaaactcagcaggtaaataccttgctcttaaagcagatcaatcagaaggtcaaaaaactttagctgctaagaaaatagctttagatgaagctatcgctgcttataacaagttgtctgcaacagaccaaaaaggtgaaaaaggaattactgcaaaagaacttatcaaaactaaacaagcagattacgatgcagccttcattgaggctcgtacagcttatgagtggataacagataaggctagagccattacctacacttcaaacgatcaaggtcaatttgaagttacaggtcttgcagacggtacttacaaccttgaagaaacacttgctccagcaggatttgctaagttggcaggtaatattaagtttgtagttaatcaagggtcatacataacaggtggtaacattgactacgttgctaacagcaaccaaaaagatgcgacacgtgtagaaaataaaaaggtaacaatcccacaaacaggtggtattggtacaattcttttcacaattattggtttaagcattatgcttggagcagtagttatcatgaaaagacgccaatcaaaggaagct

SEQ ID NO: 3744 - protein, 705 aa, Streptococcus agalactiae
MKRINKYFAMFSALLLTLTSLLSVAPAFADEATTNTVTLHKILQTESNLNKSNFPGTTGLNGKDYKGGAISDLAGYFGEGSKEIEGAFFALALKEDKSGKVQYVKAKEGNKLTPALINKDGTPEITVNIDEAVSGLTPEGDTGLVFNTKGLKGEFKIVEVKSKSTYNNNGSLLAASKAVPVNITLPLVNEDGVVADAHVYPKNTEEKPEIDKNFAKTNDLTALTDVNRLLTAGANYGNYARDKATATAEIGKVVPYEVKTKIHKGSKYENLVWTDIMSNGLTMGSTVSLKASGTTETFAKDTDYELSIDARGFTLKFTADGLGKLEKAAKTADIEFTLTYSATVNGQAIIDNPESNDIKLSYGNKPGKDLTELPVTPSKGEVTVAKTWSDGIAPDGVNVVYTLKDKDKTVASVSLTKTSKGTIDLGNGIKFEVSGNFSGKFTGLENKSYMISERVSGYGSAINLENGKVTITNTKDSDNPTPLNPTEPKVETHGKKFVKTNEQGDRLAGAQFVVKNSAGKYLALKADQSEGQKTLAAKKIALDEAIAAYNKLSATDQKGEKGITAKELIKTKQADYDAAFIEARTAYEWITDKARAITYTSNDQGQFEVTGLADGTYNLEETLAPAGFAKLAGNIKFVVNQGSYITGGNIDYVANSNQKDATRVENKKVTIPQTGGIGTILFTIIGLSIMLGAVVIMKRRQSKEA

SEQ ID NO: 3745 - DNA, 2703 bp, Streptococcus agalactiae
atgagaaaataccaaaaattttctaaaatattgacgttaagtcttttttgtttgtcgcaaataccgcttaataccaatgttttaggggaaagtaccgtaccggaaaatggtgctaaaggaaagttagttgttaaaaagacagatgaccagaacaaaccactttcaaaagctacctttgttttaaaaactactgctcatccagaaagtaaaatagaaaaagtaactgctgagctaacaggtgaagctacttttgataatctcatacctggagattatactttatcagaagaaacagcgcccgaaggttataaaaagactaaccagacttggcaagttaaggttgagagtaatggaaaaactacgatacaaaatagtggtgataaaaattccacaattggacaaaatcaggaagaactagataagcagtatccccccacaggaatttatgaagatacaaaggaatcttataaacttgagcatgttaaaggttcagttccaaatggaaagtcagaggcaaaagcagttaacccatattcaagtgaaggtgagcatataagagaaattccagagggaacattatctaaacgtatttcagaagtaggtgatttagctcataataaatataaaattgagttaactgtcagtggaaaaaccatagtaaaaccagtggacaaacaaaagccgttagatgttgtcttcgtactcgataattctaactcaatgaataacgatggcccaaattttcaaaggcataataaagccaagaaagctgccgaagctcttgggaccgcagtaaaagatattttaggagcaaacagtgataatagggttgcattagttacctatggttcagatatttttgatggtaggagtgtagatgtcgtaaaaggatttaaagaagatgataaatattatggccttcaaactaagttcacaattcagacagagaattatagtcataaacaattaacaaataatgctgaagagattataaaaaggattccgacagaagctcctaaagctaagtggggatctactaccaatggattaactccagagcaacaaaaggagtactatcttagtaaagtaggagaaacatttactatgaaagccttcatggaggcagatgatattttgagtcaagtaaatcgaaatagtcaaaaaattattgttcatgtaactgatggtgttcctacgagatcatatgctattaataattttaaactgggtgcatcatatgaaagccaatttgaacaaatgaaaaaaaatggatatctaaataaaagtaattttctacttactgataagcccgaggatataaaaggaaatggggagagttactttttgtttcccttagatagttatcaaacacagataatctctggaaacttacaaaaacttcattatttagatttaaatcttaattaccctaaaggtacaatttatcgaaatggaccagtgaaagaacatggaacaccaaccaaactttatataaatagtttaaaacagaaaaattatgacatttttaattttggtatcgatatatctggttttagacaagtttataatgaggagtataagaaaaatcaagatggtacttttcaaaaattgaaagaggaagcttttaaactttcagatggagaaatcacagaactaatgaggtcgttctcttccaaacctgagtactacacccctatcgtaacttcagccgatacatctaacaatgaaattttatctaaaattcagcaacaatttgaaacgattttaacaaaagaaaactcaattgttaatggaactatcgaagatcctatgggtgataaaatcaatttacagcttggtaatggacaaacattacagccaagtgattatactttacagggaaatgatggaagtgtaatgaaggatggtattgcaactggtgggcctaataatgatggtggaatacttaagggggttaaattagaatacatcggaaataaactctatgttagaggtttgaatttaggagaaggtcaaaaagtaacactcacatatgatgtgaaactagatgacagttttataagtaacaaattctatgacactaatggtagaacaacattgaatcctaagtcagaggatcctaatacacttagagattttccaatccctaaaattcgtgatgtgagagaatatcctacaataacgattaaaaacgagaagaagttaggtgaaattgaatttataaaagttgataaagataataataagttgcttctcaaaggagctacgtttgaacttcaagaatttaatgaagattataaactttatttaccaataaaaaataataattcaaaagtagtgacgggagaaaacggcaaaatttcttacaaagatttgaaagatggcaaatatcagttaatagaagcagtttcgccggaggattatcaaaaaattactaataaaccaattttaacttttgaagtggttaaaggatcgataaaaaatataatagctgttaataaacagatttctgaatatcatgaggaaggtgacaagcatttaattaccaacacgcatattccaccaaaaggaattattcctatgacaggtgggaaaggaattctatctttcattttaataggtggagctatgatgtctattgcaggtggaatttatatttggaaaaggtataagaaatctagtgatatgtccatcaaaaaagat

SEQ ID NO: 3746 - protein, 901 aa, Streptococcus agalactiae
MRKYQKFSKILTLSLFCLSQIPLNTNVLGESTVPENGAKGKLVVKKTDDQNKPLSKATFVLKTTAHPESKIEKVTAELTGEATFDNLIPGDYTLSEETAPEGYKKTNQTWQVKVESNGKTTIQNSGDKNSTIGQNQEELDKQYPPTGIYEDTKESYKLEHVKGSVPNGKSEAKAVNPYSSEGEHIREIPEGTLSKRISEVGDLAHNKYKIELTVSGKTIVKPVDKQKPLDVVFVLDNSNSMNNDGPNFQRHNKAKKAAEALGTAVKDILGANSDNRVALVTYGSDIFDGRSVDVVKGFKEDDKYYGLQTKFTIQTENYSHKQLTNNAEEIIKRIPTEAPKAKWGSTTNGLTPEQQKEYYLSKVGETFTMKAFMEADDILSQVNRNSQKIIVHVTDGVPTRSYAINNFKLGASYESQFEQMKKNGYLNKSNFLLTDKPEDIKGNGESYFLFPLDSYQTQIISGNLQKLHYLDLNLNYPKGTIYRNGPVKEHGTPTKLYINSLKQKNYDIFNFGIDISGFRQVYNEEYKKNQDGTFQKLKEEAFKLSDGEITELMRSFSSKPEYYTPIVTSADTSNNEILSKIQQQFETILTKENSIVNGTIEDPMGDKINLQLGNGQTLQPSDYTLQGNDGSVMKDGIATGGPNNDGGILKGVKLEYIGNKLYVRGLNLGEGQKVTLTYDVKLDDSFISNKFYDTNGRTTLNPKSEDPNTLRDFPIPKIRDVREYPTITIKNEKKLGEIEFIKVDKDNNKLLLKGATFELQEFNEDYKLYLPIKNNNSKVVTGENGKISYKDLKDGKYQLIEAVSPEDYQKITNKPILTFEVVKGSIKNIIAVNKQISEYHEEGDKHLITNTHIPPKGIIPMTGGKGILSFILIGGAMMSIAGGIYIWKRYKKSSDMSIKKD

SEQ ID NO: 3747 - DNA, 996 bp, Streptococcus agalactiae
ttgagagagtttactgaattgattgaaaattatttagaaaaagacatccttaatcaaataaaacttctaactttatgctatgattactacccttccattactctagacaaatcatgtcatcaacttggtttatctgaactacttattaggaaatattgtcatgatttaacaactttatttaacagtcaactctctctgaatatcgaaaagagtacaatagtctaccaatctaatggtgtaactagagaacaagctttcaaatatatttatcatcaatcacacgttttacaacttttaaaatttttgatcacgaatgattcaggcaggttacctttaacttactttagtgaaaaatttggactatcttgtgcaactgcttatcgcatacgaaaacatattagtccattactagaaaaacttggatttcagattgtcaaaaatactattaccggtgacgagtatcgaattcgctatttaatcgcatttttaaatgctcaatttggtatagaagtttatcccatgtctaagatggataaattgctcatcaaacgattgttattagaacactcaactacttttactgcttctcattacttcccaaatacatttattttctttgatacattgttgtctctatcatggaaacgtattaattataatgtagttgtcccttactcatcccttttcactgaactacaaaatatatttatctatgatacattacaatattgtgtcaaaaatgttattatagattcctttaaaattaatttaaaaaaagacgatatagactatatttttcttgcttaccttacttcccataactctttttctaatccaaattggactgagaagcgtatcgataatgtaatagctattttcgaaaattatcccaaattccaaaaattattacagccactcaaagatgctcttcccttatctggctcctatcatgatgagttggtaaaagttgctatctttttttccgaacatttattt

SEQ ID NO: 3748 - protein, 332 aa, Streptococcus agalactiae
MREFTELIENYLEKDILNQIKLLTLCYDYYPSITLDKSCHQLGLSELLIRKYCHDLTTLFNSQLSLNIEKSTIVYQSNGVTREQAFKYIYHQSHVLQLLKFLITNDSGRLPLTYFSEKFGLSCATAYRIRKHISPLLEKLGFQIVKNTITGDEYRIRYLIAFLNAQFGIEVYPMSKMDKLLIKRLLLEHSTTFTASHYFPNTFIFFDTLLSLSWKRINYNVVVPYSSLFTELQNIFIYDTLQYCVKNVIIDSFKINLKKDDIDYIFLAYLTSHNSFSNPNWTEKRIDNVIAIFENYPKFQKLLQPLKDALPLSGSYHDELVKVAIFFSEHLF

SEQ ID NO: 3749 - DNA, 1491 bp, Streptococcus pyogenes
ttgatagaaaaatacttggaatcatcaatcgaatcaaaatgtcagttaattgtcttgttttttaagacatcttatttgccaataactgaggtagcagaaaaaactggcttaacctttttacaactaaaccattattgtgaggaactgaatgcctttttccctggtagtctgtctatgaccatccaaaaaaggatgatatcttgccaatttacacatccttttaaagaaacttatctttaccaactctatgcatcatctaatgtcttacaattactagcctttttaataaaaaatggttcccactctcgtccccttacggattttgcaagaagtcattttttatcaaactcctcagcttatcggatgcgcgaagcattgattcctttattaagaaactttgaattaaaactctctaagaacaagattgtcggtgaggaatatcgcatccgttacctcatcgctctgctatatagtaagtttggcattaaagtttatgacttgacgcagcaagacaaaaacactattcatagctttttatcccatagttccacccaccttaaaacctctccttggttatcggaatcgttttctttctatgacattttattagctttatcgtggaagcggcatcaattttcggtaactattccccaaaccagaatttttcaacaattaaaaaaactttttgtctacgattctttgaaaaaaagtagccatgatattatcgaaacttactgccaactaaacttttcagcaggagatttggactacctctatttaatttatatcaccgctaataattcttttgcgagcttacaatggacacctgagcatatcagacaatattgtcaactttttgaagaaaatgatacttttcgcctgcttttaaatcctatcatcactcttttacctaacctaaaagagcaaaaggctagtttagtaaaagctcttatgtttttttcaaaatcattcttgtttaatctgcaacattttattcctgagaccaacttattcgtttctccgtactataaaggaaaccaaaaactctatacgtccttaaagttaattgtcgaagagtggatggccaaacttcctggtaagcgtgacttgaaccataagcattttcatcttttttgccactatgtcgagcaaagtctaagaaatatccaacctcctttagttgttgttttcgtagccagtaattttatcaatgctcatctcctaacggattcttttccaaggtatttctcggataaaagcattgattttcattcctattatctattgcaagataatgtttatcaaattcctgatttaaagccagatttggtcatcactcacagtcaactgattccttttgttcaccatgaacttacaaaaggaattgctgttgctgaaatatcttttgatgaatcgattctgtctatccaagaattgatgtatcaagttaaagaggaaaaattccaagctgatttaaccaagcaattaaca

SEQ ID NO: 3750 - protein, 497 aa, Streptococcus pyogenes
LIEKYLESSIESKCQLIVLFFKTSYLPITEVAEKTGLTFLQLNHYCEELNAFFPGSLSMTIQKRMISCQFTHPFKETYLYQLYASSNVLQLLAFLIKNGSHSRPLTDFARSHFLSNSSAYRMREALIPLLRNFELKLSKNKIVGEEYRIRYLIALLYSKFGIKVYDLTQQDKNTIHSFLSHSSTHLKTSPWLSESFSFYDILLALSWKRHQFSVTIPQTRIFQQLKKLFVYDSLKKSSHDIIETYCQLNFSAGDLDYLYLIYITANNSFASLQWTPEHIRQYCQLFEENDTFRLLLNPIITLLPNLKEQKASLVKALMFFSKSFLFNLQHFIPETNLFVSPYYKGNQKLYTSLKLIVEEWMAKLPGKRDLNHKHFHLFCHYVEQSLRNIQPPLVVVFVASNFINAHLLTDSFPRYFSDKSIDFHSYYLLQDNVYQIPDLKPDLVITHSQLIPFVHHELTKGIAVAEISFDESILSIQELMYQVKEEKFQADLTKQLT

SEQ ID NO: 3751 - DNA, 1137 bp, Streptococcus agalactiae
atggaaaataaggtaaaaacagttgctgttttctcaggatattatctacccttcctcggaggtattgaacgttatacagataaaatgacagcagatttggttaagcgtggctaccgtgttgttattgtaacaactaatcatggtgatttaccgattatagatgaagacaagggtagaaaaatttaccgtttaccgaccaaaaatattgtcaagcagcgctatcctattattaacaaaaatcgagaatacaacacgctgatgaaatatgtttcagatgaaaatattgattttgtgatttgtaatacacgttttcagttaacaacgctagaagggctatcttttgcaaagaatcaccatttacctagtattgttttagaccatgggtcaagtcatttttctgtcaataatcgttttttagatttctttggagctatctatgaacatcttctcacagcgcgtgttaagcattatcgtccagatttttatgcggtatccaagagaagcgttgaatggttaaaacattttaatatagaagctaaaggagttatttataattcggtatctgaaagtctaggctctgattttgctggtacggcttaccttgaaaaatctgctgatgatattttcatcacttatgctggtagaattattaaagaaaaaggcattgaattgctcttagaagcattttcgatgtcacagtactctgaaaatgtttatttacagattgcaggagacggacctgaattagcacatttgaaagagaaatatcagtccaaacagattaactttttggggaaattaaactttgaacagactatgtctttaatggcacagactgatatctttgtttacccttcaatgtatccagagggattaccaacctctattttagaagctggtctactttcaagtgctattattgcaacagatcgcggtggaacagttgaagttattgatagccctgagttaggaatcatcatggaagaaaatactcagtcactccatgaatctcttgatttattagtaaaagataaggcattaagagagaaactacaacagaatattgctaaaagaattaaagaacatttcacatgggaaaaaacagttgaaaagttggattatattattcaaaaaaat

SEQ ID NO: 3752 - protein, 379 aa, Streptococcus agalactiae
MENKVKTVAVFSGYYLPFLGGIERYTDKMTADLVKRGYRVVIVTTNHGDLPIIDEDKGRKIYRLPTKNIVKQRYPIINKNREYNTLMKYVSDENIDFVICNTRFQLTTLEGLSFAKNHHLPSIVLDHGSSHFSVNNRFLDFFGAIYEHLLTARVKHYRPDFYAVSKRSVEWLKHFNIEAKGVIYNSVSESLGSDFAGTAYLEKSADDIFITYAGRIIKEKGIELLLEAFSMSQYSENVYLQIAGDGPELAHLKEKYQSKQINFLGKLNFEQTMSLMAQTDIFVYPSMYPEGLPTSILEAGLLSSAIIATDRGGTVEVIDSPELGIIMEENTQSLHESLDLLVKDKALREKLQQNIAKRIKEHFTWEKTVEKLDYIIQKN

SEQ ID NO: 3753 - DNA, 846 bp, Streptococcus agalactiae
atgaaatatttagcgggtattgtcacctttaaccccaatattgaacgcttagatcagaacattcgagcaatttatcctcaagtaagccacatctatatcgtagataatggctcgaaaaataaggaagaaatttctcaattagtagccgattataatgaagaggggcacctaactgttgattatttaacagaaaataaagggattgcatatgctttgaactgtatcggtcaatttgcagtagcacaagaatttgattggttcttgactttagatcaagattcggttgtcctaggtgatttgatagataattatgaaaattaccttcatttacctaaggtcggtatgttatcttgtttgtatcaagatatgaaccgtgaaaatttagtgatgcaagaatttgactataaagaaattgaagagtgtattacttcggctgctttaatgaaaacgagcgttttcgaagaaacatctggctttgcagaagagatgtttattgattttgttgactctgaaatgaattatcgtctgtcagagatgggatataagacttatcaggttaattttattggtctgttacacgaaattggacactcttcacgagttaaaaaatttggccatgtttttcatgtattgaatcattcaccatttcgaaaatattacatgatacgcaatgcgatctatattataaaaaaatatggtaagaagaagcgatacaaatatttagtatttatgcgaaatgaatttgttcgagtgttggtagcagaagagcaaaagagcaaaaaaatagttgctatgattaaaggcttaaaagatggcttattgatgaaagtggataaatatggaaaa

SEQ ID NO: 3754 - protein, 282 aa, Streptococcus agalactiae
MKYLAGIVTFNPNIERLDQNIRAIYPQVSHIYIVDNGSKNKEEISQLVADYNEEGHLTVDYLTENKGIAYALNCIGQFAVAQEFDWFLTLDQDSVVLGDLIDNYENYLHLPKVGMLSCLYQDMNRENLVMQEFDYKEIEECITSAALMKTSVFEETSGFAEEMFIDFVDSEMNYRLSEMGYKTYQVNFIGLLHEIGHSSRVKKFGHVFHVLNHSPFRKYYMIRNAIYIIKKYGKKKRYKYLVFMRNEFVRVLVAEEQKSKKIVAMIKGLKDGLLMKVDKYGK

SEQ ID NO: 3755 - DNA, 1422 bp, Streptococcus agalactiae
atgaaacttttgaaaaatatgttttataatacctcataccagttattgactttgttgttacctttagtaacagttccttatgtttcccgtgtactatctcctcaaggcatcggtattaatgcctatacgagctccattgtcatgtactttactttatttggtgctttagggatatctttgtacggtaatcgtgagatagcttttgtgcagtcaaataagtataagagaagtaagatattttgggaattagttgtattaaaacttgcctctgtatctatagcaacgttattattctttggatttgtcttacttacaaacgaatggcaattattctatttaattcaaggtattaatttattagcgactgcaactgatatttcgtggtattttattggagttgaagactttaagataattgtcattcgtaataccattgttaagcttattacagttgttttgaccttcttagttgtgaagacgccagatgacctagcactttatatgtttttaattgcatttgcatcattactcggaaatttaacagtctggcatcatttaaagcatgaaatcatcaagataccatttagtagattagatatcttaatacatctaagaccaactttaatgttatttttaccccaaatcaccatgcagatttatctctctcttaacaagagtatgctgggagcaatggatagtgtggtcagtgctggatattttgatcaatctgataaaattattcgtattttatttaccattgtttcagcaatcggaggagttttcttaccaaggctctccagtctattttcttcaggaaaagaaaagcaagctaaggctttacttttgaaacttgttgatttaagcaatgctatctcaatgttaatgattgcgggagtggtaggagtttcgtcgacatttgccgtcttcttttttgggaaagggtatgaagctgtcggtccgctaatggctgttgagtctttgatgatcatttgcatttcttatggtaacgctttagggacacagtatctactggcttcaagacgtacaaaagcttacacaatgtctgcagttattggacttgtggcaaatgttgtgcttaatatacttttaataccaattttaggtgctatgggagctattatctctacagttattactgaatttattgtctccctatatcaagctatctctttaagagatgtatttacttttaaagaattaacaagaggaatgctgcgctatttaattgctgctactcttagtggagctgtactctattatatcaatactcaaatgtcagtatcattggtaaattatgtcattcaaagtttagtagcagtaactatctatgtcggtatcgtttttataaccaaagcaccagtcattcagttatttagagattttagaaaagagcatagaaca

SEQ ID NO: 3756 - protein, 474 aa, Streptococcus agalactiae
MKLLKNMFYNTSYQLLTLLLPLVTVPYVSRVLSPQGIGINAYTSSIVMYFTLFGALGISLYGNREIAFVQSNKYKRSKIFWELVVLKLASVSIATLLFFGFVLLTNEWQLFYLIQGINLLATATDISWYFIGVEDFKIIVIRNTIVKLITVVLTFLVVKTPDDLALYMFLIAFASLLGNLTVWHHLKHEIIKIPFSRLDILIHLRPTLMLFLPQITMQIYLSLNKSMLGAMDSVVSAGYFDQSDKIIRILFTIVSAIGGVFLPRLSSLFSSGKEKQAKALLLKLVDLSNAISMLMIAGVVGVSSTFAVFFFGKGYEAVGPLMAVESLMIICISYGNALGTQYLLASRRTKAYTMSAVIGLVANVVLNILLIPILGAMGAIISTVITEFIVSLYQAISLRDVFTFKELTRGMLRYLIAATLSGAVLYYINTQMSVSLVNYVIQSLVAVTIYVGIVFITKAPVIQLFRDFRKEHRT

SEQ ID NO: 3757 - DNA, 120 bp, Streptococcus agalactiae
atgactaaaagaatcaatcctataagagcaatactaagatttttagtcaacgatttatcaactaaaagatttatcaaaagcgataaaaatgctccaaatacaatatatccagtcgagtca

SEQ ID NO: 3758 - protein, 40 aa, Streptococcus agalactiae
MTKRINPIRAILRFLVNDLSTKRFIKSDKNAPNTIYPVES

SEQ ID NO: 3759 - DNA, 117 bp, Streptococcus agalactiae
atgagggcaaccaaggtgattgagacaaaggaactaaataaccttgctactgtaatcattacccccatagaaggatacacaaatttgcctaaaaataagccaactgctggcacaaga

SEQ ID NO: 3760 - protein, 39 aa, Streptococcus agalactiae
MRATKVIETKELNNLATVIITPIEGYTNLPKNKPTAGTR

SEQ ID NO: 3761 - DNA, 1362 bp, Streptococcus agalactiae
atgaacctcaaaaaagttcgtctatttgaaaagttttttctagacaagaacttgcataaaacatattttatattaggcttaacgattactattgtattgagcctattaatgccatttttcaatgaacctgatggacaataccatttagctgtgtctggtcgtatttcaaataacattattgatacttcttactatggagaatataatattgattcaggtatgagacgacaatcgacctcctatagagatggtactagatttgaaaaatactatttaaataaagccaattttgttgatggtaatcatttgcctcgtgagataaactattctaaacataactttgttttttggggtcatcttgtgccagcagttggcttatttttaggcaaatttgtgtatccttctatgggggtaatgattacagtagcaaggttatttagttcctttgtctcaatcaccttggttgccctcattatccggtatgtgaaaaaaggaaagttaatctactttgctattttcctcagtcccgtagttctaaattcatttgctagtctatcttatgactcgactggatatattgtatttggagcatttttatcgcttttgataaatcttttagttgataaatcgttgactaaaaatcttagtattgctcttataggattgattcttttagtcattgttgcatgtaagcagaattactggctgtttttattgctagtaataccggtattattgcaggttaacaatcctaaattaatgggctataatcagaagctatcacatttatttcaaggtcttaaatctaaaaagctattttggctatgtctaacctttttgtcacttgctatagtttatgttctgaccgcaagacatggtggtgtccttgctgttttaagacgttatgtaatgacatttggctataattatgctggtatcaatattttaagtaatgacattacttcctggcttgcctctccatatccaagtcagaattttattcccacttgggtatcatcagtatggtatctcatggtctttctagtatggttttctgaagaaaaatttgttaagtcaaaaaatatgggatttcttttcttagctagtttctttgtgggaattcttggtgtcttttttatcatgttagaatatcgtggagcgccaacaagctacattgaaggagttcaaggacgttactttactgttacattgcttttggtacaagtttttgcatcaagtattccagcgcgtctaaatgaggcaggaaggaaagtggtgccgtatgcgttaactggcttggtaattgtatcaaatgccttattgttatttgatactgttattagtttaattatgaggagaaac

SEQ ID NO: 3762 - protein, 454 aa, Streptococcus agalactiae
MNLKKVRLFEKFFLDKNLHKTYFILGLTITIVLSLLMPFFNEPDGQYHLAVSGRISNNIIDTSYYGEYNIDSGMRRQSTSYRDGTRFEKYYLNKANFVDGNHLPREINYSKHNFVFWGHLVPAVGLFLGKFVYPSMGVMITVARLFSSFVSITLVALIIRYVKKGKLIYFAIFLSPVVLNSFASLSYDSTGYIVFGAFLSLLINLLVDKSLTKNLSIALIGLILLVIVACKQNYWLFLLLVIPVLLQVNNPKLMGYNQKLSHLFQGLKSKKLFWLCLTFLSLAIVYVLTARHGGVLAVLRRYVMTFGYNYAGINILSNDITSWLASPYPSQNFIPTWVSSVWYLMVFLVWFSEEKFVKSKNMGFLFLASFFVGILGVFFIMLEYRGAPTSYIEGVQGRYFTVTLLLVQVFASSIPARLNEAGRKVVPYALTGLVIVSNALLLFDTVISLIMRRN

SEQ ID NO: 3763 - DNA, 945 bp, Streptococcus agalactiae
atggtaaaaacagcagttttgatggcaacatataatggtcaaggtttcatccacgatcagctagattcaattagaaatcaaacgttgagaccagactatgtcttaatgagggacgatggctctactgatgatactgtaaaggtggttgaagactatataaaagagcaccgtttagatggttggtcaataactagtaatgataaaaatttaggttggcgtttaaattttcgtcaattacttattgatgtgttagcctatgaggttgactatgtcttttttagtgatcaagatgacacatggtatcatcataaaaataagatgcaagttgatattatggaagaacgccaagatataaaccttcttagcgccgatattgatatcaaaaagttatcagaagaggctactattcccaataattttaagttcaatggtgaggaaacaatttctaagtatccattagacttttcatatcataactatcgtcaaggttggactttttgtttacgcaagtcgtttgttgatcaagtaatgactttttacagtgataatttaattttgtcacatgataatctttttgcaggggtatctggtgtcattggttcaggttacaatttaaacagaagtgttggtgaacataagcgacatgctgagaatgcaagtgggaatatcttgaatatgagctcaagttacgaaaggcatttacaagaactgtattttgttttgagttactatatcatccttgtaccatttttagaaaaaagtagctctagtcaattaagggaagctaaagcttatctggattttaatcagcaacgttataaaaatgctcaaaataaagattttgtagcaatacttaaacaaatgatgactaaaaaacggttctatgatagcttttcaaatcgcattcgtgacttggtgtttttattaaaagatataaaaaggagt

SEQ ID NO: 3764 - protein, 315 aa, Streptococcus agalactiae
MVKTAVLMATYNGQGFIHDQLDSIRNQTLRPDYVLMRDDGSTDDTVKVVEDYIKEHRLDGWSITSNDKNLGWRLNFRQLLIDVLAYEVDYVFFSDQDDTWYHHKNKMQVDIMEERQDINLLSADIDIKKLSEEATIPNNFKFNGEETISKYPLDFSYHNYRQGWTFCLRKSFVDQVMTFYSDNLILSHDNLFAGVSGVIGSGYNLNRSVGEHKRHAENASGNILNMSSSYERHLQELYFVLSYYIILVPFLEKSSSSQLREAKAYLDFNQQRYKNAQNKDFVAILKQMMTKKRFYDSFSNRIRDLVFLLKDIKRS

SEQ ID NO: 3765 - DNA, 945 bp, Streptococcus agalactiae
ttgaggagtaatatggtaaagacagcagttttaatggcgacatacaatggcgaaatatttatatctgaacaacttgattcaattcgccaacagacattaaaaccagattatgtattattgagggatgattgttcaacggatgaaacagtcaatgtcgtcaataactatatcgcaaaacatgagttagaaggctggaaaattgttaaaaacgacaaaaacttaggctggcgtttaaattttcgtcaattacttattgatgtgttagcctatgaggttgactatgtcttttttagtgatcaagatgatatttggtatcttgataaaaacgaacgacagtttgccattatgtcagataaacctcaaattgaggttttgagtgcagacgttgatatcaaaacgatgtctacagaagccagtgttccacattttctaactttttcttctagtgatagaatcagtcagtatcctaaagtatatgattatcaaacattccgtcccggatggaccattgctatgaagagagattttgcgcaagctatcgctgataattggacttttggagctaatatttcgcacgataatcttatcgagacaactgccagtattattggaaatggttataaccttaacgaaagcgtaggagttcatattcgatatggaggaaacgcaagtggtaatagcaaatttgttttgaattggaagtcgcctaaaacacaacatatcacaggattaaaaacatttgttgatttttacgaaaccatgcagaaggttgtcaacaaatatcaaaatgatgtcgctttaaatcaacgcttagcctttgaaaaagaaagattggaagcttctaaattgtcattaattcataatagtgcttttgtgattaaaaattggcgactctataactctaatagtggacgtatgagagatttattatttgcgtttaaaaag

SEQ ID NO: 3766 - protein, 315 aa, Streptococcus agalactiae
MRSNMVKTAVLMATYNGEIFISEQLDSIRQQTLKPDYVLLRDDCSTDETVNVVNNYIAKHELEGWKIVKNDKNLGWRLNFRQLLIDVLAYEVDYVFFSDQDDIWYLDKNERQFAIMSDKPQIEVLSADVDIKTMSTEASVPHFLTFSSSDRISQYPKVYDYQTFRPGWTIAMKRDFAQAIADNWTFGANISHDNLIETTASIIGNGYNLNESVGVHIRYGGNASGNSKFVLNWKSPKTQHITGLKTFVDFYETMQKVVNKYQNDVALNQRLAFEKERLEASKLSLIHNSAFVIKNWRLYNSNSGRMRDLLFAFKK

SEQ ID NO: 3767 - DNA, 1056 bp, Streptococcus agalactiae
atgatgattaaatttagtaataaaattgtacaagaagatttagcacttattagtaaccaaaattatattaattgggaaagaattgctaataaaggcgttttaataagtggttctaatagtatgttagcgagttatatggtatttttactagcctatctcaatgagacaagaaattaccaaacgcaaattattgcgacagctagaaacattgaaaaagcccgtgataaattttcagatttagttgggaaagattatttcaccttaattccttatgatgtagaagaacgcctagagtatgatggaaaagtggattacattatccatgcagcaagcaatgctagtccaactgctattttgagtaatcctgttagcatcataaaagctaatacaattggtacattgaatttattagactttgcaaaggaaaaaacaattgaaaacttcttgttcttatcaacgcgtgaagtatatggaacatctattaaagaagtgattgatgaagaagcttatggtggatttgatattttagctactagagcttgttacccagaaagcaaacgtatggctgaaactctactgcaaagttactatgatcaatataaggtaccctttactattgctcgtattgcacattcatttggtcctggtatggagcttggtaacgatggtcgtattatgaatgatcttttatcgaatgtcattgatggcaaagatatcgttttaaaaagtagtggtacagcagagcgtgctttctgttatttagcagatgctgtatcagggttatttactattttattaaatggtgaagttggtcaagcttacaatgtagcaaatgaagatcaacccattatgattaaggatttggcacaaaagttagttgatctcttttctgataaaaatatttcagtagtattcgatattcctaaaactatgagtgcaggttatagcaaaatggggagaacacgtctcactatggccaaattagaagcgttgggatggaagcgagaagtttctcttgaatctggaatattaaaaacagtacaagcatttgaggag

SEQ ID NO: 3768 - protein, 352 aa, Streptococcus agalactiae
MMIKFSNKIVQEDLALISNQNYINWERIANKGVLISGSNSMLASYMVFLLAYLNETRNYQTQIIATARNIEKARDKFSDLVGKDYFTLIPYDVEERLEYDGKVDYIIHAASNASPTAILSNPVSIIKANTIGTLNLLDFAKEKTIENFLFLSTREVYGTSIKEVIDEEAYGGFDILATRACYPESKRMAETLLQSYYDQYKVPFTIARIAHSFGPGMELGNDGRIMNDLLSNVIDGKDIVLKSSGTAERAFCYLADAVSGLFTILLNGEVGQAYNVANEDQPIMIKDLAQKLVDLFSDKNISVVFDIPKTMSAGYSKMGRTRLTMAKLEALGWKREVSLESGILKTVQAFEE

SEQ ID NO: 3769 - DNA, 741 bp, Streptococcus agalactiae
ttggtactggaaagaaggttaatgatgaatattggagttatttttgcaggtggtgttggtcgtcgcatgaataccaaaggtaaaccaaagcaattcctagaagtgcatggtaaacccattattgtacacacaattgatattttccaaaatacagaagctattgatgctgtagtagttgtctgtgtatcagactggctagattatatgaataatctggtagagcgtttcaaccttacgaaagtaaaagcagttgttgcaggtggagaaactggccaaatgtcaatttttaaggggcttgaagccgctgaacagctggctacagatgatgccgttgttttaattcatgacggagtacgtccattgattaatgaagaagttattaatgctaatatacagtcagtaaaagaaacaggaagtgcggtaacttcagttcgtgctaaagagacagttgttctagtcaatgattcttctaaaatatctgaagttgttgatcgtactcgttccttcattgctaaagcgccacaaagtttttatctatcagatatcctttctgttgaacgtgatgccattagcaaagggattactgatgcaattgattctagtactttgatgggtatgtacaatcgtgaactcactattgttgagggaccatatgaaaatatcaagataacaacaccagatgatttttatatgtttaaagctttgtatgatgctagagaaaatgaacaaatttatgggatg

SEQ ID NO: 3770 - protein, 247 aa, Streptococcus agalactiae
MVLERRLMMNIGVIFAGGVGRRMNTKGKPKQFLEVHGKPIIVHTIDIFQNTEAIDAVVVVCVSDWLDYMNNLVERFNLTKVKAVVAGGETGQMSIFKGLEAAEQLATDDAVVLIHDGVRPLINEEVINANIQSVKETGSAVTSVRAKETVVLVNDSSKISEVVDRTRSFIAKAPQSFYLSDILSVERDAISKGITDAIDSSTLMGMYNRELTIVEGPYENIKITTPDDFYMFKALYDARENEQIYGM

SEQ ID NO: 3771 - DNA, 822 bp, Streptococcus agalactiae
atgaaagaaatgacggtctcagaaataagagaagttcaacttgaaatgttagcttatattgataaagttgcgcgtgataataaaattgaatattctttaggcggaggcagcctactgggagcaatgagacataaaggattcattccatgggatgacgatattgatttgatgctagaaagaagccagtatgagcgtttgatgaaagcattagctgatgctaataatagcgattttaaattgctacatcattctgttgaaaaaaatctatggccatttgccaagctgtatcacacaaagtcaatgtacttaagtaaaacagatagaattcatccttggacagggatttttattgatatcttcccacttgaccgattaccagagagtgcagaagaacgtcaaagattctttaaaaaagttcactctgctgctgcaaatttgatgtgtacgacttaccccaattttgctagcggttcccgaaagctttatgcaaatgcaaggctaattttggggctaccccgattcatcgcttatcacggccaagctaaaaaacgtgctgaaattgttgatcaagtgatggaaacatataataatcaagaggttccttacatgggttataccgattcaagatatcgcttgaaagaatattttccaagagaaattttttctgagtatgaagatgttatgtttgaaaacattaaaacccgaaaaattaaaaatgagcatgcttatctgaatcaattatatgggggtagttatatggaattacctccagaaagtaagagagaaagtcatagttattacacttggtactggaaagaaggt

SEQ ID NO: 3772 - protein, 274 aa, Streptococcus agalactiae
MKEMTVSEIREVQLEMLAYIDKVARDNKIEYSLGGGSLLGAMRHKGFIPWDDDIDLMLERSQYERLMKALADANNSDFKLLHHSVEKNLWPFAKLYHTKSMYLSKTDRIHPWTGIFIDIFPLDRLPESAEERQRFFKKVHSAAANLMCTTYPNFASGSRKLYANARLILGLPRFIAYHGQAKKRAEIVDQVMETYNNQEVPYMGYTDSRYRLKEYFPREIFSEYEDVMFENIKTRKIKNEHAYLNQLYGGSYMELPPESKRESHSYYTWYWKEG

SEQ ID NO: 3773 - DNA, 1731 bp, Streptococcus agalactiae
atgagtaaaaaacatatttttatttgtctgtttttcatgctttttttagtaggttgccaaaataataaaaaagtaaaaacagataaaaaagtagatattacagcttattattatcataataataccccgcaatacagtgttcagattaatgctattcatttacaaacagcattggataaagtgaggacgggggagtttgagagcaaagactttacacactatacttttgatagtatcaagcggaagtaccaagttagtggtaaaaaagtccttatggataataactatagatttggttctggtataaaaaatactagacaggatgctattgctattgtaaggttactgcttgaaaagaataaagattatttaatttacatgaatggcttagaagagccaagtgttttatataatccagaaaataaacgttataagttcacaaataacaaaggaaaagcaattggtaatattccagttggtttaactgcttttgaaaacagcgcagaaactcaagaatatgtgttgaaaaatattcagaaaaacgaaacgatttatcttggtaatacccgagtagataatcctcgagtaactgttaataacaaaaaaagagatactataggagttgaatacggtaaacgtattacttataggattccaatttattcaaagcagctgactgtcagagttagccctaattttgtagtagatagtactaattataattaccgactttctcaagcgcctattattgcggaagaaggtaaagagggacgtttgtatccaatagatagcagtattagtgtcgatggtgataaaattgttttaaatagtagtggtgatgaaacagagcaaaaagaattattacaaaatagcctgtataaacttcactctattgataagttagactttgatttgacaaatgctgatattaaagagttagagattacaggacatgttgcttcaaaaagagattataatttgtctgttgctcaggaaaagaaaggcgtcatagagactaaacggagtctaatttctgttgataatcaaaaacaagatcaagggatttttgtcgaggattctaaaggctatataaagacacctagtttgagcagttatggtataaattttgccatgtatgacgacaatcaaaatagattattacaaggttcagagtatattttaggaagattgaatgcagataaaaaagtatctctatatcaacctaatggcttttggataaatactcaaaaaacgattaagagtttaaataaagaatatcttaaccaaaatgcttaccatattagaggaaataacattataggtattgatggctattcaaatgacatagacttgaatcctaggttatgggcttataactataaaaaacaagtgaaaagtaaccaatcattatttaaattacgaggtttgtctaataaatataagtatttcttaatacagacaaaatctccaaaaggctacttacaaagcaataaaccattttattttacagtaaataaagatagtgtttctaaagcacaatttggtaactataatataaatggttatataatggacatgcagtacaacaaacaagaatacaatgcacttgcaaacactccaaaaggtcaaaaaacaaagaaaactttcaaacccatgaccctagtgattctttttgcagtagctttatttattttctatattacagctataagatttgtatttaaaagaatg

SEQ ID NO: 3774 - protein, 577 aa, Streptococcus agalactiae
MSKKHIFICLFFMLFLVGCQNNKKVKTDKKVDITAYYYHNNTPQYSVQINAIHLQTALDKVRTGEFESKDFTHYTFDSIKRKYQVSGKKVLMDNNYRFGSGIKNTRQDAIAIVRLLLEKNKDYLIYMNGLEEPSVLYNPENKRYKFTNNKGKAIGNIPVGLTAFENSAETQEYVLKNIQKNETIYLGNTRVDNPRVTVNNKKRDTIGVEYGKRITYRIPIYSKQLTVRVSPNFVVDSTNYNYRLSQAPIIAEEGKEGRLYPIDSSISVDGDKIVLNSSGDETEQKELLQNSLYKLHSIDKLDFDLTNADIKELEITGHVASKRDYNLSVAQEKKGVIETKRSLISVDNQKQDQGIFVEDSKGYIKTPSLSSYGINFAMYDDNQNRLLQGSEYILGRLNADKKVSLYQPNGFWINTQKTIKSLNKEYLNQNAYHIRGNNIIGIDGYSNDIDLNPRLWAYNYKKQVKSNQSLFKLRGLSNKYKYFLIQTKSPKGYLQSNKPFYFTVNKDSVSKAQFGNYNINGYIMDMQYNKQEYNALANTPKGQKTKKTFKPMTLVILFAVALFIFYITAIRFVFKRM

SEQ ID NO: 3775 - DNA, 93 bp, Streptococcus agalactiae
ttggtattgctactagtatcaaataattctaaacaaaacagaaataaaatagcaccaaataacaagaaattcatcgttaaagcgaatccaagg

SEQ ID NO: 3776 - protein, 31 aa, Streptococcus agalactiae
MVLLLVSNNSKQNRNKIAPNNKKFIVKANPR

SEQ ID NO: 3777 - DNA, 759 bp, Streptococcus agalactiae
ttgcaacaaattattacaataagagataagatgatgaaaaaaattttactagtgatacctgcttataatgaagaaggtagtattgcaaagacagtccagactattgtagattttaaggcgtctcgctcactaccttttgagctggattatattgttattaacgatgggtcaaccgatggtactccagagttattagatagattgggtttaaatcatattgaccttgttcaaaatctaggtattggtggctgtgtgcagacaggatacttatacgctaatcgtaatcattacgatgttgccgttcaatttgatggtgatggtcaacatgatattagaagcattgaagatgttgttatgccaatcttaaatgacgaagcagattttgttattggttctcgctttgttgataaaaaacatcaaaattttcaatcgacagcaatgaggcgtcttggcataaatttaatatctgctgctataaaattaacgacgggacacaaagtctatgatacaacaagtggttatagggcagccaacgcggcgctaatagcttatttatcgtgtcattatccagtacaatacccagagcctgaatcaactgctcggattttgaaaaaaggctatcgtttgaaggaagtcacagctaatatgtttgaacgtgaggcaggtacttcaagtataagttccctaaaatcgattttttatatgacggatgttttaacatcaattattattgcagggtttattaaggaggatgataaa

SEQ ID NO: 3778 - protein, 253 aa, Streptococcus agalactiae
MQQIITIRDKMMKKILLVIPAYNEEGSIAKTVQTIVDFKASRSLPFELDYIVINDGSTDGTPELLDRLGLNHIDLVQNLGIGGCVQTGYLYANRNHYDVAVQFDGDGQHDIRSIEDVVMPILNDEADFVIGSRFVDKKHQNFQSTAMRRLGINLISAAIKLTTGHKVYDTTSGYRAANAALIAYLSCHYPVQYPEPESTARILKKGYRLKEVTANMFEREAGTSSISSLKSIFYMTDVLTSIIIAGFIKEDDK

SEQ ID NO: 3779 - DNA, 693 bp, Streptococcus pyogenes
gtgaaaaagttaatcattattcctgcttacaatgaaagcagtaatattgtcaatactatacgtactattgaatcagatgccccggattttgactatatcattattgatgattgctcaacggataatacgttagcaatatgtcaaaaacaggggttcaatgttatttctttgcccattaacctgggaattggcggtgcggtgcaaactggctatcgttatgcacaaagatgtggatatgacgttgcagttcaagtagatggagatggtcagcacaatccatgctatttggaaaaaatggttgaggtattagttcaatcttcagtaaatatggtaattggatcacgatttatcacaaaagaagggtttcagtcatcatttgctcgacgtatcggcataaagtattttacttggcttattgcgctactaacaggaaaaaaaataacagatgcaacgtcaggtctaaggttaattgaccgttcattgattgaacgttttgctaatcattatccagatgattatcctgaacctgaaacagttgttgatgtattggttagtcattttaaagtgaaagaaattcctgttgtaatgaatgagcgacaaggcggtgtgtcatctatctcgttgacgaaatcggtctattatatgattaaagtgactttagctattttagttgttagattgaaaggaaatcgt

SEQ ID NO: 3780 - protein, 231 aa, Streptococcus pyogenes
VKKLIIIPAYNESSNIVNTIRTIESDAPDFDYIIIDDCSTDNTLAICQKQGFNVISLPINLGIGGAVQTGYRYAQRCGYDVAVQVDGDGQHNPCYLEKMVEVLVQSSVNMVIGSRFITKEGFQSSFARRIGIKYFTWLIALLTGKKITDATSGLRLIDRSLIERFANHYPDDYPEPETVVDVLVSHFKVKEIPVVMNERQGGVSSISLTKSVYYMIKVTLAILVVRLKGNR

SEQ ID NO: 3781 - DNA, 939 bp, Streptococcus agalactiae
atgaaagttaatattttaatggccacctacaatggagagaagtttctggcgcagcaaatcgaaagtatccaaaagcaaacctttaaagagtggaacctcctaatcagagatgatggttcaagtgacaagacatgtgatattattagaaactttactgctaaagattctcgaattcgtttcattaatgaaaatgagcaccataatttaggagttattaaatcattttttacgctagttaattacgaagttgcagatttctatttttttagtgatcaagatgatgtatggttgccagaaaagttatctgtaagtttagaggcagcaaagcataaagcatctgatgtaccattacttgtttatactgatttgaaagttgttaatcaagaattaaatattttacaagacagcatgattcgggctcaatcgcaccatgccaatacgacattattaccagaactaactgagaatactgttactggtgggactatgatgataaatcatgcattagctgagaagtggtttactcctaatgatatcttaatgcatgattggtttttagcactcttagcagcaagtttaggagaaatcatttatttggatttaccaactcaactataccgtcaacatgacaataatgttttgggggcgaggacaatggataagagatttaagatacttcgtgaaggtcctaaatctatatttacaaggtattggaaacttatccatgactcacaaaagcaagcttccttaattgttgataagtatggtgatattatgacagctaatgatcttgagctcattaaatgttttataaaaattgacaaacagccttttatgacaagattaaggtggttatggaaatatggttatagcaaaaatcaatttaagcatcaagttgtgtttaaatggttgattgcaacaaattattacaataagaga

SEQ ID NO: 3782 - protein, 313 aa, Streptococcus agalactiae
MKVNILMATYNGEKFLAQQIESIQKQTFKEWNLLIRDDGSSDKTCDIIRNFTAKDSRIRFINENEHHNLGVIKSFFTLVNYEVADFYFFSDQDDVWLPEKLSVSLEAAKHKASDVPLLVYTDLKVVNQELNILQDSMIRAQSHHANTTLLPELTENTVTGGTMMINHALAEKWFTPNDILMHDWFLALLAASLGEIIYLDLPTQLYRQHDNNVLGARTMDKRFKILREGPKSIFTRYWKLIHDSQKQASLIVDKYGDIMTANDLELIKCFIKIDKQPFMTRLRWLWKYGYSKNQFKHQVVFKWLIATNYYNKR

SEQ ID NO: 3783 - DNA, 1182 bp, Streptococcus agalactiae
atggattgtttagctagaatggagaagatgatgcaagatgttttcattataggaagtagagggttgccagctcgttacggtggttttgaaacttttgtttcagaattgattaatcatcaaaaaagtttcgacataaaataccatgttgcatgccttagtgataaagaacatcatactcattttaactttgctgacgctgattgttttactataaatcctccccaattagggccagcacgtgtgattgcttatgatattatggccattaattatgcccttgacttggttaagacacatgatttaaaagagcctattttttatattttaggaaatacaattggtgcctttatttggcattttgccaataaaatacataaagtcggtggcttattgtatgttaatccggatggtttagagtggaagcgatcaaagtggtctcgtcccacacagcgttatttaaaatacgccgaaaaatgtatgactaaaaatgcagacctaattatttctgataatattggtattgaaaattacattcaatctacctactctaatgtgaagacaaggttcattgcttacggtacagagattaattctaggaaattatcgtcagatgatccacgtgtcaaacagttgtttaaaaaatggaatattaagtctaagggttactatctaatcgttggtcgatttgtccctgaaaacaattatgaaacggctattagggagttcatggcttcagatactaagcgtgatttagttattatctgtaaccatcaaaataacccctactttgaaaagttgtccttaaagacaaaccttcaacaagataaaagagttaagtttgtaggtacgctctatgaaaaagatctgctggattatgttcgtcaacaagcctttgcttatattcatgggcatgaagttggcggtactaatccaggactgcttgaggctttagctaatactgatttgaatcttgttctagatgttgatttcaacaaatcagtagcaggtctctcaagtttttactgggctaaaaaagagggggatttagctaagcttattaacgatagtgatcaacaacaggatttatctacttacggtgatcgagcaaaagccattattcaagaaaactatacttggaaaaaaattgttgaagaatatgaggatttgtttttaaatgaaagt

SEQ ID NO: 3784 - protein, 394 aa, Streptococcus agalactiae
MDCLARMEKMMQDVFIIGSRGLPARYGGFETFVSELINHQKSFDIKYHVACLSDKEHHTHFNFADADCFTINPPQLGPARVIAYDIMAINYALDLVKTHDLKEPIFYILGNTIGAFIWHFANKIHKVGGLLYVNPDGLEWKRSKWSRPTQRYLKYAEKCMTKNADLIISDNIGIENYIQSTYSNVKTRFIAYGTEINSRKLSSDDPRVKQLFKKWNIKSKGYYLIVGRFVPENNYETAIREFMASDTKRDLVIICNHQNNPYFEKLSLKTNLQQDKRVKFVGTLYEKDLLDYVRQQAFAYIHGHEVGGTNPGLLEALANTDLNLVLDVDFNKSVAGLSSFYWAKKEGDLAKLINDSDQQQDLSTYGDRAKAIIQENYTWKKIVEEYEDLFLNES

SEQ ID NO: 3785 - DNA, 1152 bp, Streptococcus pyogenes
atgcaggatgtttttatcattggtagcagagggttaccagcgaaatacggtggctttgaaacctttgtcgaagagttgattagtcatcaatcatctaaaaacattcgttatcatgttgcttgtttaagcgatacgaagcataaggttcattttgattataagggggcagattgcttttaccttaatcccccaaaacttggtcctgctagagttattgcttatgatatgatggcaattacctatgccctgtcttatagcgaccaacaccagattcagaaccctattttttatgtgttgggcaatactgtaggcgcttttattgcgccatttgtgaagcagattcacaatcgaggtggacgcttttttatcaatccagacgggttagagtggaaacggtctaaatggtcaagaccagtgcaggcctacctgaagttttccgaaaagcaaatgactagacaggctgatttggtcatttcagataatattggcattgaccgctaccttaaacaagtttatccttggtctaaaacatgttttattgcttatggaacgcagacacaaccttcacgtttggcaacagcagatagcaaggtcagagcttattttcaaacctttgatattagagaaaaggattactatctcattttaggacgctttgttcctgaaaataattacgaaaccgctattaaagaatttatggcttcctcaactaagcgtgatttagtgattatttgtaatcatgaaggcaatgcttactttaagcaattacttgctgagacagagtgtgataaagacccacgcattaaatttgttggtaccctttatgacaaagaactattagcctacattcgagaacaggcttatgcctatatccatggtcatgaggtaggagggactaatccaggccttctagaagcactagcccataccaatcttaatttggttttaggagttgattttaaccagtcggtggctaagtctgctgcgctttattggaccaagcaaaaagggcaattagcagagctgattaaccaagttgatgcaggttttgatagtgatcatctgggcaaagaagccaaagctattattcaagaacattacacttgggaaaaaattgtaggggagtacgaggctttatttttaaatgaacat

SEQ ID NO: 3786 - protein, 384 aa, Streptococcus pyogenes
MQDVFIIGSRGLPAKYGGFETFVEELISHQSSKNIRYHVACLSDTKHKVHFDYKGADCFYLNPPKLGPARVIAYDMMAITYALSYSDQHQIQNPIFYVLGNTVGAFIAPFVKQIHNRGGRFFINPDGLEWKRSKWSRPVQAYLKFSEKQMTRQADLVISDNIGIDRYLKQVYPWSKTCFIAYGTQTQPSRLATADSKVRAYFQTFDIREKDYYLILGRFVPENNYETAIKEFMASSTKRDLVIICNHEGNAYFKQLLAETECDKDPRIKFVGTLYDKELLAYIREQAYAYIHGHEVGGTNPGLLEALAHTNLNLVLGVDFNQSVAKSAALYWTKQKGQLAELINQVDAGFDSDHLGKEAKAIIQEHYTWEKIVGEYEALFLNEH

SEQ ID NO: 3787 - DNA, 852 bp, Streptococcus agalactiae
atgattttaattacaggggcaaacgggcaattaggtagtgaattacgtcaccttttagacgaacgaactcaagagtatgttgctgttgatgtagctgaaatggatattacaaatgccgagatggtggacaaagtctttgaagaggtgaagccatctttagtttaccattgtgcagcttacacagctgttgatgcggcagaagatgaaggaaaagagctagactttgcaatcaatgtcactggtacagagaatgtcgctaaggctgctgctaaacatgatgcaacacttgtttacatttcgacggactacgtgtttgatggtgaaaaaccagtggggcaagaatgggaagtagatgatctgcctgatcccaaaacagagtacggtcgtacaaaacgtatgggtgaagagttagttgaaaaatatacttcaaaattctataccattcgcacagcgtgggtatttggtaactatggtaaaaactttgtctttacgatgcaaaaccttgcaaaaacacacaaaactctaactgttgttaacgaccaacatggacgaccaacatggacacgtactttggctgagtttatgacttatttagctgaaaatcaaaaagattttggttactatcatttatcaaatgatgctaaagaagatacaacatggtatgattttgcggttgaaatcttaaaagacacagatgtggaggttaagcctgttgattctagtcaattcccagcaaaagcaaaacgtcctttaaattcaactatgagtttggaaaaagcgaaagcaacaggatttgtgattcctacttggcaagatgctttaaaagagttctacaagcaggaagttaaaaaa

SEQ ID NO: 3788 - protein, 284 aa, Streptococcus agalactiae
MILITGANGQLGSELRHLLDERTQEYVAVDVAEMDITNAEMVDKVFEEVKPSLVYHCAAYTAVDAAEDEGKELDFAINVTGTENVAKAAAKHDATLVYISTDYVFDGEKPVGQEWEVDDLPDPKTEYGRTKRMGEELVEKYTSKFYTIRTAWVFGNYGKNFVFTMQNLAKTHKTLTVVNDQHGRPTWTRTLAEFMTYLAENQKDFGYYHLSNDAKEDTTWYDFAVEILKDTDVEVKPVDSSQFPAKAKRPLNSTMSLEKAKATGFVIPTWQDALKEFYKQEVKK

SEQ ID NO: 3789 - DNA, 912 bp, Streptococcus pyogenes
atgttagagaacactaagatactgagaaaagtgttctacctatggcaaaaaggagaactgatgattttaattacaggaagcaatggtcaattagggacagaacttcgatacttattagatgaacgaggtgttgattatgtagccgttgatgtcgcagaaatggacatcacaaatgaagacaaagtcgaagctgtttttgcgcaggtcaagccaacattggtctatcattgtgctgcttatacggcagttgatgcagcagaagacgaaggaaaagccttgaatgaggctattaatgtaacaggctcagaaaatattgccaaggcttgtggaaaatatggggctacccttgtttacatttcaacagactacgtatttgatggcaataaaccagtcggtcaagaatgggtagaaacagatcatccagaccctaagacagaatatggccgtacaaaacgtttaggagaactagctgttgaacgatacgcagagcatttttatattatccgtactgcttgggtatttggaaattatggtaaaaactttgtctttaccatggagcagttagcagaaaatcactcccgtttgactgttgtcaatgaccaacacggtcggccaacgtggacaaggaccttggcagaattcatgtgttatttgacagagaatcaaaaagcctttggttactatcacttgtcaaatgatgctaaggaagacaccacttggtatgattttgccaaagaaatcttaaaagacaaggctgttgaagtggtgccagttgattcatcagctttcccagcaaaagccaaacgtcctttaaattcaaccatgaatcttgataaggcaaaagcaacagggtttgttattccaacatggcaagaagccttgaaggcattttaccaacaaggactgaaaaag

SEQ ID NO: 3790 - protein, 304 aa, Streptococcus pyogenes
MLENTKILRKVFYLWQKGELMILITGSNGQLGTELRYLLDERGVDYVAVDVAEMDITNEDKVEAVFAQVKPTLVYHCAAYTAVDAAEDEGKALNEAINVTGSENIAKACGKYGATLVYISTDYVFDGNKPVGQEWVETDHPDPKTEYGRTKRLGELAVERYAEHFYIIRTAWVFGNYGKNFVFTMEQLAENHSRLTVVNDQHGRPTWTRTLAEFMCYLTENQKAFGYYHLSNDAKEDTTWYDFAKEILKDKAVEVVPVDSSAFPAKAKRPLNSTMNLDKAKATGFVIPTWQEALKAFYQQGLKK

SEQ ID NO: 3791 - DNA, 339 bp, Streptococcus agalactiae
atgtcagaagtaaagcaatatagcgaagaagaagttggaaaaataaaagatcgtatcctagaagctttggagatggttatcgatcctgaattgggaatagatattgttaaccttgggttaatttatgagattcgctttgaagataacggtcgaactgaaattgatatgactttaacgactatgggatgcccgttagcagatttattgacagatcaaattcatgatgttatgaaaacagtcccagaggtaactgaaaccgaggtgaaattggtatggtacccagcctggtctgttgataagatgagtcgttatgctcgtatcgctttgggaattcgttca

SEQ ID NO: 3792 - protein, 113 aa, Streptococcus agalactiae
MSEVKQYSEEEVGKIKDRILEALEMVIDPELGIDIVNLGLIYEIRFEDNGRTEIDMTLTTMGCPLADLLTDQIHDVMKTVPEVTETEVKLVWYPAWSVDKMSRYARIALGIRS

SEQ ID NO: 3793 - DNA, 336 bp, Streptococcus pyogenes
atgtctgatacaccaaaatatacacaagatcaggtgatagctatcaagaatagaattcttgaagctttagaaactgttattgatcccgagctaggtattgatgttgttaatctaggcttgatttatgaaattcggtttaatgataacggttatacagagattgatatgacactcacaacaatgggttgtcctttggcagacttgttgacagattacatccatgatgccctgcaagatgtgccagaagtcactaagactgaggtcaaattagtctggtaccctgcttggacggttgataaaatgagccgctatgctaggattgcgctgggtattcgc

SEQ ID NO: 3794 - protein, 112 aa, Streptococcus pyogenes
MSDTPKYTQDQVIAIKNRILEALETVIDPELGIDVVNLGLIYEIRFNDNGYTEIDMTLTTMGCPLADLLTDYIHDALQDVPEVTKTEVKLVWYPAWTVDKMSRYARIALGIR

SEQ ID NO: 3795 - DNA, 1140 bp, Streptococcus agalactiae
ttgctcaaaaaagaaatatggaatgaggaacctatggcagagaaaaaaggaaatacaacttttaatgttcaagttgcggattttattcgcaatcataaaaaacaaggtactgcaattgatgatgaggtaacagaaaaacttgttattccttttgttttagatgcagatcaaattgatgatttgttagaacgattgacagacggtggcatttcaatcacagataaagaaggcaatccttcaacaaagtatgtggtagaagggccaaaacctgaagaattgactgatgaagagctcataggaagtaattctgctaaagtcaatgacccagtacgtatgtacttgaaggaaattggtgttgttcctcttttaacgaatgaagaagaaaaagaattggctgttgcggttgctgagggagatttaatggctaaacaacgtttagctgaagcaaaccttcgtcttgttgtctcaattgcaaaacgttatgttggacgtggaatgcaatttcttgatttaattcaagagggtaacatggggctcatgaaagctgttgataaatttgattattcaaagggattcaaattttcaacttatgcaacatggtggattcgtcaagctataacacgtgcaattgcagatcaagcacgtacgattcgtattcctgttcatatggttgaaacgattaataaattggtccgtgaacaacgtaatcttcttcaagaacttggtcaagatccaactcctgagcaaatcgcagaacgcatggatatgacaccagataaagtacgtgaaatcctaaaaattgctcaagagccggtatcgctagaaacgccaatcggtgaggaagatgatagccatttgggtgatttcattgaagacgaagttattgaaaatccagtagattatactacacgtgttgttcttcgtgagcaattagatgaggttttagatactcttactgaccgtgaagagaatgttcttcgtttacgctttggtcttgacgatggtaaaatgcgtacgttagaggacgtaggtaaagtatttaatgttactcgtgagcgcattcgtcagattgaagctaaagcccttagaaaacttcgccatcctagtcgtagcaagcaacttaaagatttcatggaagat

SEQ ID NO: 3796 - protein, 380 aa, Streptococcus agalactiae
MLKKEIWNEEPMAEKKGNTTFNVQVADFIRNHKKQGTAIDDEVTEKLVIPFVLDADQIDDLLERLTDGGISITDKEGNPSTKYVVEGPKPEELTDEELIGSNSAKVNDPVRMYLKEIGVVPLLTNEEEKELAVAVAEGDLMAKQRLAEANLRLVVSIAKRYVGRGMQFLDLIQEGNMGLMKAVDKFDYSKGFKFSTYATWWIRQAITRAIADQARTIRIPVHMVETINKLVREQRNLLQELGQDPTPEQIAERMDMTPDKVREILKIAQEPVSLETPIGEEDDSHLGDFIEDEVIENPVDYTTRVVLREQLDEVLDTLTDREENVLRLRFGLDDGKMRTLEDVGKVFNVTRERIRQIEAKALRKLRHPSRSKQLKDFMED

SEQ ID NO: 3797 - DNA, 1107 bp, Streptococcus pyogenes
atgacaaaacaaaaagaaataacaacttttaacgttcaagttgcggagtttattcgccatcacaaaaaagaaggaacagcgattgatgatgacgtgaccgaaaaacttgtcattccatttgctttggatgctgatcagattgatgacttacttgagcggttaacagatggtggtatctcgattacggataaagaaggtaacccatcatcaaaatacattgttgaagaaccaaaaccagaagaattaactgatgaagaattaattggtagtaattcagctaaagtaaacgaccctgtccgcatgtacctcaaagaaattggtgtggtaccgcttttaacaagtgaagaggaaaaagaattggctgttgcggttgccaagggagatttaatggctaaacaacgtttagcggaagcaaaccttcgtcttgttgtctcaattgcaaaacgttatgttggacgtggaatgcaatttcttgatttaattcaagaaggtaacatgggactcatgaaagctgttgataaatttgattattcaaaaggattcaaattctcaacttatgcaacatggtggattcgtcaagctataacacgcgcaattgcagatcaagcacgtacgattcgtatccctgttcatatggttgaaaccattaataaattggttcgtgaacaacgtaaccttcttcaagaacttggtcaagatccaacgccagaacaaatcgcagaacgtatggaaatgactccagacaaggttcgtgaaattctaaaaattgctcaagaacctgtttctttagaaacaccaattggggaagaagatgatagtcacttaggtgattttatcgaagatgaagttattgaaaatccagtagattatacgacgcgtgttgttcttcgtgagcaattggatgaagttttagatacgcttactgaccgtgaagagaacgttcttcgcctacgctttggccttgacgatggtaaaatgcgtacgttagaggacgtaggtaaagtctttaatgttactcgtgagcgcattcgacagattgaagctaaagcccttagaaaacttcgccatcctagtcgtagtaaacaattaagagactttatagaggac

SEQ ID NO: 3798 - protein, 369 aa, Streptococcus pyogenes
MTKQKEITTFNVQVAEFIRHHKKEGTAIDDDVTEKLVIPFALDADQIDDLLERLTDGGISITDKEGNPSSKYIVEEPKPEELTDEELIGSNSAKVNDPVRMYLKEIGVVPLLTSEEEKELAVAVAKGDLMAKQRLAEANLRLVVSIAKRYVGRGMQFLDLIQEGNMGLMKAVDKFDYSKGFKFSTYATWWIRQAITRAIADQARTIRIPVHMVETINKLVREQRNLLQELGQDPTPEQIAERMEMTPDKVREILKIAQEPVSLETPIGEEDDSHLGDFIEDEVIENPVDYTTRVVLREQLDEVLDTLTDREENVLRLRFGLDDGKMRTLEDVGKVFNVTRERIRQIEAKALRKLRHPSRSKQLRDFIED

SEQ ID NO: 3799 - DNA, 120 bp, Streptococcus agalactiae
atgttggtaatcttccacaaatttaaagacatcaccagagcgaccacaaccaaaacaatgaaaaaactgcctatcttcgataacattaaaagatggcgttttttctttatgaaatgggca

SEQ ID NO: 3800 - protein, 40 aa, Streptococcus agalactiae
MLVIFHKFKDITRATTTKTMKKLPIFDNIKRWRFFFMKWA

SEQ ID NO: 3801 - DNA, 1887 bp, Streptococcus agalactiae
gtgaagaagaaatccttgaaaaagcttttgaaaaaatttacacagaaaagaaaaaatgatataatcaaatgtaaaactataatgggttatttctgtggaggtcatgacttggcaattgataaagaaaaaatttctgaaatcaagaacagtgttaacattgttgatgtcatcggtgaagttgtcggtttgacaaaaacaggacgcaatcatcttggtttatgcccatttcataaagaaaaaacgccatcttttaatgttatcgaagataggcagttttttcattgttttggttgtggtcgctctggtgatgtctttaaatttgtggaagattaccaacatattagttttttagatagtgtacaagttctagctgaacgttcaggaatacctctagatactaattttaaggggcaagttcctaaaaaacctaaagctaatcagtcgcttttagatattcatagagttgcttcgggattttaccatgcctatttaatgacaactaatgatggtgaacgcgctagacaataccttgccgagcgcggagtgacagaggacttaattaaacattttcaaataggattatcgccgggagggcaggattttctatatcgtcgtctggcaaaagagtttgatgaaaaaactttgatgtcttctggtttgttcaattattcagaaaatagcaatcagttttacgattcatttaataatagaattatgtttccgttaactaatgatattggtgaagtcattgcgttttcaggacgagtttggactcaagaggacattgatagaaaacaagctaaatataaaaattctcgtgccacccctatttttaataagtcttacgagctttaccatttagataaagcgcgtgctgtaattaataaagcacacgaagtttacctaatggaaggctttatggatgttattgcagcttatcgtgcaggaattgagaatgttgttgcttctatggggaccgctttaaccaatgaacatgttagacaccttaaaagatttactaagaaagttgttctgacttatgatggtgatagagctggtcaaaacgcaattgacaagtctttagaactgctatcagatatgactgttgatatcgttaggatacctaataaaatggaccctgatgaatttctacaagcaaattcagcagaagattttaaacaactcttagaaaatgggcgcatcagtaatacagagttttatatccactacttaaagcctgaaaacaccgataatttacaatctgaaattgcttatgttgaaaaaatagcgaaattaattgctaaatctccatcgataacagcacaaaattcatatattacaaaagtggctgaactcttgccagattttgattattttcaagtagaacaatcggttaataacgaacgattgcatcatagaagtcaacagcaagcttcatcttcagtacaaacaagtgctacagtgcaattaccacagacaggtaagttatcagctatcactaaaacagaaatgcaattgtttcatcgattattgaatcatccctacctgttaaatgaattccgtaatagggataatttttattttgatacaacagaaatacaagttttatatgagttgctaaaagaaagtggtgagatcacgtcttatgatttatcacaagaaagtgacaaagttaatcgtacttattatataattttagaggaacaattacctgtagaagtatctattggagagattgaagccgtcgaaaaggcacgtgaccgtttattgaaagaacgtgatttaagaaaacaaagccagttaattagacaatctagtaatcaaggtgatgaagaaggagccttggctgcattagaaaatttaattgctcaaaaaagaaatatggaa

SEQ ID NO: 3802 - protein, 629 aa, Streptococcus agalactiae
MKKKSLKKLLKKFTQKRKNDIIKCKTIMGYFCGGHDLAIDKEKISEIKNSVNIVDVIGEVVGLTKTGRNHLGLCPFHKEKTPSFNVIEDRQFFHCFGCGRSGDVFKFVEDYQHISFLDSVQVLAERSGIPLDTNFKGQVPKKPKANQSLLDIHRVASGFYHAYLMTTNDGERARQYLAERGVTEDLIKHFQIGLSPGGQDFLYRRLAKEFDEKTLMSSGLFNYSENSNQFYDSFNNRIMFPLTNDIGEVIAFSGRVWTQEDIDRKQAKYKNSRATPIFNKSYELYHLDKARAVINKAHEVYLMEGFMDVIAAYRAGIENVVASMGTALTNEHVRHLKRFTKKVVLTYDGDRAGQNAIDKSLELLSDMTVDIVRIPNKMDPDEFLQANSAEDFKQLLENGRISNTEFYIHYLKPENTDNLQSEIAYVEKIAKLIAKSPSITAQNSYITKVAELLPDFDYFQVEQSVNNERLHHRSQQQASSSVQTSATVQLPQTGKLSAITKTEMQLFHRLLNHPYLLNEFRNRDNFYFDTTEIQVLYELLKESGEITSYDLSQESDKVNRTYYIILEEQLPVEVSIGEIEAVEKARDRLLKERDLRKQSQLIRQSSNQGDEEGALAALENLIAQKRNME

SEQ ID NO: 3803 - DNA, 1812 bp, Streptococcus pyogenes
atgggatttttatggggaggtgacgatttggcaattgacaaagaaatgatttcccaagtaaaaaatagcgttaatattgtcgatgtcattggagaagtggtcaaactttcccgatcagggcggcattacctcgggctttgcccatttcataaggaaaagacaccctcttttaatgttgttgaagacagacaattttttcactgctttggctgtggaaaatcaggggatgtttttaaatttattgaggaataccgccaagtccccttcttagaaagtgttcagattattgccgataagactggtatgtcgcttaatataccgccaagtcaggcagtacttgctagccaacacaagcaccctaatcacgctttgatgacacttcatgaggatgctgctaaattttaccatgcagttttgatgaccactaccattggtcaagaagctaggaagtacctttaccagagaggcttggatgaccaattaattgagcatttcaatattggtttagccccagatgagtcagattatctttatcaagctctttctaaaaaatacgaggaaggtcaattggttgcttcaggattgtttcacttgtccgatcaatccaataccatttacgacgcctttcgaaatcgtatcatgtttcccttatcagatgaccgagggcatattattgccttttcaggacgtatctggacggcagctgatatggaaaagagacaggcaaagtataaaaattcaagaggaacagttctttttaacaaatcttatgaattgtatcatctggacaaggcaaggcctgttattgccaaaacccatgaagtgtttctaatggaagggtttatggacgtgattgccgcttaccgttccggctatgaaaatgctgttgcttcaatggggacggcattgactcaagaacatgtcaatcaccttaagcaagtcactaaaaaagttgttttgatttatgatggtgacgatgctggacaacatgctattgcaaaatcactagaattgcttaaagattttgttgtcgaaattgtcagaatccccaataaaatggatcctgacgaatttgtacaacggcattccccagaagcatttgcagatttgcttaagcagtcacggatcagtagtgttgaattttttattgattacctaaaacctactaatgtagacaatttgcaatcacaaattgtttatgtggagaaaatggcaccattgattgctcaatcaccatccatcacagctcaacattcgtatattaacaagattgctgatttgttgccaaactttgactattttcaagtagaacaatcagtaaatgcattaaggattcaagataggcaaaaacatcaaggtcaaatagctcaagccgtcagcaatcttgtgaccttaccaatgccaaaaagtttgacagctattgctaagacagaaagtcatctcatgcatcggctcttacatcatgactatttattaaatgaatttcgacatcgtgatgatttttattttgatacctctaccttagaattactttatcaacggctgaagcaacaaggacacattacatcttatgatttgtcagagatgtcagaggaagttaaccgtgcttattacaatgttttagaagaaaaccttcccaaagaagtagctcttggtgagattgatgatattttatccaaacgtgccaaacttttagcagagcgcgatcttcacaaacaagggaaaaaagttagagaatctagtaacaaaggcgatcatcaagcggctctagaagtactagaacattttattgcgcagaaacgaaaaatggaa

SEQ ID NO: 3804 - protein, 604 aa, Streptococcus pyogenes
MGFLWGGDDLAIDKEMISQVKNSVNIVDVIGEVVKLSRSGRHYLGLCPFHKEKTPSFNVVEDRQFFHCFGCGKSGDVFKFIEEYRQVPFLESVQIIADKTGMSLNIPPSQAVLASQHKHPNHALMTLHEDAAKFYHAVLMTTTIGQEARKYLYQRGLDDQLIEHFNIGLAPDESDYLYQALSKKYEEGQLVASGLFHLSDQSNTIYDAFRNRIMFPLSDDRGHIIAFSGRIWTAADMEKRQAKYKNSRGTVLFNKSYELYHLDKARPVIAKTHEVFLMEGFMDVIAAYRSGYENAVASMGTALTQEHVNHLKQVTKKVVLIYDGDDAGQHAIAKSLELLKDFVVEIVRIPNKMDPDEFVQRHSPEAFADLLKQSRISSVEFFIDYLKPTNVDNLQSQIVYVEKMAPLIAQSPSITAQHSYINKIADLLPNFDYFQVEQSVNALRIQDRQKHQGQIAQAVSNLVTLPMPKSLTAIAKTESHLMHRLLHHDYLLNEFRHRDDFYFDTSTLELLYQRLKQQGHITSYDLSEMSEEVNRAYYNVLEENLPKEVALGEIDDILSKRAKLLAERDLHKQGKKVRESSNKGDHQAALEVLEHFIAQKRKME

SEQ ID NO: 3805 - DNA, 441 bp, Streptococcus agalactiae
ttggatttctcaaaagaaatctgctataatgaacgtgaattaaataatattaaggagcttgttcacatgattaaagaactaaaagaatttttatttaagggtaatgttttagaccttgctgttgctgttattttaggtgcagcttttaatgctatcatcacttcacttgttaaagacgttattacaccgcttatccttaatcctgtattaaaagctgctggcgtttcaaatatcgcacagctttcatggaatggtgttgcttacggtaatttcttaagtgcagttattaatttcttaatcgttggtactactttattcttcatcgttaaagctgctaacaaggttatggctaagaaacctgctgaagaagaaattattgaagttgttgaaccaacacaagagcaattacttgctgaaatccgcgacttactcgctaacaaa

SEQ ID NO: 3806 - protein, 147 aa, Streptococcus agalactiae
MDFSKEICYNERELNNIKELVHMIKELKEFLFKGNVLDLAVAVILGAAFNAIITSLVKDVITPLILNPVLKAAGVSNIAQLSWNGVAYGNFLSAVINFLIVGTTLFFIVKAANKVMAKKPAEEEIIEVVEPTQEQLLAEIRDLLANK

SEQ ID NO: 3807 - DNA, 360 bp, Streptococcus pyogenes
atggttaaagaattaaaagcatttttgtttagaggaaacattattgaacttgctgtagcagttatcatcgggggagcttttggtgctattgtcacttcttttgtgaacgatattatcacaccgcttattttaaacccagctttgaaagctgcaaatgttgaaaacatcactcaattgtcatggaatggtgttaaatatggtagctttttaggagccgttattaattttcttatcatcggtaccagtcttttctttgttgtaaaagccgctgaaaaagctatgcctaaaaaggaaaaagaagctgcagctcctactcaagaagaattattgacagaaatccgtgatttgttggctcaaaaa

SEQ ID NO: 3808 - protein, 120 aa, Streptococcus pyogenes
MVKELKAFLFRGNIIELAVAVIIGGAFGAIVTSFVNDIITPLILNPALKAANVENITQLSWNGVKYGSFLGAVINFLIIGTSLFFVVKAAEKAMPKKEKEAAAPTQEELLTEIRDLLAQK

SEQ ID NO: 3809 - DNA, 108 bp, Streptococcus agalactiae
gtgactaaagctggtactcttcaagaatcacgtaaacgtgaattctacgaaaaaccttctgtaaaacgtaaacgtaaatcagaagcagctcgcaaacgtaaaaaattc

SEQ ID NO: 3810 - protein, 36 aa, Streptococcus agalactiae
MTKAGTLQESRKREFYEKPSVKRKRKSEAARKRKKF

SEQ ID NO: 3811 - DNA, 210 bp, Streptococcus pyogenes
gtgaaaatgttacaatatcttgaggaggtgaaacacatgtcaaaaacagtagtacgtaagaatgaatctcttgacgatgctcttcgtcgcttcaaacgttctgttactaaagctggtactcttcaagaatcacgtaaacgtgaattctacgaaaaaccttctgtaaaacgtaaacgtaaatcagaagcagctcgcaaacgtaaaaaattc

SEQ ID NO: 3812 - protein, 70 aa, Streptococcus pyogenes
VKMLQYLEEVKHMSKTVVRKNESLDDALRRFKRSVTKAGTLQESRKREFYEKPSVKRKRKSEAARKRKKF

SEQ ID NO: 3813 - DNA, 1443 bp, Streptococcus agalactiae
gtgaaaaaaacaattggtattataggtatgggagttagtggtttagctgttctactagcactttctcgtaaaaaagagaaagagttaaaacagttagctattttttgttttgatgatactgtccactttggacgaggaattccttttcaagaagacgttgactcagctttaatcaattccccaatcaacgatatttcatttgattatcgccatatgtctgacttcatggattggttagaagaaaattactatgacacaaatctaacctatgtatcaaggacactttacggacaatacctttcagaaagaactaagttacttttagataaactccctgtcacggttattaaaacaagagtggataaactaaactatttatcagatgagcaacaatggcaagtctatattcaagataagctttttcctgtcacatttgatgaattacacttagcttgtggtgctctgcctgttatagaaccttatcatttggaagggaagaccgattatatcaaagacccttatcctatcaaatacttggctcaggaaaattggaagggaaaaacagttgctatcatcgggactggtctagctgcaattgatgttataaaatggttgctactcaatacacaatcttctgttaaagcattttcaagaaccaactacttccctagcgtccgtattgttaatgatttaccacttacttggcacttttttaccaatgataaccttaaagcatttctatcacatccttcaaaaaccttcactattgccgattttaatgatttgatgtctggcgaattggagcatcttggctttaaaaactggaaaaatacaacagaaacttttttatccccaggaattgatggtctcaagttagcctttaaataccctaagcaactctatctattacaacaattagcttcacgaatcactgtctggttaactgacctttggccactcatgtcattatcagataagaaagagtataaagcactctatggaaaagcgattattaacttgcgaaatcctatgcctgatgaatctgctaaagtaattttgaaagctgcacaaaaagggactttttctctgatcaataacgtcaagacaattacaaaaaatgacgaaggattttcaatagaaaaagaaaaacaaaatcatatatctgtcgatcgcgtcattaacgctactggttaccagttaaacactaaaaactggacaaaagccaatccacttctaaaatcgctcatcaatcaagaattttgtcaaattgacgatcaaggagggattactattttaactgaaaatgcacaagttttgtctccaaaatatggtccaatgccaggtttatatgcgcatggtgcactggttaatggtgtcgtttatcagaataactctacaattaaaattcaacaaatggcagagcgagccttttctgataataaa

SEQ ID NO: 3814 - protein, 481 aa, Streptococcus agalactiae
MKKTIGIIGMGVSGLAVLLALSRKKEKELKQLAIFCFDDTVHFGRGIPFQEDVDSALINSPINDISFDYRHMSDFMDWLEENYYDTNLTYVSRTLYGQYLSERTKLLLDKLPVTVIKTRVDKLNYLSDEQQWQVYIQDKLFPVTFDELHLACGALPVIEPYHLEGKTDYIKDPYPIKYLAQENWKGKTVAIIGTGLAAIDVIKWLLLNTQSSVKAFSRTNYFPSVRIVNDLPLTWHFFTNDNLKAFLSHPSKTFTIADFNDLMSGELEHLGFKNWKNTTETFLSPGIDGLKLAFKYPKQLYLLQQLASRITVWLTDLWPLMSLSDKKEYKALYGKAIINLRNPMPDESAKVILKAAQKGTFSLINNVKTITKNDEGFSIEKEKQNHISVDRVINATGYQLNTKNWTKANPLLKSLINQEFCQIDDQGGITILTENAQVLSPKYGPMPGLYAHGALVNGVVYQNNSTIKIQQMAERAFSDNK

SEQ ID NO: 3815 - DNA, 669 bp, Streptococcus agalactiae
atgctcgaattaaaaaatattgcttatcgttataaggggaacgacaataaaacattagaaaatatcaattatagttttcagtcaggggtattttatactatattagggaattctggttcagggaaaacaacccttctatccttgatggcaggtcttgattcgcctactgagggacaagtattatttaacaaaaaagatattaaagaagcaggttatgctcagcatcgcaaaaagaatatagctttggtctttcaaaattataaccttttagactatctaaccccattggaaaatgttcagttggtaaaacctactgcagataaacaattattgttggatttaggtttaaaagaagatatgttaacgcgaaatatcttgagattatcaggagggcaacaacaacgtgtagctattgcgagagctttggttgtaggaacaccagctattttacttgatgaacctacggggaatttagattttgacatttcgcgtgatattacgatgcgtcttaaagattttgcgcataaggaaaaacgatgtgttattatggtgacacatagtagagagatcgctcatatggctgatactgctttacaattgataggagataacttaaaagaattatcaaaagaaagtatagcacagtctatattacaacaaaggaattta

SEQ ID NO: 3816 - protein, 223 aa, Streptococcus agalactiae
MLELKNIAYRYKGNDNKTLENINYSFQSGVFYTILGNSGSGKTTLLSLMAGLDSPTEGQVLFNKKDIKEAGYAQHRKKNIALVFQNYNLLDYLTPLENVQLVKPTADKQLLLDLGLKEDMLTRNILRLSGGQQQRVAIARALVVGTPAILLDEPTGNLDFDISRDITMRLKDFAHKEKRCVIMVTHSREIAHMADTALQLIGDNLKELSKESIAQSILQQRNL

SEQ ID NO: 3817 - DNA, 318 bp, Streptococcus agalactiae
atgattgctattccagcctttgctttatcagtacttatcagtcaatttattggtcaaaaattagcagactccttagtgtatcaggcctctagaactgtcagagcagactttatgaaagggtttgggaatatgcagcttggggctgatagtgatacagatatgtttatgcaaacgattaagacgttaaatgtacaagtgaagcctgaggaagtctggttagtaattctagttggtttagcaatcgtcttatttgctattattactactagtttaattattgctcgctacaaaccaaggggaatcttatcaaaactgtcc

SEQ ID NO: 3818 - protein, 106 aa, Streptococcus agalactiae
MIAIPAFALSVLISQFIGQKLADSLVYQASRTVRADFMKGFGNMQLGADSDTDMFMQTIKTLNVQVKPEEVWLVILVGLAIVLFAIITTSLIIARYKPRGILSKLS

SEQ ID NO: 3819 - DNA, 264 bp, Streptococcus agalactiae
atgttttcaaaagaccccgttagaaacagtaaggataaaacattagttgaagcaactattgttggcatatataaaggtaaaacggtacaaaaatcaaattacccttatgagatgctagaaaatacagccttttcagatacgcaattgattaaggatttatacggctattctaaaggtaaggccttttatcgccaaacaactgtatatcctaaaaagaatgctgatatagaaactcttaaaagttttatcaaaaaacaatcctat

SEQ ID NO: 3820 - protein, 88 aa, Streptococcus agalactiae
MFSKDPVRNSKDKTLVEATIVGIYKGKTVQKSNYPYEMLENTAFSDTQLIKDLYGYSKGKAFYRQTTVYPKKNADIETLKSFIKKQSY

SEQ ID NO: 3821 - DNA, 441 bp, Streptococcus agalactiae
atgaatttatttaaacgttcctttttatatgttagccgtaaaaagcgtaagagtatcactttattcgtatgtttatggctagttgcttctacattaattagcggtattgcggtaaaaaatgctggtcttactgctaagaagacattttcaaggcaaactggatcaattttgcatatttcatcggatagtactgaccttgttggtgatggttacggatctggagaaatccctgaaaaagcaatagttaacatagcaagtaatccaaatgttaagcgcgttaataataatttgatggcttatgctggactaacctcggaaaaaatggttacacgaccaaatgataaagaacaatataaagaacaagttttacaagttcatggtaatagttactccgatacagatcctaaatacacagcggggatgatttctcttaagggaggg

SEQ ID NO: 3822 - protein, 147 aa, Streptococcus agalactiae
MNLFKRSFLYVSRKKRKSITLFVCLWLVASTLISGIAVKNAGLTAKKTFSRQTGSILHISSDSTDLVGDGYGSGEIPEKAIVNIASNPNVKRVNNNLMAYAGLTSEKMVTRPNDKEQYKEQVLQVHGNSYSDTDPKYTAGMISLKGG

SEQ ID NO: 3823 - DNA, 1317 bp, Streptococcus agalactiae
ttgatagataacgtagaagtcgatagagaatatctaacgacttctatcgttattctagagattattaagatagaaaaaggagggaaaatagtgaacctatggacattaagtttagcttatttgaaacgtcaaaaaatgaaaacagtaaccttgttcttagtttttctaactataggcacatgtttaatcagtctgatgagtattcagcattctttggaaaaaaatatcctaacaaaacaagggaaaagcatttatttaacctccaaagaaaaggcttattggcctgaacaagcatacgaagctttgaaaaaagcaaaaatggttgagtcagtagaggcaagtttaagcattgatgttggtagccgtttaaaatctgtatcaccatataactcttctaaagaagagaatcaagttacattagcaggttatcaaagtacagaagatttacgagcttttcagacaaaagcattggtcttaaagaaaggaagccatttagcggccgataatacaaaacaagtactagttccattgaagttagcacaaaagaatcatttaagtgtgggtaacaaattgagattaggcaaagaaaatgttactattgcaggaatttatgatgcgaatagtgctaagtctaaaaatacttttaatcccaatattgataatacattgattgctcaggcaacattggttaggaagattagtaaacaaaaaggttatcagacggttgcagtgcgcttaagtgataaacgtttagtggatacagttatccaaaacatcaaacaatggccgcttgatttcgggaaattagatgttcaaacagctaaagagttttatggagattcttatcgtaatatcgagacattgcatcgtctagtgggacgaatcattcttattgttagtctcgtggcgatggcaatattagttgtcatgctaacattttggattaataaccgcattaaagagacgggaattttactcgctatcggaaaaactaagtttgaaatcataggtcattatctgatagaagtactgttagtagcaggtgctgccttcacactatctattattggtggtgtctttcttggaaaaacatttgcagctggccttttatcacaagttaatggtggtgtgagttcacaaattgtacaaaatagtagtctaattattgatagaattgataacctcgctgtttctgttggagtaatggatgtctttagactctatgctcagggtgctttaatttgcttatttgcagttgtattatctagttattctattcttaaactacaaccaaagcaaatattgtcacgaatgtca

SEQ ID NO: 3824 - protein, 439 aa, Streptococcus agalactiae
MIDNVEVDREYLTTSIVILEIIKIEKGGKIVNLWTLSLAYLKRQKMKTVTLFLVFLTIGTCLISLMSIQHSLEKNILTKQGKSIYLTSKEKAYWPEQAYEALKKAKMVESVEASLSIDVGSRLKSVSPYNSSKEENQVTLAGYQSTEDLRAFQTKALVLKKGSHLAADNTKQVLVPLKLAQKNHLSVGNKLRLGKENVTIAGIYDANSAKSKNTFNPNIDNTLIAQATLVRKISKQKGYQTVAVRLSDKRLVDTVIQNIKQWPLDFGKLDVQTAKEFYGDSYRNIETLHRLVGRIILIVSLVAMAILVVMLTFWINNRIKETGILLAIGKTKFEIIGHYLIEVLLVAGAAFTLSIIGGVFLGKTFAAGLLSQVNGGVSSQIVQNSSLIIDRIDNLAVSVGVMDVFRLYAQGALICLFAVVLSSYSILKLQPKQILSRMS

SEQ ID NO: 3825 - DNA, 1059 bp, Streptococcus agalactiae
atgaataaaataacgacattatcaaccatcgccctgactttaatgctttgcgttggatgttctgccaataaagataatcaaaaaactaaaactgaggatcctaagcaagaaaacgtaactgcaaatccgaaggaagacaaggcaacagcagccaagcgaatgaagttaacgaaagaacttgaaaaatataataaaggcacagagagctttattagtaacaaacaatatcaaaaatatatcaaaacacctatcaaagaatatggtcaaaaggttgaagtcaaaggcaagaagatgaatgtctatactgttggagaaggtaaagtaccaattgtctttattcctggtcaagggacggtgactgccaaacatcagtaccataatttgattagtaatttaagtaaaactcataaggttgtggtagttgagccatttggttcaggtttaagtgatgtcattgaccaaccacgaaatctagctaatattacctcagatatccacgaagctttacaaaaagttggtattaccggaaaatatgtaattgcctctcattcaattggtggtgtttatgcccttaaatacatcagtacttatccaaaggaagtgctaggattaataggtttagatacatcaacgccgggtatggaaggtggtaagcaagttgatttcgctgctccagtgttaaaagaattacctaaaattcctaaagtatccgacgatattaatgcacaattttttgctattggacataagatacttaataattctaatatgaaagaagaagcgaagaattcttctaatatgattaacgaaagtgccaactataagattccaaagggaattcctgctatgtatttattagcacgtgaaagtgacttagggcttcaattacgtagtttagatataccaattaaaggcagttggcaagagcaacataaggagttatcagaagatccaaaagaagtctctattcatacactagacggaactcaccaaatttatgatactaaccttaaagaagtaattgattatactaaccaatttatgaaaacatttgagaaa

SEQ ID NO: 3826 - protein, 353 aa, Streptococcus agalactiae
MNKITTLSTIALTLMLCVGCSANKDNQKTKTEDPKQENVTANPKEDKATAAKRMKLTKELEKYNKGTESFISNKQYQKYIKTPIKEYGQKVEVKGKKMNVYTVGEGKVPIVFIPGQGTVTAKHQYHNLISNLSKTHKVVVVEPFGSGLSDVIDQPRNLANITSDIHEALQKVGITGKYVIASHSIGGVYALKYISTYPKEVLGLIGLDTSTPGMEGGKQVDFAAPVLKELPKIPKVSDDINAQFFAIGHKILNNSNMKEEAKNSSNMINESANYKIPKGIPAMYLLARESDLGLQLRSLDIPIKGSWQEQHKELSEDPKEVSIHTLDGTHQIYDTNLKEVIDYTNQFMKTFEK

SEQ ID NO: 3827 - DNA, 1044 bp, Streptococcus agalactiae
atgaaatacctaagtcaaggagaaaaaatgaataaaataacgaaattatcaaccgttgccctcgctttgatgctttgcgttggatgttctgccaataaagataatcaaaaaactaaaactgagcagcctaagcaagaaaagtcaatcgctaagcaaaaacaagagagagaagcagaaaaagctatgattgctaaaggtgctattgacctaactaaatataaagcgaaaccaattgaagattacggacaaaaaattgatgtcggtgacggtaaaaaaatgaacatatatacaatgggtcaagggaaaattccgctagtagtcttccctggtcaagctgaaatttcaccacgttatgcttacaaaaacttgcttgatagattagggaaaaaatataaaatttatacggttgaaccgctcggttatgggcttagtgatatgacagataagccacgtacgattgaaaatattaccaaagagattcatacagctcttgaaaaagtcggtgtcaaaaatttctatcttatggctcactcgttaggtggcatatacggtctaaattatgctaagacatattctaacgatgtcaaaggtttcattggcatggatacaagcacaccaaatatggaaggtgatggcacaactggagaatcttcagcttcaaccttaaaatgggcagaatccattccagaagttgataagaaaaccaatgaacaatacttatcaatcggtgctaaaaaatcaggtaataaaacagagcgcgataaagataggcgtgttagtgacaatcttcataaaatggaaaaagttaagttccctaaaggtatgccagctaagtatttcttagctaatgagtcagcagaagatataaaaatgcgtaaaaaaatattccctaagcttaaaagctgggaacaacaacatattgacttatctgaagatccaaaagacgtttctgttgagacactagatgctagccacttgatttatcatacgcaatataaacatatggcgaaggctattgacgagtggattcaatcgcatgaaaaa

SEQ ID NO: 3828 - protein, 348 aa, Streptococcus agalactiae
MKYLSQGEKMNKITKLSTVALALMLCVGCSANKDNQKTKTEQPKQEKSIAKQKQEREAEKAMIAKGAIDLTKYKAKPIEDYGQKIDVGDGKKMNIYTMGQGKIPLVVFPGQAEISPRYAYKNLLDRLGKKYKIYTVEPLGYGLSDMTDKPRTIENITKEIHTALEKVGVKNFYLMAHSLGGIYGLNYAKTYSNDVKGFIGMDTSTPNMEGDGTTGESSASTLKWAESIPEVDKKTNEQYLSIGAKKSGNKTERDKDRRVSDNLHKMEKVKFPKGMPAKYFLANESAEDIKMRKKIFPKLKSWEQQHIDLSEDPKDVSVETLDASHLIYHTQYKHMAKAIDEWIQSHEK

SEQ ID NO: 3829 - DNA, 1029 bp, Streptococcus agalactiae
atgaagaatataacaaagctatcaactgttgctttaagcctactactttgtacggcgtgtgctgcatcaaacacgtctacatctaaaacacagtctcatcatcctaaacaaactaaactcacagataagcaaaaagaagaacccaaaaacaaagaagctgctgatcaagagatgcatccccaaggcgctgttgatttgacaaaatataaggcaaaaccggtcaaagattatggtaaaaaaatcgatgttggtgatggcaagaaaatgaacatttatgaaactggtcagggaaaaattccaattgtttttattcctggtcaagctgagatttcgccacgctatgcttataagaatttaattgagcggttaagtaaaaaatataaaatttatacagtagaaccattaggctatggtctcagtgatattcctactaaaccacgtacgctagaaaacattacaaaagaaattcacacaggcctaaataaaattggagttaaaaatttctaccttgcagctcactcacttggcggtatgtattctttaaattatgctaaaaattatccagaagaagtcagaggatttattggtatggataccagtacaccttggatggaaggggaacaaaaaacaaagtatgaccctgaaagtgctaaatgggcaatgaaattaccagatgttgatgataagactaacgaacagtatctgtcaattgcgaaaaaaattaacggcaataagtctcaacgagatgaagatgagcgcttaggtgataatcttggtaaattgaagaatgtaaaattccctaaagggatgccaactaagtattttcttgctgatcaatctgtggagggaatcaagctacgtcaagcagattttaaaggtttgaaaaattgggatcagcagcatattgatttatctgaagatccaaaagatgcttccgttgaaatttttaaaggtagtcacaatattttccaaacacaatatgaacatatggctaaagctattgatggatttatccaatcccatcaaaag

SEQ ID NO: 3830 - protein, 343 aa, Streptococcus agalactiae
MKNITKLSTVALSLLLCTACAASNTSTSKTQSHHPKQTKLTDKQKEEPKNKEAADQEMHPQGAVDLTKYKAKPVKDYGKKIDVGDGKKMNIYETGQGKIPIVFIPGQAEISPRYAYKNLIERLSKKYKIYTVEPLGYGLSDIPTKPRTLENITKEIHTGLNKIGVKNFYLAAHSLGGMYSLNYAKNYPEEVRGFIGMDTSTPWMEGEQKTKYDPESAKWAMKLPDVDDKTNEQYLSIAKKINGNKSQRDEDERLGDNLGKLKNVKFPKGMPTKYFLADQSVEGIKLRQADFKGLKNWDQQHIDLSEDPKDASVEIFKGSHNIFQTQYEHMAKAIDGFIQSHQK

SEQ ID NO: 3831 - DNA, 108 bp, Streptococcus agalactiae
ttgagagctaacatcccagtacgtaatttccaagaattttatgatgcctttggtgttaaaaaaggcgattcaatgtatctaaaaccagaaaaacgtttgacactttgg

SEQ ID NO: 3832 - protein, 36 aa, Streptococcus agalactiae
MRANIPVRNFQEFYDAFGVKKGDSMYLKPEKRLTLW

SEQ ID NO: 3833 - DNA, 816 bp, Streptococcus agalactiae
ttgggtgattattatggtaagaaatattttggtgaggcagctaaaaaagacgtcgaacatatggctaagaaaatcattaatgtctataaaacacggttaaaaaacaacacttggttatcagaaaatacaaaagcaatggccattaagaaacttgataacatgagattaatgattggctatccagaagattatcctgatctttatcgtcagtaccaatttgatagtaaagcaagcttctttgaaaacaatgataactacagaaaattatcgaacaagaaaacatttgaagaatttaaccagtctaatcaacgtgaacattggcaaatgagtgccaatgctgtaaatgcttataatgatcctaataccaattccatagtctttccagcagcgatttttcaatcaccactctacgataaaactaaaacagttagtcaaaattatggagctatcggagcaattattggtcatgaaatttcacactcatttgatattaatggtatgaaatatgacgagaaagggaatcttcacgattggtggactaaagaagatttaaaacattataagaaaaaaacacaagctatgattgaccaatgggatggccttaaagcagatggcggtaaagttgatggtaaattaactttagcagaaaatattgcagataatggtggtgttatggcatctctagaagctcttaagactgaaaaaatccaaactataaagaattttttgaatcatgggcaagtatttggcgtcaaaaagcaaccaaagaacaaagtaagtcctcaattcagtcagatgttcatgcaccatatgaat

SEQ ID NO: 3834 - protein, 272 aa, Streptococcus agalactiae
MGDYYGKKYFGEAAKKDVEHMAKKIINVYKTRLKNNTWLSENTKAMAIKKLDNMRLMIGYPEDYPDLYRQYQFDSKASFFENNDNYRKLSNKKTFEEFNQSNQREHWQMSANAVNAYNDPNTNSIVFPAAIFQSPLYDKTKTVSQNYGAIGAIIGHEISHSFDINGMKYDEKGNLHDWWTKEDLKHYKKKTQAMIDQWDGLKADGGKVDGKLTLAENIADNGGVMASLEALKTEKIQTIKNFLNHGQVFGVKKQPKNKVSPQFSQMFMHHMN

SEQ ID NO: 3835 - DNA, 1092 bp, Streptococcus agalactiae
gtgtcatttatgcaaagaaaatcctatttaaaatccatgagtgttcttactttaacagcttgtcttatatcaggatatgtggttaaagatattgctatgttacatgcagtatctgccagtgagaagaaagcaaataatgtcagtccgagagaaaatctctacagggctgtcaatgataattggctagccaatacaaaactcaaacaagggcagactagtgttaatagtttttcagaaattgaggataaattaaagcaactgttagtgtctgatatggctaaaatggcctcaggaaagattgaaacaaccaatgatgaacagaaaaaaatggttgcatactataaacaaggtatggactttaaaacaagagataaaaatggtctcaaacctctaaaaccagttttacaaaaacttgaagcagtctcttcaatgaaagactttcaaagtttggcccatgattttgtgatgagtggttttgttttaccatttggtttgactgtggaaaccaatgctcgagataatagccaaaagcaattggtgcttcgtcaagcacccgcattacttgaatcacctgaccaatataagaagggcaataaagaaggtgaggctaaattatcagcttaccgtacttcagcaatggctttgcttaaacaagctggaaaaagtaacattgaagatagaaaactagttaaacaagctatagcatttgatagactcttatcagaaaaaacgcaagttgatcaaagtaaaatcacagctgaaagtgagacagctgcggggcgatataaccctgaaagtatggaaacggttcacaattacgccaaggaatttgactttaaagaattgattgaaaaactagttgggccaacgaataaggcagtcaatgtagaagataaaacttattttaaacaggttaatgatgttataaatagtaaacaattagccaatatgaaagcatggatgatgatttctatgctagttgatcaatcagattttctaggagaacaaaatcgtcaagcagcgagtgcttttaagaatgttgcgtctggtttgactcagattgaatcgaaagaaaaaatgcttacacccaat

SEQ ID NO: 3836 - protein, 364 aa, Streptococcus agalactiae
MSFMQRKSYLKSMSVLTLTACLISGYVVKDIAMLHAVSASEKKANNVSPRENLYRAVNDNWLANTKLKQGQTSVNSFSEIEDKLKQLLVSDMAKMASGKIETTNDEQKKMVAYYKQGMDFKTRDKNGLKPLKPVLQKLEAVSSMKDFQSLAHDFVMSGFVLPFGLTVETNARDNSQKQLVLRQAPALLESPDQYKKGNKEGEAKLSAYRTSAMALLKQAGKSNIEDRKLVKQAIAFDRLLSEKTQVDQSKITAESETAAGRYNPESMETVHNYAKEFDFKELIEKLVGPTNKAVNVEDKTYFKQVNDVINSKQLANMKAWMMISMLVDQSDFLGEQNRQAASAFKNVASGLTQIESKEKMLTPN

SEQ ID NO: 3837 - DNA, 3243 bp, Streptococcus agalactiae
ttgaataataaaggtgtcggtggcgatggtgtccaaatttatcaatactatatcaaaatggacaacaataaaccttacttaagtcccaaagataagactactgtagagaagttagaagatcgctggaaaaaaattactttcaaagttcaggatactggcattggtttgaaagacgtttatcttcaatctgttaagtatgttggtggtggcaataataatttagaccttatcacacctccaggatttaaaaaagaagataaaaaagttgaaaaaccaaaattagaccgtccaccaggaattgatttaccagcaccaacttcaatgagaagttttgattattcaaccccaccgggaactaagccaagcaaacccaaagatagtttatcaactcctccaggtttcccagatttaaacacgccgccggatgaagcaccaaaggatagtaaaaaagacgctattgaagataaatcaggagcaattaaatatgctaagtctcttcaacttagctttgttgatggccctattttagctagcaaagtaaatggcaaaatattacaagtcgaatctgatggcaaattagtcattcctagaaatgctttgtcagctaatcaatttgatgacactagtcttaaaatttatcgtaataataatcgcaataaagaaattactatcacaacagattattttgcagatacaaaatatgtcaatatcacagcggttgactatttgagcaatactacttttgagcaattagctactggtgaaacagtagattaccatgccattgtattttcaagctttgctgctattaaagacaagggtggtaagatttatgttaacgataaattgcaagaaacttctcgtatagcgcttaaagataaatctgttaagattggtattgaattaccaaatgatgtcagacatattgatagtttatctgttcgtcgtttgaatgaggttaaaactgttgataatatcttgaaaaatgatgaacaagacattaatctcagcaaaacttaccaattaaaatacaacccgacaaatcgtcgtctagagtttactattaataacattaactcaagttcagaaatcatgaccactttcaaagatggaaagatgccagaattggttgaacaaaaagatgtttctttggatataaacgatatggacatgagtaagtttaaaactattcgacttggacgaaaggattctgaatttaagggacaacttattgcaaaaactggaacagttgaattagatatgtttttcaaacaatctcaagacccagcttcaattattaaaaaaatataccttatccaaaatggtgttccaaatgaattgaaaaaatttgactctagttttggtttaactgaaagtcagatagatggatactatatttataaagatgcaattaaccttaaatttaaattaaccagtggtgcaagtcttaaagttgtttataaagggcaagaagatccatatagtcatcagaaagaagatatgactaaaaaaggtgaacagctcagtcattcaactcaagccaatgaaaatacagcaaaagtaacctttgctaatattgactggtcacattatagtaaggttactgtgaatggaaaagaagttgttaaaggtagtgagttacctttaactaaaggatggacaacatttgtattacataaaacagaaaattcattaaatgttaaaagtttgattatggagacgggtagtgtaagtaagaaagttcaacaacttcctttaagtcctagattatctaaaaataagcatatgagggatatgctacttactatgcaaaaagattcagcgtattacgaaacaagtgacagtctagtccttcgaattaatctcactgcagatactaaacttaattttaatgctgttaaaggagcgagtgctcttactgaaaatatgatgatgagacagtttgcagttgctggaccacaagatgatcctgttagtgaacataaatacccatcagtatttctcttaactcctgccttattggaaactgctagtgaggcaactctaaatggtaaggaaatcacagcatctggtattatcggtcacatcaaggatggtgataaaagcaagcatgttgaagtcaaaatggtgaatgaaaatggagacatgctaggaacccctgttattattcaaggtaaagacttgactaatcgaacaaaaccattaatgagtggacgtagagtactttatgccggtaaacaatatgagttccgggctaaattaccacttagtcgttttaacacttggattagggttgaagtggtaacagaagcaggagagaaagcaagtattgttcgtcgcatgttctttgaccaatcagttccagagcttaacacagcagttgctaaacgtgatttgacttctgatactgctcttatccacatcgttgccaaagatgactctctaaaactaaaattatatcaagatgattcattacttgaatctgttgataaaaccggtctttatagttttagaaatggtgtagaaatcactaaagatatgacagtaccactagaatttggagataatattattaagttatctgctgttgacttatcaaattatcgtcgtaatgagacccttcatatctatagaaaccgttttgatgttaaagcaagccaaatgacagctgacaaaggagctaaagtaactgtggatatgttgatgaagcacttagttgttccagaaatggcaggagcttatacattaacaatcgacgaagctccaaacacaaatgaatcaggaatgttaacaaacgctaaagtatcgattcattatgtaaatggtggtgttgataaagttgatgttccgattaaagtagttgacttagaagctattcgtaaagctgaagaagcacgtaaagctgaagaagcacgtaaagctgaagaagcacgtaaagctgaagagggacataaaacccaagaagcacctatagttgaagaaggctacaaggttaataacgttcatcaaactgatactacagttaaagcgtctgatttaccaaagactaagacagtttccgcagttcatatggctagaacagacaataaacagataacttcacatcagacacatgttgaaaaacaaattaaaaatacattgccatccactggtgacagcaaacgtggttattatatcactggaatggctatcgttatgctgagtgtattatttagtttagctaaaaagtttaaaagcaaatat

SEQ ID NO: 3838 - protein, 1081 aa, Streptococcus agalactiae
MNNKGVGGDGVQIYQYYIKMDNNKPYLSPKDKTTVEKLEDRWKKITFKVQDTGIGLKDVYLQSVKYVGGGNNNLDLITPPGFKKEDKKVEKPKLDRPPGIDLPAPTSMRSFDYSTPPGTKPSKPKDSLSTPPGFPDLNTPPDEAPKDSKKDAIEDKSGAIKYAKSLQLSFVDGPILASKVNGKILQVESDGKLVIPRNALSANQFDDTSLKIYRNNNRNKEITITTDYFADTKYVNITAVDYLSNTTFEQLATGETVDYHAIVFSSFAAIKDKGGKIYVNDKLQETSRIALKDKSVKIGIELPNDVRHIDSLSVRRLNEVKTVDNILKNDEQDINLSKTYQLKYNPTNRRLEFTINNINSSSEIMTTFKDGKMPELVEQKDVSLDINDMDMSKFKTIRLGRKDSEFKGQLIAKTGTVELDMFFKQSQDPASIIKKIYLIQNGVPNELKKFDSSFGLTESQIDGYYIYKDAINLKFKLTSGASLKVVYKGQEDPYSHQKEDMTKKGEQLSHSTQANENTAKVTFANIDWSHYSKVTVNGKEVVKGSELPLTKGWTTFVLHKTENSLNVKSLIMETGSVSKKVQQLPLSPRLSKNKHMRDMLLTMQKDSAYYETSDSLVLRINLTADTKLNFNAVKGASALTENMMMRQFAVAGPQDDPVSEHKYPSVFLLTPALLETASEATLNGKEITASGIIGHIKDGDKSKHVEVKMVNENGDMLGTPVIIQGKDLTNRTKPLMSGRRVLYAGKQYEFRAKLPLSRFNTWIRVEVVTEAGEKASIVRRMFFDQSVPELNTAVAKRDLTSDTALIHIVAKDDSLKLKLYQDDSLLESVDKTGLYSFRNGVEITKDMTVPLEFGDNIIKLSAVDLSNYRRNETLHIYRNRFDVKASQMTADKGAKVTVDMLMKHLVVPEMAGAYTLTIDEAPNTNESGMLTNAKVSIHYVNGGVDKVDVPIKVVDLEAIRKAEEARKAEEARKAEEARKAEEGHKTQEAPIVEEGYKVNNVHQTDTTVKASDLPKTKTVSAVHMARTDNKQITSHQTHVEKQIKNTLPSTGDSKRGYYITGMAIVMLSVLFSLAKKFKSKY

SEQ ID NO: 3839 - DNA, 2655 bp, Streptococcus agalactiae
gtgactaaaccacagggggcggttgctgagaaagctactccggctgtgccaaagcctcaaaaagtaagagtaattgttgaatttaataaggaatctatcttagattatgcgacagaacagaaaaaaacagttgcacagttaaatcaagctgatgttgagaaaaaattacaaagcatcaagcaagagcaagataaagttcttaagaatattgaaaaaagtgttcactttgattcaagcaaagtgaagcgttacgatgctattattaatggtgtcgcacttgatattcaagctcaagaaattgaaaaattaaaaacgattgctgatgttagaagggtctatgtctcacaagaatatgttcagacaaaacctttactatcttcctcagggcaacttattggtttgccagaagtttggaacaactcccagtataaaggtgagggaactgttgttgcagttattgattcaggggttgatttcaaacaccaagcactaaaaatcaaagaaccaaatcgtgctaagtataataaaactagtattgaaaaactgattcatgaaaagaatctcaaaggaaaattctattccgaaaaagtaccttatggttataactattatgactataatgataacctcaaggatagctacggtgtaatgcatggtatgcatgtaacaggtatcgtaggagctaatgatgataatcaaaaattgtatggtgttgcaccaaatgctcaaattttagcgatgaaggtattttcagatgaccaacaaaatcccacaaccttcacagatgtgtggctaaaagctctagacgatgctattttactaaaagctgatgttgttaatatgagtcttggaacacctgctggatttgtacatgaggggaaagactatcctgaacttgaagttattgcaagagcgtgtaaggcaggaatcgtcattgcagtagcagcaggtaatgaaggaaatatcactgacggtaatacttatggtgttaagccgctagcagaaaattatgatacagccttgattgccaacccagccctcgatgataataccttggctgttgcctctatggagaaccttaaaaagcatgctcatgttttgaaatttaaagataaaaaatctggaacagaagttacagaagtcattaatcttcatgttgccccaaacgcttcaaaaactattattggattggctgtagatttgggagcaggagctccttcggaattgtcaaaacattttgatttaagtggtaaaatcgccatgcttgaaattccagaagataataaatctaatggatttttagaaaaagtacaggcgattactaagttaaatccagctgctatcttgctttacaataatgcgaaggttaaagatgatttaggcagtcaattattagttgaatcagaagcagctaaatttaatattgctcgcattaccagaagcacgtataacaatatcaaaaataatagcaataaaattattactattttaacagagcgtcaagctattgataatagtttagcaggacaattatcttcttattcttcttggggacctacaccagacttacgtctaaaacctgagattacagctccaggtggtcatattttctcaactgtggaggataatcaatatgctgataaatcaggaacatcaatggctgcacctcaggtagctggggcagctgcagttttaaaacaatacattacagataaaaaaattcctgttgataatgctgctgattttattaaattactcttgatgaacactgcacagccaattatcaataaacaatcaaaagatggcaaaacaccttactttgtgcgccaacaaggtagcggagcaatgaatcttgccaaagctcttgttacgacagtcgttgcaactgtaacagggactaacgataataatgcagatggtaagttggagttacgtgaattaaaagagaaaaaatttaaagcacgcattctacttcgtaactttggaaaaactaataaaacgtatatcatctcatcagaagcgattgcggacccagttgatgaaaaaggatttcgtacgcaaaattcagaacacctagtatcaaaaaaagctgatgcagttacaaggaaagttactgtagaagcaggtaagacattagctgttgaccttgatgtggattattctgatgcagaggctttaactcgcaataatttcttggaaggttatcttaacttaaaagatactgaaggtgtagccgatttacacttaccatttttaggtttttacggttcatggacagagcaaaaagctattgatgcttttgaaggcatttctgaaattggtaacggtgacaaaaaacgtcgcgttcaattctatgttaataaagaaaccaacaagacctcatcaacctttacaactaacggcatgttgagtcttccaatctataacaatacagtatttttctctcctaatagtcctttctatgacaaagcaggagttcgtattgcagctttgcgtaatatggagtatgttcaatattctattatagatccagataccaataaagaagttcgtgtacttggtagatcacacgacgttagaaaactttatcgcctagattatcgtaatagttttgccatgatgccagattctatttgggatggtaagattaaagat

SEQ ID NO: 3840 - protein, 885 aa, Streptococcus agalactiae
MTKPQGAVAEKATPAVPKPQKVRVIVEFNKESILDYATEQKKTVAQLNQADVEKKLQSIKQEQDKVLKNIEKSVHFDSSKVKRYDAIINGVALDIQAQEIEKLKTIADVRRVYVSQEYVQTKPLLSSSGQLIGLPEVWNNSQYKGEGTVVAVIDSGVDFKHQALKIKEPNRAKYNKTSIEKLIHEKNLKGKFYSEKVPYGYNYYDYNDNLKDSYGVMHGMHVTGIVGANDDNQKLYGVAPNAQILAMKVFSDDQQNPTTFTDVWLKALDDAILLKADVVNMSLGTPAGFVHEGKDYPELEVIARACKAGIVIAVAAGNEGNITDGNTYGVKPLAENYDTALIANPALDDNTLAVASMENLKKHAHVLKFKDKKSGTEVTEVINLHVAPNASKTIIGLAVDLGAGAPSELSKHFDLSGKIAMLEIPEDNKSNGFLEKVQAITKLNPAAILLYNNAKVKDDLGSQLLVESEAAKFNIARITRSTYNNIKNNSNKIITILTERQAIDNSLAGQLSSYSSWGPTPDLRLKPEITAPGGHIFSTVEDNQYADKSGTSMAAPQVAGAAAVLKQYITDKKIPVDNAADFIKLLLMNTAQPIINKQSKDGKTPYFVRQQGSGAMNLAKALVTTVVATVTGTNDNNADGKLELRELKEKKFKARILLRNFGKTNKTYIISSEAIADPVDEKGFRTQNSEHLVSKKADAVTRKVTVEAGKTLAVDLDVDYSDAEALTRNNFLEGYLNLKDTEGVADLHLPFLGFYGSWTEQKAIDAFEGISEIGNGDKKRRVQFYVNKETNKTSSTFTTNGMLSLPIYNNTVFFSPNSPFYDKAGVRIAALRNMEYVQYSIIDPDTNKEVRVLGRSHDVRKLYRLDYRNSFAMMPDSIWDGKIKD

SEQ ID NO: 3841 - DNA, 513 bp, Streptococcus agalactiae
atgacattttataaaaagacggacaaatttggatttaggaaaagtaaagtgtgccgcagcctatgcggtgctttattgggtacagtagcagttgttagtctagctacagcaagtacagagattcacgctgatgaagcaacaacctcacctaccactgtaacgaaagtacctcagccagttcaagcagacacaacagctctaaatacctctaagactcacagtacacaagcaactacaactcctgttgaagctaaggagaataaggttgtcaaaagtgaaactgttcaatctgagagccgagtaatgcctagagataaggtagtagaaaggccagaaacagtaaaagctagtgttaactcagacgttagccaacctattacaaccacacccccaacaattaatgaaaaaacagttgagattcctaacttagctcaagatactaagaaggtagctccaaaagtaactgttacaccagaagttgttaatcagccaaagcagttgcctaaatacgag

SEQ ID NO: 3842 - protein, 171 aa, Streptococcus agalactiae
MTFYKKTDKFGFRKSKVCRSLCGALLGTVAVVSLATASTEIHADEATTSPTTVTKVPQPVQADTTALNTSKTHSTQATTTPVEAKENKVVKSETVQSESRVMPRDKVVERPETVKASVNSDVSQPITTTPPTINEKTVEIPNLAQDTKKVAPKVTVTPEVVNQPKQLPKYE

SEQ ID NO: 3843 - DNA, 573 bp, Streptococcus agalactiae
ttgaatcctttatcagaaaaagacaaagttaactatattatgatttataaaaataggcagtctacattggagaataatttatctggcgatcggttgatgagatatcaacaagcaaatagacaggtaagcaaagataaactgttaacagggagttattttgtgtaccaatgcttaaaaaagttaggttttaccaataagatttgtcaggaatctttttctagtgttagtagttatttaattggtttgccaaaggggaaaattagttactctaattctggtgactatcatattctaacctatgctcccagtggttcaactggggttgatattgagaaatacaaagatagatcagaacaaacctaccaaaactacctaggagaatcagttagtagtgatatggattctaaattattattttataaggcatggttacaaaaagaaatttcctataaatgtgggaaatctatagatattacctatcaaacaatgatagatggctatatttatggttatgcttttgataatacttttaaagtagaagcggtttacttaaaagaattattaccagataac

SEQ ID NO: 3844 - protein, 191 aa, Streptococcus agalactiae
MNPLSEKDKVNYIMIYKNRQSTLENNLSGDRLMRYQQANRQVSKDKLLTGSYFVYQCLKKLGFTNKICQESFSSVSSYLIGLPKGKISYSNSGDYHILTYAPSGSTGVDIEKYKDRSEQTYQNYLGESVSSDMDSKLLFYKAWLQKEISYKCGKSIDITYQTMIDGYIYGYAFDNTFKVEAVYLKELLPDN

SEQ ID NO: 3845 - DNA, 1248 bp, Streptococcus agalactiae
gtggtatctcttttgctattattgaaaaaaggtgataaaatgagtaaatttttatttgctcctttcatgatgaatttaggagagagccaaagattatcaaaactggctaattgtttatatgaacaaggacatgatattcatatccttggagacaattattatccatttttatttaataatgatgcttatcgctatcaccactgtgtagaagataaatctgtttataatagtaagcgatatgatgctttcttttctctttcaacagactttaattttttatcagaagaagaaattgaacgcatctgttctattgaaagagacttgttacgccaagaaaaatttgatgctgtattgacaggttaccgtctatctattgttacaagttgtcgtttagaaagcataccattaatttggattatttcaggggcaacgcatatcagtgaaattgttgaaaactcagaaggaatattgcctaatgggaagataagtaaagctagtaagcctcaaacaaaggattttatcaaaagagtaatcactacttattcaacaaatgttaaaacgtggaataactatattaaaaaatatggtggcaaaacttttaataatgctttagaattatttactggtgatctaaacttggtaacagattactctttgttttatgaatttgataaagattcgtcctataaaacgataggacctattttgatagataatgtaggtttttcaaaatgcagccaaattaatcaagacaataagactgtactgctcagctttggtacttcatttaaacgagattgggtggaatcttttttaaagacattaccaaggcattatcattatttactgacaagctgtggtgaggctataaacattccaggaagttatattgagatagttgattttattgattttaaaaccatagataaagagatttatttcgctattatacacggtgggcaaggaacagtttatgcgatggctgcacaaggtattccctttataggtatccctttctttaacgaacaattttggaatattaagaagttcagtaaagaaaagtgcgcttatttggtaaagaaacctgatgtaagagagatacgtaaagcaattagctgtcttgaaagagactatgatatctataaaagttatatgataagactaagccaaggaattaaagaagaagcagaggcatctttacaaaaagcggaggcagaaattgaatcctttatcagaaaaagacaaagt

SEQ ID NO: 3846 - protein, 416 aa, Streptococcus agalactiae
MVSLLLLLKKGDKMSKFLFAPFMMNLGESQRLSKLANCLYEQGHDIHILGDNYYPFLFNNDAYRYHHCVEDKSVYNSKRYDAFFSLSTDFNFLSEEEIERICSIERDLLRQEKFDAVLTGYRLSIVTSCRLESIPLIWIISGATHISEIVENSEGILPNGKISKASKPQTKDFIKRVITTYSTNVKTWNNYIKKYGGKTFNNALELFTGDLNLVTDYSLFYEFDKDSSYKTIGPILIDNVGFSKCSQINQDNKTVLLSFGTSFKRDWVESFLKTLPRHYHYLLTSCGEAINIPGSYIEIVDFIDFKTIDKEIYFAIIHGGQGTVYAMAAQGIPFIGIPFFNEQFWNIKKFSKEKCAYLVKKPDVREIRKAISCLERDYDIYKSYMIRLSQGIKEEAEASLQKAEAEIESFIRKRQS

SEQ ID NO: 3847 - DNA, 156 bp, Streptococcus agalactiae
atggaagcaacagatgataagatagccattttaagattttctctagcaggtaatgtttctagaggtgaatctaaagatgacaataagacaccactattatttccaccaaaagcaaacgaaaaatttaaagcatttcttattgggtattctctcttt

SEQ ID NO: 3848 - protein, 52 aa, Streptococcus agalactiae
MEATDDKIAILRFSLAGNVSRGESKDDNKTPLLFPPKANEKFKAFLIGYSLF

SEQ ID NO: 3849 - DNA, 2220 bp, Streptococcus agalactiae
ttgtatcccagaaagttggaacaaagaatgagcgtatatgttagtggaataggaattatttcttctttgggaaagaattatagcgagcataaacagcatctcttcgacttaaaagaaggaatttctaaacatttatataaaaatcacgactctattttagaatcttatacaggaagcataactagtgacccagaggttcctgagcaatacaaagatgagacacgtaattttaaatttgcttttaccgcttttgaagaggctcttgcttcttcaggtgttaatttaaaagcttatcataatattgctgtgtgtttagggacctcacttgggggaaagagtgctggtcaaaatgccttgtatcaatttgaagaaggagagcgtcaagtagatgctagtttattagaaaaagcatctgtttaccatattgctgatgaattgatggcttatcatgatattgtgggagcttcgtatgttatttcaaccgcctgttctgcaagtaataatgccgtaatattaggaacacaattacttcaagatggcgattgtgatttagctatttgtggtggctgtgatgagttaagtgatatttctttagcaggcttcacatcactaggagctattaatacagaaatggcatgtcagccctattcttctggaaaaggaatcaatttgggtgagggcgctggttttgttgttcttgtcaaagatcagtccttagctaaatatggaaaaattatcggtggtcttattacttcagatggttatcatataacagcacctaagccaacaggtgaaggggcggcacagattgcaaagcagctagtgactcaagcaggtattgactacagtgagattgactatattaacggtcacggtacaggtactcaagctaatgataaaatggaaaaaaatatgtatggtaagtttttcccgacaacgacattgatcagcagtaccaaggggcaaacgggtcatactctaggggctgcaggtattatcgaattgattaattgtttagcggcaatagaggaacagactgtaccagcaactaaaaatgagattgggatagaaggttttccagaaaattttgtctatcatcaaaagagagaatacccaataagaaatgctttaaatttttcgtttgcttttggtggaaataatagtggtgtcttattgtcatctttagattcacctctagaaacattacctgctagagaaaatcttaaaatggctatcttatcatctgttgcttccatttctaagaatgaatcactttctataacctatgaaaaagttgctagtaatttcaacgactttgaagcattacgctttaaaggggctagaccacccaaaactgtcaacccagcacaatttaggaaaatggatgatttttccaaaatggttgccgtaacaacagctcaagcactaatagaaagcaatattaatctaaaaaaacaagatacttcaaaagtaggaattgtatttacaacactttctggaccagttgaggttgttgaaggtattgaaaagcaaatcacaacagaaggatatgcacatgtttctgcttcacgattcccgtttacagtaatgaatgcagcagctggtatgctttctatcatttttaaaataacaggtcctttatctgtcatttcgacaaatagtggagcgcttgatggtatacaatatgccaaggaaatgatgcgtaacgataatctagactatgtgattcttgtttctgctaatcagtggacagacatgagttttatgtggtggcaacaattaaactatgatagtcaaatgtttgtcggttctgattattgttcagcacaagtcctctctcgtcaagcattggataattctcctataatattaggtagtaaacaattaaaatatagccataaaacattcacagatgtgatgactatttttgatgctgcgcttcaaaatttattatcagacttaggactaaccataaaagatatcaaaggtttcgtttggaatgagcggaagaaggcagttagttcagattatgatttcttagcgaacttgtctgagtattataatatgccaaaccttgcttctggtcagtttggattttcatctaatggtgctggtgaagaactggactatactgttaatgaaagtatagaaaagggctattatttagtcctatcttattcgatcttcggtggtatctcttttgctattattgaaaaaagg

SEQ ID NO: 3850 - protein, 740 aa, Streptococcus agalactiae
MYPRKLEQRMSVYVSGIGIISSLGKNYSEHKQHLFDLKEGISKHLYKNHDSILESYTGSITSDPEVPEQYKDETRNFKFAFTAFEEALASSGVNLKAYHNIAVCLGTSLGGKSAGQNALYQFEEGERQVDASLLEKASVYHIADELMAYHDIVGASYVISTACSASNNAVILGTQLLQDGDCDLAICGGCDELSDISLAGFTSLGAINTEMACQPYSSGKGINLGEGAGFVVLVKDQSLAKYGKIIGGLITSDGYHITAPKPTGEGAAQIAKQLVTQAGIDYSEIDYINGHGTGTQANDKMEKNMYGKFFPTTTLISSTKGQTGHTLGAAGIIELINCLAAIEEQTVPATKNEIGIEGFPENFVYHQKREYPIRNALNFSFAFGGNNSGVLLSSLDSPLETLPARENLKMAILSSVASISKNESLSITYEKVASNFNDFEALRFKGARPPKTVNPAQFRKMDDFSKMVAVTTAQALIESNINLKKQDTSKVGIVFTTLSGPVEVVEGIEKQITTEGYAHVSASRFPFTVMNAAAGMLSIIFKITGPLSVISTNSGALDGIQYAKEMMRNDNLDYVILVSANQWTDMSFMWWQQLNYDSQMFVGSDYCSAQVLSRQALDNSPIILGSKQLKYSHKTFTDVMTIFDAALQNLLSDLGLTIKDIKGFVWNERKKAVSSDYDFLANLSEYYNMPNLASGQFGFSSNGAGEELDYTVNESIEKGYYLVLSYSIFGGISFAIIEKR

SEQ ID NO: 3851 - DNA, 1230 bp, Streptococcus pyogenes
atgacatttaaaagagtagtggtaacaggttatggtctaacatctccaatcgggcatgatcctgaaacgttttggaacaatctgaaagctggccaaattggtattggtcctattactaaatttgacacgactgattatgcagtcaagaatgctgctgaaattcaggattttccatttgacaaatactttgtgaaaaaagatttgaaccgtttcgatagatattctctttatgctctttacgcagcgaaagaggctattaatcatgctgatttaaatattgagatggttgattccgatcgatttggcgttattgttgcttcaggtattggtggaattgcggagattgaagagcaagtgattcgcttacatgaaaaagggccaaaacgtgtgaagccaatgacgttgccaaaagcgctaccaaatatggctgcaggaaatgtcgccatgtctttaaaagctcaaggagtatgtaaatcaattaatactgcctgcgcttcttcaaatgatgcgattggggatgcctttcgtgccattaaatttgggactcaagatgtgatgatagttggtgggtcagaggcggccataaccaagtttgccattgctggcttccaaagtttaacagctctctcaacaactgaagatccaagcagaagctctattccatttgataaagaccgcaatggttttatcatgggagaaggatcaggaatgcttgttttagaaagcctagaacatgcgcaagaacgcggggcgacaatcttagcagaaattgtgggttatggaaatacctgcgatgcctaccatatgacatctccaaatcctgagggattaggagctcgtaaagccatccacttagccttacaagaagctggtattgaagccagtgctattaattatgtcaatgcgcacggaacttcaaccccagctaatgaaaaaggagagagtcaagcaattgtagccgttcttggtaaggatgttccggtgtcttcaacaaaatcgtttacgggtcaccttcttggagcagcaggcgctattgaagctattgccactatcgaggctatgcgtcataactatgttccgatgacggctgggacacaagctttatcagaggatatcgaagcaaatgtcatctttggagaaggaaaagaaacagctatcaactatgccatttcaaatacttttggatttggtggtcataatgctgtattagctttcaaatgttgggaggag

SEQ ID NO: 3852 - protein, 410 aa, Streptococcus pyogenes
MTFKRVVVTGYGLTSPIGHDPETFWNNLKAGQIGIGPITKFDTTDYAVKNAAEIQDFPFDKYFVKKDLNRFDRYSLYALYAAKEAINHADLNIEMVDSDRFGVIVASGIGGIAEIEEQVIRLHEKGPKRVKPMTLPKALPNMAAGNVAMSLKAQGVCKSINTACASSNDAIGDAFRAIKFGTQDVMIVGGSEAAITKFAIAGFQSLTALSTTEDPSRSSIPFDKDRNGFIMGEGSGMLVLESLEHAQERGATILAEIVGYGNTCDAYHMTSPNPEGLGARKAIHLALQEAGIEASAINYVNAHGTSTPANEKGESQAIVAVLGKDVPVSSTKSFTGHLLGAAGAIEAIATIEAMRHNYVPMTAGTQALSEDIEANVIFGEGKETAINYAISNTFGFGGHNAVLAFKCWEE

SEQ ID NO: 3853 - DNA, 951 bp, Streptococcus agalactiae
atgaatactatttataatacattgagaacagataaaggttataaagtttatgaggggtatttatatgaaattactggtgaagaatgtgaagaagccttagaccttgtgattcctaagaatattgtatttgcagatacagatacttgtggctacacttttttactcaatgaagatggaacagtttatgatgatgtgactttctacaaatttgatgataaatattggttggctagtcataaagctttggattcttatttagacaacatcaattttgactataccgtaacagatatttctgacgagtataaaatgctgcaaattgaaggaagatattcgggagaaattgctcagtcattttatgaatatgatatttcaacacttaattttcgtactttgatagagatgacttataaaggtgagaaaggttatcttgctagatttggtttttctggagaatttggctatcaatttttcctaccatcttctatttttgctacttttgtttcggatgtctgtgaaggtatagcagagtatggggatgaacttgatagatatttaaggtttgaagtgggacaacccattactgatatttatcaacaagaagaatattctttatatgaaataggttattcttggaatctagatttcacaaaggaagaatttagaggtcgcgatagcttgttagagcacatcagatcagcaacagttaaaagtgttggattctcaacgaaggaaaaactcgcttcaggaacaccagtgctatttgatgaccaaattgttggaaagattttttggatagcagacgagaaagactcttcggaaaattacctaggtttgatgattgttaaccaaacatatgctcattcaggagttacttttgtaacagaagatggccaaattttgaaaacacaatcaagcccttattgtatcccagaaagttggaacaaagaa

SEQ ID NO: 3854 - protein, 317 aa, Streptococcus agalactiae
MNTIYNTLRTDKGYKVYEGYLYEITGEECEEALDLVIPKNIVFADTDTCGYTFLLNEDGTVYDDVTFYKFDDKYWLASHKALDSYLDNINFDYTVTDISDEYKMLQIEGRYSGEIAQSFYEYDISTLNFRTLIEMTYKGEKGYLARFGFSGEFGYQFFLPSSIFATFVSDVCEGIAEYGDELDRYLRFEVGQPITDIYQQEEYSLYEIGYSWNLDFTKEEFRGRDSLLEHIRSATVKSVGFSTKEKLASGTPVLFDDQIVGKIFWIADEKDSSENYLGLMIVNQTYAHSGVTFVTEDGQILKTQSSPYCIPESWNKE

SEQ ID NO: 3855 - DNA, 2001 bp, Streptococcus agalactiae
atgaaagatgataataaattaaagatttctgaagcttccttagaagattattctgaagtggttcatttatttaataggaatcatgtttatcaatttccagacggtaggcctttaactgttgatgaccttgatttaacgttaaaagttaaagaagtgacacatttatttttactgaaaaatcatggtgttttgattggaacatcagctttctttaaatttattacctatggttgtttagattggaatagtagctttagtggttttcttttaattgattcgaaaagtcgtagtggacaggcaatcacttatctatataaaactatcttaaagaagataacaaaactgaagttttctaatatctataccgaaatcagtaactacaataaaccctccttagctttatcaaaattgaatggcttcaaagagtatgataagacatatgaagacatactgcattgtcgatcattgcgtagtcacctccctaagatattgaatacgtttcgtatttcgaattattatggtaaaacatacgacatatcaacttttcaaattatggaggaaattgaaaatcccttggaagaggagacagaaattaggaccaaagtctctgatgaagaaatattatttaaagcagaagatagtgcttcacttccttattatttaaaaatgagcttgtttcaaatggaaattgctaagttagataaccgttatgttttacaagttgactttttatcggaacaagtaaagagggttcgggttaaaactggaaaatatcacttggcaaacttaacgagggctcaccctagcctaactttaagtcgttttgccaattattattacattcaagcaactgtggaaaccctttatggtaatatcgatgttcaactggaacgtcgaaaaaagcattatagagatgcaactatttgtcttaagagaacttttcaaggttatgatttacttatctctccaaatggcagccttatttttgaaaagcagaaaagaaagatacttgaagatagttttttgatttttagccaacctttggacaagaaattagttgtaaaagaagaagaaaatcacattacaatcaaatgtttctatcaaggtgctttaattgagaaaatcatgacatttacaagtgacgaagaaatcacttgtgtttataaatgtaatcaaaaggctaaagagatgttcccaaaattattgaaacagactttcaagttacactgccaagagcagttgattagagatagtgaaggttatcttgtgaatgttccaggaagttacccgattgagcatgatgattttcttcgagcagataagtttgaagatagacaattccattattacctcccgaatgaagataaaatgatttcctattctcctcctggcaaagccagcaatcaaatgcaatttagacccttatgtcttattgatacagatagcctttcttttccactgacttatcattttaggatttcacaagcatcatcggaggaggcgttaatcaatctaaaaaaacagccaatatgggacagcaactaccaagcgtcagcaactgaccttttaaaacatatctctaacctaacattagaagaagagaaggattatggcatcaagagaatgatagctaacagaaagcattatcctagtcacaaactggttttagcctataatcagattgttttgcctaagaatgaaattccaagagacagtgaattatattctatttcttttgattatcgaattagaggaaagtttgtccaaatccgccaaggggaacatgtcaaatatgataataaatcctatgttttggaaaatagtcaacaattagtattgtatgtagctagcgatgataaatatatactaatttctgctaaaaatggaatattttattcttacaaagagaacaatcatttaaaaataaggtgcatgtttaaaaggaactcaccttatgctacaaatgtgagcattacagaatatagaaagtgtgaagaaaaa

SEQ ID NO: 3856 - protein, 667 aa, Streptococcus agalactiae
MKDDNKLKISEASLEDYSEVVHLFNRNHVYQFPDGRPLTVDDLDLTLKVKEVTHLFLLKNHGVLIGTSAFFKFITYGCLDWNSSFSGFLLIDSKSRSGQAITYLYKTILKKITKLKFSNIYTEISNYNKPSLALSKLNGFKEYDKTYEDILHCRSLRSHLPKILNTFRISNYYGKTYDISTFQIMEEIENPLEEETEIRTKVSDEEILFKAEDSASLPYYLKMSLFQMEIAKLDNRYVLQVDFLSEQVKRVRVKTGKYHLANLTRAHPSLTLSRFANYYYIQATVETLYGNIDVQLERRKKHYRDATICLKRTFQGYDLLISPNGSLIFEKQKRKILEDSFLIFSQPLDKKLVVKEEENHITIKCFYQGALIEKIMTFTSDEEITCVYKCNQKAKEMFPKLLKQTFKLHCQEQLIRDSEGYLVNVPGSYPIEHDDFLRADKFEDRQFHYYLPNEDKMISYSPPGKASNQMQFRPLCLIDTDSLSFPLTYHFRISQASSEEALINLKKQPIWDSNYQASATDLLKHISNLTLEEEKDYGIKRMIANRKHYPSHKLVLAYNQIVLPKNEIPRDSELYSISFDYRIRGKFVQIRQGEHVKYDNKSYVLENSQQLVLYVASDDKYILISAKNGIFYSYKENNHLKIRCMFKRNSPYATNVSITEYRKCEEK

SEQ ID NO: 3857 - DNA, 876 bp, Streptococcus agalactiae
atgtttgaactaatttctagaaatcgtaaagtttacacgcgagatcggttagcgtttttcatgtcttttttatcagttattatcttaattttggtctatcagattttcttgggaaaaattcaattagatgctataaaagcagcattgaggagtaatacagtatccagtgatactattcacatggttaattattggctcattgcaggtttgacgactattatttcaatgactagtacattaggtgcctttggagttatggtgtccgacaaagaaaaaaaattaaatgaagattttaaggtcagtcctatatcaaatatcaaaattgaattgtcctatgctatatttgccgttttatttggtattgtcatgacgatgttctcttgcatctttgctatcggtatttttaacggctttaattccttgctagagtattcagctatggattatttaactattttagggatcgtttccttagggactgttttatctgcggcgatgattttacctattttagcctttattcatactagttcagcttttacgactcttagcacaattgtagggacttttattggttttatttcaggagtatatctctcaattggctcggtaggaaaagcattacaacaggttatgacatggtttccattgactcaaatcaattctcttttgaaacaggtcttaatgaagggttctattgcgaaggtatttgacaaagccaacgaagccactgtctctaactataaagaatcatatggtgttgttttgcgtaatgctgatggagaaaggctgagtaatcactttatgttgatttatatcattgccctcattcttattttattggcaattcattttattattaaaaaggttaaaaaa

SEQ ID NO: 3858 - protein, 292 aa, Streptococcus agalactiae
MFELISRNRKVYTRDRLAFFMSFLSVIILILVYQIFLGKIQLDAIKAALRSNTVSSDTIHMVNYWLIAGLTTIISMTSTLGAFGVMVSDKEKKLNEDFKVSPISNIKIELSYAIFAVLFGIVMTMFSCIFAIGIFNGFNSLLEYSAMDYLTILGIVSLGTVLSAAMILPILAFIHTSSAFTTLSTIVGTFIGFISGVYLSIGSVGKALQQVMTWFPLTQINSLLKQVLMKGSIAKVFDKANEATVSNYKESYGVVLRNADGERLSNHFMLIYIIALILILLAIHFIIKKVKK

SEQ ID NO: 3859 - DNA, 975 bp, Streptococcus agalactiae
atgagaataaaaaagaggttgcctcaggaaggatgttggtatcagaaaatggaaattaaactcaaaaatattggaaaaaaatatggttcttttgaagcattgagagacattaatctcatctttgaagagggaaaattttatggccttcttggacctaatggagctggtaaaacaactttatttaaccttttaattcaaaattttaagcaaacgtcaggcgatattaagtgggaggtggatggaaaacctctatctattaaagatttttatcgtcacattggtattgtcttccaaagtaatcgcttagatgataatttaacggttgaggaaaatctaatttctagaggtgctttgtacggtttatctaaatcacaagtacgtaatcgccttaaagatcttcaaacgtatctagatatcacagcaataaaaaaacaaaaatatggcagtttatcaggaggtcaaaaacgaaaagttgatattgcacgcgccttgctgccacaaccttctctattattattagatgaaccaacgactggtttagaccctcaatctcgtcgcgatttatgggatgctatcgcacaactaaatcaacaatcgcagatgacagttgtactaattactcattatcttgaagaaatgtctgcttgtgatgttttaaatgttcttattgaaggaaacatttattattcgggagatattaaaagctttattgagcaacattccacaacaaacttgaatgtggtattgaaaccagaaaagtcattagaccaactttcgatagctgattttgttaataaatgtcaagtcctttcagaaagggagatagtatttaaggatatttctgttgaggaaatgatgcaggttatctcagacaatcaagataaatctattattgagacatttaatgttgaatattcgaacttagaggcggcgtatctcaacttgcttagagaaaaagaaaggaaaaacaatgtt

SEQ ID NO: 3860 - protein, 325 aa, Streptococcus agalactiae
MRIKKRLPQEGCWYQKMEIKLKNIGKKYGSFEALRDINLIFEEGKFYGLLGPNGAGKTTLFNLLIQNFKQTSGDIKWEVDGKPLSIKDFYRHIGIVFQSNRLDDNLTVEENLISRGALYGLSKSQVRNRLKDLQTYLDITAIKKQKYGSLSGGQKRKVDIARALLPQPSLLLLDEPTTGLDPQSRRDLWDAIAQLNQQSQMTVVLITHYLEEMSACDVLNVLIEGNIYYSGDIKSFIEQHSTTNLNVVLKPEKSLDQLSIADFVNKCQVLSEREIVFKDISVEEMMQVISDNQDKSIIETFNVEYSNLEAAYLNLLREKERKNNV

SEQ ID NO: 3861 - DNA, 303 bp, Streptococcus agalactiae
atgattaactgggctgaagaacgtaaaataataaaaacacgtcaagaagtagttgatgaaattaaaggtattttgattgactctttaatgttggatattgataaagatctgattatgaatgatcaaccattatttggtcgtggattagagctagactctattgatgccctagaactgtcaatagggatttcaacaacgtttggtgttgaactaaatgatgatgatatttcaatattatcatcagtaaatagactagcagattttgtgattgaaaatagtgaggatatagatgaccaagctaag

SEQ ID NO: 3862 - protein, 101 aa, Streptococcus agalactiae
MINWAEERKIIKTRQEVVDEIKGILIDSLMLDIDKDLIMNDQPLFGRGLELDSIDALELSIGISTTFGVELNDDDISILSSVNRLADFVIENSEDIDDQAK

SEQ ID NO: 3863 - DNA, 720 bp, Streptococcus agalactiae
atgaaagtagcaatagttactggtggtaccagaggaattggaagggctattacaaaagagttatacaaagaaggttacaaagtcattgctatttataatagcaatgatgctaaggcaagagctttacaagaggagttaccaaaattagacgtttataaatgcaatatttcagatgcaaaagcagtacaaaaattggtgactaaaatttttagagaatatggcggtattgattgtttagttaataatgctggtattgttagagatggctttttcttgatgatgtctaaggaaaaatggatggatgtcattaacataaatattatggggctagttaacatgagtaaagccgtgttaaaaatcatgaaggctaagcgtatacagggaaaggttatcaatatttcttcaactagtggtatagcagggcagatagggcaagcgaactattcagcaacgaaaggcgctatcatttccattactaaaactctagcgaaagaatttgcatcagatggtattacgattaattgtgtaagtccaggattcattgaaacagatatgacaaatgaattgcaaaataaagaagagctaaaagagcatcttattcctctaaaaaggtttggacaacctgaagaggtggcttggctcgtaagctttttagcaagtgagaaggcaaactatattacaggaaaaaatattgtgattgatggaggaatgattaatgat

SEQ ID NO: 3864 - protein, 240 aa, Streptococcus agalactiae
MKVAIVTGGTRGIGRAITKELYKEGYKVIAIYNSNDAKARALQEELPKLDVYKCNISDAKAVQKLVTKIFREYGGIDCLVNNAGIVRDGFFLMMSKEKWMDVININIMGLVNMSKAVLKIMKAKRIQGKVINISSTSGIAGQIGQANYSATKGAIISITKTLAKEFASDGITINCVSPGFIETDMTNELQNKEELKEHLIPLKRFGQPEEVAWLVSFLASEKANYITGKNIVIDGGMIND

SEQ ID NO: 3865 - DNA, 732 bp, Streptococcus pyogenes
atggaaattaaaggaaaaaatatatttatcacaggctcaacgagaggtatcggtttagcaatggctcatcaattcgccagtttagaagctaatattgtcttaaatggtcgctctgctatctctgaggagcttgttgctagttttactgactacggcgttacagttgttaccatctctggggatgtttcagaagcatcagaagctaaacgtatggtcaatgaagctatcgaaagtttaggttcgattgatgttttagttaacaatgctggcattactaatgataaattgatgcttaaaatgacggaagaggattttgagcgcgtcttgaaaatcaatttgaccggtgcttttaacatgactcaatcagtgttaaaaccaatgatcaaggcccgccaaggagcaattattaatgtctctagtgtggttggtttaacaggcaatattgggcaagcaaactatgctgcttctaaggcaggaatgattggttttaccaagtctgttgcccgtgaagttgctgctcgtaacatttgcgtgaatgctattgctccaggatttatcgagtccgacatgacaggtgtccttcctgaaaaaatgcaagagcaaatcttaagtcaaatcccaatgaaacgtattggaaaagctcaagaagttgctcacttagcaagcttcttggtggaacaagattatattacgggacaagttatcgctattgatggcggtatgacaatgcaa

SEQ ID NO: 3866 - protein, 244 aa, Streptococcus pyogenes
MEIKGKNIFITGSTRGIGLAMAHQFASLEANIVLNGRSAISEELVASFTDYGVTVVTISGDVSEASEAKRMVNEAIESLGSIDVLVNNAGITNDKLMLKMTEEDFERVLKINLTGAFNMTQSVLKPMIKARQGAIINVSSVVGLTGNIGQANYAASKAGMIGFTKSVAREVAARNICVNAIAPGFIESDMTGVLPEKMQEQILSQIPMKRIGKAQEVAHLASFLVEQDYITGQVIAIDGGMTMQ

SEQ ID NO: 3867 - DNA, 846 bp, Streptococcus agalactiae
atgaaaacagtaataatatatggaggacagggtaatgttcagtcaaaacacctttgtcaactagttaaaactccaaaaggtgaaattcttttttcaaagttacaagcaactgatttagaatcatatcagttaatgatggatgtcattaaccacaaggtaagtttagacaatgttcatgcgtctatgttagcaaattttttatataatgattggctaacaaacgatgaaaaaatagtatctgggataggattttcagctcatagcgccggtattttcaatgtgttatatgctagtggtagtactagttttgaaaacattattcactttattaaacgtcgtgcccaacttatagaaaattgtcatgtgtctgaagagctttggcttttgatggttgaaaacattgatatgtttagtaaggatgttttaaaagaacagtctgagaaagtaaaattagctattattactgatgatagagctggtgtaattgctatggatcaagtcaaccgttctttctttgatgacgtgatgactaacaaaggttatttttataaattaaagcagttaggcgtaaaagcaccatatcatactgattttttaaatgaatctaaagagcagtataaacaattgattgaaagcctagatatttcgcaaaatgatgactatgactatatttttcattgtgatcaattggtagatgaaattttatatcagtggaccaatctctttaactggcgtgcgattaaggaaactatcatagaaaaggatgcggagattattgatatttctcctaataggtttatttctagtcagttgcaaaaaatgaaaaagagggggaggaaacagtta

SEQ ID NO: 3868 - protein, 282 aa, Streptococcus agalactiae
MKTVIIYGGQGNVQSKHLCQLVKTPKGEILFSKLQATDLESYQLMMDVINHKVSLDNVHASMLANFLYNDWLTNDEKIVSGIGFSAHSAGIFNVLYASGSTSFENIIHFIKRRAQLIENCHVSEELWLLMVENIDMFSKDVLKEQSEKVKLAIITDDRAGVIAMDQVNRSFFDDVMTNKGYFYKLKQLGVKAPYHTDFLNESKEQYKQLIESLDISQNDDYDYIFHCDQLVDEILYQWTNLFNWRAIKETIIEKDAEIIDISPNRFISSQLQKMKKRGRKQL

SEQ ID NO: 3869 - DNA, 120 bp, Streptococcus agalactiae
atggcttgccttactaatcaagaacccgcactctcatatacttctactcctttatgccaaagtattagtgataccataaaagaaatcaaggaaatcaagataaccccaccaatattaaaa

SEQ ID NO: 3870 - protein, 40 aa, Streptococcus agalactiae
MACLTNQEPALSYTSTPLCQSISDTIKEIKEIKITPPILK

SEQ ID NO: 3871 - DNA, 783 bp, Streptococcus agalactiae
atgacaaaatatcagcgaatgcactttatttttattaaacaatacatgaagcaaatcatggagtataaaatagacttttttgtaggcgttttaggagtatttttaacacaagggttaaatcttttatttctgaatgttctttttcaacatatcccttctttagaaggatggacttttcagcaaatagcttttatttatggtttttctctcctcccaaaaggaattgatcaccttttctttgataacttgtgggctcttggtcaaaggcttattcgaaaaggagaatttgataagtatttaaccaggccgatcagtcctttatttcatgtcctagttgaaacctttcaagtagatgcattgggggagttattggttggttttattctgttatctaccacagtatctagtataagctggaccgtgccaaaagtattattatttatatttattatcccctttgcaactttgatttatacctccttgaagattgctacgtcaagtatcgctttttggaccaaacaatctggtgctgttatctatattttttatatgtttaatgactttgctaagtatcctgtcgcaatatataataatctattgcgttggatcattagttttgtcattccatttgcttttacagcttattatcccgctgcttacttcttacaagatagaaatgtctattttaatattggtggggttatcttgatttccttgatttcttttatggtatcactaatactttggcataaaggagtagaagtatatgagagtgcgggttct

SEQ ID NO: 3872 - protein, 261 aa, Streptococcus agalactiae
MTKYQRMHFIFIKQYMKQIMEYKIDFFVGVLGVFLTQGLNLLFLNVLFQHIPSLEGWTFQQIAFIYGFSLLPKGIDHLFFDNLWALGQRLIRKGEFDKYLTRPISPLFHVLVETFQVDALGELLVGFILLSTTVSSISWTVPKVLLFIFIIPFATLIYTSLKIATSSIAFWTKQSGAVIYIFYMFNDFAKYPVAIYNNLLRWIISFVIPFAFTAYYPAAYFLQDRNVYFNIGGVILISLISFMVSLILWHKGVEVYESAGS

SEQ ID NO: 3873 - DNA, 783 bp, Streptococcus pyogenes
atggcaaaattgagatgtatgcacgctatttttatcaaacaatacctcaaacaaattatggaatacaaggttgattttgtggtgggagtgctaggtgtttttctcactcagggacttaatctgctctttttatcggtacttttccaacatatcccttctttagaaggctggacgtttgaacaaattgcctttatttatggcttttgtttgattccaaagggaattgatcacctcttttttgacaatctttgggctttagggcaacggcttgtccgcaaaggagaatttgacaagtacctcaccagaccaattagtcctttgtttcatgttttagttgagacctttcaagtggatgccctgggtgaattattggttggggttatcttattagtgaccacggctggtagtatcgtatggactcttcctaaggtgcttttgtttattttggttattccttttgcgaccttgatttacacctctttaaaaattgcgaccgccagcatttctttttggaccaagcagtctggggcagttatctatattttttacatgttcaatgacttttctaagtaccctatgtccatttaccattcctttttgcggtggttaatcagttttatcattccctttgcttttacagcttattaccctgcttcttattttttaacaggtcaacacctgctctttaatattggaggcttggtagtggtgtcgttactggttttggccttgtcgcttaagctttggaaatggggcctggatgcttatgaaagtgcaggttcc

SEQ ID NO: 3874 - protein, 261 aa, Streptococcus pyogenes
MAKLRCMHAIFIKQYLKQIMEYKVDFVVGVLGVFLTQGLNLLFLSVLFQHIPSLEGWTFEQIAFIYGFCLIPKGIDHLFFDNLWALGQRLVRKGEFDKYLTRPISPLFHVLVETFQVDALGELLVGVILLVTTAGSIVWTLPKVLLFILVIPFATLIYTSLKIATASISFWTKQSGAVIYIFYMFNDFSKYPMSIYHSFLRWLISFIIPFAFTAYYPASYFLTGQHLLFNIGGLVVVSLLVLALSLKLWKWGLDAYESAGS

SEQ ID NO: 3875 - DNA, 816 bp, Streptococcus agalactiae
atgaacagaatttggagacgttataaaccttttattagtacaggaatccaaggattaatcacatatcgtgttgatttcatcctttataggataggtgatgtgataggagcatttgttgcattttatctatggaaagcagttttcgattcctcaagtcaatccttaatccaaggttttcagctgtcagatatgattctctatattattatgagttttgtgactaatttattaacaagaactgatagttcatttatgataggtgacgaagtaaaagacggttcaattattatgcgactcttacgtccagttcactttgctgcttcctaccttttcatggagattggttctagatggctcatctttttaagtataggggtaccgtttttgcttgttattacgggggtacgcctcttcttggggactgatttgattcaagctatagtgttagtggtattttatattattagcattattttagcttttttgattaacttcttttttaatatttgttttggcttctcggcatttgtttttaaaaatttatgggggtcaaacctgttaaaaaattcgttagtcgcatttatgtcggggagcttgattcctcttactttttttccgaaaatcgttgctgatattttaggatttttaccattttcatctttaatttacacaccagtaatgattattattggtaaatatgatggcagtcaaattgtgcaagccttacttttacaaatattttggctaatagtaatggtagctttatctcaattaatatggaaaaaagtacagttgcatatcactatccaaggaggt

SEQ ID NO: 3876 - protein, 272 aa, Streptococcus agalactiae
MNRIWRRYKPFISTGIQGLITYRVDFILYRIGDVIGAFVAFYLWKAVFDSSSQSLIQGFQLSDMILYIIMSFVTNLLTRTDSSFMIGDEVKDGSIIMRLLRPVHFAASYLFMEIGSRWLIFLSIGVPFLLVITGVRLFLGTDLIQAIVLVVFYIISIILAFLINFFFNICFGFSAFVFKNLWGSNLLKNSLVAFMSGSLIPLTFFPKIVADILGFLPFSSLIYTPVMIIIGKYDGSQIVQALLLQIFWLIVMVALSQLIWKKVQLHITIQGG

SEQ ID NO: 3877 - DNA, 858 bp, Streptococcus pyogenes
ttgaggatattgttcgtcgtttctaccgaaaggagctttaagatgtggtcattttggaaacgttatagaccctttctcagtgcaggaattcaggaattaataacctatcgcgttaatttctttttgtatcgtattggagatgtcatgggggcttttgtggcttattacctctggaaggctgtttttgattcgtctaagcaatccttaatcaatggttttactctgtctgacatgaccttttacattatcatgagttttgtgaccactttactgaccaaatcagacagctcctttatgattggcgaagaagtgaaagatggttctatcatcatgcgcctgcttcgaccagttcattttgcagcctcttacctctttatggaaattggttttcgctggattgtgctaatgagtgtcggctttccttttttaatggtcttatctggtattaaagtcatggcggggctgtctatcttgcaagtcctagccagcagttgtctgtatttagttagccttttattagcttttttaatcaatttttatttcaacatttgttttggctcttcagcatttgtctttaaaaacctttgggggtctaatttattgaaaaatgccttggttgcctttatgtcaggcagtttgattccattggctttttttcctaaaatggtttctatagtgcttagttttctaccgttttcctctttggtttacacgccagttatgattgtcattgggaaatacagccttagtcagataatggtggccctaagtttgcaaatcttttggttactggtgatggtagtcttatcgcaagtcatctggaaaaaggttcagtaccatttaacgattcaaggaggg

SEQ ID NO: 3878 - protein, 286 aa, Streptococcus pyogenes
LRILFVVSTERSFKMWSFWKRYRPFLSAGIQELITYRVNFFLYRIGDVMGAFVAYYLWKAVFDSSKQSLINGFTLSDMTFYIIMSFVTTLLTKSDSSFMIGEEVKDGSIIMRLLRPVHFAASYLFMEIGFRWIVLMSVGFPFLMVLSGIKVMAGLSILQVLASSCLYLVSLLLAFLINFYFNICFGSSAFVFKNLWGSNLLKNALVAFMSGSLIPLAFFPKMVSIVLSFLPFSSLVYTPVMIVIGKYSLSQIMVALSLQIFWLLVMVVLSQVIWKKVQYHLTIQGG

SEQ ID NO: 3879 - DNA, 1011 bp, Streptococcus agalactiae
ttgagtaaaagaggtattaatatgtcaatgattgaagtttctcaccttcagaaaaattttataaaaaccgttaaagcaccagggttaaaaggagcatttcaatcatttcttcgtcctgaaaaacacacctttgaagctgttaaagatttaacatttgatgtgcctaaaggacaaattctgggatttattggagcgaacggtgcaggaaaatctacaacaattaaaatgttaactgggattttaaaaccaacttcgggcttttgccgtattgatggcaaattgccacaagaaaaccgacaaaattatgttaaggatattggagtcgtttttgggcaacgtacgcagttatggtgggatttagctctacaagaaacctatacagtgttaaaagaaatctatgacgttcctgataaagaatttcgcaaacgcatggcttttttaaatgaggttttggaactaaatgactttataaaggatcctgttagaactttgtctctcggacagcgtatgagagcggatatcgcagcttctttattacataacccaaaggttcttttcttagatgaacccaccattggcttggacgtttcagtgaaagataatatccgacgtgcaatcacacaaattaatcaagaagaagagacaacgattttactaacgacacatgacctcagtgatattgaacaactttgtcatcgtatttttatgattgatagaggacaagaaatatttgatggcacagtttctcagctaaaagagacatttggaaagatgaaaactctttcttttgatttgcgcccaggacaagagcatatcagctctagtttaattggaaagtcggagattaatattaaacgtaatgacttagttttagatattcagtatgatagttctcgctaccaaactgctgacataattcagcagacattagcagatttttctgtacgtgaccttaaaatgacagatgcggatattgaagatatcattcgtcgcttctatagaaatgagcta

SEQ ID NO: 3880 - protein, 337 aa, Streptococcus agalactiae
MSKRGINMSMIEVSHLQKNFIKTVKAPGLKGAFQSFLRPEKHTFEAVKDLTFDVPKGQILGFIGANGAGKSTTIKMLTGILKPTSGFCRIDGKLPQENRQNYVKDIGVVFGQRTQLWWDLALQETYTVLKEIYDVPDKEFRKRMAFLNEVLELNDFIKDPVRTLSLGQRMRADIAASLLHNPKVLFLDEPTIGLDVSVKDNIRRAITQINQEEETTILLTTHDLSDIEQLCHRIFMIDRGQEIFDGTVSQLKETFGKMKTLSFDLRPGQEHISSSLIGKSEINIKRNDLVLDIQYDSSRYQTADIIQQTLADFSVRDLKMTDADIEDIIRRFYRNEL

SEQ ID NO: 3881 - DNA, 990 bp, Streptococcus pyogenes
atggtcatgatagaagtgtcccaccttcaaaaaaatttttccaaaaccattaaagagccaggattaaagggagccttgaagtcgtttgttcatcccccaagagaaatctttgaggcggttaaggacttatcttttgaggtacccaaagggcaaattttaggttttattggcgccaatggtgcaggaaaatcaacaacgattaagatgttaacaggtattttaaagcctacatcaggttactgtcgcattaacggaaagattccacaagataatcgtcaatattatgtgagagacattggagctgtttttggtcaacgaacacaactatggtgggatttggccttgcaagagacctatgtcgttttaaaagaaatttacgatgtacctgaaaaagcctttcgcaagcgcatggattttttaaatgaggttttggacctgaatgagtttattaaggatcctgtccggaccttatcactcggtcagcggatgcgagctgatattgctgcctccttgttgcataatcctaaagtattgtttttagatgaaccaacgattggacttgatgtttctgtgaaggacaacattcggcgtgccattactcaaattaatcaagaagaagagacaactattttactgacgacccatgatttgagtgatattgaacagctctgtgatcggattatcatgattgataaagggcaagaaatctttgatggaacggtgacccaattaaagcaaagctttggaaaaatgaagagtctgtcttttgagttgaagccagggcaggagcaggtggtctcacagtttatgggcttacctgacatcacagtggaacggcatgagcttagtttagacattcaatatgacagttcgcgctatcaaactgcggacattattcaaaaaaccatggctgattttgcggtcagggatgtgaagatgactgatgtagatattgaggatattgttcgtcgtttctaccgaaaggagctt

SEQ ID NO: 3882 - protein, 330 aa, Streptococcus pyogenes
MVMIEVSHLQKNFSKTIKEPGLKGALKSFVHPPREIFEAVKDLSFEVPKGQILGFIGANGAGKSTTIKMLTGILKPTSGYCRINGKIPQDNRQYYVRDIGAVFGQRTQLWWDLALQETYVVLKEIYDVPEKAFRKRMDFLNEVLDLNEFIKDPVRTLSLGQRMRADIAASLLHNPKVLFLDEPTIGLDVSVKDNIRRAITQINQEEETTILLTTHDLSDIEQLCDRIIMIDKGQEIFDGTVTQLKQSFGKMKSLSFELKPGQEQVVSQFMGLPDITVERHELSLDIQYDSSRYQTADIIQKTMADFAVRDVKMTDVDIEDIVRRFYRKEL

SEQ ID NO: 3883 - DNA, 1170 bp, Streptococcus agalactiae
atgatattaaggaggttatttatggtacgtaaatttttaaaatcgctcctatctctctttcttatagcagtaatcgccaccggtatttcagtggcatgtttcttttttattccagaaaataaagggaatattacaccgattttattgcatcgctttatgcgaaaaaataatgttaatggaatgatgattgttagcgataatactggtaaaccgattaccatctcgcatgggattaaccgtggggaagttgaaacggatattgaaaataataaattatttccaatggcttctctccaaaaactcatgacaggaattattatccaaagattaattgatcaagatgtcttgagtgaagacgaccgattgtctcagttctttccccaagtaaaaggtagtaatagtattaccatccaccaattgttgacccatacgagtgggttaagagaaaaaggtgttaaggtgtctccttatctaaaaaatgagagagaacaattacaattttgcttaaaacactataactttgttaataagaaatcgtggtattattctaatatcaactttagtttcctaacaggtatagccactcaagttacgggaaggacctacgctgaacttgttgatgatgtgataaaaaatcctttgcgattagatgatacccaaagttaccaatcagttgttaatcatgacttagttagcccaatgcgaaagaacggcaagttaaataaaattaatatctttaatcaagtatccacagcatatggagctggagattttttcacaactccgctgaacttttgggtgttgatgcggtctttttctaaagggtactttttcccaacggatgaatataccaaacatcaaaatgatgcgatatcacattattatggtgggctttacatgcatggtcgtatagttaattctaatgggacctttttccagtattcaagttttggttatgcagatctaaagacgcatgatacaatggtgctttttatgaataacaaagtctatagtgatgctagtcacgtggcaccaaaagcatttgaatattatcaaaaatttatgttccttaataagattttccacttagtcttttactttgtattttctttctttttaatgcttttaatacgtcattcgtttaggaaaagaaggtataagaaacgtctc

SEQ ID NO: 3884 - protein, 390 aa, Streptococcus agalactiae
MILRRLFMVRKFLKSLLSLFLIAVIATGISVACFFFIPENKGNITPILLHRFMRKNNVNGMMIVSDNTGKPITISHGINRGEVETDIENNKLFPMASLQKLMTGIIIQRLIDQDVLSEDDRLSQFFPQVKGSNSITIHQLLTHTSGLREKGVKVSPYLKNEREQLQFCLKHYNFVNKKSWYYSNINFSFLTGIATQVTGRTYAELVDDVIKNPLRLDDTQSYQSVVNHDLVSPMRKNGKLNKINIFNQVSTAYGAGDFFTTPLNFWVLMRSFSKGYFFPTDEYTKHQNDAISHYYGGLYMHGRIVNSNGTFFQYSSFGYADLKTHDTMVLFMNNKVYSDASHVAPKAFEYYQKFMFLNKIFHLVFYFVFSFFLMLLIRHSFRKRRYKKRL

SEQ ID NO: 3885 - DNA, 948 bp, Streptococcus pyogenes
atggtttacgaaatgactttggcggtcattaaatgtattgaaaaccatcttcacaaaaaagtatacaaaggggccagtctggctctctttcaatctggtcgatggcaagaataccatatcggaacaattgatggaagacgaccagttgatgctaacttagtttatgacttggctagtgtttcaaaagttgttggtgtggccacaatatgcaatattttattgaataatggtacgttagcattagatgatcccttaaaggtatattatcctagtattgctgatgcgactgtcactattcgacagttattgactcataccagtggtcttgatccttatattcctaacagagatgttttaaatgcacaacaattaagaaaagcacttaatcatcttactcaaaaagaaaataaaaacttttattacacagatgtcaatttcctcttgttaggcttcatgttagaagagctctttagtgaatctttagaccagatatttgacaagactatctttactccctttgggatgtatcatacgtcttttggccctcgtccagaagctgtaccaacattaaagggtgtgagtgatggagaagttcatgatcccaaagcaaaaatcttaaaaaaacattctggatctgcggggctattttcaactcttgcagatttagaaagttttagcaatcattatcttaatgatccattttcagattgtctgtggcgcaactacagccaacaaacaattgagcggtcactagggtggaatttagatggcgattggattagtcatacaggttacacagggccgtttctaatgcttaataaaaaagagcaaacggcagctatttttttgaccaaccgtacttacgacgaggatgataaaagtaaatggttaaaagaacgtcagttgctttacaatgcactaaagcatgatctgacaacccccgtatcg

SEQ ID NO: 3886 - protein, 316 aa, Streptococcus pyogenes
MVYEMTLAVIKCIENHLHKKVYKGASLALFQSGRWQEYHIGTIDGRRPVDANLVYDLASVSKVVGVATICNILLNNGTLALDDPLKVYYPSIADATVTIRQLLTHTSGLDPYIPNRDVLNAQQLRKALNHLTQKENKNFYYTDVNFLLLGFMLEELFSESLDQIFDKTIFTPFGMYHTSFGPRPEAVPTLKGVSDGEVHDPKAKILKKHSGSAGLFSTLADLESFSNHYLNDPFSDCLWRNYSQQTIERSLGWNLDGDWISHTGYTGPFLMLNKKEQTAAIFLTNRTYDEDDKSKWLKERQLLYNALKHDLTTPVS

SEQ ID NO: 3887 - DNA, 267 bp, Streptococcus agalactiae
atggtgagcttgcttctcttgaaagtaaagcaggaggagttgatagagtttcataatgttttttatagagaagcgatatcttcttatcttgaaacagaaaattttgagaaggctaaagtgactgaagagaattaccaagtttttttaggaatccgtacttatcagaagagttataactatcaagatcatagtgagaatctaaaaggaaatattgaggtagcaatgataggagttgaaaataatattagcgacgaacatattttttgc

SEQ ID NO: 3888 - protein, 89 aa, Streptococcus agalactiae
MVSLLLLKVKQEELIEFHNVFYREAISSYLETENFEKAKVTEENYQVFLGIRTYQKSYNYQDHSENLKGNIEVAMIGVENNISDEHIFC

SEQ ID NO: 3889 - DNA, 117 bp, Streptococcus agalactiae
atgaattctctttttaaaatattcaaagtttctaaagctaaatgtttgtgcttgatgattttgatgagattattggttgctcaagtttggtgtttgaataaggcgattcaaggacat

SEQ ID NO: 3890 - protein, 39 aa, Streptococcus agalactiae
MNSLFKIFKVSKAKCLCLMILMRLLVAQVWCLNKAIQGH

SEQ ID NO: 3891 - DNA, 219 bp, Streptococcus agalactiae
atgcatacataccatatcctatataacggctatcgttttaagaacaatttatttatgttggcagaaaataataataggaagcagaaaaatccaataatattcaagagaaaaagtataggtgatagctctctaaaaaaatttgatattgaaactataagaaaccctgtagatacgatagttgaaacaacctttttcttatccatattaataaccacccct

SEQ ID NO: 3892 - protein, 73 aa, Streptococcus agalactiae
MHTYHILYNGYRFKNNLFMLAENNNRKQKNPIIFKRKSIGDSSLKKFDIETIRNPVDTIVETTFFLSILITTP

SEQ ID NO: 3893 - DNA, 171 bp, Streptococcus agalactiae
ttgcttgatgattcggaaaaatacggagactatactatttcaaggaaaagatacaaaagtttcgaatcaagtcttcaactatacatccttcaaagtcatcggctagagatttggaattatgaaccaatccctttgattactagaaaaataaatagcttggagaggctaacg

SEQ ID NO: 3894 - protein, 57 aa, Streptococcus agalactiae
MLDDSEKYGDYTISRKRYKSFESSLQLYILQSHRLEIWNYEPIPLITRKINSLERLT

SEQ ID NO: 3895 - DNA, 228 bp, Streptococcus agalactiae
atgggcattactctagtttttaataagctatctgatgagcagaaggagaagttaatgcatgttgggaagtcttattttgactatcaagaaaatgctcttatcccacaattaggttttctatattctaaattaactaaaaaaattgaacttgataatcggttgtctccgactgaaaaaaagttattgattaccttattattacatactaaaggtttaatcattgatatg

SEQ ID NO: 3896 - protein, 76 aa, Streptococcus agalactiae
MGITLVFNKLSDEQKEKLMHVGKSYFDYQENALIPQLGFLYSKLTKKIELDNRLSPTEKKLLITLLLHTKGLIIDM

SEQ ID NO: 3897 - DNA, 90 bp, Streptococcus agalactiae
atgggaaatggtcaggattgggttggaacagccgaaagactagatggtgaaactgatacagttccaaaagaaggtactattctctctttt

SEQ ID NO: 3898 - protein, 30 aa, Streptococcus agalactiae
MGNGQDWVGTAERLDGETDTVPKEGTILSF

SEQ ID NO: 3899 - DNA, 156 bp, Streptococcus agalactiae
atggaaaaacaggattcacgagttctcatccattgggaggggaattctggggacaagctcattgaacaccaaaccagcgcaacggggtggtactaccaagtcgatcgtagctttagtcaaccaaaaggggaaccgcccagaatgatccaaaggcac

SEQ ID NO: 3900 - protein, 52 aa, Streptococcus agalactiae
MEKQDSRVLIHWEGNSGDKLIEHQTSATGWYYQVDRSFSQPKGEPPRMIQRH

SEQ ID NO: 3901 - DNA, 126 bp, Streptococcus agalactiae
gtgcgtagcgttgctacaacgaagcaaagggtaaaaatcctttattttaagcactttttcaagcattttgtctttattgaaaagagtgattttaacataaaaaaggtattaaaaaacatattgacg

SEQ ID NO: 3902 - protein, 42 aa, Streptococcus agalactiae
MRSVATTKQRVKILYFKHFFKHFVFIEKSDFNIKKVLKNILT

SEQ ID NO: 3903 - DNA, 636 bp, Streptococcus agalactiae
atgaagccattaggagttattccttatcttttagtggcgcgcgatccatatagtgatagatcgagatatttagatccaaaagttctatcatcctcttttggcgccttttttccagcagataatattaaggtagcttggtctaacaactccagcactttatttacaccacctattaatgcaaactacaccactcagattcaagctattgggacaacgattaagtcacaaattccggaatcgattttgacggttacggataaaaagagcaggaagttcagcattaacaagattgacgaagctaaagaaggcttagtaggtgcgaccttcaccttgtctaaacgcacaacagtagcggcagatcatcaagtacaaggagatttcattcctgtcagcaaagagacgacagtcggtcggacaacccttacctttgacaaccttaaacctggattttatgaccttaaagaaacgaaagcgccgaatgcttacgtacttgatcctaagacttatgttgtggtcgttcaaaattcaggaaaaacgacaattgtggatgaagctaacttcaaagaggctgattacccaatggctgataataccagccatgtggagtgcgtagcgttgctacaacgaagcaaaggg

SEQ ID NO: 3904 - protein, 212 aa, Streptococcus agalactiae
MKPLGVIPYLLVARDPYSDRSRYLDPKVLSSSFGAFFPADNIKVAWSNNSSTLFTPPINANYTTQIQAIGTTIKSQIPESILTVTDKKSRKFSINKIDEAKEGLVGATFTLSKRTTVAADHQVQGDFIPVSKETTVGRTTLTFDNLKPGFYDLKETKAPNAYVLDPKTYVVVVQNSGKTTIVDEANFKEADYPMADNTSHVECVALLQRSKG

SEQ ID NO: 3905 - DNA, 99 bp, Streptococcus agalactiae
ttgtacttcatgaaggtcctaaagaccattttaaaagcagaattgccagttgttacgttatcatctatgaagctaaagaattcagttgttcgcttttct

SEQ ID NO: 3906 - protein, 33 aa, Streptococcus agalactiae
MYFMKVLKTILKAELPVVTLSSMKLKNSVVRFS

SEQ ID NO: 3907 - DNA, 102 bp, Streptococcus agalactiae
ttggatgttcaaagcgatgagaattttgcttttaaaatttttaaagttgcgaaagccaaaggcttgtcgcttgatgtctttgataagcttgttggtcgcttc

SEQ ID NO: 3908 - protein, 34 aa, Streptococcus agalactiae
MDVQSDENFAFKIFKVAKAKGLSLDVFDKLVGRF

SEQ ID NO: 3909 - DNA, 207 bp, Streptococcus pyogenes
atgagtaaacaggaagtaagagactcattgtcaactgtagtgggtgacttatcattaacaacgagagagaatcagattggttctctctttttggatgttcaaagcgatgaggattttggttttaaagttgtcaaagttctgaaatctaaaggcattgtacttaatgcccttgatgagtctgtttgtggcttcaagtttgtcgttgaa

SEQ ID NO: 3910 - protein, 69 aa, Streptococcus pyogenes
MSKQEVRDSLSTVVGDLSLTTRENQIGSLFLDVQSDEDFGFKVVKVLKSKGIVLNALDESVCGFKFVVE

SEQ ID NO: 3911 - DNA, 567 bp, Streptococcus agalactiae
atgttagaagtcagagagcaggttgaccatgtgatgattccaaaaatcaatcaggatttaccaatctacgctggttcagaagaggacaatctgcaacggggagttggtcatctagaagggataagtttgccgattggaggggcttctacacatgcggtcttgagcggtcaaagaggtatgccagctgctcggttgtttgcggatttggataagatgaaaaaaggtgattatttttatgttaccaatctgaaagaaaccttggcttatcaagtggatcgtatcatggtgattgaacctagccaattggatgccgtgagcattgaagaggataaagattatgttacccttctgacctgtacaccttatatgggctctttgtcaactgtaatgggtgacttatcattaacaacgagagagaatcagcttggttctctctctttttggatgttcaaagcgatgagaattttgcttttaaaatttttaaagttgcgaaagccaaaggcttgtcgcttgatgtctttgataagcttgttggtcgcttctaatttggcattggaaagggatagc

SEQ ID NO: 3912 - protein, 189 aa, Streptococcus agalactiae
MLEVREQVDHVMIPKINQDLPIYAGSEEDNLQRGVGHLEGISLPIGGASTHAVLSGQRGMPAARLFADLDKMKKGDYFYVTNLKETLAYQVDRIMVIEPSQLDAVSIEEDKDYVTLLTCTPYMGSLSTVMGDLSLTTRENQLGSLSFWMFKAMRILLLKFLKLRKPKACRLMSLISLLVASNLALERDS

SEQ ID NO: 3913 - DNA, 2709 bp, Streptococcus agalactiae
atgatgattgtgaataatggttatctagaagggagaaaaatgaaaaagagacaaaaaatatggagagggttatcagttactttactaatcctgtcccaaattccatttggtatattggtacaaggtgaaacccaagataccaatcaagcacttggaaaagtaattgttaaaaaaacgggagacaatgctacaccattaggcaaagcgacttttgtgttaaaaaatgacaatgataagtcagaaacaagtcacgaaacggtagagggttctggagaagcaacctttgaaaacataaaacctggagactacacattaagagaagaaacagcaccaattggttataaaaaaactgataaaacctggaaagttaaagttgcagataacggagcaacaataatcgagggtatggatgcagataaagcagagaaacgaaaagaagttttgaatgcccaatatccaaaatcagctatttatgaggatacaaaagaaaattacccattagttaatgtagagggttccaaagttggtgaacaatacaaagcattgaatccaataaatggaaaagatggtcgaagagagattgctgaaggttggttatcaaaaaaaattacaggggtcaatgatctcgataagaataaatataaaattgaattaactgttgagggtaaaaccactgttgaaacgaaagaacttaatcaaccactagatgtcgttgtgctattagataattcaaatagtatgaataatgaaagagccaataattctcaaagagcattaaaagctggggaagcagttgaaaagctgattgataaaattacatcaaataaagacaatagagtagctcttgtgacatatgcctcaaccatttttgatggtactgaagcgaccgtatcaaagggagttgccgatcaaaatggtaaagcgctgaatgatagtgtatcatgggattatcataaaactacttttacagcaactacacataattacagttatttaaatttaacaaatgatgctaacgaagttaatattctaaagtcaagaattccaaaggaagcggagcatataaatggggatcgcacgctctatcaatttggtgcgacatttactcaaaaagctctaatgaaagcaaatgaaattttagagacacaaagttctaatgctagaaaaaaacttatttttcacgtaactgatggtgtccctacgatgtcttatgccataaattttaatccttatatatcaacatcttaccaaaaccagtttaattcttttttaaataaaataccagatagaagtggtattctccaagaggattttataatcaatggtgatgattatcaaatagtaaaaggagatggagagagttttaaactgttttcggatagaaaagttcctgttactggaggaacgacacaagcagcttatcgagtaccgcaaaatcaactctctgtaatgagtaatgagggatatgcaattaatagtggatatatttatctctattggagagattacaactgggtctatccatttgatcctaagacaaagaaagtttctgcaacgaaacaaatcaaaactcatggtgagccaacaacattatactttaatggaaatataagacctaaaggttatgacatttttactgttgggattggtgtaaacggagatcctggtgcaactcctcttgaagctgagaaatttatgcaatcaatatcaagtaaaacagaaaattatactaatgttgatgatacaaataaaatttatgatgagctaaataaatactttaaaacaattgttgaggaaaaacattctattgttgatggaaatgtgactgatcctatgggagagatgattgaattccaattaaaaaatggtcaaagttttacacatgatgattacgttttggttggaaatgatggcagtcaattaaaaaatggtgtggctcttggtggaccaaacagtgatgggggaattttaaaagatgttacagtgacttatgataagacatctcaaaccatcaaaatcaatcatttgaacttaggaagtggacaaaaagtagttcttacctatgatgtacgtttaaaagataactatataagtaacaaattttacaatacaaataatcgtacaacgctaagtccgaagagtgaaaaagaaccaaatactattcgtgatttcccaattcccaaaattcgtgatgttcgtgagtttccggtactaaccatcagtaatcagaagaaaatgggtgaggttgaatttattaaagttaataaagacaaacattcagaatcgcttttgggagctaagtttcaacttcagatagaaaaagatttttctgggtataagcaatttgttccagagggaagtgatgttacaacaaagaatgatggtaaaatttattttaaagcacttcaagatggtaactataaattatatgaaatttcaagtccagatggctatatagaggttaaaacgaaacctgttgtgacatttacaattcaaaatggagaagttacgaacctgaaagcagatccaaatgctaataaaaatcaaatcgggtatcttgaaggaaatggtaaacatcttattaccaacactcccaaacgcccaccaggtgtttttcctaaaacagggggaattggtacaattgtctatatattagttggttctacttttatgatacttaccatttgttctttccgtcgtaaacaattg

SEQ ID NO: 3914 - protein, 903 aa, Streptococcus agalactiae
MMIVNNGYLEGRKMKKRQKIWRGLSVTLLILSQIPFGILVQGETQDTNQALGKVIVKKTGDNATPLGKATFVLKNDNDKSETSHETVEGSGEATFENIKPGDYTLREETAPIGYKKTDKTWKVKVADNGATIIEGMDADKAEKRKEVLNAQYPKSAIYEDTKENYPLVNVEGSKVGEQYKALNPINGKDGRREIAEGWLSKKITGVNDLDKNKYKIELTVEGKTTVETKELNQPLDVVVLLDNSNSMNNERANNSQRALKAGEAVEKLIDKITSNKDNRVALVTYASTIFDGTEATVSKGVADQNGKALNDSVSWDYHKTTFTATTHNYSYLNLTNDANEVNILKSRIPKEAEHINGDRTLYQFGATFTQKALMKANEILETQSSNARKKLIFHVTDGVPTMSYAINFNPYISTSYQNQFNSFLNKIPDRSGILQEDFIINGDDYQIVKGDGESFKLFSDRKVPVTGGTTQAAYRVPQNQLSVMSNEGYAINSGYIYLYWRDYNWVYPFDPKTKKVSATKQIKTHGEPTTLYFNGNIRPKGYDIFTVGIGVNGDPGATPLEAEKFMQSISSKTENYTNVDDTNKIYDELNKYFKTIVEEKHSIVDGNVTDPMGEMIEFQLKNGQSFTHDDYVLVGNDGSQLKNGVALGGPNSDGGILKDVTVTYDKTSQTIKINHLNLGSGQKVVLTYDVRLKDNYISNKFYNTNNRTTLSPKSEKEPNTIRDFPIPKIRDVREFPVLTISNQKKMGEVEFIKVNKDKHSESLLGAKFQLQIEKDFSGYKQFVPEGSDVTTKNDGKIYFKALQDGNYKLYEISSPDGYIEVKTKPVVTFTIQNGEVTNLKADPNANKNQIGYLEGNGKHLITNTPKRPPGVFPKTGGIGTIVYILVGSTFMILTICSFRRKQL

SEQ ID NO: 3915 - DNA, 849 bp, Streptococcus agalactiae
atgaaaaagcggctagtcaaaatagtcacaataattcgaaataataaaatcagaaccctcatttttgtgatgggaagtctgattctcttatttccgattgtgagccaggtaagttactaccttgcttcgcatcaaaatattaatcaatttaagcgggaagtcgctaagattgatactaatacggttgaacgacgcatcgctttagctaatgcttacaatgagacgttatcaaggaatcccttgcttatagacccttttaccagtaagcaaaaagaaggtttgagagagtatgctcgtatgcttgaagttcatgagcaaataggtcatgtggcaatcccaagtattggggttgatattccaatttatgctggaacatccgaaactgtgcttcagaaaggtagtgggcatttggagggaaccagtcttccagtgggaggtttgtcaacccattcagtactaactgcccaccgtggcttgccaacagctaggctatttaccgacttaaataaagttaaaaaaggccagattttctatgtgacgaacatcaaggaaacacttgcctacaaagtcgtgtctatcaaagttgtggatccaacagctttaagtgaggttaagattgtcaatggtaaggattatataaccttgctgacttgcacaccttacatgatcaatagtcatcgtctcttggtaaaaggagagcgtattccttatgattctaccgaggcggaaaagcacaaagaacaaaccgtacaagattatcgtttgtcactagtgttgaagatactactagtattattaattggactcttcatcgtgataatgatgagaagatggatgcaacatcgtcaa

SEQ ID NO: 3916 - protein, 283 aa, Streptococcus agalactiae
MKKRLVKIVTIIRNNKIRTLIFVMGSLILLFPIVSQVSYYLASHQNINQFKREVAKIDTNTVERRIALANAYNETLSRNPLLIDPFTSKQKEGLREYARMLEVHEQIGHVAIPSIGVDIPIYAGTSETVLQKGSGHLEGTSLPVGGLSTHSVLTAHRGLPTARLFTDLNKVKKGQIFYVTNIKETLAYKVVSIKVVDPTALSEVKIVNGKDYITLLTCTPYMINSHRLLVKGERIPYDSTEAEKHKEQTVQDYRLSLVLKILLVLLIGLFIVIMMRRWMQHRQ

SEQ ID NO: 3917 - DNA, 915 bp, Streptococcus agalactiae
atgggacaaaaatcaaaaatatctctagctacgaatattcgtatatggatttttcgtttaattttcttagcgggtttccttgttttggcatttcccatcgttagtcaggtcatgtactttcaagcctctcacgccaatattaatgcttttaaagaagctgttaccaagattgaccgggtggagattaatcggcgtttagaacttgcttatgcttataacgccagtatagcaggtgccaaaactaatggcgaatatccagcgcttaaagacccctactctgctgaacaaaagcaggcaggggtcgttgagtacgcccgcatgcttgaagtcaaagaacaaataggtcatgtgattattccaagaattaatcaggatatccctatttacgctggctctgctgaagaaaatcttcagaggggcgttggacatttagaggggaccagtcttccagtcggtggtgagtcaactcatgccgttctaactgcccatcgagggctaccaacggccaagctatttaccaatttagacaaggtaacagtaggtgaccgtttttacattgaacacatcggcggaaagattgcttatcaggtagaccaaatcaaagttatcgcccctgatcagttagaggatttgtacgtgattcaaggagaagatcacgtcaccctattaacttgcacaccttatatgataaatagtcatcgcctcctcgttcgaggcaagcgaattccttatgtggaaaaaacagtgcagaaagattcaaagaccttcaggcaacaacaatacctaacctatgctatgtgggtagtcgttggacttatcttgctgtcgcttctcatttggtttaaaaagacgaaacagaaaaagcggagaaagaatgaaaaagcggctagtcaaaatagtcacaataattcgaaa

SEQ ID NO: 3918 - protein, 305 aa, Streptococcus agalactiae
MGQKSKISLATNIRIWIFRLIFLAGFLVLAFPIVSQVMYFQASHANINAFKEAVTKIDRVEINRRLELAYAYNASIAGAKTNGEYPALKDPYSAEQKQAGVVEYARMLEVKEQIGHVIIPRINQDIPIYAGSAEENLQRGVGHLEGTSLPVGGESTHAVLTAHRGLPTAKLFTNLDKVTVGDRFYIEHIGGKIAYQVDQIKVIAPDQLEDLYVIQGEDHVTLLTCTPYMINSHRLLVRGKRIPYVEKTVQKDSKTFRQQQYLTYAMWVVVGLILLSLLIWFKKTKQKKRRKNEKAASQNSHNNSK

SEQ ID NO: 3919 - DNA, 921 bp, Streptococcus agalactiae
atgaaacaaacattaaaacttatgttttcttttctgttgatgttagggactatgtttggaattagccaaactgttttagcgcaagaaactcatcagttgacgattgttcatcttgaagcaagggatattgatcgtccaaatccacagttggagattgcccctaaagaagggactccaattgaaggagtactctatcagttgtaccaattaaaatcaactgaagatggcgatttgttggcacattggaattccctaactatcacagaattgaaaaaacaggcgcagcaggtttttgaagccactactaatcaacaaggaaaggctacatttaaccaactaccagatggaatttattatggtctggcggttaaagccggtgaaaaaaatcgtaatgtctcagctttcttggttgacttgtctgaggataaagtgatttatcctaaaatcatctggtccacaggtgagttggacttgcttaaagttggtgtggatggtgataccaaaaaaccactagcaggcgttgtctttgaactttatgaaaagaatggtaggactcctattcgtgtgaaaaatggggtgcattctcaagatattgacgctgcaaaacatttagaaacagattcatcagggcatatcagaatttccgggctcatccatggggactatgtcttaaaagaaatcgagacacagtcaggatatcagatcggacaggcagagactgctgtgactattgaaaaatcaaaaacagtaacagtaacgattgaaaataaaaaagttccgacacctaaagtgccatctcgaggaggtcttattcccaaaacaggtgagcaacaggcaatggcacttgtaattattggtggtattttaattgctttagccttacgattactatcaaaacatcggaaacatcaaaataaggat

SEQ ID NO: 3920 - protein, 307 aa, Streptococcus agalactiae
MKQTLKLMFSFLLMLGTMFGISQTVLAQETHQLTIVHLEARDIDRPNPQLEIAPKEGTPIEGVLYQLYQLKSTEDGDLLAHWNSLTITELKKQAQQVFEATTNQQGKATFNQLPDGIYYGLAVKAGEKNRNVSAFLVDLSEDKVIYPKIIWSTGELDLLKVGVDGDTKKPLAGVVFELYEKNGRTPIRVKNGVHSQDIDAAKHLETDSSGHIRISGLIHGDYVLKEIETQSGYQIGQAETAVTIEKSKTVTVTIENKKVPTPKVPSRGGLIPKTGEQQAMALVIIGGILIALALRLLSKHRKHQNKD

SEQ ID NO: 3921 - DNA, 1743 bp, Streptococcus agalactiae
gtgctaaactttaatagttttgtgcttaataataatcagcacttacaaagaacaaagggaaaagcgaggagagaacttttaatgaaattatcgaagaagttattgttttcggctgctgttttaacaatggtggcggggtcaactgttgaaccagtagctcagtttgcgactggaatgagtattgtaagagctgcagaagtgtcacaagaacgcccagcgaaaacaacagtaaatatctataaattacaagctgatagttataaatcggaaattacttctaatggtggtatcgagaataaagacggcgaagtaatatctaactatgctaaacttggtgacaatgtaaaaggtttgcaaggtgtacagtttaaacgttataaagtcaagacggatatttctgttgatgaattgaaaaaattgacaacagttgaagcagcagatgcaaaagttggaacgattcttgaagaaggtgtcagtctacctcaaaaaactaatgctcaaggtttggtcgtcgatgctctggattcaaaaagtaatgtgagatacttgtatgtagaagatttaaagaattcaccttcaaacattaccaaagcttatgctgtaccgtttgtgttggaattaccagttgctaactctacaggtacaggtttcctttctgaaattaatatttaccctaaaaacgttgtaactgatgaaccaaaaacagataaagatgttaaaaaattaggtcaggacgatgcaggttatacgattggtgaagaattcaaatggttcttgaaatctacaatccctgccaatttaggtgactatgaaaaatttgaaattactgataaatttgcagatggcttgacttataaatctgttggaaaaatcaagattggttcgaaaacactgaatagagatgagcactacactattgatgaaccaacagttgataaccaaaatacattaaaaattacgtttaaaccagagaaatttaaagaaattgctgagctacttaaaggaatgacccttgttaaaaatcaagatgctcttgataaagctactgcaaatacagatgatgcggcatttttggaaattccagttgcatcaactattaatgaaaaagcagttttaggaaaagcaattgaaaatacttttgaacttcaatatgaccatactcctgataaagctgacaatccaaaaccatctaatcctccaagaaaaccagaagttcatactggtgggaaacgatttgtaaagaaagactcaacagaaacacaaacactaggtggtgctgagtttgatttgttggcttctgatgggacagcagtaaaatggacagatgctcttattaaagcgaatactaataaaaactatattgctggagaagctgttactgggcaaccaatcaaattgaaatcacatacagacggtacgtttgagattaaaggtttggcttatgcagttgatgcgaatgcagagggtacagcagtaacttacaaattaaaagaaacaaaagcaccagaaggttatgtaatccctgataaagaaatcgagtttacagtatcacaaacatcttataatacaaaaccaactgacatcacggttgatagtgctgatgcaacacctgatacaattaaaaacaacaaacgtccttcaatccctaatactggtggtattggtacggctatctttgtcgctatcggtgctgcggtgatggcttttgctgttaaggggatgaagcgtcgtacaaaagataac

SEQ ID NO: 3922 - protein, 581 aa, Streptococcus agalactiae
MLNFNSFVLNNNQHLQRTKGKARRELLMKLSKKLLFSAAVLTMVAGSTVEPVAQFATGMSIVRAAEVSQERPAKTTVNIYKLQADSYKSEITSNGGIENKDGEVISNYAKLGDNVKGLQGVQFKRYKVKTDISVDELKKLTTVEAADAKVGTILEEGVSLPQKTNAQGLVVDALDSKSNVRYLYVEDLKNSPSNITKAYAVPFVLELPVANSTGTGFLSEINIYPKNVVTDEPKTDKDVKKLGQDDAGYTIGEEFKWFLKSTIPANLGDYEKFEITDKFADGLTYKSVGKIKIGSKTLNRDEHYTIDEPTVDNQNTLKITFKPEKFKEIAELLKGMTLVKNQDALDKATANTDDAAFLEIPVASTINEKAVLGKAIENTFELQYDHTPDKADNPKPSNPPRKPEVHTGGKRFVKKDSTETQTLGGAEFDLLASDGTAVKWTDALIKANTNKNYIAGEAVTGQPIKLKSHTDGTFEIKGLAYAVDANAEGTAVTYKLKETKAPEGYVIPDKEIEFTVSQTSYNTKPTDITVDSADATPDTIKNNKRPSIPNTGGIGTAIFVAIGAAVMAFAVKGMKRRTKDN

SEQ ID NO: 3923 - DNA, 117 bp, Streptococcus agalactiae
atgattgatgacttgttggcaactagcctcaaactgtgtttggaaaaaggcatcgatagacacaagaagactacgtatactggtagtaggaaaacaagggacaagctttatatagga

SEQ ID NO: 3924 - protein, 39 aa, Streptococcus agalactiae
MIDDLLATSLKLCLEKGIDRHKKTTYTGSRKTRDKLYIG

SEQ ID NO: 3925 - DNA, 1230 bp, Streptococcus agalactiae
atgataatgaaggcggtctatcaaatggttacattcgattttaaacatgttcaaacattgcataccatatctcaactacctatttcagtcatgtcacgagacaaggaactcgttcagttatatggtaacgaagactatctgttgccttactatcagtttttaaaacatttagctatcccttataaccaagatatcactgtttatgagggtctttttgaagaatcattcttaatttttcctgtctgtcaatatcttattgctattggaccattttatccctatagccctgatatcaataggcaagaacagttatccagtcgctttctagaacaattttctcatcgtaataaaaaagaaatcttatcctatataaagcttgtcccttgttttcctactaccagtatacgtagtcttcttgtgtctatcgatgcctttttccaaacacagtttgaggctagttgccaacaagtcatcaatcatttattagaagagtcagaacagattgttgcggatcctgatattgttcttcacctaaaacatactaagaaaaactcttttcagttacccactgttttaaaccatctcaatcacattattgatctcgttaagctgggtaacactcaactgttaaagcaagaaattaatcgcctcccatcatccagtgttacctcatcttcaatccctgccctaagagctgaaaagaacttaactgttgtttacttaacaaaattactagaattaagtttcgaggaaaatactgatgtggctaaaagttatgcgctggtaaagcactatatggctttaaacgaagaggctcctgatcttattgatgtttcaagaattcgctgtgcagctcttattgatttttcagaatccttaaccaataagagcatctctgacaagcagcaaatgtacaatagtattctccattatgtggacaaccacctctactccaaactcaaagtatctgatattgccaactacctatatatctcagattcccacttacgctcagtttttaaaaaatactctgacatttccttgcaaagttatattctaaaggcaaaaattaaggagggacaattactactgcaaagaggggtaccgattggggaagtagcgaaattattacatttttacgacaccacacattttcttaaaacctttaaaaaatacgtgggaatatcttcaaacgaatatcttactaaatatcgtgagacctcatgccag

SEQ ID NO: 3926 - protein, 410 aa, Streptococcus agalactiae
MIMKAVYQMVTFDFKHVQTLHTISQLPISVMSRDKELVQLYGNEDYLLPYYQFLKHLAIPYNQDITVYEGLFEESFLIFPVCQYLIAIGPFYPYSPDINRQEQLSSRFLEQFSHRNKKEILSYIKLVPCFPTTSIRSLLVSIDAFFQTQFEASCQQVINHLLEESEQIVADPDIVLHLKHTKKNSFQLPTVLNHLNHIIDLVKLGNTQLLKQEINRLPSSSVTSSSIPALRAEKNLTVVYLTKLLELSFEENTDVAKSYALVKHYMALNEEAPDLIDVSRIRCAALIDFSESLTNKSISDKQQMYNSILHYVDNHLYSKLKVSDIANYLYISDSHLRSVFKKYSDISLQSYILKAKIKEGQLLLQRGVPIGEVAKLLHFYDTTHFLKTFKKYVGISSNEYLTKYRETSCQ

SEQ ID NO: 3927 - DNA, 345 bp, Streptococcus agalactiae
atggataaaattattaaatcaatttctgcctctggtgccttcaggtcttatgtcctcgatagcaccgagactgttaaattggctcaggaaaaacatcataccttgtcgtcttcaacagttgctcttggtcgcaccctgattgctaatcaaatattagcggctaatcaaaaaggcgatagcaagattacggttaaagtcatcggtgattcttcctttggtcatattatctctgttgcagataccaaagggcatgttaaggggtacatccaaaatactggtgttgacatcaaaaaacggtcacaggtgaagttttggttggcccttttatggggaatggtcattttg

SEQ ID NO: 3928 - protein, 115 aa, Streptococcus agalactiae
MDKIIKSISASGAFRSYVLDSTETVKLAQEKHHTLSSSTVALGRTLIANQILAANQKGDSKITVKVIGDSSFGHIISVADTKGHVKGYIQNTGVDIKKRSQVKFWLALLWGMVIL

SEQ ID NO: 3929 - DNA, 870 bp, Streptococcus pyogenes
atggataaaataattaaatcaatagcacaatcaggggcttttagggcttatgtccttgatagcactgagacggttgcattagctcaagaaaaacacaacacgctgtcatcgtctactgttgcgcttggccgtaccttgatcgccaaccagattttggcggctaatcaaaaaggcgatagtaaaatcaccgtcaaagtgattggtgattcttcttttggacacattatctctgtggcagataccaaaggacatgtgaaaggttacattcaaaatactggtgtcgatattaaaaagaccgcaacaggtgaagtccttgttgggccttttatggggaatggtcattttgtgacgattattgattatggcacaggtaacccttacacctcaacaacgcctcttattactggggaaattggtgaggattttgcctactacttaaccgaatcagagcaaacaccatctgcaatcggacttaatgtgcttttagatgaaaatgataaggttaaggttgctggtggctttatggtgcaggtgctaccaggcgcttctgaagaagagattgctcgctatgaaaaacgcctgcaagaaatgcctgccatttctcacctactagcttccaaaaatcatgtggatgcccttttggaggccatctatggagatgaaccttacaagcgtctttctgaagaacctctgagttttcagtgtgactgttctagagaacgttttgaagcagccctaatgactttgccaaaagcagatttacaggccatgattgacgaagataagggtgctgagattgtttgccaattttgtggtaccaagtaccaatttaatgaaagtgatttggaggccattatcagtgataaagct

SEQ ID NO: 3930 - protein, 290 aa, Streptococcus pyogenes
MDKIIKSIAQSGAFRAYVLDSTETVALAQEKHNTLSSSTVALGRTLIANQILAANQKGDSKITVKVIGDSSFGHIISVADTKGHVKGYIQNTGVDIKKTATGEVLVGPFMGNGHFVTIIDYGTGNPYTSTTPLITGEIGEDFAYYLTESEQTPSAIGLNVLLDENDKVKVAGGFMVQVLPGASEEEIARYEKRLQEMPAISHLLASKNHVDALLEAIYGDEPYKRLSEEPLSFQCDCSRERFEAALMTLPKADLQAMIDEDKGAEIVCQFCGTKYQFNESDLEAIISDKA

SEQ ID NO: 3931 - DNA, 147 bp, Streptococcus agalactiae
gtgcaggaagttttgattatcgcaagagagaatcatcaagtgactcatgaacacgtgtcaatcttattgacctgcgttcaagaattgattgtggaagtcaatcaaacacagccactcagtcgtgagtttcgtgaaaagtatatgggt

SEQ ID NO: 3932 - protein, 49 aa, Streptococcus agalactiae
MQEVLIIARENHQVTHEHVSILLTCVQELIVEVNQTQPLSREFREKYMG

SEQ ID NO: 3933 - DNA, 819 bp, Streptococcus agalactiae
ttgtgtcgtgttttacgtgtcaatcgctccacttactataaatttctaaaacataagccctcaaaaagagaattggataatcaaatttataaaaaacaaatacttgagatttataccaaagcaaacaaaagacttggtgtgaagtctatcaaagtcattcttcaaagagactacgacacaaaaatctctgaaggaagaatttaccatctgatgaagaatatggcgctccctaaaatggctaccgttaagacaaaaacagctcttaaaaagactcaaaaaacgtatcctcaaaacttactcaaccagaaattttatcctgacaaacctaatcaagtatggtctactgacttcacctatatttctattggatataagaaatatgtctatctctgcgcaatacttgatctctattctagaaaatgtattgcttggaaattgagtcaccgtatggatgcaaagttagcatgtaacactctagaattagctcttaataaaagaaagattgaaggaacacttctctttcattccgaccaagggtcacaatttaaggccagggaatttagaaaaataattgatgacaacaatatcatgcattctttttctaaacctggatatccttatgataatgccgtaactgaagcatttttcaagtatttaaagcatagacaaatcaaccgaaaacattatcaaaatatcaaacaggttcaattagactgctttgaatacattgagaatttttataacaattacatcccacatacggctaatctaggactaacccctaatcagaaagaagaaaattattttaacgcaataaaa

SEQ ID NO: 3934 - protein, 273 aa, Streptococcus agalactiae
MCRVLRVNRSTYYKFLKHKPSKRELDNQIYKKQILEIYTKANKRLGVKSIKVILQRDYDTKISEGRIYHLMKNMALPKMATVKTKTALKKTQKTYPQNLLNQKFYPDKPNQVWSTDFTYISIGYKKYVYLCAILDLYSRKCIAWKLSHRMDAKLACNTLELALNKRKIEGTLLFHSDQGSQFKAREFRKIIDDNNIMHSFSKPGYPYDNAVTEAFFKYLKHRQINRKHYQNIKQVQLDCFEYIENFYNNYIPHTANLGLTPNQKEENYFNAIK

SEQ ID NO: 3935 - DNA, 516 bp, Streptococcus agalactiae
ttgagagtttatgaaaataaagaagagttgaaaaaagaaataagtaaaacatttgagaaatacattatggaatttaataatattccagagaatctaaaagataaaagaattgatgaagttgatagaactccagcagccaacctttcttatcaggttggctggaccaacttggttcttaaatgggaagaagatgaaagaaagggacttcaagtaaaaacaccatcggataaatttaaatggaatcaacttggtgaattatatcagtggttcacagatacctacgctcatttatctctgcaagagttgaaagcaaaattaaatgaaaatattaattctatctatgcaatgattgatttgttgagtgaggaagaattatttgaagcgcatatgagaaagtgggctgatgaagcgactaaaacagcgacttgggaagtgtataagtttattcatgtaaatacggttgcaccttttggaactttcagaactaaaatcagaaaatggaagaagatagtatta

SEQ ID NO: 3936 - protein, 172 aa, Streptococcus agalactiae
MRVYENKEELKKEISKTFEKYIMEFNNIPENLKDKRIDEVDRTPAANLSYQVGWTNLVLKWEEDERKGLQVKTPSDKFKWNQLGELYQWFTDTYAHLSLQELKAKLNENINSIYAMIDLLSEEELFEAHMRKWADEATKTATWEVYKFIHVNTVAPFGTFRTKIRKWKKIVL

SEQ ID NO: 3937 - DNA, 747 bp, Streptococcus agalactiae
atggaggttcttatgaagaaagtgttagtgagtagtcttttggttttagggattacgataacgttacaaacagtagttgaggctaaggggccaaaagtagcttatacacaagagggaatgactgctctttcggacacaaataaagataaagtcactactatttctattgacgagattcaaaaaagcttagaaggtaagaagccgattactgttagttttgatattgatgatacactgcttttcagtagtcaatattttcaatatggtaaagaatatgtaactcctggatcgtttgattttcttcataaacaaaaattctgggatcttgttgcaaaacgaggagatcaagattccattcccaaagaatatgctaaaaaattaattgctatgcatcaaaaacgaggagataaaattgtttttataacaggtaggacaagagggtcaatgtataaggagggcgaggttgataaaacagctaaagccttagctaaagattttaaattagacaaaccaattgctgtaaattatacaggcgataaacctaaaaagccatacaaatatgataaatcatattatattaagaaatatggttcagacattcattatggagatagtgatgacgatattcatgcagctagggaggccggtgctagaccaattagaattttaagagcacctaattctacaaatctacctttaccagaagctggaggctacggtgaagaggttctcgaaaattcagcttac

SEQ ID NO: 3938 - protein, 249 aa, Streptococcus agalactiae
MEVLMKKVLVSSLLVLGITITLQTVVEAKGPKVAYTQEGMTALSDTNKDKVTTISIDEIQKSLEGKKPITVSFDIDDTLLFSSQYFQYGKEYVTPGSFDFLHKQKFWDLVAKRGDQDSIPKEYAKKLIAMHQKRGDKIVFITGRTRGSMYKEGEVDKTAKALAKDFKLDKPIAVNYTGDKPKKPYKYDKSYYIKKYGSDIHYGDSDDDIHAAREAGARPIRILRAPNSTNLPLPEAGGYGEEVLENSAY

SEQ ID NO: 3939 - DNA, 729 bp, Streptococcus pyogenes
atgaaaaaagaatttaccagtatcctgtttacagttagtttttgtggaatcatagcattgcctgtcgaagctagtggccctaaagttccttatacacaagaaggtataacggccatttcaaatcaggcaacagtaaaattgatttctattgctgatatcgcgagcagtttagaaggacaaaaacctataacggttagttttgatatcgatgatactttgttatttactagccaatattttcagtacggcaaagaatatataactccaggctcatttgattttttgcataagcaaaaattttgggacttggtcgctaaacggggagatcaggattctattccaaaagagtatgcaaagcaactaatcgcaatgcatcaaaaacgaggagataaaattgtctttattactggccgaactcgaggatcgatgtataaaaaaggtgagattgataaaacagctaagtcactggctaaagattttaagttagacaagccaatagctatcaattatacaggagataaagctgtgaagccgtatcagtatgataaaacatattatataaagaaaaacggctcacaaattcattacggagatagtgatgaagatataaatgctgccaaagaggcaggtgcaagacctattcgcattttaagagctcctaattcaaccaatcttcctttgccaaaagctggaggatacggagaagaggttttagaaaattcggcttat

SEQ ID NO: 3940 - protein, 243 aa, Streptococcus pyogenes
MKKEFTSILFTVSFCGIIALPVEASGPKVPYTQEGITAISNQATVKLISIADIASSLEGQKPITVSFDIDDTLLFTSQYFQYGKEYITPGSFDFLHKQKFWDLVAKRGDQDSIPKEYAKQLIAMHQKRGDKIVFITGRTRGSMYKKGEIDKTAKSLAKDFKLDKPIAINYTGDKAVKPYQYDKTYYIKKNGSQIHYGDSDEDINAAKEAGARPIRILRAPNSTNLPLPKAGGYGEEVLENSAY

SEQ ID NO: 3941 - DNA, 219 bp, Streptococcus agalactiae
ttgccaactatgcagctgttagatgagttagttcttccaaaagacattaccatagcagatgtcagtcaaagtatccaagaatttgaaatagaaagagatgcccttcaagaattttttgacgatatgctgaagacttatacaacctaccaagaaatgaaagattatattaaatctcgtgaagcgaacactcctaagcaagagacagaagaaaaatcactt

SEQ ID NO: 3942 - protein, 73 aa, Streptococcus agalactiae
MPTMQLLDELVLPKDITIADVSQSIQEFEIERDALQEFFDDMLKTYTTYQEMKDYIKSREANTPKQETEEKSL

SEQ ID NO: 3943 - DNA, 1398 bp, Streptococcus agalactiae
gtgtataaactaaagacttcaaatgatagatataaaaggaaaattatgttacataaaaatgatattattgaaactgaaattagcgacattagccatgagggaatgggtattgccaaagtagatggctttgttttctttgttgaaaatgctcttccaggtgagattattaagatgcgcgtcttgaaattacgtaagcgtataggatatggaaaagttgaggaatatttaacgacttctcctcaccgaaatgaaggattagactatacctatttacgtacagggattgctgatttgggacatcttacttatgaacaacagctgttatttaaacaaaaacaagtagctgataacctttataaaattgctcatatatctgatgttttagtagaacctactcttggtatgacaatccctttggcatatcgaaataaagctcaggtaccagttcgtcgtgttgatggacagctagagacaggttttttcagaaaaaattcacatactctggtatccattgaagattatttaattcaggaaaaagagattgatgctctgattaattttacacgagatttattaagaaaatttgatgttaaaccatatgacgaagagcagcaatctggtttaattagaaatctcgttgttcgtcgaggacattatacagggcaattaatgttggttttggtgacaacacgtcctaaaatattccgcattgaccaaatgattgaaaagttggtgtctgcctttccttctgttgtttcaattatgcaaaatattaatgatcgtaatagcaacgttatttttgggaaagaatttcgtactctatatggttctgatactattgaggaccaaatgttaggaaatacttacgctatatcagcccaatctttttaccaagttaatactgaaatggctgaaaaactgtaccaaaaagcaatcgatttttcagatttaaactcagaggatatcgttattgatgcctattcaggtataggaacaattggcttatctgttgctaaacaagtaaaacatgtttatggtgttgaagttgttgaaaaagcagtaagtgatgccaaagaaaatgctactcgaaatgggataactaacagtacctatgttgctgattcggctgaaaatgcaatggcaaagtggcttaaagaaggtataaaaccaactgttataatggttgatccaccacgaaaaggattaacggagagttttgtatattctgctgcccaaacaaaagcagataaaatcacttatatttcttgtaattcagcgacaatggcgcgtgatatcaaactatttgaagaattagggtatcatttagtaaaaattcaaccagtagacttattcccaatgacacatcatgtggagtgtgtggctctgctcgtaaaagcc

SEQ ID NO: 3944 - protein, 466 aa, Streptococcus agalactiae
MYKLKTSNDRYKRKIMLHKNDIIETEISDISHEGMGIAKVDGFVFFVENALPGEIIKMRVLKLRKRIGYGKVEEYLTTSPHRNEGLDYTYLRTGIADLGHLTYEQQLLFKQKQVADNLYKIAHISDVLVEPTLGMTIPLAYRNKAQVPVRRVDGQLETGFFRKNSHTLVSIEDYLIQEKEIDALINFTRDLLRKFDVKPYDEEQQSGLIRNLVVRRGHYTGQLMLVLVTTRPKIFRIDQMIEKLVSAFPSVVSIMQNINDRNSNVIFGKEFRTLYGSDTIEDQMLGNTYAISAQSFYQVNTEMAEKLYQKAIDFSDLNSEDIVIDAYSGIGTIGLSVAKQVKHVYGVEVVEKAVSDAKENATRNGITNSTYVADSAENAMAKWLKEGIKPTVIMVDPPRKGLTESFVYSAAQTKADKITYISCNSATMARDIKLFEELGYHLVKIQPVDLFPMTHHVECVALLVKA

SEQ ID NO: 3945 - DNA, 1386 bp, Streptococcus pyogenes
atggttagccctagaaaaggaaaaagaataagaatgttgaaaaaaaatgatattatccaagttgctatttcagatttaagccatgagggagcaggtgtcgctaaacacgatggttttgttttctttgttgataatgccttgccagaagaagtgattgacatgcgtgtcttaaaggtcaataaaaacagcggttttggcaaagtagaagcctatcattacctgtcgtcagctagaaatgcagatgtcaatttaacttatttgcgaacaggcattgcagaccttggacatctaacttatgaagaccaactgactttcaaaaagaaacaagttcaggacagcctctataaaattgctggaatcagtgacgtgacagtcgaaagcacgattgggatgacagaacctttagcttaccgaaataaggctcaagttcctgttagacgtgttaatggtcagctagaaacaggctttttccgcaagcattctcatgacttgattcctatttcggattattatattcaggacaaagagattgatcgtctcattaattttacccgtgatttattacgccgctttgatattaaaccgtatgacgaaacagaacaaacaggtctcttgagaaatattgttgttcgccgaggtcattactctggagaaatgatgctggtcttagtgactacacgcccaaaagttttccgtgttgaccaagtcattgaaaaaatcgttgaagcttttccagcagtggtgtctattattcaaaatattaatgataagaacaccaatgcaatctttggtaaagatttcaaaacgctttacggcaaggataccattactgatagcatgcttggaaacaactatgccatttctgctcagtctttctaccaagtgaatacggttatggcagaaaaactctatcaaacagctatagccttttcagacctttctaaagatgatattgtgattgacgcctactcaggtatcggaaccattggcctatcatttgctaaaaccgttaaagctgtttatggtgttgaagtgattgaagcagctgttagagatgctcaacagaatgccgctcttaatggcatcaccaatgcctactttgtcgcagataccgcagaacatgccatggcaacatgggcgaaagatggcatcaaaccaagtgttattctggtagacccgccacgaaaaggcttaacagaaagtttcatccaagccagcgtggcaatgggaccacaaaaaattacctacgtttcctgcaacccagccaccatggcgcgtgacataaagcgttatcaagagttgggttacaaactggccaaagtacagcccgtagatttgtttccgcaaacgcatcacgtcgagtgcgtagtattgctaatcaaggag

SEQ ID NO: 3946 - protein, 462 aa, Streptococcus pyogenes
MVSPRKGKRIRMLKKNDIIQVAISDLSHEGAGVAKHDGFVFFVDNALPEEVIDMRVLKVNKNSGFGKVEAYHYLSSARNADVNLTYLRTGIADLGHLTYEDQLTFKKKQVQDSLYKIAGISDVTVESTIGMTEPLAYRNKAQVPVRRVNGQLETGFFRKHSHDLIPISDYYIQDKEIDRLINFTRDLLRRFDIKPYDETEQTGLLRNIVVRRGHYSGEMMLVLVTTRPKVFRVDQVIEKIVEAFPAVVSIIQNINDKNTNAIFGKDFKTLYGKDTITDSMLGNNYAISAQSFYQVNTVMAEKLYQTAIAFSDLSKDDIVIDAYSGIGTIGLSFAKTVKAVYGVEVIEAAVRDAQQNAALNGITNAYFVADTAEHAMATWAKDGIKPSVILVDPPRKGLTESFIQASVAMGPQKITYVSCNPATMARDIKRYQELGYKLAKVQPVDLFPQTHHVECVVLLIKE

SEQ ID NO: 3947 - DNA, 1371 bp, Streptococcus agalactiae
atgtcaagaaataattacggtcagctaaatcatcatgaagagctacgatataactatcttttaaaaaacatccattatcttaatgaacgtgaaaagatggaatttcagtaccttcattataaaaaaacagcagtacgaccacagagaaggacagaaagtccaccaactaattcttattatgaggaaccttattctgattcttattatcaagatgacgatttttactcagagcctcagctaacctcacaaggtttaccaatttatcaagaagagagagctccgaagaagaaaaaacaaagggccagaaaagaaaaacagagggtgaaggttatggcgcctttccctccaaaggctataaccccccctagaaagaaaaaaaaatttaagggtttcctaaagttcataggtattatattactaattgttttatcaggtatggttttcatgtttgttaaaggaatgcgtgatgtgaataatgggaagtcacattatagccctgcaattattgaagattttaagggaaaagatgctgttgatgggactaatatcttaattttaggtagtgataaacgtgtcagcgagagatctactgatgcgagaacagataccataatggttgctaatgttggtaacaaggataataaggttaagatggtgagttttatgcgagatctcttagtcaatattcctaattatagtacggaaggttactatgatatgaaattaaatgcgtcttttaatttgggagaacaagataatcataaaggagcagagtatgttcgacaaacgttgaaaaatcattttgatattgatataaaatattatgttatggttgactttgagacatttgcagatgctattgatacactgtttcctaatggtgtcaagattaatgctaaatttggacttgtcggtggacaatctgctgattcagttaaagttcctgatgatttaaggatgaaaaatggcgttgtacctagccaaaaaattaaggttgggattcagtacatggatggaaggacccttctaaattatgctcgtttcagaaaagacgatgatggggactttggtcgaacacaacgtcaacaacaagttatgagagctattgtctctcaaataaaagacccacgtcgtctctttacaggttctgctgctatcggtaaagcctatgctttaacttcaagtaatttatcttatagctttgtcctaacagatggcattccaattttatcagatgctaaaaatggtattaagcaaatgacaattccaagagaaggagattgggtagatgattatgaccagtatggtggtcaagggttaacaattgattttgctaagtacaaaaagatcctaaagaaaatgggactgcgt

SEQ ID NO: 3948 - protein, 457 aa, Streptococcus agalactiae
MSRNNYGQLNHHEELRYNYLLKNIHYLNEREKMEFQYLHYKKTAVRPQRRTESPPTNSYYEEPYSDSYYQDDDFYSEPQLTSQGLPIYQEERAPKKKKQRARKEKQRVKVMAPFPPKAITPPRKKKKFKGFLKFIGIILLIVLSGMVFMFVKGMRDVNNGKSHYSPAIIEDFKGKDAVDGTNILILGSDKRVSERSTDARTDTIMVANVGNKDNKVKMVSFMRDLLVNIPNYSTEGYYDMKLNASFNLGEQDNHKGAEYVRQTLKNHFDIDIKYYVMVDFETFADAIDTLFPNGVKINAKFGLVGGQSADSVKVPDDLRMKNGVVPSQKIKVGIQYMDGRTLLNYARFRKDDDGDFGRTQRQQQVMRAIVSQIKDPRRLFTGSAAIGKAYALTSSNLSYSFVLTDGIPILSDAKNGIKQMTIPREGDWVDDYDQYGGQGLTIDFAKYKKILKKMGLR

SEQ ID NO: 3949 - DNA, 1449 bp, Streptococcus pyogenes
atgacaaaataccccatgggtggccttagtcaccatgaagaattacgttatttttatctcctaaggaatttgagttaccttagtgagaatgaaaaaaaagagtttgcttttttaaaatctaaattggaaattggtcgagcttatgctccttctaagcagcattataggaagtcaaaacggcaagaaccttactttgaagatgactactataacgactactcaccaaatgatttactagaagatgatgacgtcaatcatgactcttcttttgttccatatggtttaccgatatatcctaaagaagacagatatttaaacaaaaaaacaaaacttacagctcgtagacctatagatgctccgcagcctattgatgaagacgatgcttttttaacagagtctgttgctcgttgtgctcttcctagatctcaaaaaaggaagcataagaaaaaaggatgtatgaaatggttttttaacattcttggcttattgctaatgactgtgcttatggggttagggttgatgtttgcaaaaggggtttttgatatttctactaataaagctaattacaaaccagctgtttcccaagcttttgatggtcaagaaactcaagatggtacgaacattctgattttgggttctgaccaacgagttactcaaggttctacagatgctcgcacagataccattatggttgtcaatgtcggcaaccatgctaaaaaaataaaaatggtctcttttatgcgtgacactttgattaacattccaggatacagttataatgataattcgtatgatcttaaattaaatagtgcatttaatcttggagagcaagaagatcaccacggagcagagtacgttcgacgggccttaaaacataattttgatatcgacattaagtattatgtgatggtagattttgaaacatttgcagaagctattgacaccttgtttccaaatggtgttaagattgatgccaaatttgcgacagtaggtggtgtagctgttgactccgtagaagttccagatgacttgcgaatgaaaaatggggttgttcccaaccaaaccatcgaagttggagaacaacgcatggatggtagaaccttgctcaactatgctcgtttccgtaaagatgacgaaggagatttcggacgaaccgtccggcagcaacaggttatgtcagctgttatgtcccaaatcaaagacccaactaaactctttacagggtctgcggctattggtaaaatctatgcgctgacttcgaccaatgtttctttcccatttgttgttaaaaatggtgtttctgttttaggaagtgggaaaaatggagttgagcacgtgaccatcccagaaaatggggattgggttgacgaatacgatatgtatggaggacaagccctttacatagattttgataagtatcagaaaacgttagccaaattaggtctgcgc

SEQ ID NO: 3950 - protein, 483 aa, Streptococcus pyogenes
MTKYPMGGLSHHEELRYFYLLRNLSYLSENEKKEFAFLKSKLEIGRAYAPSKQHYRKSKRQEPYFEDDYYNDYSPNDLLEDDDVNHDSSFVPYGLPIYPKEDRYLNKKTKLTARRPIDAPQPIDEDDAFLTESVARCALPRSQKRKHKKKGCMKWFFNILGLLLMTVLMGLGLMFAKGVFDISTNKANYKPAVSQAFDGQETQDGTNILILGSDQRVTQGSTDARTDTIMVVNVGNHAKKIKMVSFMRDTLINIPGYSYNDNSYDLKLNSAFNLGEQEDHHGAEYVRRALKHNFDIDIKYYVMVDFETFAEAIDTLFPNGVKIDAKFATVGGVAVDSVEVPDDLRMKNGVVPNQTIEVGEQRMDGRTLLNYARFRKDDEGDFGRTVRQQQVMSAVMSQIKDPTKLFTGSAAIGKIYALTSTNVSFPFVVKNGVSVLGSGKNGVEHVTIPENGDWVDEYDMYGGQALYIDFDKYQKTLAKLGLR

SEQ ID NO: 3951 - DNA, 510 bp, Streptococcus agalactiae
atgcctaaggtattattgggattcatgggagttggcaagactagtgttgccaactgcttagaaaatgaagtaattgatatggatagtctgattgaaaaacatattggtatgtcaatttcccgattttttacagaagaaggagaagcctcctttcgtgctttagaatctcaatttttaaacgaacttttaaagaaaaaaaatgaaggacttgtgatagctagtggaggaggtattgtactccttgaagaaaatcgtcgtcttttaactttaaatcgtcataataatattcttttaacaggaagttttgaagtcttatatcatcgtataaaaaaagatgagaagaatagaagaccattatttttaaaccattcaaaagaagaattttatgatatttatcaaaaacgcatgttactctatagtggtttgtctgatatgattattgataccgattatcttacaccacaaaaaatagctactgtaattggagagtcactggttaatttatctaac

SEQ ID NO: 3952 - protein, 170 aa, Streptococcus agalactiae
MPKVLLGFMGVGKTSVANCLENEVIDMDSLIEKHIGMSISRFFTEEGEASFRALESQFLNELLKKKNEGLVIASGGGIVLLEENRRLLTLNRHNNILLTGSFEVLYHRIKKDEKNRRPLFLNHSKEEFYDIYQKRMLLYSGLSDMIIDTDYLTPQKIATVIGESLVNLSN

SEQ ID NO: 3953 - DNA, 489 bp, Streptococcus pyogenes
atgactaaagtgttattgggatttatgggagtggggaaaacaacggtttcgaaacacctaagtatgcactgtaaagatatggatgctattattgaagctaaaatcggtatgtctattgcagctttttttgaacagcatggagaaatagcatttcgaacaattgaaagtcaagtgttaaaagatctattgtttgcaaatgataatagtatcatcgtaacaggtggcggtgtagtggttttacaagaaaatcgacaattactgagaaaaaatcaccagcataatattttattggtagcttcttttgaaactttgtaccagcgtttaaaacatgataaaaagtctcaaagacctctatttcttaagtactctaaggaagcattttatgaattttatcaacaacgtatggtattttatgagggactttcagatttagtaatcagagttgaccatcgtacgcctgaagaagttgccaacatcattgagggttat

SEQ ID NO: 3954 - protein, 163 aa, Streptococcus pyogenes
MTKVLLGFMGVGKTTVSKHLSMHCKDMDAIIEAKIGMSIAAFFEQHGEIAFRTIESQVLKDLLFANDNSIIVTGGGVVVLQENRQLLRKNHQHNILLVASFETLYQRLKHDKKSQRPLFLKYSKEAFYEFYQQRMVFYEGLSDLVIRVDHRTPEEVANIIEGY

SEQ ID NO: 3955 - DNA, 1293 bp, Streptococcus agalactiae
ttgggagttatcatgaaattactgactaatgcaaatactctcaagggaaccatccgtgttcctggcgataaatcaataagtcacagggctattatttttgggagtatatctcagggagttacccgaattgttgatgtcttaagaggcgaggatgttttatcaactatagaggcttttaaacaaatgggggttctaattgaagacgatggcgagataatcactatctatggcaaaggatttgcaggtttaacacaaccgaataatctcttagacatgggaaactctggtacttcaatgcgtctgatagcaggtgtgttagctggtcaagagtttgaagtgacgatggttggagacaatagtttgtcaaagagacctatggatcgtatagcattgcctttaagcaaaatgggagctagaatttcgggagtaactaaccgtgatttaccaccattaaaacttcaaggtacaaaaaaattaaaacctattttttaccatttacccgtagcttctgcacaagtaaaatcagctttaatttttgcggctttacaaactaagggagaatctctcattgtagaaaaagagcaaacaaggaatcatactgaggacatgattcggcaatttggtggacatttggatattaaagataaagaaattcgactcaatggcggtcagagcttagtaggacaagatataagagttcctggtgatatttcgagtgctgccttttggatagtagcgggtcttattattcctaacagtcatattattttagaaaacgtaggtataaacgagacacgaactggaatccttgatgtcgtcagtaaaatgggtggaaaaattaagttatcttcggttgataatcaagtaaaatcagcaacccttacagttgattactctcatctacaagctactcatatttctggggctatgattccacgtctgattgatgaattacctattattgctcttttagcaacacaagctcaaggcaccacagtcatagcagatgctcaggaattaaaggtgaaagagacagatcggattcaggtcgttgtcgaatcgctaaaacagatgggtgctgatattactgctacagcagatggtatgattatacgtggtaatacccctcttcacgctgcttcacttgattgtcatggagatcatagaataggaatgatgatagctattgctgctctcttggtcaaagaaggcgaagtagatttatctggtgaagaagctattaatacaagctatcctaactttttagaacatttggagggattagttaatgcc

SEQ ID NO: 3956 - protein, 431 aa, Streptococcus agalactiae
MGVIMKLLTNANTLKGTIRVPGDKSISHRAIIFGSISQGVTRIVDVLRGEDVLSTIEAFKQMGVLIEDDGEIITIYGKGFAGLTQPNNLLDMGNSGTSMRLIAGVLAGQEFEVTMVGDNSLSKRPMDRIALPLSKMGARISGVTNRDLPPLKLQGTKKLKPIFYHLPVASAQVKSALIFAALQTKGESLIVEKEQTRNHTEDMIRQFGGHLDIKDKEIRLNGGQSLVGQDIRVPGDISSAAFWIVAGLIIPNSHIILENVGINETRTGILDVVSKMGGKIKLSSVDNQVKSATLTVDYSHLQATHISGAMIPRLIDELPIIALLATQAQGTTVIADAQELKVKETDRIQVVVESLKQMGADITATADGMIIRGNTPLHAASLDCHGDHRIGMMIAIAALLVKEGEVDLSGEEAINTSYPNFLEHLEGLVNA

SEQ ID NO: 3957 - DNA, 1290 bp, Streptococcus pyogenes
atgaaacggatgaaattgcgaacaaatgcaggaccattacagggaacgattcaagttccaggagacaagtccattagtcaccgggcagtcatattaggagccgttgctaaaggggaaacacgagtaaaaggactcttaaaaggagaagatgtgctttccacgattcaagcctttaggaatttgggggtccgtatcgaagaaaaagatgaccagcttgtgatagaaggtcaaggttttcaaggattgaacgctccttgtcagacacttaatatgggaaattctggaacctctatgcgcctcattgctggcttattggcaggtcaaccttttagtgtcaaaatgattggcgatgaaagcttatccaaacgtcctatggatcggattgtttatccgttaaagcaaatgggggttgagatatctggagaaacagataggcaatttcctccactacaattgcaaggtaatcgtaatttacaaccaatcacatataccttgcctatctcttctgctcaggttaagtcagctattttattagcagctttgcaagcaaaaggaacaacacaggttgttgaaaaagagattactcgaaaccatacagaagaaatgattcaacaatttggtggacgattgatagttgatggtaaacgcattactttggtgggaccccagcagctcactgctcaagagataactgtccccggagatatttctagtgcagctttttggcttgtcgccggcttaattattcctggttcggagctccttttaaagaatgttggagtcaatccgacacgaacagggattcttgaagtggttgaaaaaatgggagcacagattgtctatgaagatatgaataagaaagagcaagtaactagtattcgagtggtatattctaacatgaaaggaactatcatatcaggaggtcttatccctcgattgattgatgaactgcccatcattgcacttcttgcaacccaagcacaaggaacaacctgtattaaagatgctcaagaattacgagtcaaagaaacagatcgtattcaagtagtaactgatattcttaacagtatgggagctaatatcaaagcgacagcagatggcatgattatcaaaggccctacggtactatatggggctaacacaagtacctatggagatcatcgtattggtatgatgacagcaattgcagccttgcttgttaaacaaggacaggtccatttggataaagaagaagccatcatgacgtcttatccaacgtttttcaaagatttagaaaggctgtgtcatgac

SEQ ID NO: 3958 - protein, 430 aa, Streptococcus pyogenes
MKRMKLRTNAGPLQGTIQVPGDKSISHRAVILGAVAKGETRVKGLLKGEDVLSTIQAFRNLGVRIEEKDDQLVIEGQGFQGLNAPCQTLNMGNSGTSMRLIAGLLAGQPFSVKMIGDESLSKRPMDRIVYPLKQMGVEISGETDRQFPPLQLQGNRNLQPITYTLPISSAQVKSAILLAALQAKGTTQVVEKEITRNHTEEMIQQFGGRLIVDGKRITLVGPQQLTAQEITVPGDISSAAFWLVAGLIIPGSELLLKNVGVNPTRTGILEVVEKMGAQIVYEDMNKKEQVTSIRVVYSNMKGTIISGGLIPRLIDELPIIALLATQAQGTTCIKDAQELRVKETDRIQVVTDILNSMGANIKATADGMIIKGPTVLYGANTSTYGDHRIGMMTAIAALLVKQGQVHLDKEEAIMTSYPTFFKDLERLCHD

SEQ ID NO: 3959 - DNA, 1062 bp, Streptococcus agalactiae
atgaaaagaaaacagtttataaaattaggaattgcaaccttactaacggttatttcgctttacacaccaataaacctagctacaaatcataccacagaaaatattgttactgctcaagagtataaaacaaaagagaatggtactttaccttttaaacacaaacgacaattggttttaggagagttggatgacaaaggtcgtgccacattcgcacatattcagctaaaagttaaagatgaacccaagaaaaagagagtaaaacgtttaaaaacaacccctgttggatggcacaattttaaattctattataatgatggtactcaaaaagcttggctaatgagccgaggccgtcttatttgccaccaatttagtggactaaacaatgaaagaaagaatttagttccaatgacgaattggctaaatactggaaactacaatagcacgaattcatctaaccctgagagcatgctattctatgaaaaacaactaaagacttggctttcgactcataaaaactactacttagattataaagtaacaccaatttatcaaaataatgaactaattccaagaaaaattgaattaaaatatgttggtattgataagactgggaaattattacctatttttatcggaaacaaatccactcaagatcaattcggcatcagcactgttaccttagagaatacctcaccaaatgctaccattgactacctcagcggaaaggctcaaaatactgtcttatcagctaaagaacaaagaaaacttatcgctaagcacgaagaagaaaaacgacttgcagaaaagaaagttgaagaggaaaaagctgctgctgaaactcagaaaaaactggaagaagaacaagcaaggcttgctgctgaagctcaaaggaagcaaaaagaggagcaagcaaggctcgcagctgaaactcagaaaaaacaagaaactctagtacaagaacaaactagtcaaggctacaaacgtgactatagaggaaggtggcatcgtccaaatggacaatacgcttcaaaagcagaaatcgctgctgctggattgcaatgg

SEQ ID NO: 3960 - protein, 354 aa, Streptococcus agalactiae
MKRKQFIKLGIATLLTVISLYTPINLATNHTTENIVTAQEYKTKENGTLPFKHKRQLVLGELDDKGRATFAHIQLKVKDEPKKKRVKRLKTTPVGWHNFKFYYNDGTQKAWLMSRGRLICHQFSGLNNERKNLVPMTNWLNTGNYNSTNSSNPESMLFYEKQLKTWLSTHKNYYLDYKVTPIYQNNELIPRKIELKYVGIDKTGKLLPIFIGNKSTQDQFGISTVTLENTSPNATIDYLSGKAQNTVLSAKEQRKLIAKHEEEKRLAEKKVEEEKAAAETQKKLEEEQARLAAEAQRKQKEEQARLAAETQKKQETLVQEQTSQGYKRDYRGRWHRPNGQYASKAEIAAAGLQW

SEQ ID NO: 3961 - DNA, 756 bp, Streptococcus pyogenes
atgaaattatctaaacaaaaggcaagtttgcttaccgctgttttactgttactttctctttctataacgacaataactgttgacgcagctagggtacgaacttatccgaatgtatcccatgcaaacacacattataaaaatactgtttctagtaagctcttaccttttactgctaattatcagttacaacttggtgagttggataaccttaaccgcgctaccttttcacatatccaactgcaagatagacacgaaactaaagatgtacgcactaaaataaattatgaccctgtgggatggcacaactatcaatttccatacggagatggctcaaaatcttcatgggtaatgaatcgtgggcatctagtcggatatcaattttgtggattaaacgatgaaccaagaaatttagtggcaatgacagcctggctaaacacaggtgcttattcaggagcaaatgacagcaatcctgaagggatgttatactatgaaaaccgtttagattcttggcttgcacttcaccctgacttttggctagattataaagtcactcctatatatagtggcaatgaagtagtgcctcgacaaattgaattacagtatgttggaattgattcatctggtgagttgcttactataaggctaaatagtaataaagaaagtattgatgaaaatggtgttactacagtaatcttagaaaactctgctccaaatatcaaccttgactatttaaatggaactgccactcctaaaaac

SEQ ID NO: 3962 - protein, 252 aa, Streptococcus pyogenes
MKLSKQKASLLTAVLLLLSLSITTITVDAARVRTYPNVSHANTHYKNTVSSKLLPFTANYQLQLGELDNLNRATFSHIQLQDRHETKDVRTKINYDPVGWHNYQFPYGDGSKSSWVMNRGHLVGYQFCGLNDEPRNLVAMTAWLNTGAYSGANDSNPEGMLYYENRLDSWLALHPDFWLDYKVTPIYSGNEVVPRQIELQYVGIDSSGELLTIRLNSNKESIDENGVTTVILENSAPNINLDYLNGTATPKN

SEQ ID NO: 3963 - DNA, 1305 bp, Streptococcus agalactiae
atgtcaattattactgatgtttacgcacgcgaagtccttgactcacgcggtaacccaacacttgaagtagaagtttatacagaatcaggtgctttcggacgtggtatggttccttcaggagcttctactggtgaacacgaagcagttgaacttcgcgacggcgacaagtctcgttacggtggtcttggaacacaaaaagctgttgacaatgtaaataacgttattgcagaagcaatcattggttatgatgtacgcgaccaacaagctatcgaccgtgctatgatcgctcttgacggaactcctaataaaggtaaattaggtgcaaatgctattcttggtgtttctattgccgtagcacgtgctgcagctgattaccttgaagtaccactttacagctaccttggtggattcaacactaaagttcttccaactccaatgatgaacatcatcaacggtggttctcactcagacgctccaatcgcattccaagaattcatgattatgccagttggtgcaccaactttcaaagaagcacttcgttggggtgctgaagtattccatgctcttaagaaaatccttaaagaacgtggtcttgaaacagctgttggtgatgaaggtggatttgcacctaaatttgaaggtactgaagatggcgtagaaactattcttaaagctattgaagcagctggttacgaagctggcgaaaacggaatcatgattggttttgactgtgcttcatcagagttctacgatgcagaacgtaaagtatacgactacagtaaattcgaaggtgaaggtggagcagttcgtactgctgcagaacaaatcgattaccttgaagagttggttaacaaatacccaatcatcactattgaagatggtatggatgaaaacgactgggatggttggaaagctcttacagaacgccttggtggacgtgtacaattagttggtgacgatttcttcgttacaaatactgattacttagcacgtggtatcaaagaagaagctgctaactcaatccttatcaaagttaaccaaatcggtactttgacagaaactttcgaagctattgaaatggctaaagaagctggttacactgcagttgtatcacaccgttcaggtgaaactgaagattcaacaatcgctgatatcgcagttgcaactaacgctggtcaaattaaaacaggttcattatcacgtactgaccgtattgctaaatacaaccaattacttcgtatcgaagaccaacttggtgaagttgctcaatacaaaggtatcaaatcattctacaacttaaaaaaa

SEQ ID NO: 3964 - protein, 435 aa, Streptococcus agalactiae
MSIITDVYAREVLDSRGNPTLEVEVYTESGAFGRGMVPSGASTGEHEAVELRDGDKSRYGGLGTQKAVDNVNNVIAEAIIGYDVRDQQAIDRAMIALDGTPNKGKLGANAILGVSIAVARAAADYLEVPLYSYLGGFNTKVLPTPMMNIINGGSHSDAPIAFQEFMIMPVGAPTFKEALRWGAEVFHALKKILKERGLETAVGDEGGFAPKFEGTEDGVETILKAIEAAGYEAGENGIMIGFDCASSEFYDAERKVYDYSKFEGEGGAVRTAAEQIDYLEELVNKYPIITIEDGMDENDWDGWKALTERLGGRVQLVGDDFFVTNTDYLARGIKEEAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 3965 - DNA, 1305 bp, Streptococcus pyogenes
atgtcaattattactgatgtatacgctcgcgaagtccttgactcacgcggtaacccaacacttgaagtagaagtttatacagaatcaggtgcattcggacgtggtatggttccttcaggagcttcaactggtgaacatgaagccgttgaacttcgtgatggtgacaaatctcgttaccttggtctaggtactcaaaaagcagttgataacgttaataacattatcgctgaggcaatcatcggttacgatgttcgcgatcaacaagctatcgaccgtgcaatgatcgctcttgacggtactcctaacaaaggcaaacttggtgctaatgctattcttggtgtttctatcgctgttgctcgtgcagctgctgactatcttgaagtgccactttacacttaccttggcggattcaacactaaagttcttccaactcctatgatgaacatcatcaacggtggatcacactcagatgccccaattgcattccaagagttcatgatcatgccagttggtgcacctactttcaaagaaggtcttcgttggggtgctgaagttttccacgctcttaagaaaattcttaaagaacgcggacttgttacagctgtaggtgacgaaggtggatttgctcctaaatttgaaggaactgaagacggtgtagaaactatccttaaagctattgaagcagctggttacgaagctggtgaaaacggcattatgatcggttttgactgtgcatcatcagaattctacgacaaagaacgtaaagtttacgactatactaaatttgaaggtgaaggcgctgctgttcgtacatctgcagaacaagttgattaccttgaagagttggttaacaaatacccaattattactatcgaagatggtatggatgaaaacgactgggatggttggaaagttcttactgaacgcctaggcaaacgtgttcaattggttggtgacgacttcttcgttacaaacactgaataccttgctcgtggtatcaaagaaaatgcagctaactcaatccttatcaaagttaaccaaatcggtactttgactgaaacgtttgaagctatcgaaatggctaaagaagctggatatactgccgttgtatcacaccgttcaggtgaaactgaagattcaacaatcgctgacatcgcagttgcaacaaacgctggccaaatcaaaacaggttcattgtcacgtacagaccgtattgctaaatacaaccaattacttcgtatcgaagatcaacttggtgaagttgctcaatacaaaggtatcaaatcattctataacttaaaaaaa

SEQ ID NO: 3966 - protein, 435 aa, Streptococcus pyogenes
MSIITDVYAREVLDSRGNPTLEVEVYTESGAFGRGMVPSGASTGEHEAVELRDGDKSRYLGLGTQKAVDNVNNIIAEAIIGYDVRDQQAIDRAMIALDGTPNKGKLGANAILGVSIAVARAAADYLEVPLYTYLGGFNTKVLPTPMMNIINGGSHSDAPIAFQEFMIMPVGAPTFKEGLRWGAEVFHALKKILKERGLVTAVGDEGGFAPKFEGTEDGVETILKAIEAAGYEAGENGIMIGFDCASSEFYDKERKVYDYTKFEGEGAAVRTSAEQVDYLEELVNKYPIITIEDGMDENDWDGWKVLTERLGKRVQLVGDDFFVTNTEYLARGIKENAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 3967 - DNA, 186 bp, Streptococcus agalactiae
atgacaatagcccaactcattgttaaccaaagagggcttactttagcgttaactccaaagagtaaacctggtagcatcatccataagaatgaagctccagcaaagaaaagtccatacgcaaattttttaggtgatgaaggttgcttacttccccatttagcccataaccaagcaaagaatggtaca

SEQ ID NO: 3968 - protein, 62 aa, Streptococcus agalactiae
MTIAQLIVNQRGLTLALTPKSKPGSIIHKNEAPAKKSPYANFLGDEGCLLPHLAHNQAKNGT

SEQ ID NO: 3969 - DNA, 1080 bp, Streptococcus agalactiae
atggttggtaatttatatggagaaaatgattctcgtcgtgatgctggttttagtatctttgtttttggtattaaccttggtgcttttatttcacccattgtagtggggtacctcggacaagaagtaaatttccatcttggtttctcacttgctgctattggtatgttctttggtctcctccaatataccttagatggaaaaaaatatttgactgaagagagtctcagaccaaacgatcctttaagtcctgaagaaaagtcctctctatataaaaaagttgggcttatccttattggtattgttattgtacttattctacttcacttgatgcatatgctaacaattgaagtaattatcgatatttttagtattattgcaatcgccatcccaattatttattttatcaagattttaagtagtaaaaagatttcttctgttgagcgttctcgagtgtgggcatatatccctctctttatcgcctcaattctattttggtcaattgaagaacaaggttcagttgtcttagccttatttgcagatgaacaaacaaaactttaccttaacttctttgggcatcatattaatttcccatcaagttatttccaaagtatgaaccctctcttcattatgctttatgtaccattctttgcttggttatgggctaaatggggaagtaagcaaccttcatcacctaaaaaatttgcgtatggacttttctttgctggagcttcattcttatggatgatgctaccaggtttactctttggagttaacgctaaagtaagccctctttggttaacaatgagttgggctattgtcatcgttggggaaatgctaatctcaccagttggattatcagcaactagtaagctcgcacctaaagcattccaagctcaaatgatgagcatctggttcttaagtaatgctgcagcacaagctattaacgctcaaatcgttaaattgtacacacctgatactcaaactctttattatggtgttgttggtggtataacagttgtatttggatttatcctcttattttatgttccacgcattgaaaaactaatgtctggagttaaa

SEQ ID NO: 3970 - protein, 360 aa, Streptococcus agalactiae
MVGNLYGENDSRRDAGFSIFVFGINLGAFISPIVVGYLGQEVNFHLGFSLAAIGMFFGLLQYTLDGKKYLTEESLRPNDPLSPEEKSSLYKKVGLILIGIVIVLILLHLMHMLTIEVIIDIFSIIAIAIPIIYFIKILSSKKISSVERSRVWAYIPLFIASILFWSIEEQGSVVLALFADEQTKLYLNFFGHHINFPSSYFQSMNPLFIMLYVPFFAWLWAKWGSKQPSSPKKFAYGLFFAGASFLWMMLPGLLFGVNAKVSPLWLTMSWAIVIVGEMLISPVGLSATSKLAPKAFQAQMMSIWFLSNAAAQAINAQIVKLYTPDTQTLYYGVVGGITVVFGFILLFYVPRIEKLMSGVK

SEQ ID NO: 3971 - DNA, 189 bp, Streptococcus agalactiae
atgtcacgcagtcaaaaagttattttaactaatatgtgtcttattgaagataataaaggacgtattgtgatgcaaatccgtgatcctaaacgttattcttggtcaggagctgctttaccaggcggccatattgaagaaggagaatgctctcgttcgagaagttcacgaggagacaggtttaacaataag

SEQ ID NO: 3972 - protein, 63 aa, Streptococcus agalactiae
MSRSQKVILTNMCLIEDNKGRIVMQIRDPKRYSWSGAALPGGHIEEGECSRSRSSRGDRFNNK

SEQ ID NO: 3973 - DNA, 1323 bp, Streptococcus agalactiae
atgattaacttatttgatagttacactcaatcaagttgggatttacatttttccttgataaaatcaggttatattaaccctactatagctttgaatgatgatggttttttaccagacgacgtaacatcaccctatttatattacactggttttgcaaagacaggtgctggccgcccactttactacaatgaacttagagttcctgatacatgggaaattattggttttagtagtggtgctgatattgttgacttaggtgtcaaaaagggcagaattatttatgcaaacccaaatcataagcgtctaataaaagaggtagactggtttgatgagcaaggtagagtcattttaaaagatcgctttaataagtttgggttctgttttgcacaaaccttttataacgcggatggtcaagcgattcagacgtcatattataataaggataggcaagaggttatatcagagaaccatatgacaggggattatattttaaatgataataatcagtttaaggtttttaaatctaaagttgaatttgtcataaattatcttcaagaagcaaaatttaacttagatagaatcttctataattctctgtcaacaccatttttagtaagcttttaccttaatcgtctagagagtaaagatgttctcttttggcaggagcctctcgtagatgatattccaggaaatatgcgcttattattgaacaatccttccccaaacactaaaattgtaattcaaagttatgaagcttatgctaatgctatgaggttattaactgacgaagaacaaaaacaagttagctttttaggatttatgtatcctcttaaagagacagaaaaattacataaccaagctcttattttgacgaattctgatcaaatcgaagcattagaaagtttagtgacttctcttcctaatttgacttttaacataggtgctttgaccgagatgtctagtgatctcatgaattttggcaaatatgataatgttgtactctacccaaatatcacaacaaatcaaatacaatatttatcaaatatttgtgctttttatcttgatattaatcatcataatgagatattatcagcagttcgctctgcttttgaacatcaacagttaatttttgctttcgaagagactagtcatcaaattcgttttgtatcacctaaaaatatttttccaaaaaaagatatttttacatttatttcgcacttgcagccactaattggcaataaatgtaatatagaaaaagcattaaaacagcagcttgaagattgtcatgtttcaagctctactcagtatcaatctgtaattaat

SEQ ID NO: 3974 - protein, 441 aa, Streptococcus agalactiae
MINLFDSYTQSSWDLHFSLIKSGYINPTIALNDDGFLPDDVTSPYLYYTGFAKTGAGRPLYYNELRVPDTWEIIGFSSGADIVDLGVKKGRIIYANPNHKRLIKEVDWFDEQGRVILKDRFNKFGFCFAQTFYNADGQAIQTSYYNKDRQEVISENHMTGDYILNDNNQFKVFKSKVEFVINYLQEAKFNLDRIFYNSLSTPFLVSFYLNRLESKDVLFWQEPLVDDIPGNMRLLLNNPSPNTKIVIQSYEAYANAMRLLTDEEQKQVSFLGFMYPLKETEKLHNQALILTNSDQIEALESLVTSLPNLTFNIGALTEMSSDLMNFGKYDNVVLYPNITTNQIQYLSNICAFYLDINHHNEILSAVRSAFEHQQLIFAFEETSHQIRFVSPKNIFPKKDIFTFISHLQPLIGNKCNIEKALKQQLEDCHVSSSTQYQSVIN

SEQ ID NO: 3975 - DNA, 1506 bp, Streptococcus agalactiae
atgacagtttataatataaaccatggaattggttgggcaagcagcggtgttgagtacgctcaagcataccgaggttctgttttgagaaaacttggaattgatgctaagtttatttttacagattttttttcagctgataatattattagcctcacgcgaaatataggttttcaggataaagaaattatttggttatataattttttttcagatattgagcttgccccgacaacttttagtatagaagatttgcaaaaacaatatcttggaaaacttgttcgaaaagaagataaaggtcgggtaatcaagtttttctacgaagatgaaaatatctatttaacagtttaccttgataattttaacaaggataaagtgcatcgtgtagaaatcgtttcaaataacaaccttatcagaaaagattattatagttatacacgtactttctcagagtattactatcctaaagatggtgtagctcacctttatcaacgtagattctacaatgaagatgaaagtacagcctttttggagatggtagaaaatagctcaagtcgttttattatcaatggcagacttttaccatccaaagtagctttttttgattattttttggaatcaatgactttcacttcaaaagatattattcttttggatagaggaactgataccgctcagagtcttttgcgccatggtaaacccgctaagctagggactgttgttcatgcggaacattttagtgagaatgctgtgactgctgacactattttatggaataactattacgattatcagtttactaacgctaatagatttgatttttttattacctccactgataaacaaacagaacttttggaacaacaatttaaacaatttacaaatcataatcctagaattataactatcccggtaggctcaattgacaatcttaaaatgccaatggacaatcgccgtccgtactctattttgacagcttcacgcctagctagtgaaaaacatgtagattggttagtacgtgcagttattaggataagagaaattcttcctgaagtgacctttgatatctatggatcaggtggagaagaagaaaaaattagaaatattataaatgcagccaatgcaacggaatacattcgattgatgggacataaaaatctctcgaatgtttatcaaaattatgagttatatttgacagcttctaaaagtgaggggtttggcttaactttacttgaagctattggcgcaggacttcctttgattgggtttgatgttcgttatggtaatcaaacttttatcaaagacggagaaaatggttatctaattcctcgatttgatatggatgatgaggaagctattgtagaagcttttaaagagaaagtgttacaattattccaacaggatcaaaaggctttacgagaagcttcttacgccattgccgaaggattcttaacaaatgaagtagaaggaaaatggtataacttagttaaggagttggtacaagatgat

SEQ ID NO: 3976 - protein, 502 aa, Streptococcus agalactiae
MTVYNINHGIGWASSGVEYAQAYRGSVLRKLGIDAKFIFTDFFSADNIISLTRNIGFQDKEIIWLYNFFSDIELAPTTFSIEDLQKQYLGKLVRKEDKGRVIKFFYEDENIYLTVYLDNFNKDKVHRVEIVSNNNLIRKDYYSYTRTFSEYYYPKDGVAHLYQRRFYNEDESTAFLEMVENSSSRFIINGRLLPSKVAFFDYFLESMTFTSKDIILLDRGTDTAQSLLRHGKPAKLGTVVHAEHFSENAVTADTILWNNYYDYQFTNANRFDFFITSTDKQTELLEQQFKQFTNHNPRIITIPVGSIDNLKMPMDNRRPYSILTASRLASEKHVDWLVRAVIRIREILPEVTFDIYGSGGEEEKIRNIINAANATEYIRLMGHKNLSNVYQNYELYLTASKSEGFGLTLLEAIGAGLPLIGFDVRYGNQTFIKDGENGYLIPRFDMDDEEAIVEAFKEKVLQLFQQDQKALREASYAIAEGFLTNEVEGKWYNLVKELVQDD

SEQ ID NO: 3977 - DNA, 2385 bp, Streptococcus agalactiae
atgatagcctttaatagtttattttcgttagataagaaacgtttaaaaaaacttcagcgtactttaaatactatcaatagtttaaagggccaaatggcaacactatcaaatgaggagttgcaagctaagacaactgaatttagaaaacgtttagttaatggggaaacactagatgatatttgtgctgaagcttttgctgttgttagggaagctgatgagcgcgtattaggtctatttccgtatgatgtacaggtaatcggtggtcttgttctgcaccaaggaaatactgctgagatgaaaactggtgaaggaaaaacattaactgccactatgcctttgtatctcaatgctttagaagggaagggggcaatgttgctgactaataattcctaccttgctattcgagatgcggaagaaatgggaaaagtatatcgttttttaggattgagtgtcggtgtgggagtttctgataatgaggaagaggatagagatgctgcgactaagcgagctgtttatagttcggatattgtctatagtacaagtagtgcactaggctttgattatttaattgataacctagcttcatctaaatctcaaaaatatatgcccaagttacattatgctattgtagatgaagctgatgcagttcttctagatatggcccagactcctttagttatttcaggttcacctcgagtacaatctaatctctataaaatagcagatgaactaattcttagttttgaagaacaagttgattattattttgacaaagagcgtcaggaagtgtggataaaaaaccagggtgttcgtgaagctgagagatattttagaatccctcatttttataaacagtctaatcgagaacttgtgcgacatttgaacttatctttaaaagcacataaattatttgaacgaggaaaagattatgtggttgacgatggtgaaatcaagttgctagatgcgactaatggccgtgttttagaaggtactaaacttcaaggaggtgttcatcaagctattgagcaaaaagagcatcttaatgtcacaccagagtctcgagcaatggcttccattacctatcaaaatctttttagaatgtttactaaattggctggaatgacaggaactggaaaaactgctgaaaaagagtttattgaggtctatgatatggaagtagttagaattccaactaattctcctgttagacgaattgactatcctgataagatttatacaaccttaccagagaaaatccatgcaacgattgaatttgttaaacaggttcatgatacaggacaaccaatcctactagttgccggttctgtgagaatgtcagagctattctcagaattattattactaagtggtatccctcatagcctgttaaatgctcaaagtgcggttaaggaagcacagatgattgcagaagcagggcaaaaaggtgcggtcactgttgcaacgaatatggctggtcgtggtacagatattaagttaggtaagggagtatcagaattaggtggtcttgcagttattggaacggagagaatgaagagtcaaagaatggatttacaattaaggggacgttcgggtcgacaaggcgatattggttttagtcaattttttgtatcatttgaagatgatctaatgatagaatcaggtcctaaatgggcgcaagattactttaggaaaaatcgtgacaaagttaatccagaaaaacctaaagccttaggtcagagaagatttcagaagttattccagcaaactcaggaagctagtgacggtaagggagagtctgcacgtagtcaaacgatagagtttgattcgagtgtacagcttcagcgagagtatgtttatcgtgagagaaatgctttgatcaatggagaaagtggacattttagtccaagacagattattgatacagtgatttcttccttcattgcttatttagatggtgaagtagaaaaagaagaactcatttttgaagtaaatcgttttatatttgataatatgtcttacaatcttcaagggatttctaaagagatgtcacttgaagaaattaaaaactatttattcaaaatagccgatgagattcttcgagaaaagcataatttgcttggtgatagttttggtgactttgaacgtactgctgctttaaaagcgattgatgaagcttggattgaagaagtagattatctacaacaattacgtactgtggcaacagctcgtcaaacggcacagcgtaacccggttttcgaatatcataaagaagcatataaatcctacaatatcatgaaaaaagaaattcgtgaacaaacttttagaaatctacttttgagtgaagtatccttcaatgagaatggagatcttcaaatttattttata

SEQ ID NO: 3978 - protein, 795 aa, Streptococcus agalactiae
MIAFNSLFSLDKKRLKKLQRTLNTINSLKGQMATLSNEELQAKTTEFRKRLVNGETLDDICAEAFAVVREADERVLGLFPYDVQVIGGLVLHQGNTAEMKTGEGKTLTATMPLYLNALEGKGAMLLTNNSYLAIRDAEEMGKVYRFLGLSVGVGVSDNEEEDRDAATKRAVYSSDIVYSTSSALGFDYLIDNLASSKSQKYMPKLHYAIVDEADAVLLDMAQTPLVISGSPRVQSNLYKIADELILSFEEQVDYYFDKERQEVWIKNQGVREAERYFRIPHFYKQSNRELVRHLNLSLKAHKLFERGKDYVVDDGEIKLLDATNGRVLEGTKLQGGVHQAIEQKEHLNVTPESRAMASITYQNLFRMFTKLAGMTGTGKTAEKEFIEVYDMEVVRIPTNSPVRRIDYPDKIYTTLPEKIHATIEFVKQVHDTGQPILLVAGSVRMSELFSELLLLSGIPHSLLNAQSAVKEAQMIAEAGQKGAVTVATNMAGRGTDIKLGKGVSELGGLAVIGTERMKSQRMDLQLRGRSGRQGDIGFSQFFVSFEDDLMIESGPKWAQDYFRKNRDKVNPEKPKALGQRRFQKLFQQTQEASDGKGESARSQTIEFDSSVQLQREYVYRERNALINGESGHFSPRQIIDTVISSFIAYLDGEVEKEELIFEVNRFIFDNMSYNLQGISKEMSLEEIKNYLFKIADEILREKHNLLGDSFGDFERTAALKAIDEAWIEEVDYLQQLRTVATARQTAQRNPVFEYHKEAYKSYNIMKKEIREQTFRNLLLSEVSFNENGDLQIYFI

SEQ ID NO: 3979 - DNA, 990 bp, Streptococcus agalactiae
atgagtacgataagctacatttattgggatgatttttcaaggttttcttataattttggaacaaaattacaatttttaggaaaatcagtatgctttgaaaatccattagctccttctagcacaaacttgtatacatggagctcccagactaattatcagtcaaaaagaatttctcctaacttacctttactaagaaagggaactcgttatagcttgtcattaaatgcagaactcgatttagttagctctctttttgttcgcattgaattttacaatcgctttaatgagtctgttggttttgaactgttaaaaaaagatagtattatttttatctatcctaaagaggcttatacctataccattagtttgattaatgcaggttgtagcgattttacttttcattatttgaaacttgaggaagttacagatagcgttattcaggagaaaaatctatcgacagagtttactattgaagaacatcaagacgttttaaatcttcttttggtcgagaaaaaagatagtgtatatattaataaaatagaaagcatttctcaattgcaacagaaagtcgagttggtcagcaatccctcattaaattctgatagtttgatattacctgagttggaaaaggggttagaagatgcattaaaagtttttcctaacattaagattaatgtcattgcgtatggaacacaaggtaattttgctgctttatattatgctaaaaaatttcccagaataactgcctatattaatgattgttttgctcctttcggaattttacttaaatccttaccacacttgactgccaaacaacaaatatttcttagagaagtctgggatacgagagagacgtctccaaatgtaaagcactatggattggtttcagaaaattcctctttaaatttagtatcaatgatcttatctggtaatgaacatctaccttacctcacacttttaaaaaagcaggacgacaattatgatagcctt

SEQ ID NO: 3980 - protein, 330 aa, Streptococcus agalactiae
MSTISYIYWDDFSRFSYNFGTKLQFLGKSVCFENPLAPSSTNLYTWSSQTNYQSKRISPNLPLLRKGTRYSLSLNAELDLVSSLFVRIEFYNRFNESVGFELLKKDSIIFIYPKEAYTYTISLINAGCSDFTFHYLKLEEVTDSVIQEKNLSTEFTIEEHQDVLNLLLVEKKDSVYINKIESISQLQQKVELVSNPSLNSDSLILPELEKGLEDALKVFPNIKINVIAYGTQGNFAALYYAKKFPRITAYINDCFAPFGILLKSLPHLTAKQQIFLREVWDTRETSPNVKHYGLVSENSSLNLVSMILSGNEHLPYLTLLKKQDDNYDSL

SEQ ID NO: 3981 - DNA, 1557 bp, Streptococcus agalactiae
atgtcaaaaataaaacttacaattcttcaagttggtgaagagaactgggcaactaaagagaatatccctaataatatggaatggctctttattaaaccagatcaaatttctgactttgtaactacagaaaataattatcttacatcgtcaaagttattgcaaaaactacctcgaaaaatatctgctcttttgttgacagagcaaacttatggaccagagttatctagtttatcgtcattctttgaggtttatgaagtattttatcctaaagataaacatgctacggggataacagaagagtttttacgctcgaaaatggcccaacgatatgatagtagctctccagatcagctaattcgtcaattttataaagggctttttataggacaatacggagagaaacttcaagtttcacaaatacaaattagaaatgattttgaaggtgtagtaaactatcagggaaataactatcttgaattagaagggcaatttggtgagaactatagttttttgcttaattttgcttacaatattccattttcatcggatttttataatgagttatttttagaacacattatagagggtgatatagatattcgattggttatctcgttgattgttgatggttctgttgatgatattgctaaagagtggtactttgagaaggaagacctaaatcaacttatttctttagagtccgatattagtggtagccttgcagttaaactttttgctaagggaaagggtatcgttaagttaggtccattgcaccgtcgtaatggtagaggaggattgggcacatttctactaggaggagaacgtcacatagatgctataggtcatgaatttatgacttattttgatccagtagatttcaaaccacctctaactgtttatttttcgggatttcgttcagctgaaggctttgagggattctggatgatgaagagtatgaagactccattcatgttaatttgtgatccacgattacaaggtggtgccttttatataggaagcaaagaatatgaacaaaaaatagttgatgctattcaagaaaaactggcctttttaaattttagttctgatcagttaattttatccggactttcaatggggacttatggtgctacttaccatggtgctaagctaaatcctcatgctattattattggtaaaccaatatttaatttaggaacagttgctcaacgtgaaagattagagagaccagatggatttgctacttcattagatattcaactactcaatcaaggtgacttgaccagttcctcttctgagaagttaaataactatttttggaaatctatagaagaaggagatttttcaaatacgacttttgccttagcctatatgaaaaacgatgactatgatgcgactgccttttctgatttattgcaatattttagaggaaagaagcataagatattaggcagaggttgggatggccgacatggtgattgttctgcagaagttggtgcatggtttacaagtcagtataggcgaatgctatctaatgattttggaaggaaagaagaa

SEQ ID NO: 3982 - protein, 519 aa, Streptococcus agalactiae
MSKIKLTILQVGEENWATKENIPNNMEWLFIKPDQISDFVTTENNYLTSSKLLQKLPRKISALLLTEQTYGPELSSLSSFFEVYEVFYPKDKHATGITEEFLRSKMAQRYDSSSPDQLIRQFYKGLFIGQYGEKLQVSQIQIRNDFEGVVNYQGNNYLELEGQFGENYSFLLNFAYNIPFSSDFYNELFLEHIIEGDIDIRLVISLIVDGSVDDIAKEWYFEKEDLNQLISLESDISGSLAVKLFAKGKGIVKLGPLHRRNGRGGLGTFLLGGERHIDAIGHEFMTYFDPVDFKPPLTVYFSGFRSAEGFEGFWMMKSMKTPFMLICDPRLQGGAFYIGSKEYEQKIVDAIQEKLAFLNFSSDQLILSGLSMGTYGATYHGAKLNPHAIIIGKPIFNLGTVAQRERLERPDGFATSLDIQLLNQGDLTSSSSEKLNNYFWKSIEEGDFSNTTFALAYMKNDDYDATAFSDLLQYFRGKKHKILGRGWDGRHGDCSAEVGAWFTSQYRRMLSNDFGRKEE

SEQ ID NO: 3983 - DNA, 1542 bp, Streptococcus agalactiae
atgtttcattttattccatcttggtataatgaaaatcgtacttggtatgataataattacttgtggtatttcaagccgactaatgtcggttttgatgatactatcaaccaaatgaagatgtttgattatgctggaaaagagagtagattagttgtcttaaactatatgcccaatttacgttattatttacatcgctatgacttgttagaatcaggttattattcagtttttgatgatattcaagaaattgggaatgtaagacagcaaatgattgacttccgacaactcaattggcctgaaggggtggactttacctatactccgtttatagttttggtaaaaaagtcaggagatttaattgctaaggttcaatttggtgaagaaggaaatttaacgcatattgattattttgcaaatgaacaaatagctaagaaatacctctttgatgatagaggatttctatctagtattctctattatgataatggtggtgaagcctatcaagattatttagcaccatcaggggaaaggatcatgagagaatacctaagagaaggtgaccaccatgttgaaattaatcctaagaaagctattcattttttaaagttatcttactccgatattgaagagttgattagagagaaatatctgacctatctccataaagaagttagtaaatcagatactatcattgttagctttaatcaagttcataacgcatttattgttgggaacactagtaaaggaaatttaatattatctgttttctcggagaggaataatgctcacaatgtattggaggattactcttccttatctcgagcagacgctattatttgtgatagactagatattgctgcacaattgaaagaaaaaatagataaaccagttgttcatgtttctccctttgatacgcgtttagctttgggaaaaagtaatcaagttagagatttagaaatatattttgtcgtagatagactttcccataaagaattgcaaaagtctttaacatccttatataaggttatgctcaaaaataatgatataaaagtaacatttgtcagctacgaacgagaatttgaaagtcggcaattgacatatgactaccttaaagaagcaacaaaagtttttgatcagaaattctttagtttatcagacgatgatgccaatcaagttcttatgcaatctgatgaagtagaaaaggaaaaaacacgcctttcttttacccatcctttgtcagaaacagatatcataaaccggttagagtatgtccgtttgattattgatatctcgaaaataccagacttatacacgcaaattgcagggataagttcaggtatccctcagataaatacaatattaacagaatttgttgaacacaggaaaaacggttacattattgaagagatccaagaattggaaaaggcaattccttattattgtgaacaattaactaattggaaccgttctttaatttattctattgataaaatcaatgactatacaggtggtcaattggtagaaagaattataaatagttat

SEQ ID NO: 3984 - protein, 514 aa, Streptococcus agalactiae
MFHFIPSWYNENRTWYDNNYLWYFKPTNVGFDDTINQMKMFDYAGKESRLVVLNYMPNLRYYLHRYDLLESGYYSVFDDIQEIGNVRQQMIDFRQLNWPEGVDFTYTPFIVLVKKSGDLIAKVQFGEEGNLTHIDYFANEQIAKKYLFDDRGFLSSILYYDNGGEAYQDYLAPSGERIMREYLREGDHHVEINPKKAIHFLKLSYSDIEELIREKYLTYLHKEVSKSDTIIVSFNQVHNAFIVGNTSKGNLILSVFSERNNAHNVLEDYSSLSRADAIICDRLDIAAQLKEKIDKPVVHVSPFDTRLALGKSNQVRDLEIYFVVDRLSHKELQKSLTSLYKVMLKNNDIKVTFVSYEREFESRQLTYDYLKEATKVFDQKFFSLSDDDANQVLMQSDEVEKEKTRLSFTHPLSETDIINRLEYVRLIIDISKIPDLYTQIAGISSGIPQINTILTEFVEHRKNGYIIEEIQELEKAIPYYCEQLTNWNRSLIYSIDKINDYTGGQLVERIINSY

SEQ ID NO: 3985 - DNA, 1227 bp, Streptococcus agalactiae
ttgaaattactatatatttttgaaaaaaatattattcttcgtaaaatattgataacattttcattaataatcatttttttacttggtcgctatgttccaatacctggtgtcttgatttctgcttataagggacaagacaataactttgcgacgctttattcaacagtaactggtggtaatttgtctcaggttggggtcttttcattgggtattggtcctatgatgaccacaatgattttactaagactatttacgattggtaaatactctagtggagtatctcaaaaagttcaacagtttcgccaaaatgtggtgatgcttgtcatagcaattattcaagggctagccataaccatatcttttcaatatcataatggtttttctctgaccaaattattactcgcgacaatgatacttgtgactggtgcatatattatttcctggattggtaatctaaatgcggaatacgggtttggtggaatgactattttagtggtggtaggtatgcttgttgggcaatttaataatattcctcttatttttgaattattccaagatggttatcaacttgctatcatcttatttcttttgtggacactagtagcaatgtacttaatgataacttttgaacgttcagaatatcgtataccagtaatgcgtacttcaatccataatcgtctcgttgatgatgcctacatgccaataaaagtaaatgcttcgggggggatggcatttatgtatgtttataccttactaatgttcccccagtatattattattttactaagaagtattttcccaactaatccagatatcacatcatacaatgactattttagtttatcttctattcagggagtggttatttatatgattttaatgcttgttttatcagttgcatttacttttgtgaatatcgatccgactaaaatttctgaggcaatgcgagaaagtggtgattttattcctaattatagacctggtaaagaaacacaaagttatttatcgaaaatctgttatttatttggaacttttagtggttttttcatggctttcttaggaggggtaccattattatttgctcttggaaatgatgatcttaggacagtttcatctatgacagggatttttatgatgatcacagggatgtcatttatgatattggatgaattccaagttattcgtattcgtaaacaatacacttctgtatttgaaaatgaggagaat

SEQ ID NO: 3986 - protein, 409 aa, Streptococcus agalactiae
MKLLYIFEKNIILRKILITFSLIIIFLLGRYVPIPGVLISAYKGQDNNFATLYSTVTGGNLSQVGVFSLGIGPMMTTMILLRLFTIGKYSSGVSQKVQQFRQNVVMLVIAIIQGLAITISFQYHNGFSLTKLLLATMILVTGAYIISWIGNLNAEYGFGGMTILVVVGMLVGQFNNIPLIFELFQDGYQLAIILFLLWTLVAMYLMITFERSEYRIPVMRTSIHNRLVDDAYMPIKVNASGGMAFMYVYTLLMFPQYIIILLRSIFPTNPDITSYNDYFSLSSIQGVVIYMILMLVLSVAFTFVNIDPTKISEAMRESGDFIPNYRPGKETQSYLSKICYLFGTFSGFFMAFLGGVPLLFALGNDDLRTVSSMTGIFMMITGMSFMILDEFQVIRIRKQYTSVFENEEN

SEQ ID NO: 3987 - DNA, 1350 bp, Streptococcus pyogenes
ttgctaaaggtggttcaatcgaagtcatctaatgaggggatactcattatgttcttaaaaatactaaaagacgcgttaaagataaagactgtacggaataaaattttctttactatatttatcattcttgtattccgaattgggacacatattaccgtacctggtgtaaatgccaagagcttagagcaattaagtgaactccctttcttaaatatgttaaacttagttagtggtaatgcgatgagaaatttctcagtattttcaatgggggttagcccatatattactgcttctatcgttgttcagttattgcagatggatattttacctaagtttgttgagtggggcaaacaaggtgaggttggacgtcgtaaattaaatcaagcgacgcgctatatttcacttgttttggcttttgcccaatccattggtatcactgcagggtttaatactttgtcgaacgttgcacttgttaagacaccagacatcaaaacatatttactgatcggggcattactgacaacaggtagcgttattgttacctggcttggagaacaaatcacagataaaggatttggtaatggcgtatcaatgattatctttgcgggtattatttcgtctattccaagtgcaattgcaacaattcgtgaagactattttgtaaatgttaaggcaagtgatttacactcgtcttatctcattgttgggattttaatcatagctgttcttgctattgttttctttacaacatatgtccaacaagcggaatataaaattccaatccaatacacaaagctaatgcaaggtgcacctacaagttcatatcttccattaaaagtaaatccagccggcgttattcccgttatctttgctagctcgattacaactatcccaagtacgattattccttttgttcaaaatggtagagatttaccgtggttaaaccgtttgcaagaaatttttaattatcaaactccagtcggaatgatagtttacgccttgttgattatattgttctcattcttctatacctttgtacaagttaatcctgagaagacagcagaaaatcttcagaagaattcctcatatataccaagtgttcgccctggacgtgagacagaacaatttatgtccgcattgctaaaaaaactagcaaccgtaggagctatcttcttagcatttatctctttagcgccaatagcagcacaacaagctctcaacctttcttctagtattgctttaggtggaactagtttgctcattttgatttcaactggtatcgaaggtatgaaacagcttgagggatatcttctaaagagaaaatatgtcggatttatgaatacagcagaa

SEQ ID NO: 3988 - protein, 450 aa, Streptococcus pyogenes
LLKVVQSKSSNEGILIMFLKILKDALKIKTVRNKIFFTIFIILVFRIGTHITVPGVNAKSLEQLSELPFLNMLNLVSGNAMRNFSVFSMGVSPYITASIVVQLLQMDILPKFVEWGKQGEVGRRKLNQATRYISLVLAFAQSIGITAGFNTLSNVALVKTPDIKTYLLIGALLTTGSVIVTWLGEQITDKGFGNGVSMIIFAGIISSIPSAIATIREDYFVNVKASDLHSSYLIVGILIIAVLAIVFFTTYVQQAEYKIPIQYTKLMQGAPTSSYLPLKVNPAGVIPVIFASSITTIPSTIIPFVQNGRDLPWLNRLQEIFNYQTPVGMIVYALLIILFSFFYTFVQVNPEKTAENLQKNSSYIPSVRPGRETEQFMSALLKKLATVGAIFLAFISLAPIAAQQALNLSSSIALGGTSLLILISTGIEGMKQLEGYLLKRKYVGFMNTAE

SEQ ID NO: 3989 - DNA, 1194 bp, Streptococcus agalactiae
atgagagttattaaagtaaaaacaatttcggaaactttagattatatttctaaacataccgcttcggtagcgcgttttggtgatggagaaattgatattattgcggggaattctattccttaccaggtttatgattctgaacttgctaagcgattagaacgtttattaaatcgacagagtaatgagaagttagttatctgtgtaagtgatgtttttgataatttaggtagatacaacgatttttcacaacaattttggagggatcatctatatcagtataatgatttgtaccaaaaaaattgtcaggctgaatggtatggttcaacttttatttctagaccctatatggatttactggataagagtttgtcagtaacgtactttgaacagctaaaagcattatggaaaaataaagatattttaattgtcgagggtgagacttctcgttcaggcgttggcaatgacttatttaatgatgccaatactatttcgcgtatcatttgtccttcgaaagatgcattttcatctttttatgaaatcaaggaaactatacttgaacatagtagaggtaagctaattttacttatgcttggtccaactgcaaagctattagctgaagatttatcgcagctaggacatcaagctattgatttaggtcatatcgattcagaatatgagtggtttaagatgggagcagtttctaaggtgaaactttctcataaacatacggcagaacataattttgacgaagatattactttaatagaagacaatagttacgaaaatcaaattgtatcaaaaattggtacatcagatagacagtacgctttgacagtgacgttaacagatgatatatgggagctagaacatttattacaaagatgtcctaatactgattttcatattgctgccccagtttattgttcggatagacttaagcagttagtaggttatccaaattattacctacatgaagctattactgaagagcaattcgaagtactcctattaaatagcgatatatatttagatattaatcatggtgaagaagtttggaatgttgttgatagatgtataactgagggtaaaactatatatggaatcagacgggcaagaaaagataatcaatatatttcttttgagcgaaccatggatgattttgaatatttgtgtgacactattaaacaaaataga

SEQ ID NO: 3990 - protein, 398 aa, Streptococcus agalactiae
MRVIKVKTISETLDYISKHTASVARFGDGEIDIIAGNSIPYQVYDSELAKRLERLLNRQSNEKLVICVSDVFDNLGRYNDFSQQFWRDHLYQYNDLYQKNCQAEWYGSTFISRPYMDLLDKSLSVTYFEQLKALWKNKDILIVEGETSRSGVGNDLFNDANTISRIICPSKDAFSSFYEIKETILEHSRGKLILLMLGPTAKLLAEDLSQLGHQAIDLGHIDSEYEWFKMGAVSKVKLSHKHTAEHNFDEDITLIEDNSYENQIVSKIGTSDRQYALTVTLTDDIWELEHLLQRCPNTDFHIAAPVYCSDRLKQLVGYPNYYLHEAITEEQFEVLLLNSDIYLDINHGEEVWNVVDRCITEGKTIYGIRRARKDNQYISFERTMDDFEYLCDTIKQNR

SEQ ID NO: 3991 - DNA, 885 bp, Streptococcus agalactiae
atggaggcaatagtgactgataaattagtttctgttattattccagtctataatgcagcaccatatttagaggggtgtgtaaataccattttaggacaaacataccaagtttttgaaattctactgatagatgacggttctacagatacatctgctagtatctgcgatcaattatccctaagagataaccgtattagagttttccatatcgaaaatggcggtgcttctaaagctagaaactttggattagcacgaattagtccagagagccaatttgttacgtttgttgattcggacgattgggtaaaggaaaattatttggaagtactgctagctcagcaagaaaaatataatgctgatattgttatcagtaattactatatctacagagaaacagaagatatttttggttactacatcactgacaaagattttgttatcgaagaaatctctgctcaaacagctattgatagacaagtgcattggcatttaaatagttcagtattcatcgttatttgggggaaattatatcgaagagaactatttgataccatcaccttcccaatagataaagtatttgaagatgagttggtaagtgttttactttttataaaaagtaaaaaaacaattttagttaatggaagctattatggctatagaattcgtccaaatagcattatgacatcggcgttttcatccaaaagagcagaggatcttatttatatttttgatagtaaattgtcggagattatactatcaggattggattcaactgcaactgtagagagatatttttggttaatgcgtgactataaacagcgcttagaacaagaaaatttacagaaaacaataatatataaagtgatatcaaatcggttatcaagg

SEQ ID NO: 3992 - protein, 295 aa, Streptococcus agalactiae
MEAIVTDKLVSVIIPVYNAAPYLEGCVNTILGQTYQVFEILLIDDGSTDTSASICDQLSLRDNRIRVFHIENGGASKARNFGLARISPESQFVTFVDSDDWVKENYLEVLLAQQEKYNADIVISNYYIYRETEDIFGYYITDKDFVIEEISAQTAIDRQVHWHLNSSVFIVIWGKLYRRELFDTITFPIDKVFEDELVSVLLFIKSKKTILVNGSYYGYRIRPNSIMTSAFSSKRAEDLIYIFDSKLSEIILSGLDSTATVERYFWLMRDYKQRLEQENLQKTIIYKVISNRLSR

SEQ ID NO: 3993 - DNA, 90 bp, Streptococcus agalactiae
gtggctaacttaagtaatcttgggccaaaagaggtccaagcagctatatggaagcaactattggggaatagttcaaccaattcttcaata

SEQ ID NO: 3994 - protein, 30 aa, Streptococcus agalactiae
MANLSNLGPKEVQAAIWKQLLGNSSTNSSI

SEQ ID NO: 3995 - DNA, 93 bp, Streptococcus agalactiae
ttgggccaaaagaggtccaagcagctatatggaagcaactattggggaatagttcaaccaattcttcaatataaagcaaatccacggacgttg

SEQ ID NO: 3996 - protein, 31 aa, Streptococcus agalactiae
MGQKRSKQLYGSNYWGIVQPILQYKANPRTL

SEQ ID NO: 3997 - DNA, 936 bp, Streptococcus agalactiae
atggcttatgcaaggtactacattccgcaactgattgatgcagagaaagttctttatttagatattgatactttggttgttgataacttagataagttgtttgagatagaattaggggactacccgatagcagctatcttagatggagacggtatttattttaactcaggtgttatgctaataaactcgctttactggatgagatatcgagtaacagaaaaacttctggaaataacagaacgagaattggataatggaatttttggagaccaaggggttctcaatcttctttttgataataattggcttaagttagaagataagtataatgctcaagttggaaatgatttaggtgccttttatgaaaattggcaagggtattttgatcgtaactttgaatcgcctactattatccattactgtactcatgataaaccatggaatactttttcttcttcaaggtttagggagacatggtggcaatatgagcaactagattggaatgaggtgtttaattttgaaacgtatctgttacctgagccaacatttgaaaaacacttctttactttcacaacgtccgtggatttgctttatattgaagaattggttgaactattccccaatagttgcttccatatagctgcttggacctcttttggcccaagattacttaagttagccacaaactctaacgttcgtctgtatccttcaataaccagcccactttttgaacaactaatgactaaagcaaattattaccttgatatctcaacttcttggaaggaaatacaattttgtcaaaaagctattgagaaatcaattccgatattgagttttaatgaagcagtgacatttgaatatagggagttaagtcattgctttattaatttggaggatatgcgacagtttttatgtaaaaatggaggcaatagtgac

SEQ ID NO: 3998 - protein, 312 aa, Streptococcus agalactiae
MAYARYYIPQLIDAEKVLYLDIDTLVVDNLDKLFEIELGDYPIAAILDGDGIYFNSGVMLINSLYWMRYRVTEKLLEITERELDNGIFGDQGVLNLLFDNNWLKLEDKYNAQVGNDLGAFYENWQGYFDRNFESPTIIHYCTHDKPWNTFSSSRFRETWWQYEQLDWNEVFNFETYLLPEPTFEKHFFTFTTSVDLLYIEELVELFPNSCFHIAAWTSFGPRLLKLATNSNVRLYPSITSPLFEQLMTKANYYLDISTSWKEIQFCQKAIEKSIPILSFNEAVTFEYRELSHCFINLEDMRQFLCKNGGNSD

SEQ ID NO: 3999 - DNA, 1239 bp, Streptococcus agalactiae
atgaaaaatagaaaagctatcgcgttagcggcagattttggctatcaagagcaagttaagactataattaaatcaatatgctttcataatcaatttattgatttttatatcttaaatgacgattttccagttgaatggtttcaaatgatggaatatcatttatctaaaatggattgcacaatatctaacactaaaatttttaatgaagaaattaaacattttaaatttcaaaaaccgatgccctatcctacttactttcgatactttatacctgaagttattcatgaagataaggtactatatttagactgtgatatgattatcaccagtgatttaacatcgatatttactcttgatatttcaaaatatggtgtagcggctgttcgagatgatttgctcgaagaatatgatggtaaagaagattattttaattcaggtttgctattaattaataatattttttggcgagaacaagggattagtcagcgactgttagattatactagagaaaaccaaggggctcttcaatatcatgaccaggatgttttgaatgatgtactgtgcgataattggctagaacttgatgaaacttataactatcatacaggagcagatatgttatataacctattccaacagtctgaacgtcaattaaatcgcaggaaagatttacctaaagttattcattatacagcgacaaaaccatggaaataccttgaaacatctgttcgttggcgcgatatatggtgggaatataatagacttgaatggcgcgatatttttacaagatggcaagtcaatgatggtgtagatgtttcattgaagaaagtgttacaacctatccatcgagctttcatttttacttactcagattcaattgaaggaattgagaggttggctaaggatttaccaaactggcaatttcatattgctgcctatactcaaatttcagaaaaattgaaacaattggaaatgcattcaaatataaaactttatccacttgtttatcgtttcaaattaaatgagctagttgaaaattcagatatttaccttgatattaatcatggtgatgcagatactcaggttctggagcaagtgaagaaattaggtaaagatattttatccctttctacaacttatcatggtcaaggcaaacaatttgagagagttacggatattattgattatttaaagaatgaacgatttaaagaacatattagaaaggaatattgtgaaaaa

SEQ ID NO: 4000 - protein, 413 aa, Streptococcus agalactiae
MKNRKAIALAADFGYQEQVKTIIKSICFHNQFIDFYILNDDFPVEWFQMMEYHLSKMDCTISNTKIFNEEIKHFKFQKPMPYPTYFRYFIPEVIHEDKVLYLDCDMIITSDLTSIFTLDISKYGVAAVRDDLLEEYDGKEDYFNSGLLLINNIFWREQGISQRLLDYTRENQGALQYHDQDVLNDVLCDNWLELDETYNYHTGADMLYNLFQQSERQLNRRKDLPKVIHYTATKPWKYLETSVRWRDIWWEYNRLEWRDIFTRWQVNDGVDVSLKKVLQPIHRAFIFTYSDSIEGIERLAKDLPNWQFHIAAYTQISEKLKQLEMHSNIKLYPLVYRFKLNELVENSDIYLDINHGDADTQVLEQVKKLGKDILSLSTTYHGQGKQFERVTDIIDYLKNERFKEHIRKEYCEK

SEQ ID NO: 4001 - DNA, 1203 bp, Streptococcus agalactiae
atgaagaaaacaattgttttaggtgcagatttccaatatcgtgatcaagttatgacaactataaaatctattgttagtcataatcaacatttaactatttatatcattaacacagattttcccgtagaatggtttaatatccttaaccattctttagaacagtttgactgtagagtaaaaaatattcccataagttcagatgtctttgaggggatacctaccctgagccatatcagtgtggcgggatttttcagatggtttattccaattcaccttgaagaagagatagttttatatttagatagtgatgtaatagttaggggttctttggatcctctatttgacataaaccttgaagagaatttattaggagctgtagcagatcatttttcaacgctttactatggagatacagcaccagttagttttaattcaggtgttatgctaatcaataattcattatggaaaaaagaagaaatttataatagccttatgaggattgctgataagggttctgctgttggggtaggagatcaagaataccttaatattttgactcagaatcgttggatagatatcggtaaacaatataatgttcagattggtcaagatgtcaatattaatgcatatgggcgaccagatttgtatcatttttatgatgattgcgaacctgttattgttcattataatagtcaagataaaccgtggaataaatatagtcaatcgcgataccgttcagaatggtggtattattttggtttagaatggtcagttatttatgctcaacaacaaaaaaatttgaacaggttaacaggtaaaacactgaatttatttacattaacagcctcagatacattagaacatattgaagtacttgcaaaagctctaccagattatcagtttcatattgcagcacgtagtgatatttcagagaaattagctaatctagaaacttatagcaatattaaagtttataaattagttatcaaccctatcttggaagagcttatacgtaactgtgatgtgtacttggatattaatcattcttacgaagtagaaggtattctagataaaataaaagaagagaataaaccgattttagcctttgattctacagcacatacgacaaaaaatatagaagttatctcagaaacaatgcctgaattgatggttaaaagaataagggaagtaggtcctcttaga

SEQ ID NO: 4002 - protein, 401 aa, Streptococcus agalactiae
MKKTIVLGADFQYRDQVMTTIKSIVSHNQHLTIYIINTDFPVEWFNILNHSLEQFDCRVKNIPISSDVFEGIPTLSHISVAGFFRWFIPIHLEEEIVLYLDSDVIVRGSLDPLFDINLEENLLGAVADHFSTLYYGDTAPVSFNSGVMLINNSLWKKEEIYNSLMRIADKGSAVGVGDQEYLNILTQNRWIDIGKQYNVQIGQDVNINAYGRPDLYHFYDDCEPVIVHYNSQDKPWNKYSQSRYRSEWWYYFGLEWSVIYAQQQKNLNRLTGKTLNLFTLTASDTLEHIEVLAKALPDYQFHIAARSDISEKLANLETYSNIKVYKLVINPILEELIRNCDVYLDINHSYEVEGILDKIKEENKPILAFDSTAHTTKNIEVISETMPELMVKRIREVGPLR

SEQ ID NO: 4003 - DNA, 1080 bp, Streptococcus agalactiae
gtgttaataaaactattatttaactggtatgatatggtctggataagagagagttttaaagagagattaactaaaatgcgagtacatattacaagtatatatgggcagtcaccgcgtagcattgcccttatatcacaaaaactagttaaggatgtcggacgtcaacttggttatgatgaaatgggaatctacttttataatgatcatgctgaaacgcatggtgaaagaagtactaggatggatggtatcattgcgggattaggcagaggggatattgttgtttttcaagtacctacatggaattcaacagaatttgatgaactttttctagataaattacaggcatacggtgctagaattataacttttgtacatgatattgttcccttaatgtttgagtctaatttttatttattagatagagtaattgacatgtataatcgttcggatgttgttattctacctacaaaagcgatgcatgattatctaattgaaaaagggatgactacctctaaagttctttatcaagaagtatgggatcatccagttaatatagacctccctcgtccagaatgtcaaaaagtccttagttttgcaggcgatattcaacgctttccctttgtcaatgactggaaggaaaatatcccgctcatctattatggagacggaagcagactcaattctgaggcaaatgttcatgctcagggatggaaagatgatgtagaattgatgctaagtctttctaagcggggaggatttggcctgtgttggagtgaagatagagaggagttagtcgagcgtcgttattcgaggatgaatgcctcgtataaattatctactttcttggctgctggacttccaattattgctaaccatgatatttcaagtagagactttatcaaacaacacggattaggatttacagttgaaacgctagaagaagctgttgaaaaaattaataatatggaaaaagagacttatgacagctatgtggaaaatgttgagaagatagcaactctcttgcgaaatggttatatcactaaaaaattgttgatagatgctgtgcatatgctttataga

SEQ ID NO: 4004 - protein, 360 aa, Streptococcus agalactiae
MLIKLLFNWYDMVWIRESFKERLTKMRVHITSIYGQSPRSIALISQKLVKDVGRQLGYDEMGIYFYNDHAETHGERSTRMDGIIAGLGRGDIVVFQVPTWNSTEFDELFLDKLQAYGARIITFVHDIVPLMFESNFYLLDRVIDMYNRSDVVILPTKAMHDYLIEKGMTTSKVLYQEVWDHPVNIDLPRPECQKVLSFAGDIQRFPFVNDWKENIPLIYYGDGSRLNSEANVHAQGWKDDVELMLSLSKRGGFGLCWSEDREELVERRYSRMNASYKLSTFLAAGLPIIANHDISSRDFIKQHGLGFTVETLEEAVEKINNMEKETYDSYVENVEKIATLLRNGYITKKLLIDAVHMLYR

SEQ ID NO: 4005 - DNA, 213 bp, Streptococcus agalactiae
gtgcctcgacgtcagccagcaccagcgcttcaacgagtgcgtcaatgtcagccagcaccagtgcttcaaccagtgcctcgatgtcagccagcactagcgcttcaacgagtgcgtcaatgtcagccagcacaagtgcttcaacaagtgcctcgatgtcagccagcacaagtgcttcaacaagtgcctcgatgtcagccagcactagcgcttcaa

SEQ ID NO: 4006 - protein, 71 aa, Streptococcus agalactiae
MPRRQPAPALQRVRQCQPAPVLQPVPRCQPALALQRVRQCQPAQVLQQVPRCQPAQVLQQVPRCQPALALQ

SEQ ID NO: 4007 - DNA, 876 bp, Streptococcus agalactiae
gtggaagcgctggtacttgctgatgtcgatgcactcgttgagacgctggtgctggctgacgtcgtggcactcattgaagcgctagtgctggctgacatcgaggcacttgttgaagcacttgtgctggctgacatcgaggcacttgttgaagcacttgtgctggctgacattgacgcactcgttgaagcgctagtgctggctgacatcgaggcactggttgaagcactggtgctggctgacattgacgcactcgttgaagcgctggtgctggctgacgtcgaggcactcattgaggcgctagtacttgcacttgtggaagcactggtgctggctgacgtcgaggcactcattgaggcgctagtacttgcacttgtggaagcactggtgctggctgacgtcgaggcactcattgaggcgctagtacttgcacttgtggaagcactggtgctggctgacgtcgaggcactcattgaggcgctagtacttgcacttgtggaagcactggtgctggctgacgtcgaggcactcattgaggcgctagtacttgctgacgtggatgcactggtactggcacttgtggaagcgctagtacttgcacttgttgaggcgctcatacttgctgaggtggaagcactggtactggcactggttgaggcgctggtacttgcacttgttgaagcactcatacttgcacttgttgaagcactggtgctggctgacgtcgacgcactcatggaagcgctggtacttgctgatgtcgaggcactcatggaagcgctggtacttgctgacgtcgacgcactcgtagaagcactttctgataaaagtttaatttcggcattcgcatctgagtcaccacttatattcgtatgccca

SEQ ID NO: 4008 - protein, 292 aa, Streptococcus agalactiae
MEALVLADVDALVETLVLADVVALIEALVLADIEALVEALVLADIEALVEALVLADIDALVEALVLADIEALVEALVLADIDALVEALVLADVEALIEALVLALVEALVLADVEALIEALVLALVEALVLADVEALIEALVLALVEALVLADVEALIEALVLALVEALVLADVEALIEALVLADVDALVLALVEALVLALVEALILAEVEALVLALVEALVLALVEALILALVEALVLADVDALMEALVLADVEALMEALVLADVDALVEALSDKSLISAFASESPLIFVCP

SEQ ID NO: 4009 - DNA, 174 bp, Streptococcus agalactiae
gtgcttatcgattctgaagcacttgttaaagcagatgtacttacagattcacttacacttgttaaagttgaccctgacatagacatacttacagattcactagtacttgttgaggctgactctgacatagatacactattagaatcaataatgtttttcgatactgtcccatct

SEQ ID NO: 4010 - protein, 58 aa, Streptococcus agalactiae
MLIDSEALVKADVLTDSLTLVKVDPDIDILTDSLVLVEADSDIDTLLESIMFFDTVPS

SEQ ID NO: 4011 - DNA, 2910 bp, Streptococcus agalactiae
atgtcccaaaagacttttggcaagcagttaacagttgtagatactaagagtagagtcaagatgcataaatcagaaaaaaactgggtaagaacagtaatgtcgcattttaatctatttaaagcgattaaagggagagcaactgttgaagcagatgtgtgtattcaagatgttgaaaaagaagaccgactatcttcaggaaatttgacctatctcaaaggaatactagctgctggagctctggtaggtggagcgagtttaaccagtcgtgtttatgcagatgagactccagttgttcaagaacaatcaagttctgtaccaacactggcagaacaaacggaagtgactgttaaaacaactactgttcaaaatcatcaagatgggacagtatcgaaaaacattattgattctaatagtgtatctatgtcagagtcagcctcaacaagtactagtgaatctgtaagtatgtctatgtcagggtcaactttaacaagtgtaagtgaatctgtaagtacatctgctttaacaagtgcttcagaatcgataagcacgtcagcctcagaaagtgtttcaaaatctacaagtattagtgaggtttcaaatattcttgaaactcaagcttctttaactgataaaggaagagagtcgttttcggcaaaccagatagtaacagaaagtagcttagttactgatgctggtaaaaatgcttcagtatctagcctaattgaaattacaaaaccaaaatcggagttacagacttccaaaatgtcaaatgagtcgcttataactccagagaaatcccaagtaatgattgcaagcgataaaactgggaatgagagtctaactccgacaattagattaaaatcagttattcagccaaggagtatgaacttgatgactttgagttcggagatggacttgataccactagaagaagtgtctgatactgaaatgttaggtaaagatgtatcaagcgagttgcagaaagttaatattgcgttaaaagataacactcttagtgagcctggaacagttaaattagatagttcagaaaaccttgttttgaactttgccttttcaatcgcttctgttaacgagggagatgtctttactgtaaagctttctgataaccttgacacacaagggattggtactattctaaaagttcaagatataatggatgaaacggggcagttattagcgactgggtcatatagtcctttaacacataatattacatacacctggacaaggtatgcttctacgttgaataatattaaagctagagtcaatatgccagtttggcctgaccagagaataatttctaaaacaacttcagataagcagtgctttactgcaacattgaacaatcaagttgcttcaattgaggaacgtgttcagtataatagtccttcagtgacagaacatactaatgttaagacaaatgtaagatctcggatcatgaagcttgatgatgaaagacagacagaaacttatattactcaaattaatcctgaaggtaaggaaatgtatttcgcatcaggacttgggaatctatatactattatcggttcagatggaacatcaggttcaccagttaatttattaaatgcggaagtaaagattctaaaaactaattcaaaaaatcttacagatagtatggatcaaaattatgattcgcctgagtttgaagatgtgacttcccagtatagttatactaacgatggttctaaaattaccatagattggaaaacaaattctatttcttccactacatcttatgttgttttggtcaaaatacctaaacaaagtggtgtattgtattcaactgtttctgatataaatcaaacatatggttctaaatattcttatgggcatacgaatataagtggtgactcagatgcgaatgccgaaattaaacttttatcagaaagtgcttctacgagtgcgtcgacgtcagcaagtaccagcgcttccatgagtgcctcgacatcagcaagtaccagcgcttccatgagtgcgtcgacgtcagccagcaccagtgcttcaacaagtgcaagtatgagtgcttcaacaagtgcaagtaccagcgcctcaaccagtgccagtaccagtgcttccacctcagcaagtatgagcgcctcaacaagtgcaagtactagcgcttccacaagtgccagtaccagtgcatccacgtcagcaagtactagcgcctcaatgagtgcctcgacgtcagccagcaccagtgcttccacaagtgcaagtactagcgcctcaatgagtgcctcgacgtcagccagcaccagtgcttccacaagtgcaagtactagcgcctcaatgagtgcctcgacgtcagccagcaccagtgcttccacaagtgcaagtactagcgcctcaatgagtgcctcgacgtcagccagcaccagtgcttccacaagtgcaagtactagcgcctcaatgagtgcctcgacgtcagccagcaccagcgcttcaacgagtgcgtcaatgtcagccagcaccagtgcttcaaccagtgcctcgatgtcagccagcactagcgcttcaacgagtgcgtcaatgtcagccagcacaagtgcttcaacaagtgcctcgatgtcagccagcacaagtgcttcaacaagtgcctcgatgtcagccagcactagcgcttcaatgagtgccacgacgtcagccagcaccagcgtctcaacgagtgcatcgacatcagcaagtaccagcgcttccacaagttcttcaagctcagtgacttctaattcatcaaaagagaaggtgtattctgccttaccttctacgggtgaccaagattattctgtaactgctactgccttaggtttaggtttaatgactggtgcaacccttttgggacgaaaaaaatctaaaaaagataaagac

SEQ ID NO: 4012 - protein, 970 aa, Streptococcus agalactiae
MSQKTFGKQLTVVDTKSRVKMHKSEKNWVRTVMSHFNLFKAIKGRATVEADVCIQDVEKEDRLSSGNLTYLKGILAAGALVGGASLTSRVYADETPVVQEQSSSVPTLAEQTEVTVKTTTVQNHQDGTVSKNIIDSNSVSMSESASTSTSESVSMSMSGSTLTSVSESVSTSALTSASESISTSASESVSKSTSISEVSNILETQASLTDKGRESFSANQIVTESSLVTDAGKNASVSSLIEITKPKSELQTSKMSNESLITPEKSQVMIASDKTGNESLTPTIRLKSVIQPRSMNLMTLSSEMDLIPLEEVSDTEMLGKDVSSELQKVNIALKDNTLSEPGTVKLDSSENLVLNFAFSIASVNEGDVFTVKLSDNLDTQGIGTILKVQDIMDETGQLLATGSYSPLTHNITYTWTRYASTLNNIKARVNMPVWPDQRIISKTTSDKQCFTATLNNQVASIEERVQYNSPSVTEHTNVKTNVRSRIMKLDDERQTETYITQINPEGKEMYFASGLGNLYTIIGSDGTSGSPVNLLNAEVKILKTNSKNLTDSMDQNYDSPEFEDVTSQYSYTNDGSKITIDWKTNSISSTTSYVVLVKIPKQSGVLYSTVSDINQTYGSKYSYGHTNISGDSDANAEIKLLSESASTSASTSASTSASMSASTSASTSASMSASTSASTSASTSASMSASTSASTSASTSASTSASTSASMSASTSASTSASTSASTSASTSASTSASMSASTSASTSASTSASTSASMSASTSASTSASTSASTSASMSASTSASTSASTSASTSASMSASTSASTSASTSASTSASMSASTSASTSASTSASMSASTSASTSASMSASTSASTSASMSASTSASTSASMSASTSASTSASMSASTSASMSATTSASTSVSTSASTSASTSASTSSSSSVTSNSSKEKVYSALPSTGDQDYSVTATALGLGLMTGATLLGRKKSKKDKD

SEQ ID NO: 4013 - DNA, 627 bp, Streptococcus agalactiae
ttgtgtaatatgatagaaaattttttagaaaaaaatattcttaataaagttaaattacttactttatgttatgataccccctcactatccttagataccgcctgtaaccgactccacttatcaccagttgagcttaaaaactattgtcataaattaaatgttttatttggtcataaactttctatccatatccaaaaaaaacggattttatgtaagctaaataaacttactcaggaagatgccttaaaaatagtttataatgagtcaaacactttacaacttcttaaatttttaattgatgactcgtctgataaaaaatctctagtagcttttggaaatgatctcttcttatctcgttcttctgtctatcgtctgcgagaaaatttaattcctttaattaaagatttaggattatctttatctaaaaataccattgtaggtgacgaatatcgcattagatatctcatcgcatacctcactactaaatttggtattaaaatttacgatctgtctgctctagatattaagattattcgacaatttttatttgagagtggtactaatataagacctactacgcacctttctgatatctttgttttttttgatacgcttttcattttaacc

SEQ ID NO: 4014 - protein, 209 aa, Streptococcus agalactiae
MCNMIENFLEKNILNKVKLLTLCYDTPSLSLDTACNRLHLSPVELKNYCHKLNVLFGHKLSIHIQKKRILCKLNKLTQEDALKIVYNESNTLQLLKFLIDDSSDKKSLVAFGNDLFLSRSSVYRLRENLIPLIKDLGLSLSKNTIVGDEYRIRYLIAYLTTKFGIKIYDLSALDIKIIRQFLFESGTNIRPTTHLSDIFVFFDTLFILT

SEQ ID NO: 4015 - DNA, 732 bp, Streptococcus agalactiae
atggattatatttttcttatctatcttacaagcgctaactcttttgctgctcaaaagtggactgaaacacatgtcgatgaagtgttagctatttttaaaagtcttcctaaattccaaatgctactacaacctttgaaagaagctcttccatactctgacacctactacgatgagctagtgaaagtcactatttacttttctcgaaacttcatagttggtctgaatcaattaattcctgaaacacttagttttccttcaacattctatcctggaaataatcctaaactaatatccattatcgaaccaatagtcactcattggctaactgaaattggagaatcaaagttcaaaaaaacgcacttcttcttgctctgtgctcaccttgaaagagtaataaagaatagcatgcctcctataaatattgtgttgctgacaactgattttattaataatgaaattttaaaagactatattttgcaatccctttcaacagataaaattagatttcattcctattacttattgacagataatattagtcaaatatcgaccttaaaacccgatttaattatcactaatcgaaaactgtttacctatgttacaaaggaactagctacaaatagtttagtcgctcatattgattacaacgatacaccctctcaaatcagtaatatccaaactattatttctaatattaaagaagaaaaatatcgaaaaatctttgataaaata

SEQ ID NO: 4016 - protein, 244 aa, Streptococcus agalactiae
MDYIFLIYLTSANSFAAQKWTETHVDEVLAIFKSLPKFQMLLQPLKEALPYSDTYYDELVKVTIYFSRNFIVGLNQLIPETLSFPSTFYPGNNPKLISIIEPIVTHWLTEIGESKFKKTHFFLLCAHLERVIKNSMPPINIVLLTTDFINNEILKDYILQSLSTDKIRFHSYYLLTDNISQISTLKPDLIITNRKLFTYVTKELATNSLVAHIDYNDTPSQISNIQTIISNIKEEKYRKIFDKI

SEQ ID NO: 4017 - DNA, 1989 bp, Streptococcus agalactiae
atgatagatagaaaagatactaaccgatttaaattagtttccaaatatagcccttcgggagatcaacctcaagctattgaaacgttggttgacaatattgaaggaggagaaaaagctcagattttaaaaggtgctactggtactggtaaaacctacacaatgagccaagttatcgcccaagttaacaagccaaccttggtgattgcacataataaaaccttagcaggtcaactttatggagagtttaaagaattttttcctgacaatgccgtagagtactttgtttcatattatgattattatcaaccagaagcttatgtgccttcttcggatacttatattgaaaaagatagttcagtcaatgacgaaattgacaaattacgtcactcagcgacttcttcgttattagaaagaaatgacgttattgttgtagcatctgtttcttgtatttacggtttaggttctcctaaagagtatgcagacagtgttgttagccttaggccaggtcaagaaatttcacgtgatcagttattgaacaatctcgttgatattcaatttgagcgtaacgatattgattttcaacgtggaaaatttcgcgttcgtggcgatgttgtagaagtttttcctgcgagtcgtgatgagcatgcctttcgaattgaattttttggtgatgaaattgatcgtataagagaaatagaatcgttaacagggcgtgtgctaggagaagtggaacatttagctattttcccagcaacacactttatgacaaatgatgaacatatggaagaagctatttcaaaaatacaagctgaaatggaaaatcaagtagaactttttgaaaaagaagggaaattgattgaagcgcaacgtattcgacaaaggacagaatatgatattgaaatgcttcgtgaaatgggatatacaaatggtgttgagaactactcacgtcacatggatggtagaagtgaaggtgagccaccttttactttgttagatttcttcccagaagattttttgattatgattgatgagagtcacatgacaatggggcaaatcaaagggatgtataatggagaccgttcgcgtaaagaaatgttggttaattacggtttccgtttaccatctgccttagataaccgtccacttcgtcgtgaagaattcgaaagccatgtccatcaaattgtctatgtatctgcaacgccaggagactatgaaatggagcaaacagatacagttgttgagcaaattatccggccaacaggacttcttgatccagaagttgaagttagaccaagtatggggcagatggatgacttgcttggtgaaatcaatttgaggactgaaaaaggtgagcgtacctttattacaacattgacaaagcgtatggcagaagacttaacagattatctcaaagaaatgggagttaaagttaagtatatgcacagcgatattaaaaccttagaacgtacagagattattcgtgatttacgacttggtgtgtttgatgttttaattggtattaatctcttacgtgaaggaatagatgttcctgaggtttcccttgttgcaatcttagatgctgataaggaaggtttccttcgtaatgagcgtggtcttatccaaacaatcggacgtgcagcacgtaacagtaatggtcatgttattatgtatgctgataaaataacagattctatgcaaagagctatggatgaaaccgctcgccgtcgtcgtttacaaatggattataatgaaaagcatggaattgtgccacaaacaattaaaaaagaaatccgtgatttaattgctattactaaaagtaatgacagcgataagcctgaaaaagttgtcgattacagtagtttatctaaaaaagaaaggcaagctgaaattaaagctcttcaacagcaaatgcaagaagcagctgaattattggactttgagctagctgcacaaatccgagatgttatcttagaactaaaagcaatcgat

SEQ ID NO: 4018 - protein, 663 aa, Streptococcus agalactiae
MIDRKDTNRFKLVSKYSPSGDQPQAIETLVDNIEGGEKAQILKGATGTGKTYTMSQVIAQVNKPTLVIAHNKTLAGQLYGEFKEFFPDNAVEYFVSYYDYYQPEAYVPSSDTYIEKDSSVNDEIDKLRHSATSSLLERNDVIVVASVSCIYGLGSPKEYADSVVSLRPGQEISRDQLLNNLVDIQFERNDIDFQRGKFRVRGDVVEVFPASRDEHAFRIEFFGDEIDRIREIESLTGRVLGEVEHLAIFPATHFMTNDEHMEEAISKIQAEMENQVELFEKEGKLIEAQRIRQRTEYDIEMLREMGYTNGVENYSRHMDGRSEGEPPFTLLDFFPEDFLIMIDESHMTMGQIKGMYNGDRSRKEMLVNYGFRLPSALDNRPLRREEFESHVHQIVYVSATPGDYEMEQTDTVVEQIIRPTGLLDPEVEVRPSMGQMDDLLGEINLRTEKGERTFITTLTKRMAEDLTDYLKEMGVKVKYMHSDIKTLERTEIIRDLRLGVFDVLIGINLLREGIDVPEVSLVAILDADKEGFLRNERGLIQTIGRAARNSNGHVIMYADKITDSMQRAMDETARRRRLQMDYNEKHGIVPQTIKKEIRDLIAITKSNDSDKPEKVVDYSSLSKKERQAEIKALQQQMQEAAELLDFELAAQIRDVILELKAID

SEQ ID NO: 4019 - DNA, 1989 bp, Streptococcus pyogenes
atgattgataaacgtgatgataaaccatttaaactaaaatcaaagtataaaccgtctggtgatcagccacaagctattgaaagcctagttgataatatcgagggcggagaaaaagctcagattctcctaggtgctacaggaacgggaaaaacatacaccatgagccaagtaattagtaaagtaaataaacctaccttagtgatagctcacaataaaaccttagcaggacaattatatggtgaatttaaagaattttttccagacaatgctgtggaatattttgtttcctattatgattactaccaacctgaagcatatgtcccatcaagcgacacctatatcgaaaaagatagttcagtcaatgatgaaatcgataaacttcgccattcagccacctcttctttacttgagcgtaacgatgtcatagtggtagcttctgtatcttgtatttatggactaggttcgccaaaagagtacgcagattcagcagtcagcctacgtccaggtcaggagatatcacgtgacactttgctaaatcaattagtagatattcaatttgagcgtaatgatattgattttcaacgcggctgttttcgtgtacgtggcgatgttgttgaggtctttccagcatccagggatgaacatgcttttcgggtggaatttttcggggatgagattgaccgtatatgtgaaatcgaaagtttaactgggaaaactattggagaagttgaccatttggttttatttccagctactcactttgtaacaaatgatgagcatatggagcaatcaatagccaaaattcaagcagagttagcagagcagttacagttatttgaatctgaaggtaaactactagaagcacagcgattacgccaaagaacggaatatgatattgaaatgttacgtgaaatgggctatactagcggagtcgaaaactattcccgtcatatggatggcaggtcaccaggagaacctccttataccttgttagatttcttcccagaagattttttaattatgattgatgaaagtcacatgacaatgggacaaatcaaaggcatgtataatggtgaccaagccagaaaacaaatgctagttgactatggttttcgattgccatcagctcttgataatcgtcccttaagacgcgaggaatttgaaagtcatgtgcaccaaattgtctatgtttcagcaacgcctggtgaatacgaaatgtcacagactaatacaattattgagcaaattattcgtccgactgggctacttgatcctgaaattgatgtaaggtcaagtatggggcaaatggatgatttgttgggagaaattaaccagcgcgtagcgcgcgatgaacggacgttcatcacaaccttaactaaaaaaatggcagaagatttgactgattatctaaaagagatgggtgtcaaggtcaagtatatgcacagtgatattaaaaccttagagcgaacagaaattattcgtgatttacgacttggtgtttttgatgtcttgattggaatcaatctgctccgtgaagggattgatgtgccagaagttagtcttgtagccattttggatgctgataaagagggtttcctccgtaatgaacgcggcttgattcagaccatcggtagagcagctcgaaacgtagatggtcatgtcattatgtatgcggacaagatgacagattctatgcagcgagctattgacgaaacggctcgtcgtcgtgagattcaaatagcatataacaaagcgcacggcatcgttccacaaactataaaaaaagacatcagaggccttattagtataagtaaaacaagccacaatgatatatcaaaagaagagatggattatgaaagtatgtcaagaggagaacgaaaagaagcgatcaatgctctgcaaaaacaaatgcaagaggcagctgaattacttgatttcgaattggcagctcaaatgcgagacttgattttagaacttaaattaatggac

SEQ ID NO: 4020 - protein, 663 aa, Streptococcus pyogenes
MIDKRDDKPFKLKSKYKPSGDQPQAIESLVDNIEGGEKAQILLGATGTGKTYTMSQVISKVNKPTLVIAHNKTLAGQLYGEFKEFFPDNAVEYFVSYYDYYQPEAYVPSSDTYIEKDSSVNDEIDKLRHSATSSLLERNDVIVVASVSCIYGLGSPKEYADSAVSLRPGQEISRDTLLNQLVDIQFERNDIDFQRGCFRVRGDVVEVFPASRDEHAFRVEFFGDEIDRICEIESLTGKTIGEVDHLVLFPATHFVTNDEHMEQSIAKIQAELAEQLQLFESEGKLLEAQRLRQRTEYDIEMLREMGYTSGVENYSRHMDGRSPGEPPYTLLDFFPEDFLIMIDESHMTMGQIKGMYNGDQARKQMLVDYGFRLPSALDNRPLRREEFESHVHQIVYVSATPGEYEMSQTNTIIEQIIRPTGLLDPEIDVRSSMGQMDDLLGEINQRVARDERTFITTLTKKMAEDLTDYLKEMGVKVKYMHSDIKTLERTEIIRDLRLGVFDVLIGINLLREGIDVPEVSLVAILDADKEGFLRNERGLIQTIGRAARNVDGHVIMYADKMTDSMQRAIDETARRREIQIAYNKAHGIVPQTIKKDIRGLISISKTSHNDISKEEMDYESMSRGERKEAINALQKQMQEAAELLDFELAAQMRDLILELKLMD

SEQ ID NO: 4021 - DNA, 918 bp, Streptococcus agalactiae
atgaataaaaggattttaaatagtcagttcgctgtctataaaaactggccgtcatggctattattgttatttgcttgttttatggtatacctattttttttcgttggtctaactctaggtggtgtgggaattgttctagtgtcttctgtactctataagttttcttcctatactttttttgagtttattaatttatttaataatatctatggagaattaggaacctttagtttttcagcattccttttgcttatctgggtaaaattcgtagaaaaaagacctttttcagaattggggttttctacaaagtttaaaagaactctgtggtcacttataaaaggctggagtataggttttattctattttcaatttctgtcatcactgcttatatattgggaggacttgactttcatagctatgatgtttctaaggcaacgattttctatgttgtaactctccttcctttttggcttattcaaagcggtacggaagaattgctaacacgagggtggcttcttcctctaattaatcatcgttttcatttagctgttgccataggggtctcatccactttatttggcattttgcacttggtaaatgcccatgtcacttttctttctattgtaagtattatatgttcgggagttttaatgtccttgtatatgattaaaagtggtaatatttggagtgttgcagccttacatggagcttggaattttagccaaggtaatctctatggtattgccgtaagtggtcagaaagcaggagcatctcttttgcattttaccgttaaagaaaacgcaccggactggatatcaggtggtgcattcggaatagaaggaagtttgatttctatttttgttctcttagcagcaattatataccttctatggctaattaagactgaagaaacagat

SEQ ID NO: 4022 - protein, 306 aa, Streptococcus agalactiae
MNKRILNSQFAVYKNWPSWLLLLFACFMVYLFFFVGLTLGGVGIVLVSSVLYKFSSYTFFEFINLFNNIYGELGTFSFSAFLLLIWVKFVEKRPFSELGFSTKFKRTLWSLIKGWSIGFILFSISVITAYILGGLDFHSYDVSKATIFYVVTLLPFWLIQSGTEELLTRGWLLPLINHRFHLAVAIGVSSTLFGILHLVNAHVTFLSIVSIICSGVLMSLYMIKSGNIWSVAALHGAWNFSQGNLYGIAVSGQKAGASLLHFTVKENAPDWISGGAFGIEGSLISIFVLLAAIIYLLWLIKTEETD

SEQ ID NO: 4023 - DNA, 2181 bp, Streptococcus agalactiae
atgaagcacaagttaaaagcttttacgcttgctttactctcaatattctttgtgtttggtggaaaggtcagtgcagagactgtgaatattgtttctgatacagcatacgctccattcgaatttaaagattctgatcaaacttataaaggaatcgatgttgacatcgttaacgaagtcgctaagcgtgctggctggaatgttaacatgacgtacccaggttttgatgccgcagttaacgctgttcaatctggacaggcagacgcgctaatggccggaactactgttactgaagcacgtaaaaaagtctttaatttctcagatacttattacgatacttccgttattctttatactaaaaataataataaagtcacaaactacaaacaactaaaaggaaaagtagtcggtgtaaaaaatggaacagctgctcaaagcttcttagaggaaaataaatctaaatacggctataaagttaaaacatttgatacaagtgacctaatgaataacagccttgattctggttctatttacgccgctatggacgatcaaccagttgtgcaatttgcgataaatcaaggaaaagcttacgccattaacatggaaggcgaggcagttggtagctttgcatttgctgtcaaaaaaggtagtggacacgataacctaattaaagaatttaacacagcttttgcacaaatgaaatcagatggcacttataatgacatcatggataaatggcttgggaaagacgctacaaaaacaagcggcaaagcaacaggtaatgccaatgaaaaagcaactcctgtaaagccaagttataaaattgtttctgattcttcattcgcaccattcgaatatcaaaacggtaaagggaaatatactggttttgatatggaattaatcaagaaaattgctaaacagcaaggttttaaacttgatatctcaaatccaggttttgatgccgctttaaatgctgtccaatctggacaagctgacggtgttattgcaggagctacaatcacagaagcacgccaaaaaatctttgatttttctgatccttattacacatctagcgttatcttagcggttaaaaaaggaagcaatgtcaaatcataccaagatttaaaaggaaaaacagttggtgctaaaaatggtactgcctcatatacttggttatcagaccacgcagataagtacaactatcatgttaaagcatttgatgaagcatctacaatgtatgatagtatgaactcaggttcaattgatgctctaatggatgacgaagcagttcttgcttacgctattaatcaaggtcgtaaatttgaaacacctatcaaaggtgaaaaatcaggcgatatcggatttgcagtgaaaaaaggggcaaatccagaattaattaaaatgtttaacaacggtcttgcttcactcaaaaaatcgggtgagtacgataaacttgttaaaaaatacctttccacagccagcacctcttcaaacgataaagctgctaaacctgtagatgaatcaactattttagggttaatttctaataactacaaacaattgctatctggtattggaactactttaagtttaactcttatctcatttgcgattgctatggttattggtattatctttggtatgatgagcgtatcaccaagtaatactctccgcacaatttcaatgatttttgttgatattgtccgtggtattccactcatgattgtggccgcttttattttctggggtattcctaatttaatcgaaagcatcacaggtcaccaaagtccaattaatgacttcgttgctgctactatcgctctttctttaaatggtggtgcgtacattgctgaaattgtacgtggtggtattgaagctgttccttctggtcaaatggaagcaagtcgtagtttaggtatttcttacggcaaaactatgcaaaaggttatcttgcctcaagcagtacgccttatgttaccaaactttatcaaccaatttgtcatctcattaaaggatacaacaattgtatcagcaatcggacttgtggaactcttccaaactggtaaaatcataattgcacgtaactatcaatcattccgtatgtatgctatccttgcaattatgtatcttgtaatcattacccttctcacccgtctagcaaaacgtttagaaaagaggcttaaa

SEQ ID NO: 4024 - protein, 727 aa, Streptococcus agalactiae
MKHKLKAFTLALLSIFFVFGGKVSAETVNIVSDTAYAPFEFKDSDQTYKGIDVDIVNEVAKRAGWNVNMTYPGFDAAVNAVQSGQADALMAGTTVTEARKKVFNFSDTYYDTSVILYTKNNNKVTNYKQLKGKVVGVKNGTAAQSFLEENKSKYGYKVKTFDTSDLMNNSLDSGSIYAAMDDQPVVQFAINQGKAYAINMEGEAVGSFAFAVKKGSGHDNLIKEFNTAFAQMKSDGTYNDIMDKWLGKDATKTSGKATGNANEKATPVKPSYKIVSDSSFAPFEYQNGKGKYTGFDMELIKKIAKQQGFKLDISNPGFDAALNAVQSGQADGVIAGATITEARQKIFDFSDPYYTSSVILAVKKGSNVKSYQDLKGKTVGAKNGTASYTWLSDHADKYNYHVKAFDEASTMYDSMNSGSIDALMDDEAVLAYAINQGRKFETPIKGEKSGDIGFAVKKGANPELIKMFNNGLASLKKSGEYDKLVKKYLSTASTSSNDKAAKPVDESTILGLISNNYKQLLSGIGTTLSLTLISFAIAMVIGIIFGMMSVSPSNTLRTISMIFVDIVRGIPLMIVAAFIFWGIPNLIESITGHQSPINDFVAATIALSLNGGAYIAEIVRGGIEAVPSGQMEASRSLGISYGKTMQKVILPQAVRLMLPNFINQFVISLKDTTIVSAIGLVELFQTGKIIIARNYQSFRMYAILAIMYLVIITLLTRLAKRLEKRLK

SEQ ID NO: 4025 - DNA, 738 bp, Streptococcus agalactiae
atggcagaattaaaaattgatgtccaagatttacacaagtcgtatgggcaaaatgaagttttaaaaggtattgatgctaaattttatgaaggtgatgttgtttgtattattggaccttctggttcaggaaaatcaactttccttcgcacattgaacttacttgaatcaatcacaagtggaaaagttgttgtggacggctttgagttatcaaacccaaaaacagacatagacaaagcacgtgaaaatatcggaatggtatttcaacacttcaatcttttcccacatatgtcagttcttgaaaacatcacttttgctcctatagaacttggtaaagaatctaaagaagcagctgaaaagcatgggatggaattacttgaaaaagttggtttagccgataaagctaatgccaaaccagatagtttatctggaggacaaaaacaacgtgtagctatcgcaagaagcttagcgatgaatccagatatcttactttttgacgaaccaacttctgcacttgatccagaaatggttggagatgttctcaatgttatgaaagatttagctgaacaaggtatgactatgttaattgtgacacacgaaatgggatttgctcgtcaagttgccaatcgtgttatctttacagatggtggtcgtttcctcgaagatgggacacctgagcaaatctttgatacacctcaacacccacgtctccaagacttccttaataaagttttaaacgtt

SEQ ID NO: 4026 - protein, 246 aa, Streptococcus agalactiae
MAELKIDVQDLHKSYGQNEVLKGIDAKFYEGDVVCIIGPSGSGKSTFLRTLNLLESITSGKVVVDGFELSNPKTDIDKARENIGMVFQHFNLFPHMSVLENITFAPIELGKESKEAAEKHGMELLEKVGLADKANAKPDSLSGGQKQRVAIARSLAMNPDILLFDEPTSALDPEMVGDVLNVMKDLAEQGMTMLIVTHEMGFARQVANRVIFTDGGRFLEDGTPEQIFDTPQHPRLQDFLNKVLNV

SEQ ID NO: 4027 - DNA, 738 bp, Streptococcus pyogenes
atgacagaattaaaaattgatgttcaagatttacacaaatcttatggtcaaaatgaagtcttaaaaggaattgatgccaaattctacgaaggcgatgtcgtttgtatcattggtccttctggttctgggaaatcaacctttctacgtaccctcaacctcctagagacgattaccagtggtaaggtcatggtggacggttttgaattatcagatcctaagactaatattgacaaggcacgtgaaaatatcgggatggtattccaacacttcaaccttttccctcacatgactgttcttgagaatattatctttgctcctgttgaattaggtaaagagtctaaagaagttgctaaaaagcatggcatggcacttctagaaaaagtcggactttctgataaggccgacgccttcccaggaagtttatccggcgggcaaaaacagcgtgtcgccatcgccagaagtttagcaatgaacccagatattatgctctttgatgaaccaacttctgctcttgaccccgaaatggttggggacgttttgaacgttatgaaagacttggcagaacaaggcatgaccatgttaattgttactcacgaaatgggatttgctcgccaagtagctaaccgtgttatctttacagacggtggtcaattcttggaggatggtactcctgaagagatttttgatcatcctaagcaccctcgtctcattgaatttttagacaaggtcttaaacgtc

SEQ ID NO: 4028 - protein, 246 aa, Streptococcus pyogenes
MTELKIDVQDLHKSYGQNEVLKGIDAKFYEGDVVCIIGPSGSGKSTFLRTLNLLETITSGKVMVDGFELSDPKTNIDKARENIGMVFQHFNLFPHMTVLENIIFAPVELGKESKEVAKKHGMALLEKVGLSDKADAFPGSLSGGQKQRVAIARSLAMNPDIMLFDEPTSALDPEMVGDVLNVMKDLAEQGMTMLIVTHEMGFARQVANRVIFTDGGQFLEDGTPEEIFDHPKHPRLIEFLDKVLNV

SEQ ID NO: 4029 - DNA, 156 bp, Streptococcus agalactiae
atgggagataaaccgatatcatttcgtgataaagatgggaattttgtttcagcggccgatgtctggaatgctgaaaaattagaagaactctttaacacattaaatcctaatcgtaaacttcgtttagaacgcgaaaaattagcaaaagaaaaagga

SEQ ID NO: 4030 - protein, 52 aa, Streptococcus agalactiae
MGDKPISFRDKDGNFVSAADVWNAEKLEELFNTLNPNRKLRLEREKLAKEKG

SEQ ID NO: 4031 - DNA, 186 bp, Streptococcus pyogenes
gtgttatctttaagatggaggtttctgattatgggtgataaaccgatatcctttaaggataaggatggaaattttgtatcggcagcagatgtttggaatgctgagaaattagaagaattgtttaatcttttaaatcccaatagacgtttgcgcttagaacgtgaaaaattgaaaaaggatgaggct

SEQ ID NO: 4032 - protein, 62 aa, Streptococcus pyogenes
VLSLRWRFLIMGDKPISFKDKDGNFVSAADVWNAEKLEELFNLLNPNRRLRLEREKLKKDEA

SEQ ID NO: 4033 - DNA, 1311 bp, Streptococcus agalactiae
atgagtatgtttttagatactgccaaaattagtgttaaggcaggtcgcggtggtgatggcatggttgcttttcgccgtgagaaatatgtccccaatggaggcccgtggggcggtgatggcggtaaaggcggatcggtcatttttaaagtaaacgaaggtttacgaactttgatggattttcgatataaccgtaattttaaagcaaaagctggtgaaaaagggatgactaaaggtatgcacggtcgaggtgcagaagaccttattgtgtcattaccacctggaacaactgttcgtgatgctactacaggtaaggttattaccgaccttgtggagcatgatcaggaattcgttgtagccagaggtggccgcggtggtcgtggaaatattcgctttgcaaccccacgtaatccagctcctgaaattgctgaaaatggggagcctggtgaagaacgtgaattacaattagaattaaaaattttggctgatgttggtctcgttggtttcccatcagttgggaagtcgacgctacttagtgttgtttcagcagcaaagcctaaaattggtgcctatcattttacgacaattgtccctaatttagggatggttcgtacaaaatcaggtgatagctttgcaatggctgatcttcctggtttgattgaaggggctagtcaaggtgtcggattaggaactcagtttcttagacatattgagcgtacacgtgttattctacatgttattgatatgtcggcaagtgaaggacgagacccttacgatgactatgtttcaattaataatgagttggaaacttacaatcttcgattgatggaacgtccgcaaattattgttgccaataaaatggacatgcctgattcagaagagaatttggcagcattcaaagaaaaattagcagcaaactatgatgagtttgatgacatgcctatgatttttccaatttcaagtttagcacatcaaggactagaaaaccttatggatgcgacggctgaattattagccaatacagaagagtttcttctttatgacgaaactgacatgcaagaagatgaagcatactatggatttaacgaagatgaacgtccatttgagattacacgtgatgatgatgcaacgtgggtattgtatggtgataagctagaaaaactctttgttatgacaaatatggaacgcgatgaatcaataatgaaatttgctcgtcagttacgtggtatgggcgttgatgaagcccttcgagagcgcggagctaaggatggagatattgttcgtataggtaacttcgaatttgaatttgtagat

SEQ ID NO: 4034 - protein, 437 aa, Streptococcus agalactiae
MSMFLDTAKISVKAGRGGDGMVAFRREKYVPNGGPWGGDGGKGGSVIFKVNEGLRTLMDFRYNRNFKAKAGEKGMTKGMHGRGAEDLIVSLPPGTTVRDATTGKVITDLVEHDQEFVVARGGRGGRGNIRFATPRNPAPEIAENGEPGEERELQLELKILADVGLVGFPSVGKSTLLSVVSAAKPKIGAYHFTTIVPNLGMVRTKSGDSFAMADLPGLIEGASQGVGLGTQFLRHIERTRVILHVIDMSASEGRDPYDDYVSINNELETYNLRLMERPQIIVANKMDMPDSEENLAAFKEKLAANYDEFDDMPMIFPISSLAHQGLENLMDATAELLANTEEFLLYDETDMQEDEAYYGFNEDERPFEITRDDDATWVLYGDKLEKLFVMTNMERDESIMKFARQLRGMGVDEALRERGAKDGDIVRIGNFEFEFVD

SEQ ID NO: 4035 - DNA, 1311 bp, Streptococcus pyogenes
atgagtatgtttttagatacggcaaaaatcagtgtccaagcaggccgtggtggcgatggtatggtagcttttcgtcgtgaaaagtacgtcccaaatggcggtccttggggaggagacggcggtaaaggtggctcagttatcttccgagtggacgaaggtttgcgtaccttgatggatttccggtataatcgtaaattcaaggcgaaatctggtgaaaaaggtatgaccaaaggcatgcacggccgtggtgcagaagatttgattgtctttgttcctcaagggacaacggttcgtgatgctgaaactggaaaagtaattacagacttagtagaacatggtcaagaagtggtcattgctaagggtggtcgtggtggccgtgggaatattcgttttgcaactcctcgtaatcctgcgccagagattgctgaaaatggtgagccaggtgaggaacgtcagttagagttagaactcaaaatcttagctgacgttggcttggtcggattcccatctgttgggaaatcaaccttgttaagtgttgtgtcatcagctaaaccgaaaattggtgcctatcattttaccactattgttcctaatcttggaatggttcgtacaaagtcaggtgatagctttgctatggcagatctgccaggtttgattgaaggtgctagccaaggggttggtttaggaactcaattcctccgtcatatcgagcggacacgggttattcttcatgtgattgacatgtctgctagtgagggtcgtgatccttacgaagattatgtttccattaataacgagctggaaacctataatttgcgattgatggagcgcccacagattattgtggctaataaaatggacataccagaggctcaagaaaacttgaaagccttcaagaaaaaattggctgcccaatatgacgagtttgatgatttgccaatgattttccctatttcaagcctagcacatcaaggcttagagaacttgttagaagcaacggcagaattactcgctaaaacagacgaattcttattatatgatgaatctgatctggtggacgaggaagcttactatggctttgctgagactgaaaaagactttgagatcacacgtgacgatgacgctacttgggtcttgtctggtgagaagttagaacgtctctttgtcatgaccaatatggaacgtgatgagtccatcatgaaatttgcccgtcaattgcgcggtatgggggttgacgaagctcttcgtgaacgtggagcaaaagatggggatcctgttcgtattggcaagtttgaatttgaatttgtggat

SEQ ID NO: 4036 - protein, 437 aa, Streptococcus pyogenes
MSMFLDTAKISVQAGRGGDGMVAFRREKYVPNGGPWGGDGGKGGSVIFRVDEGLRTLMDFRYNRKFKAKSGEKGMTKGMHGRGAEDLIVFVPQGTTVRDAETGKVITDLVEHGQEVVIAKGGRGGRGNIRFATPRNPAPEIAENGEPGEERQLELELKILADVGLVGFPSVGKSTLLSVVSSAKPKIGAYHFTTIVPNLGMVRTKSGDSFAMADLPGLIEGASQGVGLGTQFLRHIERTRVILHVIDMSASEGRDPYEDYVSINNELETYNLRLMERPQIIVANKMDIPEAQENLKAFKKKLAAQYDEFDDLPMIFPISSLAHQGLENLLEATAELLAKTDEFLLYDESDLVDEEAYYGFAETEKDFEITRDDDATWVLSGEKLERLFVMTNMERDESIMKFARQLRGMGVDEALRERGAKDGDPVRIGKFEFEFVD

SEQ ID NO: 4037 - DNA, 126 bp, Streptococcus agalactiae
gtggcttttggagataacggacaacgaaaaaaaactgggtttgaaaaactaactctttttgttgttattttgatggtactagtaacagttggtggtttggtatttggtgctattagtgcaatcatg

SEQ ID NO: 4038 - protein, 42 aa, Streptococcus agalactiae
MAFGDNGQRKKTGFEKLTLFVVILMVLVTVGGLVFGAISAIM

SEQ ID NO: 4039 - DNA, 126 bp, Streptococcus pyogenes
gtggcatttggagaaaatggacctcgcaaaaaaacaacctttgaaaaagtgacaatgtttgttgttatcctaatggttcttgtaactgttggcgggcttattgcgagtgccctatcagtattaatg

SEQ ID NO: 4040 - protein, 42 aa, Streptococcus pyogenes
VAFGENGPRKKTTFEKVTMFVVILMVLVTVGGLIASALSVLM

SEQ ID NO: 4041 - DNA, 1239 bp, Streptococcus agalactiae
atggttttacaagatttcgacaaccttttaaaaaaatatgcccaattaattatttctaaaggtttaaatgtccaaaaagggcacactctcgctttaacaatcgatgtggaacaagtccacttagcaaggcttttaactgaagccgcttatgaaaagggagcaagtgaagttattgttgattatacagatgattttatcacgcgccagcgactacttcatgcttcagacgaagttctcacgaatgttccacagtataccgttgataaatctttagcactattaaataagaaggctagtcgattagttgtgaaatcttctaaccctaacgctttcgctactgttgatcctaaacgtttatctgaaacaactagagcaaccgctattgccttagaggaacaaagtagagcaatacaagctaataaagtatcttggaacgtggctgcagctgctggtagagaatgggctgcacttgtcttcccagaattaaaaacaagcgaccaacaagttgatgctctttgggataccattttcaaattaaatcgtatttatgaagatgatcctattgctgcttgggacgcacatgaagctaaattattagaaaaagctactagactaaatcaagaacaatttgatgctcttcattataccgcaccaggtacagatttaacgcttggtatgcctaaaaatcatatttgggaggcagccggtagtctcaacgctcagggagagacttttatcgctaatatgcctactgaagaaatcttttcagcacctgattaccgtcgtgcagatgggtatgtgacaagtacaaaacctctcagttatgctggcgttattatcgaaaatatgacatttacctttaaagacggtaaaattatcaatgtcactgcagaaaaagggcaagaaacagtccaacgcttaatcgaggaaaatgatggggcaagatcgcttggggaagttgcacttgtcccacataaaacaccaatttcactatctggactgattttctttaatactttattcgatgaaaatgcctctaatcacctcgctattggaactgcatatgccttcaatgtagaaggaggaacagaaatgacaagtcaagaattggatgaagctggtttaaatcgttcttcaacacatgttgattttatgattggttcagaacaaatggatattgatggtattcgtgcagatggaactgctgtcccaatctttagaaatggcgaatgggctatt

SEQ ID NO: 4042 - protein, 413 aa, Streptococcus agalactiae
MVLQDFDNLLKKYAQLIISKGLNVQKGHTLALTIDVEQVHLARLLTEAAYEKGASEVIVDYTDDFITRQRLLHASDEVLTNVPQYTVDKSLALLNKKASRLVVKSSNPNAFATVDPKRLSETTRATAIALEEQSRAIQANKVSWNVAAAAGREWAALVFPELKTSDQQVDALWDTIFKLNRIYEDDPIAAWDAHEAKLLEKATRLNQEQFDALHYTAPGTDLTLGMPKNHIWEAAGSLNAQGETFIANMPTEEIFSAPDYRRADGYVTSTKPLSYAGVIIENMTFTFKDGKIINVTAEKGQETVQRLIEENDGARSLGEVALVPHKTPISLSGLIFFNTLFDENASNHLAIGTAYAFNVEGGTEMTSQELDEAGLNRSSTHVDFMIGSEQMDIDGIRADGTAVPIFRNGEWAI

SEQ ID NO: 4043 - DNA, 504 bp, Streptococcus agalactiae
ttgaaccttgaaaatggtattatttactcaaaaaatattgctaagcaattaattgctaaagatccaaaaaacaaagctacttatgagaaaaacagagatgcttatgtagctaaattagaaaaattggataaagaagcaaaatctaaatttaatgccattccagctaataaaaaattaattgttactagtgaaggttgctttaaatatttctcaaaagcttatggagttccatcagcatacatctgggaaattaacactgaagaagaaggtacaccagatcaaattactagcttagttaagaaattaaaacaagtaagaccttcagctttattcgttgaatcaagtgttgacaagcgtcctatgaaatctgtttcaagagaatcaggtatcccaatttacgcagaaatcttcacagactcaattgctaaaaaaggtcaaaagggtgacagctactacgctatgatgaaatggaatcttgataagattgcagaaggtttagcaaaa

SEQ ID NO: 4044 - protein, 168 aa, Streptococcus agalactiae
MNLENGIIYSKNIAKQLIAKDPKNKATYEKNRDAYVAKLEKLDKEAKSKFNAIPANKKLIVTSEGCFKYFSKAYGVPSAYIWEINTEEEGTPDQITSLVKKLKQVRPSALFVESSVDKRPMKSVSRESGIPIYAEIFTDSIAKKGQKGDSYYAMMKWNLDKIAEGLAK

SEQ ID NO: 4045 - DNA, 2052 bp, Streptococcus agalactiae
ttggaagatcaaatgaaacgtaaatactttattcttaatacggtgacggttttaacgttagctgctgcaatgaatactagcagtatctatgctaatagtactgagacaagtgcttcagtagttcctactacaaatactatcgttcaaactaatgacagtaatcctaccgcaaaatttgtatcagaatcaggacaatctgtaataggtcaagtaaaaccagataattctgcggcgcttacaacagttgacacgcctcatcatatttcagctccagatgctttaaaaacaactcaatcaagtcctgtcgttgagagtacttctactaagttaactgaagagacttacaaacaaaaagatggtcaagatttagccaacatggtgagaagtggtcaagttactagtgaggaactcgttaatatggcatacgatattattgctaaagaaaacccatctttaaatgcagtcattactactagacgccaagaagctattgaagaggctagaaaacttaaagataccaatcagccgtttttaggtgttcccttgttagtcaaggggttagggcacagtattaaaggtggtgaaaccaataatggcttgatctatgcagatggaaaaattagcacatttgacagtagctatgtcaaaaaatataaagatttaggatttattattttaggacaaacgaactttccagagtatgggtggcgtaatataacagattctaaattatacggtctaacgcataatccttgggatcttgctcataatgctggtggctcttctggtggaagtgcagcagccattgctagcggaatgacgccaattgctagcggtagtgatgctggtggttctatccgtattccatcttcttggacgggcttggtaggtttaaaaccaacaagaggattggtgagtaatgaaaagccagattcgtatagtacagcagttcattttccattaactaagtcatctagagacgcagaaacattattaacttatctaaagaaaagcgatcaaacgctagtatcagttaatgatttaaaatctttaccaattgcttatactttgaaatcaccaatgggaacagaagttagtcaagatgctaaaaacgctattatggacaacgtcacattcttaagaaaacaaggattcaaagtaacagagatagacttaccaattgatggtagagcattaatgcgtgattattcaaccttggctattggcatgggaggagctttttcaacaattgaaaaagacttaaaaaaacatggttttactaaagaagacgttgatcctattacttgggcagttcatgttatttatcaaaattcagataaggctgaacttaagaaatctattatggaagcccaaaaacatatggatgattatcgtaaggcaatggagaagcttcacaagcaatttcctattttcttatcgccaacgaccgcaagtttagcccctctaaatacagatccatatgtaacagaggaagataaaagagcgatttataatatggaaaacttgagccaagaagaaagaattgctctctttaatcgccagtgggagcctatgttgcgtagaacaccttttacacaaattgctaatatgacaggactcccagctatcagtatcccgacttacttatctgagtctggtttacccatagggacgatgttaatggcaggtgcaaactatgatatggtattaattaaatttgcaactttctttgaaaaacatcatggttttaatgttaaatggcaaagaataatagataaagaagtgaaaccatctactggcctaatacagcctactaactccctctttaaagctcattcatcattagtaaatttagaagaaaattcacaagttactcaagtatctatctctaaaaaatggatgaaatcgtctgttaaaaataaaccatccgtaatggcatatcaaaaagcacttcctaaaacaggtgatacagaatcaagcctatctccagttttagtagtaacccttttattagcttgttttagctttgtaacaaaaaagaatcagaaaagt

SEQ ID NO: 4046 - protein, 684 aa, Streptococcus agalactiae
MEDQMKRKYFILNTVTVLTLAAAMNTSSIYANSTETSASVVPTTNTIVQTNDSNPTAKFVSESGQSVIGQVKPDNSAALTTVDTPHHISAPDALKTTQSSPVVESTSTKLTEETYKQKDGQDLANMVRSGQVTSEELVNMAYDIIAKENPSLNAVITTRRQEAIEEARKLKDTNQPFLGVPLLVKGLGHSIKGGETNNGLIYADGKISTFDSSYVKKYKDLGFIILGQTNFPEYGWRNITDSKLYGLTHNPWDLAHNAGGSSGGSAAAIASGMTPIASGSDAGGSIRIPSSWTGLVGLKPTRGLVSNEKPDSYSTAVHFPLTKSSRDAETLLTYLKKSDQTLVSVNDLKSLPIAYTLKSPMGTEVSQDAKNAIMDNVTFLRKQGFKVTEIDLPIDGRALMRDYSTLAIGMGGAFSTIEKDLKKHGFTKEDVDPITWAVHVIYQNSDKAELKKSIMEAQKHMDDYRKAMEKLHKQFPIFLSPTTASLAPLNTDPYVTEEDKRAIYNMENLSQEERIALFNRQWEPMLRRTPFTQIANMTGLPAISIPTYLSESGLPIGTMLMAGANYDMVLIKFATFFEKHHGFNVKWQRIIDKEVKPSTGLIQPTNSLFKAHSSLVNLEENSQVTQVSISKKWMKSSVKNKPSVMAYQKALPKTGDTESSLSPVLVVTLLLACFSFVTKKNQKS

SEQ ID NO: 4047 - DNA, 1452 bp, Streptococcus pyogenes
atgacttatcaagatgcgacggctatggctattgctgttcagactggtcagaccacaccactagaattagtaacccaggctatttataaggctaaaaagttgaaccctaccttaaatgctattacctcagaacgctttgaagcagccctagaagaagccaaacaaagggatttttcaggtctgccttttgctggtgtgcctctttttttaaaagatttgggacaagaattaaaaggtcactcatcaacctcaggttccagattgtttaaagagtatcaagcgactaaaacggatttatttgtgaaaagattagaagctttaggctttattattttagggcgctccaacacgcctgaatttggctttaaaaatattagcgatagcagtttgcacggaccagtgaatttaccaagggataatacacgaaatgctggtggctcatctgggggagctgctgctctagtgtcatcaggaattagtgcgctagcaactgctagtgatggtggtggttctattcgaattccagcctcgtttaatggcttaattgggctcaaacctagccgtgggcgcatgcctgtcggacctggttcttatcgaagctggcaaggagcctcagttcattttgccttgaccaaatccgttagagatactagaaatctactctactatttacagatggaacaaatggaaagccccttccccctagccaccttaacaaaagatagtatttatcaatcgctacaacgtcccttgacaattgctttttatcaacggttaagtgacggtagcccagtatctttagatactgcaaaagctttaagacaagcagtaacttggctaagagaacaagggcatcagctagttgaattggaagagtttcctgtaaatatgacagaagtgattcgtcattattatattatgaatagtgtggaaacggctgctatgtttgctgatattgaagacacttttggacgtccgatgaccaaagacgatatggaaaccatgacctgggctatttaccaatcaggtaaagacatcccagcttggcgttactcacaggtccttcaaaaatgggatacgtacagtgcaaccatggctagttttcatgagacttatgacctgttgttgacgttcacaaccaacacaccagctcctaagcacggagaacttgtcccagattcgaaactcatggctaacttggctcaagctgaaattttcagcagtgaagagcaattcaatttggtcgaaaccatgtttggtaagagtctggctattaatccttacacagctctgcctaatctaactggccagccagctattagtttacctacttatgaaactaaggaaggtctctcaatgggcattcaactaattgcagccaaaggtagagaggacctattattaggaattgcagaacagtttgaggcagcaggattattgaagattcctcaa

SEQ ID NO: 4048 - protein, 484 aa, Streptococcus pyogenes
MTYQDATAMAIAVQTGQTTPLELVTQAIYKAKKLNPTLNAITSERFEAALEEAKQRDFSGLPFAGVPLFLKDLGQELKGHSSTSGSRLFKEYQATKTDLFVKRLEALGFIILGRSNTPEFGFKNISDSSLHGPVNLPRDNTRNAGGSSGGAAALVSSGISALATASDGGGSIRIPASFNGLIGLKPSRGRMPVGPGSYRSWQGASVHFALTKSVRDTRNLLYYLQMEQMESPFPLATLTKDSIYQSLQRPLTIAFYQRLSDGSPVSLDTAKALRQAVTWLREQGHQLVELEEFPVNMTEVIRHYYIMNSVETAAMFADIEDTFGRPMTKDDMETMTWAIYQSGKDIPAWRYSQVLQKWDTYSATMASFHETYDLLLTFTTNTPAPKHGELVPDSKLMANLAQAEIFSSEEQFNLVETMFGKSLAINPYTALPNLTGQPAISLPTYETKEGLSMGIQLIAAKGREDLLLGIAEQFEAAGLLKIPQ

SEQ ID NO: 4049 - DNA, 720 bp, Streptococcus agalactiae
atgagacttgataaatttttagtagaatgcggacttggttcacgtactcaagtcaaattaatattgaaaaaaaagcagattagtgttaatggtaatagcgagacatctccaaaagtacaggtagatgaatatagagatgagattaaatataatggaactctagtgtcatatgaaaagtttgtttattatatgcttcataaacccaaaggtgttatatcagcaacggatgatccttcgcataaaaccgtgttagatttgctagacaaaactgctcgagataaagctgttttcccagtggggcgtttagatattgatacaacaggccttttgttattaactaataatggggaattagcgcataaaatgttatcacctaaaaaacacgttgataaatgctatgaggtaaaaatctcagggataatgacagaagacgatattttggcatttgataaagggattattctgaaagattttacttgtttaccagcattattagaaattgtggaagtaaatcaggtgaagaagcagagtcttgttaaaatcaccattaaggaaggaaaattccatcaagttaaacgtatggttgctgcgtgtggtaaggaagtcttagagctaaagcgtctaaggatgggaaatctacaattagataaacagctagaaagtggacaatggagacggctaacaataaaagaaatagaaaaattagaaaaatatatgcaa

SEQ ID NO: 4050 - protein, 240 aa, Streptococcus agalactiae
MRLDKFLVECGLGSRTQVKLILKKKQISVNGNSETSPKVQVDEYRDEIKYNGTLVSYEKFVYYMLHKPKGVISATDDPSHKTVLDLLDKTARDKAVFPVGRLDIDTTGLLLLTNNGELAHKMLSPKKHVDKCYEVKISGIMTEDDILAFDKGIILKDFTCLPALLEIVEVNQVKKQSLVKITIKEGKFHQVKRMVAACGKEVLELKRLRMGNLQLDKQLESGQWRRLTIKEIEKLEKYMQ

SEQ ID NO: 4051 - DNA, 732 bp, Streptococcus pyogenes
atgatgcgcttagataaatttttagtggcaactggtgttggaactaggagccaagtcaaacttctcttaaaaaagaaggctattttcgtcaatcaaaaggttgaaacctctgccaaagcacacattgatgaatacaaggatttggtgacgtatcaaggtacgcccttggtctatgaatcctttgtttattacctgttaaacaagccgtcagggtatgtgtcagcaacccaggacagacagcaggctactgttatggagttgttagatgacacggctaggcaaaaagcagtttttcctgtgggtaggttagataaggatacccgtggacttttgctcttgaccaataatggacaactagcccatgaccttttatcccctaaaaaacatgttacgaaagagtacttggctaaagtagcaggcatcatgactgaagctgataaagattattttgctagaggtatttccttaaaggatcaccagtgcctacctgctcatttagaagtgcttgctagtgatttacagcagcaaacaagtttggttaaaattaccatacaagaaggaaaattccatcaggtgaaacgcatggtagcagcctgtggaaaggaagtgcttgacttacagcgtctcagcatgggaccattaaaactagaccctagccttgcagaaggggagtttaggcgcctgacgcctgaggaattgcagagcctggcaccttattgtcagagctcacta

SEQ ID NO: 4052 - protein, 244 aa, Streptococcus pyogenes
MMRLDKFLVATGVGTRSQVKLLLKKKAIFVNQKVETSAKAHIDEYKDLVTYQGTPLVYESFVYYLLNKPSGYVSATQDRQQATVMELLDDTARQKAVFPVGRLDKDTRGLLLLTNNGQLAHDLLSPKKHVTKEYLAKVAGIMTEADKDYFARGISLKDHQCLPAHLEVLASDLQQQTSLVKITIQEGKFHQVKRMVAACGKEVLDLQRLSMGPLKLDPSLAEGEFRRLTPEELQSLAPYCQSSL

SEQ ID NO: 4053 - DNA, 903 bp, Streptococcus agalactiae
atgtttaaaatagatgtttttcactatgaaattcatttttgtcacatagaaaaggagattgttatggaaacatatactttatcgaatactcttaacattcctaaaattggttttgggacatggcaactaactgaaggtgaagaagcttataaggcagtgactcatgctttaaaagttggttatactcatattgatactgctcagatttatggtaatgaacatagtgttggacgtgctataagagacagtggtttggcaagagaaagtatctttttgacaactaagatttggaatgacaaacatgactatcatttagccaaagcttctattgatgaatctctgcagaaattaggtgttgattatattgatcttcttttgattcattggccaaatccaaaagctcttcgtgaaaatgatgcgtggaaagctgggaatgcaggcacttggaaagcgatggaagaagcttataaagaaggaaaggtaaaagctattggtgtttcgaatttcatgaaacatcacttagaggctttatttgaaactgccgaaataaaacctatggttaatcaaattatcctagcaccaggttgtgctcaagaggatttggttcgcttctgtaaaggaaatgatatcttattagaagcttacagtccatttggaacaggtgctatttttgaaaatgaatctataaaagctattgctgaaaaatatggtaaatcagttgcgcaagtagctcttcgctggtcacttgataatggctttttaccattacctaagtcagcgactcccaaaaatattgaagcaaaccttgatatttttgattttcaattaaacgaagatgatattgctaccttaatacaactagattcaggtattaaacccaaagatccagataatgtctcattt

SEQ ID NO: 4054 - protein, 301 aa, Streptococcus agalactiae
MFKIDVFHYEIHFCHIEKEIVMETYTLSNTLNIPKIGFGTWQLTEGEEAYKAVTHALKVGYTHIDTAQIYGNEHSVGRAIRDSGLARESIFLTTKIWNDKHDYHLAKASIDESLQKLGVDYIDLLLIHWPNPKALRENDAWKAGNAGTWKAMEEAYKEGKVKAIGVSNFMKHHLEALFETAEIKPMVNQIILAPGCAQEDLVRFCKGNDILLEAYSPFGTGAIFENESIKAIAEKYGKSVAQVALRWSLDNGFLPLPKSATPKNIEANLDIFDFQLNEDDIATLIQLDSGIKPKDPDNVSF

SEQ ID NO: 4055 - DNA, 744 bp, Streptococcus agalactiae
ttgctacgatatcgcctgctgagattttttctaaattgtgatatgatagcattaataacaggaggatctaaaatgacaaaagaagatatcaaaaaacaagttcgaagagcttttgattttcgtatggcgattcgtgtttataataataatgatattcctaaagaagatatggagtatattttagatactgcttggttgagtccttcttcagtcggtttagaaggctggcgatttttggtactagatagacaaacaattgcaaaatttcgagataaacttaaggaagttgcttggggagcacaatatcaactagatactgctagtcactttgttttactactagctgaaaaaggtgcttattataacgctgatagcatgattaacagtctcattcgacgtggtctaggtgatccagctgcccttgagagtaggatacctctctacaaatccttccaagaaaacgatatgaaaattgattctgaacgttctctttgggattggacagcaaaacaaacttatatcgcactcggtaatatgatgacggctgctgctatgatcggcgtagattcatgcccaattgaaggatttgactatgaaaaggtcaataatatccttagtaaagaaggattaatagacgataagaaagaagctatttcttgtatggtttcatttggttatcgtttgcgtgaacctaaacattcccgtgctaggaaagaacgccaagaagtcattacttgggttgag

SEQ ID NO: 4056 - protein, 248 aa, Streptococcus agalactiae
MLRYRLLRFFLNCDMIALITGGSKMTKEDIKKQVRRAFDFRMAIRVYNNNDIPKEDMEYILDTAWLSPSSVGLEGWRFLVLDRQTIAKFRDKLKEVAWGAQYQLDTASHFVLLLAEKGAYYNADSMINSLIRRGLGDPAALESRIPLYKSFQENDMKIDSERSLWDWTAKQTYIALGNMMTAAAMIGVDSCPIEGFDYEKVNNILSKEGLIDDKKEAISCMVSFGYRLREPKHSRARKERQEVITWVE

SEQ ID NO: 4057 - DNA, 663 bp, Streptococcus pyogenes
atggatcaaaccattcatcaccaaatacagcaagcactacactttagaacagccgttcgtgtttataaggaagaaaagatttctgatgaggatttagcccttatccttgatgctgcttggttaagcccttcttctattggcttagaaggctggcgctttgtcgttttagacaacaagcctattaaagaagaaatcaagccctttgcctggggagcccagtatcaactggaaacagctagtcactttattcttttaatagccgaaaaacatgcaagatacgatagccctgctatcaaaaatagccttttacggcgtggtatcaaagaaggtgatggtctcaacagccgcctaaaactctatgaatctttccaaaaagaggacatggatatggcagataatcctcgggcactctttgattggacagctaaacaaacctatatcgctcttggtaatatgatgatgacagctgctcttttgggcattgatacttgccctattgaaggctttcattatgataaggtcaatcatatcctagctaagcataatgtgattgatttagaaaaagaaggcattgctagcatgttatccctaggctatcgtttgcgagatcccaaacatgctcaagttcgtaagcctaaagaagaagtgatttcagtcgttaaa

SEQ ID NO: 4058 - protein, 221 aa, Streptococcus pyogenes
MDQTIHHQIQQALHFRTAVRVYKEEKISDEDLALILDAAWLSPSSIGLEGWRFVVLDNKPIKEEIKPFAWGAQYQLETASHFILLIAEKHARYDSPAIKNSLLRRGIKEGDGLNSRLKLYESFQKEDMDMADNPRALFDWTAKQTYIALGNMMMTAALLGIDTCPIEGFHYDKVNHILAKHNVIDLEKEGIASMLSLGYRLRDPKHAQVRKPKEEVISVVK

SEQ ID NO: 4059 - DNA, 390 bp, Streptococcus agalactiae
atgccatttttacatacttgtattcgcgttaaagatttggacgcctcaattgctttttatcaagaagcacttggttttaaggaagttcgtcgtaatgactttcctgaaaatcaatttactttagtctatatggccctagaggacgaccctagttacgaattagagttaacctataactatgatcacgaagcttatgatttaggaaatgggtatggtcatattgctgttggtgtagacgatttggaaactacttatgatgcccatcagaaagcaggttactctgtaacaaaaatttctggattaccaggtaaacctaatatgttctactttattcaagatccagatggctataaaattgaagttattcgactcagtcaatttaaagctgac

SEQ ID NO: 4060 - protein, 130 aa, Streptococcus agalactiae
MPFLHTCIRVKDLDASIAFYQEALGFKEVRRNDFPENQFTLVYMALEDDPSYELELTYNYDHEAYDLGNGYGHIAVGVDDLETTYDAHQKAGYSVTKISGLPGKPNMFYFIQDPDGYKIEVIRLSQFKAD

SEQ ID NO: 4061 - DNA, 375 bp, Streptococcus pyogenes
atgaaagcattacatacctgtatccgcgtcaaagaccttgaccagtcggttgctttttacacaagtgccttcccttttaaggaaaactatcgtaaagattttccagatagtcaatttactcttgtttatctggctttagaaggagaaagttatgaattagaattaacctacaattatggtcatggcgactacgacttaggaaatggctatggtcatattgcccttggctctgaacattttgaagcagaccataaaaaacatcgacaagcaggttttccagttaccgatatcaaagaactggctgacaaatctgcccgctattatttcattcaggatccagatggctacaaaattgaagtcattgatttaaacaac

SEQ ID NO: 4062 - protein, 125 aa, Streptococcus pyogenes
MKALHTCIRVKDLDQSVAFYTSAFPFKENYRKDFPDSQFTLVYLALEGESYELELTYNYGHGDYDLGNGYGHIALGSEHFEADHKKHRQAGFPVTDIKELADKSARYYFIQDPDGYKIEVIDLNN

SEQ ID NO: 4063 - DNA, 924 bp, Streptococcus agalactiae
atggctttattatcagttattgtcccttgttataatgaacaagagactgtctcaacttttttaacagaaatcaaaaaagttgaatccgaaatggctcgttacacccattttgaatacattttcgtaaacgatggttctactgatcgtacactcgaacttcttaagaaagcagctaaacaatttgacaatgttcattacctttcattttcacgccattttggtaaagatgctgctttattggctggtttagaacatactactggtgattttatcactgttatggatgttgacttgcaagatccacccactttattaccagaaatgtacctaaaacttcaagaaggttatgatattgtcgctacaaggcgaaaagatcgtaaaggggagccgttgatacgctctctttttgccaagcttttttataaattaatcaatcaagtgtcagatactaaaatggttgatggtgcgcgtgattttcgtctcatgacaaaacaagttgttgacagtattctcgagctaaatgaagtgaatcgcttctcaaaagggattttttcctggattggatatgatgtcgcttatattagttatgagaatcgagaacgaattgcgggtaagacctcatggagtttctttaatctcttaaaatactctctagacggtttcatcaacttctcagaaattccattagctatagctacctggattggaacccttagttcagtactatcacttttagctatcatttttattataattcgaaaattactatttggggatcccgtttcaggttgggcaagcacagttaccattgtactttttatgggtggtattcagttattgtcgctaggaattataggcaaatacatctctaagattttcctagaaactaaaaaacgcccagtctatattgtcaaggaagaggga

SEQ ID NO: 4064 - protein, 308 aa, Streptococcus agalactiae
MALLSVIVPCYNEQETVSTFLTEIKKVESEMARYTHFEYIFVNDGSTDRTLELLKKAAKQFDNVHYLSFSRHFGKDAALLAGLEHTTGDFITVMDVDLQDPPTLLPEMYLKLQEGYDIVATRRKDRKGEPLIRSLFAKLFYKLINQVSDTKMVDGARDFRLMTKQVVDSILELNEVNRFSKGIFSWIGYDVAYISYENRERIAGKTSWSFFNLLKYSLDGFINFSEIPLAIATWIGTLSSVLSLLAIIFIIIRKLLFGDPVSGWASTVTIVLFMGGIQLLSLGIIGKYISKIFLETKKRPVYIVKEEG

SEQ ID NO: 4065 - DNA, 984 bp, Streptococcus pyogenes
ttgaaatatctcagcttttgtgttacaattgccctaaaattccatttgaaagaaaagtctatgacactactatctatcattgtcccctgctttaatgaagaagcaaacattctcccttattttgaagaaatgcatcaactagaaacgtccatgaccaaccaacttgcttttgaatacatttttattgatgatggttctaaggataacaccttgggtattttgcgtgagctagctgctcgctttccaaatgtgcattatctgtctttttcacgccattttggcaaggaagctgggctcttagctggactaaaagaagccaaaggcaattacattactgtgatggatgtggatctgcaagatccacccgaacttttgccaattatgtacgctaagctaaaagaaggttatgacatcgttggcaccaggcgccaaaatagacaaggagaaccactaattcgttcaatgtgttcgaatctattttatggactgatcaaacacttatcagatactgaaatggtcaatggagttcgggattatcggttaatgaccagacaagtcgttgatagcattcttgagttgggagaggttaatcgtttttcaaaagggatcttttcgtgggttggttatcgtatcacctatcttagttttgaaaaccaaaaacgcaaatatggaaaaagtcgttggcatttttgggagttgctccgatattctttagatggctttatcaacttttcagaaatgccgttaaccattgctacctggacagggactttcagctttttgatttctattttcgccatcttatttatcattatcagaaagatactctttggtgatcctgtctctggttgggccagcactgtctctattattttattcatgggaggcattcagctcttttgcatgggtattattggaaaatatatttcaaaaatattccttgaaactaaaaaaaggcctctctatattatcaaagaaaaacat

SEQ ID NO: 4066 - protein, 328 aa, Streptococcus pyogenes
LKYLSFCVTIALKFHLKEKSMTLLSIIVPCFNEEANILPYFEEMHQLETSMTNQLAFEYIFIDDGSKDNTLGILRELAARFPNVHYLSFSRHFGKEAGLLAGLKEAKGNYITVMDVDLQDPPELLPIMYAKLKEGYDIVGTRRQNRQGEPLIRSMCSNLFYGLIKHLSDTEMVNGVRDYRLMTRQVVDSILELGEVNRFSKGIFSWVGYRITYLSFENQKRKYGKSRWHFWELLRYSLDGFINFSEMPLTIATWTGTFSFLISIFAILFIIIRKILFGDPVSGWASTVSIILFMGGIQLFCMGIIGKYISKIFLETKKRPLYIIKEKH

SEQ ID NO: 4067 - DNA, 201 bp, Streptococcus agalactiae
  misc_feature (1)..(201): n = a, c, g, or t
atgtcaaaaaataataatgaccacactcaaaaatctgagaatggtatggtacgcggcctagaaaatcgtcacgtacagttaattgcgattgcagggacaatcggaactgggctttttcttggtgcaggtcgttcaattagcctgacgggtccttcaatagttcttgtctatgctatcactggcgcttnnnnnttaattaat

SEQ ID NO: 4068 - protein, 67 aa, Streptococcus agalactiae
  MISC_FEATURE (1)..(67): Xaa = Any Amino Acid
MSKNNNDHTQKSENGMVRGLENRHVQLIAIAGTIGTGLFLGAGRSISLTGPSIVLVYAITGAXXLIN

SEQ ID NO: 4069 - DNA, 1389 bp, Streptococcus pyogenes
atggagtttagaatgtctataaaagaacaaacagacaataacgaactagaaaatggaatggtaaggggcttagaaaatcgtcatgtgcagttaattgcgatcgcaggaacgattggaacaggtctctttttaggggcaggacgctctattgccctaacaggaccatctattatttttgtgtatatgattacaggtgccttcatgtttatgatgatgcgtgccatcggtgaaatgctctattatgatccagatcaacacacctttatcaattttatttccaaatacattggtccaggctggggttatttttcgggtctatcctattggatttcccttatttttattggaatggcagaaatcacagcagtaggtgcttatgtgcaattttggttcccaagctggccagcctggttgattcagttggttttcttagtcttacttagttcgatcaacttaattgctgtgcgcgtttttggggaaacagagttttggtttgccatgattaagattttagctattttagctttgattgcaacagctattttcatggtattgacaggttttgaaactcacacaggccatgctagcctttccaatatttttgaccatttttccatgttcccaaatgggaaactaaagttctttatggccttccaaatggttttctttgcttatcaagctatcgaatttgtgggaattaccacttctgagacggctaacccaagaaaagttctaccaaaggctattcaagaaattccaacccgtattgtgatcttttatgtgggagccttggtctctattatggcaattgtgccatggcatcagttaccagttgatgaatctccttttgtgatggtgttcaaattgattggtattaaatgggcagcagccttgattaactttgtggtcttgacatcagcagcgtcagcgcttaactcaaccctttattcaaccggtcgtcatctctatcagattgctaatgagactccaaacgctttgaccaatcgcttaaagattaatactttatctcgacaaggggtgccaagtcgtgccattattgcttcagcggttgtggttggtatctcagctttgattaatatcctaccaggagttgcagatgcgttctcactcattacggcctcctcatcaggtgtatatattgctatctacgccttaaccatgattgctcactggaagtaccgtcaatctaaggactttatggcagatggttatttgatgccaaaatataaagtgacaacgcctttgacccttgctttctttgcctttgtctttatctctcttttcttacaagaatccacctatatcggcgccattggagcaacgatttggattattatttttgggatttatagcaatgtcaaatttaaa

SEQ ID NO: 4070 - protein, 463 aa, Streptococcus pyogenes
MEFRMSIKEQTDNNELENGMVRGLENRHVQLIAIAGTIGTGLFLGAGRSIALTGPSIIFVYMITGAFMFMMMRAIGEMLYYDPDQHTFINFISKYIGPGWGYFSGLSYWISLIFIGMAEITAVGAYVQFWFPSWPAWLIQLVFLVLLSSINLIAVRVFGETEFWFAMIKILAILALIATAIFMVLTGFETHTGHASLSNIFDHFSMFPNGKLKFFMAFQMVFFAYQAIEFVGITTSETANPRKVLPKAIQEIPTRIVIFYVGALVSIMAIVPWHQLPVDESPFVMVFKLIGIKWAAALINFVVLTSAASALNSTLYSTGRHLYQIANETPNALTNRLKINTLSRQGVPSRAIIASAVVVGISALINILPGVADAFSLITASSSGVYIAIYALTMIAHWKYRQSKDFMADGYLMPKYKVTTPLTLAFFAFVFISLFLQESTYIGAIGATIWIIIFGIYSNVKFK

SEQ ID NO: 4071 - DNA, 327 bp, Streptococcus agalactiae
atgtcattaccaaattgccctaagtgtaactctgaatatgtctatgaagacggtattttactggtttgtccagaatgtgcttacgagtggaatccagaagaaatcgaagaagaagtaggtttaattgtattggatagcaatggaacgcgcttatcagatggagatactgtgacagttattaaggatttaaaagtaaaaggagcgcctaaggatattaagcaaggcactcgtgttaaaaatattcgtttagttgatggcgatcataatatcgattgtaaaattgatggttttggagctatgaaactaaaatctgagtttgtaaaaaaa

SEQ ID NO: 4072 - protein, 109 aa, Streptococcus agalactiae
MSLPNCPKCNSEYVYEDGILLVCPECAYEWNPEEIEEEVGLIVLDSNGTRLSDGDTVTVIKDLKVKGAPKDIKQGTRVKNIRLVDGDHNIDCKIDGFGAMKLKSEFVKK

SEQ ID NO: 4073 - DNA, 261 bp, Streptococcus pyogenes
atgtgtgcttttgaatggacaccaggcgaagaagcgactgaagaagaaggacttgttgttttggatagcaatggtgtccgactgtctgatggtgataccattactgtggttaaagatttgaaagtaaaaggcgctccaaaagacctgaaacaagggactcgagttaaaaatattcgcctggtggaaggtgatcataatattgattgtaagattgatgggtttggcgcgatgaaattgaaatcagaatttgtcaagaaaatc

SEQ ID NO: 4074 - protein, 87 aa, Streptococcus pyogenes
MCAFEWTPGEEATEEEGLVVLDSNGVRLSDGDTITVVKDLKVKGAPKDLKQGTRVKNIRLVEGDHNIDCKIDGFGAMKLKSEFVKKI

SEQ ID NO: 4075 - DNA, 138 bp, Streptococcus agalactiae
ttggagaaagaggctaagcagatcattgatttaaaaaggaatcttttcaaaattgatgtccgggcacaaaaggatgaagagaaagttttcatgcgtacggcgtggaaaataggctttttcctattgtcaagaagccta

SEQ ID NO: 4076 - protein, 46 aa, Streptococcus agalactiae
MEKEAKQIIDLKRNLFKIDVRAQKDEEKVFMRTAWKIGFFLLSRSL

SEQ ID NO: 4077 - DNA, 1812 bp, Streptococcus agalactiae
atgtgtggtatcgtaggtgtagttggaaatacaaatgcaacggatattttaattcaaggcttagaaaagctagagtaccgaggatatgactcagcaggtatttttgtagtaggtgataacaaaagtcaacttgtgaagtcagtcggtcgaatcgcggagattcaggcaaaagtaggagattctgttagtggtacgacaggtatcggtcatacacgttgggcaacccatggtaaacctactgaaggaaatgcacatcctcacacttcaggatctggtcgttttgtattggtacacaatggtgttattgaaaattaccttcaaattaaagaaacttacttaacaaaacataacctcaagggtgaaactgatacagaaatagctattcatttagttgaacactttgttgaagaagataacttatcagtgcttgaagcctttaaaaaagccttacatattatagaaggatcatacgcatttgctcttattgattctcaagatgctgatacgatttacgtagctaaaaataaatcacctcttctaataggtttgggaaatggttataatatggtgtgttcagatgccatggctatgatacgtgagacaagtgaatatatggaaatccacgataaagaactcgttattgttaaaaaagatagcgttgaagttcaagattatgatggtaatgtcattgaacgtggtagctacacagcagagcttgacttatcagatattggtaaggggacttatccattctacatgcttaaagaaattgatgagcaaccaactgtgatgcgtaagttgatttcaacttatgcgaacgaatctggagatatgaatgtggattctgatattataaaatcagtccaagaagcagatcgtctttacatattggctgcaggaacgtcatatcatgctggttttgctgctaagaccatgatcgaaaaattaactgatacacctgttgaacttggagtttcttcagaatggggttacaacatgccacttttgagtaagaagccaatgtttattttacttagtcaatcgggagaaacagcagatagtagacaagttttagttaaagcaaacgaaatgggaatccctagtttaactataacaaatgtgcctggctcaacactttctcgtgaagcaacctatacgatgctcattcatgcaggacctgaaatcgctgttgcttctacaaaagcatatactgctcaagttgcaacgttagctttcttagcaaaagcggtaggagaagcaaatggtaaggcagaagcaaaagattttgatttggttcatgaattgtcaattgtagcacaatcaattgaagcgaccttatcagaaaaagatgttatctctgagaaggtagagcagttgttaatctcgacacgtaatgccttctacattggtcgtggtaacgactattatgttacaatggaggctgcactgaagctaaaagagatttcttatattcagacagaaggttttgctgcaggtgaattaaaacatggtacaatttcgttgattgaagacaatactcctgttattgctttaatatctgctgattcaactattgcagcgcatactcgtggaaatatccaagaagttgtttctcgcggagcaaatgctttgattattgtagaagaagggttggaacgtgaaggtgatgatattattgttaataaagttcacccattcttatcagccatttcaatggttattccgactcaattaattgcttactatgcttcattacaacgtggcttagatgttgataaaccacgtaatttggcaaaagctgtaactgttgaa

SEQ ID NO: 4078 - protein, 604 aa, Streptococcus agalactiae
MCGIVGVVGNTNATDILIQGLEKLEYRGYDSAGIFVVGDNKSQLVKSVGRIAEIQAKVGDSVSGTTGIGHTRWATHGKPTEGNAHPHTSGSGRFVLVHNGVIENYLQIKETYLTKHNLKGETDTEIAIHLVEHFVEEDNLSVLEAFKKALHIIEGSYAFALIDSQDADTIYVAKNKSPLLIGLGNGYNMVCSDAMAMIRETSEYMEIHDKELVIVKKDSVEVQDYDGNVIERGSYTAELDLSDIGKGTYPFYMLKEIDEQPTVMRKLISTYANESGDMNVDSDIIKSVQEADRLYILAAGTSYHAGFAAKTMIEKLTDTPVELGVSSEWGYNMPLLSKKPMFILLSQSGETADSRQVLVKANEMGIPSLTITNVPGSTLSREATYTMLIHAGPEIAVASTKAYTAQVATLAFLAKAVGEANGKAEAKDFDLVHELSIVAQSIEATLSEKDVISEKVEQLLISTRNAFYIGRGNDYYVTMEAALKLKEISYIQTEGFAAGELKHGTISLIEDNTPVIALISADSTIAAHTRGNIQEVVSRGANALIIVEEGLEREGDDIIVNKVHPFLSAISMVIPTQLIAYYASLQRGLDVDKPRNLAKAVTVE

SEQ ID NO: 4079 - DNA, 1812 bp, Streptococcus pyogenes
atgtgtggaattgttggagttgttggaaatcgcaatgcaacggatattttaatgcaaggccttgaaaagcttgaataccggggttatgattcagcaggaatttttgtggctaatgccaatcaaacaaacttgattaaatcagtggggcggattgctgatttgcgtgccaagattggcattgatgttgctggttcaacagggattggtcacacccgttgggcaacgcatggccaatcaacagaggataatgcccatcctcacacgtcacaaactggacgttttgtacttgttcataatggtgtgattgaaaattaccttcacattaaaacagagttcctagctggacatgattttaaggggcagacagatactgagattgcagtacacttgattggaaaatttgtggaagaagacaagttgtcagtactggaagcttttaaaaaatctttaagcattattgaaggttcctacgcctttgcattaatggatagccaagcaactgatactatttatgtggctaaaaacaagtctccattgttgattggacttggtgaaggttacaacatggtttgttcagatgccatggccatgattcgtgaaaccagtgaatttatggaaattcatgataaggagctagttattttaaccaaagataaggtaactgttacagactacgatggtaaagagctgatacgagattcctacactgctgaattagacttatctgatattggcaaagggacttatcctttctatatgctgaaagaaattgatgagcaaccaaccgtaatgcgtcaattaatttcaacttatgcagatgaaactggtaacgtacaggttgatccggctatcattacctctatccaagaggctgaccgtctttatattttagcggcagggacttcctaccatgctggttttgcaacaaaaaatatgcttgagcaattgacagatacaccagttgagttgggcgtggcttctgagtggggttaccacatgcctctgcttagcaagaaaccaatgtttattctactaagccaatcaggagaaaccgcagatagtcgtcaagttttagtaaaggcaaatgctatgggcattccgagtttgacagtaactaacgttccaggatcaaccttatcacgtgaagcaacatacaccatgttgattcatgctggacctgaaattgctgttgcgtctacaaaagcttacactgcacaaattgctgcccttgcctttttggctaaggcagttggtgaggcaaatggtaagcaagaagctcttgactttaacttggtacatgagttgtcattggttgcccaatctattgaggcgactttgtctgaaaaagatctcgtggcagaaaaggttcaagctttgctagctactactcgtaatgctttttacatcgggcgtggcaatgattattacgttgcgatggaagctgctttgaaattaaaagagatttcttatattcaatgcgaaggctttgcggctggtgaattgaaacatggaaccatttcattaattgaggaggacacgccagtaatcgctttaatatcgtctagtcagttggttgcctctcatacgcgtggtaatattcaagaagttgctgcccgtggggctcatgttttaacagttgtggaagaagggcttgaccgtgagggagatgacattattgtcaataaggttcatcctttcctagccccgattgctatggtcattccaactcaactgattgcttactacgcttcattacaacgtggacttgatgttgataagccacgtaatttggctaaagctgtaacagtagaa

SEQ ID NO: 4080 - protein, 604 aa, Streptococcus pyogenes
MCGIVGVVGNRNATDILMQGLEKLEYRGYDSAGIFVANANQTNLIKSVGRIADLRAKIGIDVAGSTGIGHTRWATHGQSTEDNAHPHTSQTGRFVLVHNGVIENYLHIKTEFLAGHDFKGQTDTEIAVHLIGKFVEEDKLSVLEAFKKSLSIIEGSYAFALMDSQATDTIYVAKNKSPLLIGLGEGYNMVCSDAMAMIRETSEFMEIHDKELVILTKDKVTVTDYDGKELIRDSYTAELDLSDIGKGTYPFYMLKEIDEQPTVMRQLISTYADETGNVQVDPAIITSIQEADRLYILAAGTSYHAGFATKNMLEQLTDTPVELGVASEWGYHMPLLSKKPMFILLSQSGETADSRQVLVKANAMGIPSLTVTNVPGSTLSREATYTMLIHAGPEIAVASTKAYTAQIAALAFLAKAVGEANGKQEALDFNLVHELSLVAQSIEATLSEKDLVAEKVQALLATTRNAFYIGRGNDYYVAMEAALKLKEISYIQCEGFAAGELKHGTISLIEEDTPVIALISSSQLVASHTRGNIQEVAARGAHVLTVVEEGLDREGDDIIVNKVHPFLAPIAMVIPTQLIAYYASLQRGLDVDKPRNLAKAVTVE

SEQ ID NO: 4081 - DNA, 579 bp, Streptococcus agalactiae
atggaaaaaagattaggagtagttatggttaaacgcgattttattagaaatattattttagcattgattgctgtattgattttgattctcttgagatattttgtttttgcaacctttaaagtacataaggatgctacaaattcttattttagcaacggagatgttgttgttgttaatcgtaataggacgcctaagtacaaagactttattgtctataaggttggaaagattttctatattagtcgtgttattggtgagccaaatcaaaaagtgagagtaatggatgatattttatatttgaatgatgttttcaaggatgagccttacattgaaaaaatgaaaaatgcttattctgaaaagaaagacggtcaaatgccctttacttccgacttctcagttgaaacattaacacgaaataaagaaagcagagttcctaagggttcttatcttgtgttaaatgataatcgacaaaataaaaatgatagtcgaaaatttggattaatcaaagagaaagatattcgtggtgttattacctttaaagtataccctctaagtgaatttggttttacagcttcagag

SEQ ID NO: 4082 - protein, 193 aa, Streptococcus agalactiae
MEKRLGVVMVKRDFIRNIILALIAVLILILLRYFVFATFKVHKDATNSYFSNGDVVVVNRNRTPKYKDFIVYKVGKIFYISRVIGEPNQKVRVMDDILYLNDVFKDEPYIEKMKNAYSEKKDGQMPFTSDFSVETLTRNKESRVPKGSYLVLNDNRQNKNDSRKFGLIKEKDIRGVITFKVYPLSEFGFTASE

SEQ ID NO: 4083 - DNA, 555 bp, Streptococcus pyogenes
atggtaaagcgagattttataagaaatatattattgttattaattgtgattattggggctattttgttgagaatctttgttttttcaacttttaaagtttctccagaaacagctaatacttatttaaagagtggtgatttagtcacaatcaaaaaaaatattcagcccaaatataaagattttgtggtttatagagttggaaaaaaagattatgtcagtcgagtcattgctgttgaaggcgatagcgtgacttatatggacgatattttttacctcaataatatggtagagtcacaggcttaccttgaaaagatgaaagcacattacttgaatcatgcaccgtttggcacattgtatacagatgattttacagttgctaccatcacagctgataagtatcaaaaagttcctaaggggaagtatcttcttttgaatgataaccggaaaaatacgaatgacagtcgtcgatttgggttaataaatgcctcgcagattaaaggtttagtgacctttagagttttgcctctcagcgattttggatttgtagaagtagag

SEQ ID NO: 4084 - protein, 185 aa, Streptococcus pyogenes
MVKRDFIRNILLLLIVIIGAILLRIFVFSTFKVSPETANTYLKSGDLVTIKKNIQPKYKDFVVYRVGKKDYVSRVIAVEGDSVTYMDDIFYLNNMVESQAYLEKMKAHYLNHAPFGTLYTDDFTVATITADKYQKVPKGKYLLLNDNRKNTNDSRRFGLINASQIKGLVTFRVLPLSDFGFVEVE

SEQ ID NO: 4085 - DNA, 1500 bp, Streptococcus agalactiae
atgaataaacgcgtaaaaatcgttgcaacacttggtcctgcggttgaattccgtggtggtaagaagtttggtgagtctggatactggggtgaaagccttgacgtagaagcttcagcagaaaaaattgctcaattgattaaagaaggtgctaacgttttccgtttcaacttctcacatggagatcatgctgagcaaggagctcgtatggctactgttcgtaaagcagaagagattgcaggacaaaaagttggcttcctccttgatactaaaggacctgaaattcgtacagaactttttgaagatggtgcagatttccattcatatacaacaggtacaaaattacgtgttgctactaagcaaggtatcaaatcaactccagaagtgattgcattgaatgttgctggtggacttgacatctttgatgacgttgaagttggtaagcaaatccttgttgatgatggtaaactaggtcttactgtgtttgcaaaagataaagacactcgtgaatttgaagtagttgttgagaatgatggccttattggtaaacaaaaaggtgtaaacatcccttatactaaaattcctttcccagcacttgcagaacgcgataatgctgatatccgttttggacttgagcaaggacttaactttattgctatctcatttgtacgtactgctaaagatgttaatgaagttcgtgctatttgtgaagaaactggcaatggacacgttaagttgtttgctaaaattgaaaatcaacaaggtatcgataatattgatgagattatcgaagcagcagatggtattatgattgctcgtggtgatatgggtatcgaagttccatttgaaatggttccagtttaccaaaaaatgatcattactaaagttaatgcagctggtaaagcagttattacagcaacaaatatgcttgaaacaatgactgataaaccacgtgcgactcgttcagaagtatctgatgtcttcaatgctgttattgatggtactgatgctacaatgctttcaggtgagtcagctaatggtaaatacccagttgagtcagttcgtacaatggctactattgataaaaatgctcaaacattactcaatgagtatggtcgcttagactcatctgcattcccacgtaataacaaaactgatgttattgcatctgcggttaaagatgcaacacactcaatggatatcaaacttgttgtaacaattactgaaacaggtaatacagctcgtgccatttctaaattccgtccagatgcagacattttggctgttacatttgatgaaaaagtacaacgttcattgatgattaactggggtgttatccctgtccttgcagacaaaccagcatctacagatgatatgtttgaggttgcagaacgtgtagcacttgaagcaggatttgttgaatcaggcgataatatcgttatcgttgcaggtgttcctgtaggtacaggtggaactaacacaatgcgtgttcgtactgttaaa

SEQ ID NO: 4086 - protein, 500 aa, Streptococcus agalactiae
MNKRVKIVATLGPAVEFRGGKKFGESGYWGESLDVEASAEKIAQLIKEGANVFRFNFSHGDHAEQGARMATVRKAEEIAGQKVGFLLDTKGPEIRTELFEDGADFHSYTTGTKLRVATKQGIKSTPEVIALNVAGGLDIFDDVEVGKQILVDDGKLGLTVFAKDKDTREFEVVVENDGLIGKQKGVNIPYTKIPFPALAERDNADIRFGLEQGLNFIAISFVRTAKDVNEVRAICEETGNGHVKLFAKIENQQGIDNIDEIIEAADGIMIARGDMGIEVPFEMVPVYQKMIITKVNAAGKAVITATNMLETMTDKPRATRSEVSDVFNAVIDGTDATMLSGESANGKYPVESVRTMATIDKNAQTLLNEYGRLDSSAFPRNNKTDVIASAVKDATHSMDIKLVVTITETGNTARAISKFRPDADILAVTFDEKVQRSLMINWGVIPVLADKPASTDDMFEVAERVALEAGFVESGDNIVIVAGVPVGTGGTNTMRVRTVK

SEQ ID NO: 4087 - DNA, 1500 bp, Streptococcus pyogenes
atgaataaacgcgtaaaaatcgttgcaacacttggtcctgcggttgaaatccgtggtggtaaaaaatacggagaagatggctactgggctggtcaacttgatgttgaagaatcagcaaaaaaaatcgctgaattaattgaagctggtgcgaatgttttccgtttcaatttctcacacggtgaccacaaagagcaaggtgaccgtatggcaactgttcgccttgcagaagaaattgctcgtcaaaaagttggtttccttttggatactaaaggtcctgaaatgcgtacggaattgtttgcagatgatgctaaagagtttagctatgttactggagaaaaaatccgtgtagcgactacacaaggtattcaatcaactcgcgatgttattgctttgaacgttgctggtagccttgacatctacgatgaagtagaagtaggtcatactattcttatcgatgatggtaaacttggtttgaaagtgatcgacaaagatatcgcaacacgtcaatttatcgttgaagtagaaaacgacggtattattgctaaacaaaaaggtgttaatatccctaacactaaaattcctttcccagcacttgcggaacgcgacaatgctgatatccgttttggtcttgaacaaggacttaactttattgcaatctcatttgttcgtacagccaaagacgttgaggaagttcgtgaaatctgtcgcgaaactggtaacgaccatgtgcaattatttgctaagattgaaaaccaacaaggtatcgataatcttgatgaaatcatcgaagctgctgatggtatcatgattgcacgtggcgacatgggtatcgaagtaccatttgaaatggttccagttttccaaaaaatgattatcactaaagtgaatgcagctggtaaagcagttatcacagcaacaaacatgcttgaaacaatgactgaaaaaccacgtgcgacacgttctgaagtatctgacgtcttcaatgctgttatcgatggtactgatgcaacaatgctttcaggagagtcagctaacggtaaatacccggttgaatctgttcgtacaatggcgactattgatcgtaatgcacaaactcttcttaacgaatatggtcgtttagattcatctgccttcccacgtaccaataaaacagatgttattgcttcagctgttaaagatgccactcattcaatggacatcaaacttgttgtgactattactgagacaggtaatacagctcgtgcgatttctaaattccgtccagatgcggacatcttagctgtaacatttgatgaaaaagtacaacgtgctttgatgattaactggggtgttattcctgttcttgctgaaaaacctgcatctactgatgacatgtttgaagtagcagagcgtgttgctgtggaggcaggcttagttcaatctggggataatattgttattgttgctggtgttccagttggtactggtggaacgaatactatgcgtgttcgtacagtaaaa

SEQ ID NO: 4088 - protein, 500 aa, Streptococcus pyogenes
MNKRVKIVATLGPAVEIRGGKKYGEDGYWAGQLDVEESAKKIAELIEAGANVFRFNFSHGDHKEQGDRMATVRLAEEIARQKVGFLLDTKGPEMRTELFADDAKEFSYVTGEKIRVATTQGIQSTRDVIALNVAGSLDIYDEVEVGHTILIDDGKLGLKVIDKDIATRQFIVEVENDGIIAKQKGVNIPNTKIPFPALAERDNADIRFGLEQGLNFIAISFVRTAKDVEEVREICRETGNDHVQLFAKIENQQGIDNLDEIIEAADGIMIARGDMGIEVPFEMVPVFQKMIITKVNAAGKAVITATNMLETMTEKPRATRSEVSDVFNAVIDGTDATMLSGESANGKYPVESVRTMATIDRNAQTLLNEYGRLDSSAFPRTNKTDVIASAVKDATHSMDIKLVVTITETGNTARAISKFRPDADILAVTFDEKVQRALMINWGVIPVLAEKPASTDDMFEVAERVAVEAGLVQSGDNIVIVAGVPVGTGGTNTMRVRTVK

SEQ ID NO: 4089 - DNA, 1020 bp, Streptococcus agalactiae
atgaaacgtattgctgttttaactagtggtggtgacgcccctggtatgaacgctgctatccgtgcagttgttcgtaaagcaatttctgaaggtatggaagtttacggcatcaaccaaggttactatggtatggtgacaggggatattttccctttggatgctaattctgttggggatactatcaaccgtggaggaacgtttttacgttcagcacgttatcctgaatttgctgaacttgaaggtcagcttaaagggattgaacagcttaaaaaacacggtattgaaggtgtagtagttatcggtggtgatggttcttatcatggtgctatgcgtctaactgagcacggtttcccagctgttggtttgccgggtacaattgataacgatatcgttggcactgactatactattggttttgacacagcagttgcgacagcagttgagaatcttgaccgtcttcgtgatacatcagcaagtcataaccgtacttttgttgttgaggttatgggaagaaatgcaggagatatcgctctttggtcaggtatcgctgcaggtgcagatcaaattattgttcctgaagaagagttcaatattgatgaagttgtctcaaatgttagagctggctatgcagctggtaaacatcaccaaatcatcgtccttgcagaaggtgttatgagtggtgatgagtttgcaaaaacaatgaaagcagcaggagacgatagcgatcttcgtgtgacgaatttaggacatctgctccgtggtggtagtccgacggctcgtgatcgtgtcttagcatctcgtatgggagcgtacgctgttcaattgttgaaagaaggtcgtggtggtttagccgttggtgtccacaacgaagaaatggttgaaagtccaattttaggtttagcagaagaaggtgctttgttcagcttgactgatgaaggaaaaatcgttgttaataatccgcataaagcggaccttcgcttggcagcacttaatcgtgaccttgccaaccaaagtagtaaa

SEQ ID NO: 4090 - protein, 340 aa, Streptococcus agalactiae
MKRIAVLTSGGDAPGMNAAIRAVVRKAISEGMEVYGINQGYYGMVTGDIFPLDANSVGDTINRGGTFLRSARYPEFAELEGQLKGIEQLKKHGIEGVVVIGGDGSYHGAMRLTEHGFPAVGLPGTIDNDIVGTDYTIGFDTAVATAVENLDRLRDTSASHNRTFVVEVMGRNAGDIALWSGIAAGADQIIVPEEEFNIDEVVSNVRAGYAAGKHHQIIVLAEGVMSGDEFAKTMKAAGDDSDLRVTNLGHLLRGGSPTARDRVLASRMGAYAVQLLKEGRGGLAVGVHNEEMVESPILGLAEEGALFSLTDEGKIVVNNPHKADLRLAALNRDLANQSSK

SEQ ID NO: 4091 - DNA, 1011 bp, Streptococcus pyogenes
atgaaacgtattgctgttttaaccagtggcggcgacgctcctggtatgaacgctgctattcgtgcagtcgttcgtaaagcaatttcagaaggaatggaagtttatggtatcaaccgtggctatgcaggtatggttgatggcgacattttcccactgggttcaaaagaagttggtgataaaatctcacgtggtggaactttcttatactcagctcgttatccagagtttgctcaacttgaaggtcaattggctggtattgagcaacttaaaaaacatggtattgaaggtgttgttgttattggtggggatggttcttatcatggcgctatgcgcttgacagagcacggcttcccagcggtaggtatcccaggaacaatcgataacgatattgcgggaactgactacactatcggatttgatacagcagttaacacagcagttgaagctattgataaacttcgtgacacctcatcaagtcacggacgtacttttgtggttgaagtgatgggtcgcaatgcgggtgatattgctctttgggcaggtattgctagtggtgctgatcaaatcattgttccagaagaagagtttgatattgaaaaagtggcatcaacaatccaatatgattttgaacacaaaggtaaaaatcaccacattatcgtcttagctgaaggtgttatgagcggtgaagcttttgctcaaaaactgaaagaagctggcgataagagtgaccttcgtgtgacaaatcttggccacattcttcgtgggggttcaccaactgctcgtgaccgtgtcattgcttcttggatgggttcacatgctgttgagctacttaaagatggcaaaggtggtttggctgttggtattcacaatgaagaacttgttgaaagcccaatccttggtactgcagaagaaggtgctttgttcagcttgactgaagaaggcaagattattgttaataatccacacaaagctcgtttagactttgcagctttgaaccgttcattgtcacaa

SEQ ID NO: 4092 - protein, 337 aa, Streptococcus pyogenes
MKRIAVLTSGGDAPGMNAAIRAVVRKAISEGMEVYGINRGYAGMVDGDIFPLGSKEVGDKISRGGTFLYSARYPEFAQLEGQLAGIEQLKKHGIEGVVVIGGDGSYHGAMRLTEHGFPAVGIPGTIDNDIAGTDYTIGFDTAVNTAVEAIDKLRDTSSSHGRTFVVEVMGRNAGDIALWAGIASGADQIIVPEEEFDIEKVASTIQYDFEHKGKNHHIIVLAEGVMSGEAFAQKLKEAGDKSDLRVTNLGHILRGGSPTARDRVIASWMGSHAVELLKDGKGGLAVGIHNEELVESPILGTAEEGALFSLTEEGKIIVNNPHKARLDFAALNRSLSQ

SEQ ID NO: 4093 - DNA, 3102 bp, Streptococcus agalactiae
atgtttgcacaacttgatacaagaaccgtttattcttttatggatagcttggttgatttaaagacatatgtctctaaatcgaaatcattaggatatcaaactattggtatcttggaccacagtaatctttatgcagcatatcattttattcaagaggcgcaaaaggcaaacctaagaccaatagttggatttagctttgatatagtggttgaaaatagatcaatagaagtttactgtattgcgataaatacagttggttataagaatctcttgaagttgtcaacggctcaaatgtctgagaagatgtctctaaatttattgacagaacatcttgaaggggtgcaattgattcttccctatcaagatgttcttgatcagctcaatttaccctttgattatgttattggtgttaatttgacctctccgcagattccatataccaaacccattatagccatagatactgttcgatattttcaaaaaaatgatattgagacattacagatgcttcatgctataagagataatgtcctgttaaaagacgcacaatatgcgagcaaaaatcaagaattaaaaccttgtcaagaaatgactctagcattcaaggaacgttttcctgaagctttagctaacctagaatctttggtagagaatgttgcttatcactttgattctgactttaagttacctatttttaatagagaaattcctgctggagaagaattaagaaccttaactcaaaataacttaaaaagtaaaggtttatggagcgatgcttatcaagagcgtctcgaaaaagaattaacaatcattcacaaaatgggctttgatgactatttccttattgtgtgggatttattaagatttggtcgtagtaagggctactatatgggaatgggacgtggttcagcagcgggaagtttagtctcatatgctttaaatattaccggtatcgatcctgtcaaacataatttaatttttgaacgttttttaaatgaagagcgttattcgatgccagatattgatattgatcttccggatatttatcgtggagaattcttgcgctatgtacgtaatcgatatggttcaatgcattctgcacagattgtaaccttctcaacttttggtgcgaaacaggctattcgagatgtttttaaacgctttggtgcatcagagtatgagttaacaaacataactaaaaaaattcatttcagagataatttgaccagtgtttataaccgcaacttagctttcagacaaataatagatagtaaaattgaataccaaaaagcctatgatattgctaagcgtattgaaggaaatcctagacagacttctattcatgccgctggggtagtaatgagtgacgatttgttaacagatcatattcctttaaaaaacggtgaggatatgatgataacgcaatatgatgctagttctgttgaggataatggtcttctaaaaatggactttctaggtcttcgaaatttgacatttgttcagaaaatgaaggagaaagtcgataaggactacggtatctctatacaattagaaactattgatttagaagataaagagactctaaaactatttgcagctggtcaaacaaaggggatttttcaatttgagcaaagtggagctattaatttgttgcgacgtattaggccagagtgttttgaagatgtggtagctaccaccagcttgaataggcctggtgcaagtgattatactgagaattttataaaccgtcgttttggtaaagaaaaaatcgatttagtagatcctgtcatagctccaattttacaacctacctatggcataatgctctatcaagaacaggttatgcagattgcccagacctacgcaggttttacgctaggcaagtctgatttgctcagacgtgctatgtctaagaaaaattctaaggagatgcaaaagatgtctcaatccttcttagagggtgcagtatctaagggacatcgtcaagaagatgctcgacttatatttgaacgcatggctaaatttgcaggttatgggtttaatcgcagccatgcgtttgcttattcggctttagcttttcaattagcctatttcaaagcccattattccgatgtcttttatgacatcatgataaattattcaaatagtgattatctaatcgatgctattgattttggttttgttattgaaaaaccttcaattaatactatttcatacagagaccgcatctataaaaagaaaatttatttaggtttaaaaaatattaagggtgttcctaacgatttggcttattggatttctaaaaatcaaccgtttcagagtattgaagattttctaatgaggctgccacagcagtttcaaaaaagtggttttatttctccgctaattgctattggagcatttgacgaatttgataataatagacggaaaatcacctctaatcttgattctttatttacatttgtaaatgaactaggtagtttatttgcagatacctcatatcattggctagaagtagaagatttctctaattctgagaaatatgaaatggaacaagatatcttaggagtaggaatcagcccgcaccctttagtggggatttcacaaaaagctagccgtccgtttataccaattagtcaagttcaagaaaatagcgaagctactattttagttcagctaaagcaggtcaaagttattaggacaaaaagttctgggcaacaaatggctttcttgactgttatggatattaattcaaaaatggatattactgtttttcctgaaactttcaatattgtaagagatgatttacaagaagggaaatattattacttgcatggaaaaattcagaagcgagatgagcgattacagatggttttaaacggtgttcaagaagcaacggaggaacgtttttggatacttctaaaaaatcatgataacgacaaaaaaatatcggaaatattgtccaaatacaaagggcatattcctgtctatttgcattatgaaacaactaaagaaactatccaaagcaaagtacatttggttagaaaagatagtggcttagcccttgatttatctgaatttgttgtgaaaacggtttatcaa

SEQ ID NO: 4094 - protein, 1034 aa, Streptococcus agalactiae
MFAQLDTRTVYSFMDSLVDLKTYVSKSKSLGYQTIGILDHSNLYAAYHFIQEAQKANLRPIVGFSFDIVVENRSIEVYCIAINTVGYKNLLKLSTAQMSEKMSLNLLTEHLEGVQLILPYQDVLDQLNLPFDYVIGVNLTSPQIPYTKPIIAIDTVRYFQKNDIETLQMLHAIRDNVLLKDAQYASKNQELKPCQEMTLAFKERFPEALANLESLVENVAYHFDSDFKLPIFNREIPAGEELRTLTQNNLKSKGLWSDAYQERLEKELTIIHKMGFDDYFLIVWDLLRFGRSKGYYMGMGRGSAAGSLVSYALNITGIDPVKHNLIFERFLNEERYSMPDIDIDLPDIYRGEFLRYVRNRYGSMHSAQIVTFSTFGAKQAIRDVFKRFGASEYELTNITKKIHFRDNLTSVYNRNLAFRQIIDSKIEYQKAYDIAKRIEGNPRQTSIHAAGVVMSDDLLTDHIPLKNGEDMMITQYDASSVEDNGLLKMDFLGLRNLTFVQKMKEKVDKDYGISIQLETIDLEDKETLKLFAAGQTKGIFQFEQSGAINLLRRIRPECFEDVVATTSLNRPGASDYTENFINRRFGKEKIDLVDPVIAPILQPTYGIMLYQEQVMQIAQTYAGFTLGKSDLLRRAMSKKNSKEMQKMSQSFLEGAVSKGHRQEDARLIFERMAKFAGYGFNRSHAFAYSALAFQLAYFKAHYSDVFYDIMINYSNSDYLIDAIDFGFVIEKPSINTISYRDRIYKKKIYLGLKNIKGVPNDLAYWISKNQPFQSIEDFLMRLPQQFQKSGFISPLIAIGAFDEFDNNRRKITSNLDSLFTFVNELGSLFADTSYHWLEVEDFSNSEKYEMEQDILGVGISPHPLVGISQKASRPFIPISQVQENSEATILVQLKQVKVIRTKSSGQQMAFLTVMDINSKMDITVFPETFNIVRDDLQEGKYYYLHGKIQKRDERLQMVLNGVQEATEERFWILLKNHDNDKKISEILSKYKGHIPVYLHYETTKETIQSKVHLVRKDSGLALDLSEFVVKTVYQ

SEQ ID NO: 4095 - DNA, 3108 bp, Streptococcus pyogenes
atgtttgctcaacttgatactaaaactgtatactcatttatggatagtttaattgacttaaatcattattttgaacgagcaaagcaatttggttaccacaccataggaatcatggataaggataatctttatggtgcttaccattttattaaaggttgtcaaaaaaatggactgcagccagttttaggtttggaaatagagattctctatcaagagcggcaggtgctccttaacttaatcgcccagaatacacaaggctatcatcagcttttaaaaatttccacggcaaaaatgtctggcaagcttcatatggattacttctgccaacatttggaagggatagcggttattattcctagtaagggttggagcgatacattagtggtcccttttgactactatatcggtgttgatcagtatactgatttatctcatatggattctaagaggcagcttatacccctaaggacagttcgttattttgcgcaagatgatatggaaaccctgcacatgttgcatgccattcgagataacctcagtctggcagagacccctgtggtagaaagtgatcaagagttagcagattgtcaacaactaaccgccttctatcaaacacactgccctcaagctctacagaatttagaagacttagtgtcaggaatctattatgatttcgatacaaatttaaaattgcctcattttaatagagataagtctgccaagcaagaattgcaagacttgactgaggctggtttgaaggaaaaaggattgtggaaagagccttatcaatcgcgcttactacatgaattggtcattatttctgacatgggctttgatgattattttttgattgtgtgggatttacttcgctttggacgcagtaaaggctattatatgggaatgggacgtggctcggcggcaggtagtctagtggcttatgctctgaacattacagggattgatccagttcaacatgatttgctatttgagcgctttttaaacaaagaacgttatagcatgcctgatattgatatcgatcttccagatatttaccgttcagaatttctacggtatgtccgaaatcgttatggtagcgaccattcggcgcaaattgtgaccttttcaacctttggccctaaacaggctattcgtgatgttttcaaacggttcggggttccagaatacgaactgactaatctcactaaaaaaattggttttaaagatagcttggctactgtctatgaaaagtcaatctcttttaggcaggttattaatagtagaactgaatttcaaaaggcttttgccattgccaagcgtatcgaaggaaatccaagacaaacgtccattcacgcagctggtattgtgatgagtgatgatgccttgaccaatcatattcctctaaaatcgggcgatgacatgatgatcacccagtatgatgctcatgcggtcgaagctaatggcctgttaaaaatggattttttggggttaagaaatttgacctttgttcaaaaaatgcaagagaaggttgctaaagactacgggtgtcagattgatattacagccattgatttagaagacccgcaaacgttggcactttttgctaaaggggataccaagggaattttccaatttgaacaaaatggtgctattaatcttttaaaacggattaagccacaacgttttgaagaaattgttgccactaccagtctaaatagaccaggggcaagtgactataccactaatttcattaaacgaagagaaggacaagaaaaaattgatttgattgatcctgtgattgctcccattttagagccaacttacggtattatgctttatcaagaacaagttatgcagattgcacaggtttatgctggttttacgttaggcaaggccgacttgttaaggcgtgccatgtctaaaaaaaatctacaagaaatgcaaaaaatggaagaagactttattgcttctgctaagcacctagggagagctgaagaaacagctagaggactttttaaacggatggaaaaatttgcaggttatggttttaaccgcagccatgcctttgcctattcagctttagcttttcaattggcttatttcaaagcccattacccggctgttttttacgatatcatgatgaattattctagcagtgactatatcacagatgctctagaatcagattttcaagtagcgcaagttaccattaatagtattccttacactgataaaattgaagctagcaagatttacatggggctgaaaaatattaaggggttgccaagggattttgcttattggattatcgagcaaagaccatttaatagcgtagaggattttctcactagaactccagaaaaatatcaaaaaaaggttttccttgagcctctgataaaaataggtctgtttgattgctttgagcctaaccgtaaaaaaattctggacaatttggatggtttactggtatttgttaatgagcttggttctcttttttcagattcttcctttagttgggtagatacgaaagattactcagtaactgaaaaatattctttggaacaggagatcgttggagttggcatgagcaagcatcctttaattgatattgctgagaaaagtacccaaacttttactcctatttcacagttagtcaaagaaagcgaagcagtcgtactgattcaaatagatagcattaggatcattagaaccaaaacaagtgggcagcaaatggcttttttaagtgtgaatgacactaagaaaaagctcgatgtcacactttttccacaagagtatgccatttataaagaccaattaaaagaaggagaattctattacttaaaaggtagaataaaagaaagagaccatcgactgcagatggtgtgtcagcaagtgcaaatggctattagtcaaaaatattggttattagttgaaaaccatcagtttgattcccaaatttctgagattttaggtgcctttccaggaacgactccagttgttattcactatcaaaaaaataaggaaacaattgcattaactaagattcaggttcatgtaacagagaatttaaaggaaaaacttcgtccttttgttctgaaaacggtttttcga

SEQ ID NO: 4096 - protein, 1036 aa, Streptococcus pyogenes
MFAQLDTKTVYSFMDSLIDLNHYFERAKQFGYHTIGIMDKDNLYGAYHFIKGCQKNGLQPVLGLEIEILYQERQVLLNLIAQNTQGYHQLLKISTAKMSGKLHMDYFCQHLEGIAVIIPSKGWSDTLVVPFDYYIGVDQYTDLSHMDSKRQLIPLRTVRYFAQDDMETLHMLHAIRDNLSLAETPVVESDQELADCQQLTAFYQTHCPQALQNLEDLVSGIYYDFDTNLKLPHFNRDKSAKQELQDLTEAGLKEKGLWKEPYQSRLLHELVIISDMGFDDYFLIVWDLLRFGRSKGYYMGMGRGSAAGSLVAYALNITGIDPVQHDLLFERFLNKERYSMPDIDIDLPDIYRSEFLRYVRNRYGSDHSAQIVTFSTFGPKQAIRDVFKRFGVPEYELTNLTKKIGFKDSLATVYEKSISFRQVINSRTEFQKAFAIAKRIEGNPRQTSIHAAGIVMSDDALTNHIPLKSGDDMMITQYDAHAVEANGLLKMDFLGLRNLTFVQKMQEKVAKDYGCQIDITAIDLEDPQTLALFAKGDTKGIFQFEQNGAINLLKRIKPQRFEEIVATTSLNRPGASDYTTNFIKRREGQEKIDLIDPVIAPILEPTYGIMLYQEQVMQIAQVYAGFTLGKADLLRRAMSKKNLQEMQKMEEDFIASAKHLGRAEETARGLFKRMEKFAGYGFNRSHAFAYSALAFQLAYFKAHYPAVFYDIMMNYSSSDYITDALESDFQVAQVTINSIPYTDKIEASKIYMGLKNIKGLPRDFAYWIIEQRPFNSVEDFLTRTPEKYQKKVFLEPLIKIGLFDCFEPNRKKILDNLDGLLVFVNELGSLFSDSSFSWVDTKDYSVTEKYSLEQEIVGVGMSKHPLIDIAEKSTQTFTPISQLVKESEAVVLIQIDSIRIIRTKTSGQQMAFLSVNDTKKKLDVTLFPQEYAIYKDQLKEGEFYYLKGRIKERDHRLQMVCQQVQMAISQKYWLLVENHQFDSQISEILGAFPGTTPVVIHYQKNKETIALTKIQVHVTENLKEKLRPFVLKTVFR

SEQ ID NO: 4097 - DNA, 366 bp, Streptococcus agalactiae
atggcttgggaattcaatgaaaaatcacctatttattcacaaattgctgaacatataaagatgcaaattgttagtcaagaaataaaaagtggtgaccaattgcctaccgtgagagagttagctcaagaagctggtgttaacccaaataccatgcaacgtgccttcactgaattggaacgtgaaggaatggtattctcacaacgtacttccggacgctttgttacagaagacaacttactaattggtaaaattcgtcaacaagttgcaaaagcagagttagcaacttttgtcaacaacatgaaaaaaataggatataaattagatgaaattacggttgctctcgatcattttataaaggagattaat

SEQ ID NO: 4098 - protein, 122 aa, Streptococcus agalactiae
MAWEFNEKSPIYSQIAEHIKMQIVSQEIKSGDQLPTVRELAQEAGVNPNTMQRAFTELEREGMVFSQRTSGRFVTEDNLLIGKIRQQVAKAELATFVNNMKKIGYKLDEITVALDHFIKEIN

SEQ ID NO: 4099 - DNA, 369 bp, Streptococcus pyogenes
atgtcttggaaatttgaggaaaaatctcctatttatgcgcagatagcacaacatgtcatgatgcaaattattagccaagaaatcaagagtggtgatcaacttccaactgttcgtgaatatgcagaaatcgcaggtgttaatcctaacaccatgcaacgagcgtttacagaacttgaacgggaaggaatggtttattcgcaacgtactgctggccgttttgtaactgacgatcaaaaattaattgctcgtaaaagacgagagttagcaattagtgaattagaatcatttatcaccaatatgacaaaaatgggatttagtcacactgagattatccctgttttgacgagctttttaaaggaggattcacaa

SEQ ID NO: 4100 - protein, 123 aa, Streptococcus pyogenes
MSWKFEEKSPIYAQIAQHVMMQIISQEIKSGDQLPTVREYAEIAGVNPNTMQRAFTELEREGMVYSQRTAGRFVTDDQKLIARKRRELAISELESFITNMTKMGFSHTEIIPVLTSFLKEDSQ

SEQ ID NO: 4101 - DNA, 696 bp, Streptococcus agalactiae
atgacacagttattacaacttcatcatgttacaaagaaatatcacaaacatactgctgttaatgatgtgactgtaagtattccaacaggaaagattataggtttattaggtccaaatggtagcggaaaaacaacaatcatcaaaatgataaatggattacttcagccagataagggagatatcgttattgatggttacagaccgtctgttgaaaccaaaaaaattatttcatatctccctgatacttcatatttacaagaaaatatgaaaatcaaagacgtcgttacattatttgaagatttctataacgattttgattcaaaggtagcatatcaactatttgaggatcttaacctaaatcctagggaacgtctaaaaaacctatcaaaagggaacaaggaaaaagttcaattaatacttgttatgagtcgtaaagctaggctctacatccttgatgaacctattggtggtgtagaccctgcagcgcgtgactacattttaaaaacaatcattagcaactactctaatgatgcttctgttttaatttcgactcacttaatttctgacattgaacctatccttgatgaagttatcttccttaaagaaggagaaattgacctacaaggcaatgctgatgacttaagagaagagcacaactgttcgattgatgctctctttcgtgaaagattcaagaaa

SEQ ID NO: 4102 - protein, 232 aa, Streptococcus agalactiae
MTQLLQLHHVTKKYHKHTAVNDVTVSIPTGKIIGLLGPNGSGKTTIIKMINGLLQPDKGDIVIDGYRPSVETKKIISYLPDTSYLQENMKIKDVVTLFEDFYNDFDSKVAYQLFEDLNLNPRERLKNLSKGNKEKVQLILVMSRKARLYILDEPIGGVDPAARDYILKTIISNYSNDASVLISTHLISDIEPILDEVIFLKEGEIDLQGNADDLREEHNCSIDALFRERFKK

SEQ ID NO: 4103 - DNA, 696 bp, Streptococcus pyogenes
atggcacacctattgcaactacatcatgtttcaaaatcttaccgtgaaaaaaaagctattgatgacttaaccattactatcccgaacggtaaaattatcggattattaggtccaaatggaagtggtaaaacaactttaattaaactcattaatggccttttacaaccaaataaaggagaaattgtcattgatggctaccgtccctgtgttgagacaaaaaaaattatttcttatttaccagatactacttatcttaatgaaaatatgagaattaaggacatgttggagttctttagtgatttttacagcgactttgacaaatccaaagcaacaagccttctaagagatttagaactagaccctgaagaccgcttcaaaactctatccaaaggaaacaaagaaaaagtacaattaattcttgtgatgagtcgtaaagccagactctatgtacttgatgaacctattggtggagttgaccctgccgcaagagactacatcctaaaaaccatcattaatagttattgtgaaaatgcttctgttattatctcaacccacttgatttcggacattgaacctatccttgacgaagtcattttcttgaaacaaggaagacttttcttatctggcaatgctgatgatctaagacaagaataccagcaatccattgattccctctttagggaaacttataaggtt

SEQ ID NO: 4104 - protein, 232 aa, Streptococcus pyogenes
MAHLLQLHHVSKSYREKKAIDDLTITIPNGKIIGLLGPNGSGKTTLIKLINGLLQPNKGEIVIDGYRPCVETKKIISYLPDTTYLNENMRIKDMLEFFSDFYSDFDKSKATSLLRDLELDPEDRFKTLSKGNKEKVQLILVMSRKARLYVLDEPIGGVDPAARDYILKTIINSYCENASVIISTHLISDIEPILDEVIFLKQGRLFLSGNADDLRQEYQQSIDSLFRETYKV

SEQ ID NO: 4105 - DNA, 780 bp, Streptococcus agalactiae
atgtttggaaaattattaaaatatgaattaaaatcagttggtaagtggtatctaacactcaacgctgcggttttattagtatctattattttaggactggtattaaaggcacttggcggcaatttttctactgatactaatagtactagcgcccaaatattcactataatactcgttttattgttagcgatggttatttcaggatctctgttatccacccttgctattattatcaaacgtttttatagcaatatcttcggccgtcaaggatatctaaccttaacgctcccagtaactacgaatcagattatttgttcaaagctactagcttctcttctttggagtatttttaatatttttattgtcattattggaatcatattggtcatattacctttagtaggtattggtcagttcgttgtcgcttttccagaaatctataaaattatttcatcttcgaacgctccactttttatcgcctatttctttctatcgtacgttgcagggacattactgatttatctctctatcgctgtagggcaattatttacaaacaaacgtgtattgatgggaattgtttcttattttggaatatcactcttaattactttcttaacattaataatagatagtatttttcatattgatttattcaactctcatgcaaatgcaacattctctcaacctgtattgctctacaatatacttgttagcattgttgaaattgctatattctatatgttgacacactctattattaagtacaaacttaatatacaa

SEQ ID NO: 4106 - protein, 260 aa, Streptococcus agalactiae
MFGKLLKYELKSVGKWYLTLNAAVLLVSIILGLVLKALGGNFSTDTNSTSAQIFTIILVLLLAMVISGSLLSTLAIIIKRFYSNIFGRQGYLTLTLPVTTNQIICSKLLASLLWSIFNIFIVIIGIILVILPLVGIGQFVVAFPEIYKIISSSNAPLFIAYFFLSYVAGTLLIYLSIAVGQLFTNKRVLMGIVSYFGISLLITFLTLIIDSIFHIDLFNSHANATFSQPVLLYNILVSIVEIAIFYMLTHSIIKYKLNIQ

SEQ ID NO: 4107 - DNA, 783 bp, Streptococcus pyogenes
atgtttggaaaattattaaaatacgaatttagatctattggaaaatggtactttgcgcttaatgctttcgttattgccatcgctgccattttgtcatttacgataaaactgtttgctcaaagcaatagtgatggactatttggagtactaaccaataagatgttgcctctgacattaggtttaacttttggctccctgatcgctggttccctcttatcaacattacttatcattatcaaacgtttcagcaaaagtgtttttggatgggaaggatacttaacgttgactttacccgtcaattcgcatcaaattattttatcaaaactactagcttcttttatttgcagtgttttcaatactatcatccttgcatttgctatcgctattgtaattgtaccaatgtttaacatcaacgaactattagaaggattctttaatagttttaagatggattatttcatcaatatgctaactgtactagcctatgtcctattatcaacatttacgagtatcttattaatttatctttccatttctataggtcaacttttttccaatcggcgaggcttgatggcctttattgcatattttatattagttattctgattagcgttgctgcaacatatgttcacagtcacatctttaatattaatacaagtgccgatagtttcccatttactgagcaaaaaacaatttatcttcttattttggaacaatttattgaaatgataatgttttacctcgccactaattttattatcaaaaataaactcaacctacag

SEQ ID NO: 4108 - protein, 261 aa, Streptococcus pyogenes
MFGKLLKYEFRSIGKWYFALNAFVIAIAAILSFTIKLFAQSNSDGLFGVLTNKMLPLTLGLTFGSLIAGSLLSTLLIIIKRFSKSVFGWEGYLTLTLPVNSHQIILSKLLASFICSVFNTIILAFAIAIVIVPMFNINELLEGFFNSFKMDYFINMLTVLAYVLLSTFTSILLIYLSISIGQLFSNRRGLMAFIAYFILVILISVAATYVHSHIFNINTSADSFPFTEQKTIYLLILEQFIEMIMFYLATNFIIKNKLNLQ

SEQ ID NO: 4109 - DNA, 117 bp, Streptococcus agalactiae
atgaggtgtctatttttttacccgattttgaaaggaagtgaacttatgaaaacaaaaaatcaagaatcaaaaggtcgttccccactctttaagaccatcaaacattcattcagccaa

SEQ ID NO: 4110 - protein, 39 aa, Streptococcus agalactiae
MRCLFFYPILKGSELMKTKNQESKGRSPLFKTIKHSFSQ

SEQ ID NO: 4111 - DNA, 312 bp, Streptococcus agalactiae
atggaacttaaatttgtgattcccaacatggaaaaaacattcggcaatttagaatttgctggcgaggataaagtcgttcagcgaagaatcaacggacggctaactgtcttatcaagaagctataatctctattctgatgttcaaagagcagatgatattgtggtggtgcttcctgctgaagctggcgaaaaacatttcggctttgaggaacgtgtgaagttagtcaatccacgtattaccgcagagggctacaaaatcggcactcgtggttttacaaattaccttttacatgctgacgacatgataaaagaa

SEQ ID NO: 4112 - protein, 104 aa, Streptococcus agalactiae
MELKFVIPNMEKTFGNLEFAGEDKVVQRRINGRLTVLSRSYNLYSDVQRADDIVVVLPAEAGEKHFGFEERVKLVNPRITAEGYKIGTRGFTNYLLHADDMIKE

SEQ ID NO: 4113 - DNA, 384 bp, Streptococcus agalactiae
atgatgagattagcaaatggcattgtattagataaagacacgacttttggagaattgaaattctctgctctacgtcgtgaagtgagaatccaaaatgaagacgggtcggtttcagatgaaatcaaggaacgtacctatgacttaaaatccaaaggacaaggacgcatgattcaagtaagtattcctgccagcgtgcctttgaaagagtttgattataacgcacgggtggaacttatcaatcccattgcggacaccgttgctactgccacctatcaaggagcagatgttgactggtatatcaaggcagacgatattgtgctgacaaaggattctagttcattcaaagctcaaccacaagcaaagaaagaaccgacacaagacaaa

SEQ ID NO: 4114 - protein, 128 aa, Streptococcus agalactiae
MMRLANGIVLDKDTTFGELKFSALRREVRIQNEDGSVSDEIKERTYDLKSKGQGRMIQVSIPASVPLKEFDYNARVELINPIADTVATATYQGADVDWYIKADDIVLTKDSSSFKAQPQAKKEPTQDK

SEQ ID NO: 4115 - DNA, 1383 bp, Streptococcus agalactiae
atgaaacagcgtggtaaaaggattcgcccatctggtaaagatttagtctttcattttacgatagcgtcactcctgcctgttttcctgctggttgtcggactgtttcatgtgaagacaatccagcagatcaactggcaggattttaacctatcacaagcagataagattgacattccctatttaattatcagtttcagtgtcgcaattcttatctgcttgctggtagcgtttgtattcaaacgggttcgctatgatacggttaaacaactttaccaccgtcaaaaactggcaaagatgatacttgaaaacaagtggtatgaatctgaacaggtcaaaacagagggtttctttaaagatagtgctggtcgtacaaaggaaaagataacctacttccctaaaatgtattatcgacttaaaaatggcttgatacagatacgggtggaaatcacgctgggaaaatatcaagaccaactcttacacttggaaaagaaattagagagtggcttgtactgtgagctgacggataaagagttaaaggattcctatgtggaatatactttgctctatgacaccatagccagtcgtatttctattgatgaagtagaagctaaagatggtaaacttcgcttaatgaaaaacgtatggtgggaatatgataagctccctcatatgttgattgctggtggtacaggtggcggtaaaacttactttatactgacactgattgaagccttgcttcatacagattcaaaactgtatattcttgacccgaaaaatgctgatcttgcggacttaggttctgtgatggcaaatgtctactatagaaaagaagacttgctttcttgcattgaaacattctatgaagaaatgatgaaacgtagtgaggaaatgaagcagatgaagaactataagactggcaaaaattatgcttacttaggtctcccggcacacttcttaatctttgatgaatacgtcgctttcatggaaatgctgggaacaaaagaaaacaccgcagttatgaataagctgaaacagattgtcatgttaggtcgtcaagctggcttctttctaatactggcttgtcaacgtccagacgcaaaatatttaggcgacggaatccgtgatcagtttaatttcagagtggctttaggtcgtatgtctgaaatgggctatggcatgatgtttggcagtgacgtacaaaaggatttcttcttaaagcgaatcaaaggtcgtggctatgttgatgtaggaacaagtgtcatatcagagttttatactccccttgtaccaaaaggatatgatttcttggaggaaattaaaaagttatccaacagcagacagtccacgcaggcgacgtgcgaagcggaagtcgcaggtgtggac

SEQ ID NO: 4116 - protein, 461 aa, Streptococcus agalactiae
MKQRGKRIRPSGKDLVFHFTIASLLPVFLLVVGLFHVKTIQQINWQDFNLSQADKIDIPYLIISFSVAILICLLVAFVFKRVRYDTVKQLYHRQKLAKMILENKWYESEQVKTEGFFKDSAGRTKEKITYFPKMYYRLKNGLIQIRVEITLGKYQDQLLHLEKKLESGLYCELTDKELKDSYVEYTLLYDTIASRISIDEVEAKDGKLRLMKNVWWEYDKLPHMLIAGGTGGGKTYFILTLIEALLHTDSKLYILDPKNADLADLGSVMANVYYRKEDLLSCIETFYEEMMKRSEEMKQMKNYKTGKNYAYLGLPAHFLIFDEYVAFMEMLGTKENTAVMNKLKQIVMLGRQAGFFLILACQRPDAKYLGDGIRDQFNFRVALGRMSEMGYGMMFGSDVQKDFFLKRIKGRGYVDVGTSVISEFYTPLVPKGYDFLEEIKKLSNSRQSTQATCEAEVAGVD

SEQ ID NO: 4117 - DNA, 750 bp, Streptococcus pyogenes
ttggcgattcctgatttagataaattttcatctaacttacaacaggggaaaattcctgtcataaagcacttcgaactcaatttagataaggggagtcactgggctattgctggaaattcaggttctgggaaaccgtacgctctcacttacttcttgagtgtcctgaaacctaagtccggcctaattatcattgacccaaaattcgatacccctagccaatgggcaagagaaaataaaattgccgttatccacccagtagaaaaccattcaaaatctgatttcgtttcacaagtcaatgaacaattaaaccagtgtgcaactctcattcagaaacgacaagctatcttgtatgataatcccaatcatcaatttacccatctaactattgttattgatgaagtcctcgctctatcagagggagtcaataagaatatcaaagaagcttttttctccctactatcacaaattgccttgttgggacatgctactaaaatccatctattcttgggaagccagcgttttgaccataacactattcccatttcagtgagggaacagctaaacgtattattgcaaattggaaatatcaatcagaaaaccactcaattcttatttccagacctagatccagagggaattgtcattccaacaggacacggaacaggtatcattcaagttgtcgataatgaacactcctatcaagttctacccttactctgtccaacctactatactaagcgaggtatccta

SEQ ID NO: 4118 - protein, 250 aa, Streptococcus pyogenes
LAIPDLDKFSSNLQQGKIPVIKHFELNLDKGSHWAIAGNSGSGKPYALTYFLSVLKPKSGLIIIDPKFDTPSQWARENKIAVIHPVENHSKSDFVSQVNEQLNQCATLIQKRQAILYDNPNHQFTHLTIVIDEVLALSEGVNKNIKEAFFSLLSQIALLGHATKIHLFLGSQRFDHNTIPISVREQLNVLLQIGNINQKTTQFLFPDLDPEGIVIPTGHGTGIIQVVDNEHSYQVLPLLCPTYYTKRGIL

SEQ ID NO: 4119 - DNA, 183 bp, Streptococcus agalactiae
gtgcgaagcggaagtcgcaggtgtggactgatcttgctggctggtgtggcaatagccacgccagcacttaaccccccgtatctaacaggggggtacaaatcgacaggaaacagtcaaaaaaacattagaaaatcctttggttacaagggatttacaaaatttcagcgtatgtcaaatgggctt

SEQ ID NO: 4120 - protein, 61 aa, Streptococcus agalactiae
MRSGSRRCGLILLAGVAIATPALNPPYLTGGYKSTGNSQKNIRKSFGYKGFTKFQRMSNGL

SEQ ID NO: 4121 - DNA, 1203 bp, Streptococcus agalactiae
ttggagggatttttactgaatgaacaaacttggttacagcatttaaaagaaaaacgcttggcttatggactatctcaaaaccgtttagctgttgcgactggtattacaaggcagtatctaagcgatattgaaacaggaaaagtcaagccatcagaggatttacagcagtccctttgggaagctctggaacgcttcaatcccgacgctccccttgaaatgctgtttgattatgtaagaattcgctttccgacaacagacgtacagcaggtggtcgaaaacatcttacaactgaaactgtcctattttcttcatgaggactatggtttctattcttattcagagcattatgctttaggcgacatattcgtcctttgctcccatgaactggacaaaggagttctggtggaattgaaaggtcgtgggtgcagacaatttgaaagctatcttctggcacaacaaagaagctggtatgagttctttatggacgttttggtggctggcggtgtgatgaaacgccttgaccttgccattaacgataagacagggattttaaatatccctgtactcactgaaaagtgccaacaggaagaatgtatctccgtcttccgcagttttaaaagctatcgcagtggcgaactggtacgcaaagaggaaaaggaatgtatgggaaacaccctctatatcggttcattacaaagtgaagtttatttctgtatctatgaaaaggactacgagcagtacaagaaaaatgatattcccattgaagacgcagaagtaaaaaaccgttttgagattcgattgaaaaatgagcgtgcctattatgcagtccgtgatttactcgtctatgacaatccagagcataccgcctttaaaattatcaatcggtatatccgttttgtagataaagacgattccaaacctcgttctgattggaaactgaatgaagaatgggcttggtttattgggaacaatcgtgaacgattaaaactaaccacaaaaccagagccttactccttccaaaggacgctgaactggctatctcatcaagttgccccgaccttaaaggttgcgattaaacttgatgaaatcaaccagacgcaggttgtaaaagacattctcgaccatgcgaaactgacagaccgacacaagcagattttgaagcaacagtcagtaaaagaacaggacgtgataacaacaaaaaaa

SEQ ID NO: 4122 - protein, 401 aa, Streptococcus agalactiae
MEGFLLNEQTWLQHLKEKRLAYGLSQNRLAVATGITRQYLSDIETGKVKPSEDLQQSLWEALERFNPDAPLEMLFDYVRIRFPTTDVQQVVENILQLKLSYFLHEDYGFYSYSEHYALGDIFVLCSHELDKGVLVELKGRGCRQFESYLLAQQRSWYEFFMDVLVAGGVMKRLDLAINDKTGILNIPVLTEKCQQEECISVFRSFKSYRSGELVRKEEKECMGNTLYIGSLQSEVYFCIYEKDYEQYKKNDIPIEDAEVKNRFEIRLKNERAYYAVRDLLVYDNPEHTAFKIINRYIRFVDKDDSKPRSDWKLNEEWAWFIGNNRERLKLTTKPEPYSFQRTLNWLSHQVAPTLKVAIKLDEINQTQVVKDILDHAKLTDRHKQILKQQSVKEQDVITTKK

SEQ ID NO: 4123 - DNA, 162 bp, Streptococcus agalactiae
atgcgattgaatagctctagtaaaatgtcttttactccagcagcgttgaagactaagccaaccgcaataatcgcaataattaaaaagccaatcagtttgctaaactcacgcttgaagccaagatacaagccaatcacaacgattgctaaaagcaccagtgat

SEQ ID NO: 4124 - protein, 54 aa, Streptococcus agalactiae
MRLNSSSKMSFTPAALKTKPTAIIAIIKKPISLLNSRLKPRYKPITTIAKSTSD

SEQ ID NO: 4125 - DNA, 219 bp, Streptococcus agalactiae
atgaattttggacaaaacctttataactggtttctatcaaacgctcaatcactggtgcttttagcaatcgttgtgattggcttgtatcttggcttcaagcgtgagtttagcaaactgattggctttttaattattgcgattattgcggttggcttagtcttcaacgctgctggagtaaaagacattttactagagctattcaatcgcattattggtgct

SEQ ID NO: 4126 - protein, 73 aa, Streptococcus agalactiae
MNFGQNLYNWFLSNAQSLVLLAIVVIGLYLGFKREFSKLIGFLIIAIIAVGLVFNAAGVKDILLELFNRIIGA

SEQ ID NO: 4127 - DNA, 495 bp, Streptococcus agalactiae
atggacgatatgcaagtctatattgcgaatttaggcaaatacaatgagggcgaattggtcggtgcgtggtttacctttcccattgactttgaggaagtcaaagagaaaatcggcttgaatgatgaatatgaggaatacgccattcatgactacgagttaccctttacggttgacgaatacacttccattggcgaactcaatcgactatgggaaatggtatcggaattacccgaagaattacaatcggagctatctgctctgctcactcatttttcaagcattgaagaactaagcgaacatcaagaggatattatcattcattccgattgtgatgatatgtatgacgtggcacgctactacattgaagaaacgggtgctttaggcgaagtaccagctagtcttcaaaactatattgattatcaagcctatggtcgggatttagacctttcaggaacgtttatctcaaccaatcatgggatttttgaaatcgtctat

SEQ ID NO: 4128 - protein, 165 aa, Streptococcus agalactiae
MDDMQVYIANLGKYNEGELVGAWFTFPIDFEEVKEKIGLNDEYEEYAIHDYELPFTVDEYTSIGELNRLWEMVSELPEELQSELSALLTHFSSIEELSEHQEDIIIHSDCDDMYDVARYYIEETGALGEVPASLQNYIDYQAYGRDLDLSGTFISTNHGIFEIVY

SEQ ID NO: 4129 - DNA, 504 bp, Streptococcus agalactiae
atgggatttttgaaatcgtctattaaatctgtcggtacattactactggcagattttctattttacggggtggctcaatcagctacccctattttttatgaaaggattgattacatgaagaaaatacgaagctataccagtatctggtctgtggaaaaggtactgtattctatcaatgattttagacttccgtttcccataacctttacgcaaatgacatggtttgtcgtgtcactctttgcagtgatgatacttggcaacttgccccctctttccatgatagagggagcatttctcaaatactttgggattcctgtggctttcacatggtttatgtctacaaaaacttttgatggtaaaaagccttatggatttttgaagtctgtcattgcttatgcactgcgaccaaagctgacctatgcaggaaaaaaagtaacgcttggcagaaaccagccacaagaagccattacagcagttaggagtgaattttatggcatatccaat

SEQ ID NO: 4130 - protein, 168 aa, Streptococcus agalactiae
MGFLKSSIKSVGTLLLADFLFYGVAQSATPIFYERIDYMKKIRSYTSIWSVEKVLYSINDFRLPFPITFTQMTWFVVSLFAVMILGNLPPLSMIEGAFLKYFGIPVAFTWFMSTKTFDGKKPYGFLKSVIAYALRPKLTYAGKKVTLGRNQPQEAITAVRSEFYGISN

SEQ ID NO: 4131 - DNA, 933 bp, Streptococcus agalactiae
gtgaattttatggcatatccaattaaatacattgaaaacaatctcgtctggaataaagacggggaatgttatgcttactatgagcttgttccttacaattactcatttctaagtccagaacagaaaatacaagtgcatgattctttcagacagcttatcgcacaaaatcgtgatggcaaaattcatgctttacaaatcagtacagaatccagcatacgttctgcacaagagcgttccaaaaatgaagtcactggcaagctcaaagcggttgcctatgacaaaatcgaccaacagacagacgctttaatatccatgattggcgaaaatcaagtgaactaccgtttctttatcggctttaagttgcttctcaacgatcaggagttttctatgaaaagtcttaccgttgaagcaaaaaatgctttgtctgattttgtctatgatgtgaaccataagctgatgggcgattttgttagtatgagtaatgatgaaatcctgcgttttcagaagatggaaaagctcttagaaaataaaatctctcgtcgtttcaaaatccgcaggttagataaggacgacttcggctatctgattgaacacctttacggacagacaggcactgcctatgaagagtatgagtaccatctatcaaagaaaaagctggataatgaaacgctgattaaatactatgacttgattaagcctactcgctgtttggtggaagaaaaacagcgatatttgaaaatccagcaggaagatgaaaccgtctatgtagcttactttaccattaacagcattgtcggagaactggacttcccgtcctctgaaatcttctactaccagcaacagcaatttacattcccgattgatacgtcaatgaatgtggaaattgtagcgaatcgtaaagccctatctactgtccgcaaaaaaagaaagaac

SEQ ID NO: 4132 - protein, 311 aa, Streptococcus agalactiae
MNFMAYPIKYIENNLVWNKDGECYAYYELVPYNYSFLSPEQKIQVHDSFRQLIAQNRDGKIHALQISTESSIRSAQERSKNEVTGKLKAVAYDKIDQQTDALISMIGENQVNYRFFIGFKLLLNDQEFSMKSLTVEAKNALSDFVYDVNHKLMGDFVSMSNDEILRFQKMEKLLENKISRRFKIRRLDKDDFGYLIEHLYGQTGTAYEEYEYHLSKKKLDNETLIKYYDLIKPTRCLVEEKQRYLKIQQEDETVYVAYFTINSIVGELDFPSSEIFYYQQQQFTFPIDTSMNVEIVANRKALSTVRKKRKN

SEQ ID NO: 4133 - DNA, 1512 bp, Streptococcus agalactiae
ttggataaccacgcttggcaaagtgataatgaaaccagctccaatgtggcggaagctctggaaagtgtgaatgagctggaaaccaatttagaccaaagcaaggaatctatgtacaagctgtcttatgtggtaagggtatcagcaaatgatcttgacgaactcaaacgtcgttgtaatgaagtgaaagatttttatgacgatttaagcgtaaaactggtacgaccatttggggatatgctcggcttacatgaagaatttttacctgccagcaagcgttatatgaatgattatattcaatacgtgacctctgatttcctcgctggtttaggttttggtgctactcaaatgctgggggaaaatgaggggatttatgttggctacagcttagatactggacgcaatgtctatctgaaacctgctcttgccagtcaaggggttaagggttcagtaaccaatgcgttagcgtcggcttttgttggttcgctgggtggtggtaaatcctttgcgaataaccttatcgtctattatgcggtgctttatggggcacaagcagtgattgtagacccaaaagcagaacgtggcagatggaaagaaaccttgccagagatttcccatgaaatcaatatcgtcactctgacttctgatgagaaaaacaaaggcttacttgacccttatgtgattatgaaaaatcccaaagattctgaatcactggctattgatattctgacattccttacggggatttcctctcgtgatggggaacgcttcccaatccttagaaaagccattcgtgcagtaaccaatagtgaagtacgagggttgatgaaagtgattgaggaattacgggttgagaatacgccactaagtaccagtatagccgaccatatcgaaagttttacagactatgactttgcacatttattattcagtaatggttatgtggagcagtctatcagcttagaaaaacaactgaacattatacaggttgcggacttggtacttcccgacaaggaaacttcctttgaggaatataccactatggagcttttatccgttgctatgctgattgtcattagtacctttgctttagactttatccatacagaccgaagcattttcaagattgtagatttagacgaagcatggagctttttacaggtagcacaaggaaaaacactatctatgaagctggttcgggctggtcgtgctatgaacgctggggtatatttcgtgacccaaaatacagacgacctcttagatgaaaaactgaaaaataacctcggcttaaaatttgcatttcgttccactgaccttaacgagattaaaaagaccttagccttttttggtgtagacccagaggacgaaaacaatcagaagcgattgcgtgatttggaaaacgggcaatgccttatcagtgatttatatggtcgtgtcggtgtgatacagttccaccctgtatttgaagaactgctccatgcctttgataccagaccacctgtgcgaaaagaggtg

SEQ ID NO: 4134 - protein, 504 aa, Streptococcus agalactiae
MDNHAWQSDNETSSNVAEALESVNELETNLDQSKESMYKLSYVVRVSANDLDELKRRCNEVKDFYDDLSVKLVRPFGDMLGLHEEFLPASKRYMNDYIQYVTSDFLAGLGFGATQMLGENEGIYVGYSLDTGRNVYLKPALASQGVKGSVTNALASAFVGSLGGGKSFANNLIVYYAVLYGAQAVIVDPKAERGRWKETLPEISHEINIVTLTSDEKNKGLLDPYVIMKNPKDSESLAIDILTFLTGISSRDGERFPILRKAIRAVTNSEVRGLMKVIEELRVENTPLSTSIADHIESFTDYDFAHLLFSNGYVEQSISLEKQLNIIQVADLVLPDKETSFEEYTTMELLSVAMLIVISTFALDFIHTDRSIFKIVDLDEAWSFLQVAQGKTLSMKLVRAGRAMNAGVYFVTQNTDDLLDEKLKNNLGLKFAFRSTDLNEIKKTLAFFGVDPEDENNQKRLRDLENGQCLISDLYGRVGVIQFHPVFEELLHAFDTRPPVRKEV

SEQ ID NO: 4135 - DNA, 2175 bp, Streptococcus agalactiae
gtgaaaccatcaatagtaaacagaataaaatcaaactggacgctgaaacgtctaggtaaagtggcaatgacagtggctttcacacttgtgattgccatttttcttttagccatgctgggaacggtggttcaagctgcgggcttggtagatgatacggtcaatgtggcaaatgaatacagccgatacccacttgaaaactatcaactggatttttatgtggataatagctggggctggcttccgtggaactggtcggacgggattggaaaacaggtcatgtatggactatatgccattaccaattttatttggacaatcagtttgtatgtttccaatgcgacaggttacttagtacaggaagcctattccttagacttcatttccgctacagcagattccattggtaagaatatgcagaccttagctggtgtgagtgcaaacggattttcaacagagggtttctatgttggattcctcttactcttgattttggttcttggggtttatgttgcctatacgggactgataaagagagaaaccacaaaggcaattcatgccattatgaattttgtgctggtgtttatcctatcggcttcctttattgcctacgctcccgactacattaaaaaaatcaatgacttttcatcagacatcagtaatgccagtttatcacttggcacgaagattgtcatgccccattccgatagtcaaggcaaggacagcgtggacttaatcagagatagcctgttttccatacaggttcagcaaccgtggctactgcttcaatacaacagttcagacattgaaagtatcggtattgaccgtgtggaaagcctgctctccaccagcccagattccaacaatggcgaagacagagaaaaaattgttgcggaagaaattgaagacagaagcaataccaatctaaccattacaaagaccattaaccgtttaggtacagtcttcttcctatttgtcttcaatattgggatttccatatttgtattcctattaacaggaatcatgattttctcgcaggtactttttatcatctatgctatgtttctgcctgtgagctttattttaagcatgattccatcatttgatggtatgtcaaaacgagccataacaaagctctttaataccattttgacacgagctggaatcacattgattattacgacagcatttagtatttcaaccatgctctataccttatcggctggttatccgttctttttgattgcttttctacagattgtgacctttgcaggaatctacttcaagctgggcgatttaatgagtatgttttctctacagagtaacgattctcaaagtgtgggaagtcgtgtgatgagaaaacctcgtatgcttatgcacgctcacatgcaccgtctacagcggaaacttggacgttccatgactactctaggggctgggtctgccattgttacaggtaaaaaaggacagtcgggttcggggagttctgcaaggacacaagcagatcactcccgaccagacggaaaggaaaaatcaacacttggaaaacgtatcggtcaaaccatcggtacagtagctgataccaaagacagaatggtagacactgctagtggtttgaaagaacaggttaaagatttgccgaccaatgcaagatatgcagtatatcaaggaaaatccaaagtaaaagagaatgtccgtgatttaaccagtagtatttctcaaaccaaagcggacagagccagtggacgcaaggaacagcaggaacaaaggcgaaaaaccattgcgaagcgtcgctctgaaatggaacaggtcaaacagaaaaaacagcctgcttcttctgttcatgaaagaccgactacaagacaagaacaatatcatgatgaacagacctcaaaacagtctaatattcagacttcatataaggaatctcaacaagccaaacaagagcgtccagcagttaagtccgatttttcaagtccaaaagtggaacgccaaggcaataccgttcaagaaaaaaccgttcaaaagccagcaacttcaaccactacagcagatagaacttcacaacgtccaatcacaaaagaacgtccgtctactgttcaaagagtaccactacaaaatacaagaagtagaccaccaatcaaaaccgccaccattaagaaagtcggtaagaaacca

SEQ ID NO: 4136 - protein, 725 aa, Streptococcus agalactiae
MKPSIVNRIKSNWTLKRLGKVAMTVAFTLVIAIFLLAMLGTVVQAAGLVDDTVNVANEYSRYPLENYQLDFYVDNSWGWLPWNWSDGIGKQVMYGLYAITNFIWTISLYVSNATGYLVQEAYSLDFISATADSIGKNMQTLAGVSANGFSTEGFYVGFLLLLILVLGVYVAYTGLIKRETTKAIHAIMNFVLVFILSASFIAYAPDYIKKINDFSSDISNASLSLGTKIVMPHSDSQGKDSVDLIRDSLFSIQVQQPWLLLQYNSSDIESIGIDRVESLLSTSPDSNNGEDREKIVAEEIEDRSNTNLTITKTINRLGTVFFLFVFNIGISIFVFLLTGIMIFSQVLFIIYAMFLPVSFILSMIPSFDGMSKRAITKLFNTILTRAGITLIITTAFSISTMLYTLSAGYPFFLIAFLQIVTFAGIYFKLGDLMSMFSLQSNDSQSVGSRVMRKPRMLMHAHMHRLQRKLGRSMTTLGAGSAIVTGKKGQSGSGSSARTQADHSRPDGKEKSTLGKRIGQTIGTVADTKDRMVDTASGLKEQVKDLPTNARYAVYQGKSKVKENVRDLTSSISQTKADRASGRKEQQEQRRKTIAKRRSEMEQVKQKKQPASSVHERPTTRQEQYHDEQTSKQSNIQTSYKESQQAKQERPAVKSDFSSPKVERQGNTVQEKTVQKPATSTTTADRTSQRPITKERPSTVQRVPLQNTRSRPPIKTATIKKVGKKP

SEQ ID NO: 4137 - DNA, 132 bp, Streptococcus agalactiae
ttggaaattccgctgtcctgttcatctgaaaataaaatggcaacaaacagaagcagtgagaagaccatcaagaataatccagaaccaccaatcactaaagttttcaacttcatggtttcttaccgactttct

SEQ ID NO: 4138 - protein, 44 aa, Streptococcus agalactiae
MEIPLSCSSENKMATNRSSEKTIKNNPEPPITKVFNFMVSYRLS

SEQ ID NO: 4139 - DNA, 96 bp, Streptococcus agalactiae
atgtggctaatcgtggaaataaatatacctttgaactggctcaaagtttctcaaaagagtattcaggtggcgaaaaagtgtcttaccccaatccca

SEQ ID NO: 4140 - protein, 32 aa, Streptococcus agalactiae
MWLIVEINIPLNWLKVSQKSIQVAKKCLTPIP

SEQ ID NO: 4141 - DNA, 870 bp, Streptococcus agalactiae
gtgaatgtttccgcagaagtgctggctcataagcctatggtagaaaaatatgccaaagaatatggcgttgaagaatatgtcaacatacttcttgcgattatacaggtggaatcgggcggtactgcggaagatgttatgcagtcctcggaatccctcggtcttccacctaattcattgagtacagaagaatccattaagcaaggtgtgaagtatttcagtgaattattagccagtagcgaaaggctcagtgtagatttagaatcggttatccagtcctacaattatggtggtggtttcttagggtatgtggctaatcgtggaaataaatatacctttgaactggctcaaagtttctcaaaagagtattcaggtggcgaaaaagtgtcttaccccaatcccatagccatacctatcaatgggggctggcgatacaactatggcaatatgttttatgtgcaactggtaacgcagtatcttgtcacaacagagtttgatgatgatacggtacaagccatcatggacgaagcactgaaatatgagggctggcgatacgtttacggtggagcttccccgactacttcttttgattgtagcggactgacacaatggacgtatggaaaagctggaattaacttaccacgaaccgcacaacagcaatatgatgtgacccagcatatcccactatcggaagcacaagctggcgatttggttttctttcattctacctataacgctggctcttatattactcatgttgggatataccttggcaataaccgtatgtttcatgcaggcgacccaatcggttatgccgacttaacaagcccctactggcaacagcatttagtgggagcaggacgaatcaaacaa

SEQ ID NO: 4142 - protein, 290 aa, Streptococcus agalactiae
MNVSAEVLAHKPMVEKYAKEYGVEEYVNILLAIIQVESGGTAEDVMQSSESLGLPPNSLSTEESIKQGVKYFSELLASSERLSVDLESVIQSYNYGGGFLGYVANRGNKYTFELAQSFSKEYSGGEKVSYPNPIAIPINGGWRYNYGNMFYVQLVTQYLVTTEFDDDTVQAIMDEALKYEGWRYVYGGASPTTSFDCSGLTQWTYGKAGINLPRTAQQQYDVTQHIPLSEAQAGDLVFFHSTYNAGSYITHVGIYLGNNRMFHAGDPIGYADLTSPYWQQHLVGAGRIKQ

SEQ ID NO: 4143 - DNA, 597 bp, Streptococcus pyogenes
atgtttagacttttaaagcgtgcctgcagttttcttcttctttttgtcatttatcaatcctttgttattcatcacaatgttcaacgtgttttggcatataagcctatggttgagaaaacattagcagaaaatgatacaaaggcaaatgtagacttagtcttagctatgatatacaccgagacaaaaggaggagaagcagatgtcatgcaatccagtgaaagcagttcaggacaaaaaaactcgattacagatagtcaggccagtattgagcacggggtgaatttactgtctcataatcttgctctagctgaggaagcaggagtagattcttggacggctgttcaggcctataattttggaacagcttatattgattatattgctgaacatggaggtcaaaataccgttgatttagcgactacctattccaaaaccgttgtggcgccaagcctaggcaacactagtggtcaaacctatttttattaccaccccctcgccttgatttctggaggtaagctttataagaatggcggcaatatctattactcacgagaagttcatttcaatctttatttaattgaactgatgagccttttt

SEQ ID NO: 4144 - protein, 199 aa, Streptococcus pyogenes
MFRLLKRACSFLLLFVIYQSFVIHHNVQRVLAYKPMVEKTLAENDTKANVDLVLAMIYTETKGGEADVMQSSESSSGQKNSITDSQASIEHGVNLLSHNLALAEEAGVDSWTAVQAYNFGTAYIDYIAEHGGQNTVDLATTYSKTVVAPSLGNTSGQTYFYYHPLALISGGKLYKNGGNIYYSREVHFNLYLIELMSLF

SEQ ID NO: 4145 - DNA, 930 bp, Streptococcus agalactiae
atgagaaaggaagatttaatgatgaaatttagaaaaaatcagaataaagaaaaacagataccaaaggaaaagaaacctcgtgtctataaggtcaatcctcataaaaaggttgtgattgccttgtgggtacttttagggcttagtttcagctttgcgatattcaagcactttacagctatagatactcatactattcacgaaacaactatcatagaaaaggaatacgttgatactcatcatgtagaaaattttgtagagaactttgcgaaagtctactattcatgggagcaatccgataagtccattgataatcgaatggaaagtctaaaaggctatctgacagatgaacttcaagctctcaatgttgatacagtacgcaaagatattcctgtatcgtcttctgtaagaggatttcagatatggacggtagagccaactggcgacaatgagtttaatgtaacctacagtgtagaccagctcattacagagggagaaaatacaaagaccgtccactctgcttatatagtgagtgtctatgtagatggttctggaaatatggtactggttaagaatccgaccattaccaacatacctaagaaatcaagttataaaccaaaagccattgaaagtgaggggacggttgattccattacaaccaatgaaatcaatgagtttttaacgacgttcttcaagctctatcctacagcgacagccagtgaactttcctactatgtgaatgacgggatattaaaaccaatcggaaaagagtacatctttcaagaactggtaaatcctattcacaatcgtaaggataatcaagtcacggtatcgctgacagtggagtatatcgaccagcagaccaaagcaacgcaggtatctcaatttgatttggtacttgaaaagaacgggagtaattggaagattgtaaaa

SEQ ID NO: 4146 - protein, 310 aa, Streptococcus agalactiae
MRKEDLMMKFRKNQNKEKQIPKEKKPRVYKVNPHKKVVIALWVLLGLSFSFAIFKHFTAIDTHTIHETTIIEKEYVDTHHVENFVENFAKVYYSWEQSDKSIDNRMESLKGYLTDELQALNVDTVRKDIPVSSSVRGFQIWTVEPTGDNEFNVTYSVDQLITEGENTKTVHSAYIVSVYVDGSGNMVLVKNPTITNIPKKSSYKPKAIESEGTVDSITTNEINEFLTTFFKLYPTATASELSYYVNDGILKPIGKEYIFQELVNPIHNRKDNQVTVSLTVEYIDQQTKATQVSQFDLVLEKNGSNWKIVK

SEQ ID NO: 4147 - DNA, 1932 bp, Streptococcus agalactiae
atggaggaaaatcacatgaaaattattaatattggagttttagctcatgttgatgcaggaaaaactaccttaacagaaagcttattatataacagtggagcgattacagaattaggaagcgtggacaaaggtacaacgaggacggataatacgcttttagaacgtcagagaggaattacaattcagacaggaataacctcttttcagtgggaaaatacgaaggtgaacatcatagacacgccaggacatatggatttcttagcagaagtatatcgttcattatcagttttagatggggcaattctactgatttctgcaaaagatggcgtacaagcacaaactcgtatattatttcatgcacttaggaaaatggggattcccacaatcttttttatcaataagattgaccaaaatggaattgatttatcaacggtttatcaggatattaaagagaaactttctgccgaaattgtaatcaaacagaaggtagaactgtatcctaatatgtgtgtgacgaactttaccgaatctgaacaatgggatacggtaatagagggaaacgatgaccttttagagaaatatatgtccggtaaatcattagaagcattggaactcgaacaagaggaaagcataagatttcataattgttccctgttccctgtttatcacggaagtgcaaaaaacaatatagggattgataaccttatagaagtgattacgaataaattttattcatcaacacatcgaggtccgtctgaactttgcggaaatgttttcaaaattgaatatacaaaaaaaagacaacgtcttgcatatatacgcctttatagtggagtactacatttacgagattcggttagagtatcagaaaaagaaaaaataaaagttacagaaatgtatacttcaataaatggtgaattatgtaagattgatagagcttattctggagaaattgttattttgcaaaatgagtttttgaagttaaatagtgttcttggagatacaaaactattgccacagagaaaaaagattgaaaatccgcaccctctactacaaacaactgttgaaccgagtaaacctgaacagagagaaatgttgcttgatgcccttttggaaatctcagatagtgatccgcttctacgatattacgtggattctacgacacatgaaattatactttctttcttagggaaagtacaaatggaagtgattagtgcactgttgcaagaaaagtatcatgtggagatagaactaaaagagcctacagtcatttatatggagagaccgttaaaaaatgcagaatataccattcacatcgaagtgccgccaaatcctttctgggcttccattggtttatctgtatcaccgcttccgttgggaagtggaatgcagtatgagagctcggtttctcttggatacttaaatcaatcatttcaaaatgcagttatggaagggatacgctatggttgcgaacaaggattatatggttggaatgtgacggattgtaaaatctgttttaagtatggcttatactatagccctgttagtaccccagcagattttcggatgcttgctcctattgtattggaacaagtcttaaaaaaagctggaacagaattgttagagccatatcttagttttaaaatttatgcgccacaggaatatctttcacgagcatacaacgatgctcctaaatattgtgcgaacatcgtagacactcaattgaaaaataatgaggtcattcttagtggagaaatccctgctcggtgtattcaagaatatcgtagtgatttaactttctttacaaatggacgtagtgtttgtttaacagagttaaaagggtaccatgttactaccggtgaacctgtttgccagccccgtcgtccaaatagtcggatagataaagtacgatatatgttcaataaaataact

SEQ ID NO: 4148 - protein, 644 aa, Streptococcus agalactiae
MEENHMKIINIGVLAHVDAGKTTLTESLLYNSGAITELGSVDKGTTRTDNTLLERQRGITIQTGITSFQWENTKVNIIDTPGHMDFLAEVYRSLSVLDGAILLISAKDGVQAQTRILFHALRKMGIPTIFFINKIDQNGIDLSTVYQDIKEKLSAEIVIKQKVELYPNMCVTNFTESEQWDTVIEGNDDLLEKYMSGKSLEALELEQEESIRFHNCSLFPVYHGSAKNNIGIDNLIEVITNKFYSSTHRGPSELCGNVFKIEYTKKRQRLAYIRLYSGVLHLRDSVRVSEKEKIKVTEMYTSINGELCKIDRAYSGEIVILQNEFLKLNSVLGDTKLLPQRKKIENPHPLLQTTVEPSKPEQREMLLDALLEISDSDPLLRYYVDSTTHEIILSFLGKVQMEVISALLQEKYHVEIELKEPTVIYMERPLKNAEYTIHIEVPPNPFWASIGLSVSPLPLGSGMQYESSVSLGYLNQSFQNAVMEGIRYGCEQGLYGWNVTDCKICFKYGLYYSPVSTPADFRMLAPIVLEQVLKKAGTELLEPYLSFKIYAPQEYLSRAYNDAPKYCANIVDTQLKNNEVILSGEIPARCIQEYRSDLTFFTNGRSVCLTELKGYHVTTGEPVCQPRRPNSRIDKVRYMFNKIT

SEQ ID NO: 4149 - DNA, 2076 bp, Streptococcus pyogenes
atggctcgcgaattttcacttgcaaaaactcgtaatatcggtatcatggctcacgtcgatgctggtaaaacaactacaacagagcgtatcctttactacactggtaaaattcataaaatcggtgaaacgcacgaaggcgcatcacaaatggactggatggagcaagagcaagaacgtggtatcactattacttctgccgctacaacagctcaatgggatggtcaccgcgttaacatcatcgacacaccaggacacgtggacttcaccatcgaagtacaacgttctctccgtgttcttgatggtgctgtaaccgttcttgactcacaatcgggtgttgagcctcaaactgaaacagtttggcgtcaagcaactgaatacggtgttccacgtatcgttttcgccaacaaaatggataaaatcggtgctgacttcctttactcagtacaaacccttcatgaccgtcttcaagcaaatgcacacccaatccaattgccaatcggtgcagaagatgatttccgtggtatcattgacttgatcaagatgaaagcagaaatctataccaacgaccttggtacagatattcttgaagaagatattccagaagaatacttagaacaagctcaagaataccgtgaaaaattaatcgaagcagttgctgaaactgatgaagacttgatgatgaaataccttgaaggtgaagaaatcactaacgacgaattgattgctggtatccgtaaagcaacaatcaacgttgaattcttcccagtactttgtggttctgccttcaaaaacaaaggtgttcaattgatgcttgatgcggttatcgcataccttccaagcccacttgacatccctgcaatcaaaggtgttaacccggatacagatgctgaagaagaacgtccagcatctgatgaagagccatttgcagctcttgccttcaagatcatgactgacccattcgtaggtcgtttgacattcttccgtgtttactcaggtgttcttaatagcggttcttacgttatgaacacatcaaaaggtaaacgtgagcgtatcggacgtatccttcaaatgcacgcaaacagccgtcaagaaattgaaacagtttacgctggtgacatcgctgccgctgttggtttgaaagacacaacaactggtgactcattgactgatgaaaaagcaaaagttattcttgagtcaatcgaagttccagaaccagttatccagttgatggttgagccaaaatctaaagcagaccaagacaagatgggtgttgcccttcaaaaacttgctgaagaagatccaacattccgtgttgaaacaaacgttgaaactggtgaaacagttatcgctggtatgggtgaacttcaccttgatgtccttgttgaccgtatgaaacgtgagttcaaagttgaagctaacgttggtgctcctcaagtatcttaccgtgaaacattccgtgcttctacacaagctcgtggattcttcaaacgccaatctggtggtaaaggtcaattcggtgatgtttggattgaatttacaccaaatgaagaaggtaaaggtttcgaattcgaaaatgctatcgttggtggtgtggttcctcgtgaatttatcccagctgttgaaaaagggttgatcgaatctatggcaaacggtgttcttgctggttacccaatggttgacgttaaagctaaactttacgatggttcataccacgatgtcgactcatctgaaactgccttcaagatcgcagcatctcttgctcttaaagaagcagctaaatcagcacaaccagctatccttgagccgatgatgcttgtaacgattacagctccagaagacaatcttggagacgttatgggacacgtgacagctcgtcgtggacgcgttgatggtatggaagcacatggtaacagccaaatcgttcgtgcttatgttccacttgctgaaatgttcggttatgcaacagttcttcgttctgctactcaaggacgtggtacattcatgatggtatttgaccactatgaagatgttcctaagtcagttcaagaagaaatcattaagaaaaacaaaggtgaa

SEQ ID NO: 4150 - protein, 692 aa, Streptococcus pyogenes
MAREFSLAKTRNIGIMAHVDAGKTTTTERILYYTGKIHKIGETHEGASQMDWMEQEQERGITITSAATTAQWDGHRVNIIDTPGHVDFTIEVQRSLRVLDGAVTVLDSQSGVEPQTETVWRQATEYGVPRIVFANKMDKIGADFLYSVQTLHDRLQANAHPIQLPIGAEDDFRGIIDLIKMKAEIYTNDLGTDILEEDIPEEYLEQAQEYREKLIEAVAETDEDLMMKYLEGEEITNDELIAGIRKATINVEFFPVLCGSAFKNKGVQLMLDAVIAYLPSPLDIPAIKGVNPDTDAEEERPASDEEPFAALAFKIMTDPFVGRLTFFRVYSGVLNSGSYVMNTSKGKRERIGRILQMHANSRQEIETVYAGDIAAAVGLKDTTTGDSLTDEKAKVILESIEVPEPVIQLMVEPKSKADQDKMGVALQKLAEEDPTFRVETNVETGETVIAGMGELHLDVLVDRMKREFKVEANVGAPQVSYRETFRASTQARGFFKRQSGGKGQFGDVWIEFTPNEEGKGFEFENAIVGGVVPREFIPAVEKGLIESMANGVLAGYPMVDVKAKLYDGSYHDVDSSETAFKIAASLALKEAAKSAQPAILEPMMLVTITAPEDNLGDVMGHVTARRGRVDGMEAHGNSQIVRAYVPLAEMFGYATVLRSATQGRGTFMMVFDHYEDVPKSVQEEIIKKNKGE

SEQ ID NO: 4151 - DNA, 351 bp, Streptococcus agalactiae
atgcgtaaaaaagaagataaatatgattttagagcctttggtttagccattaaagaagctcgattgaaacgaggtttaactcgtgaacaagtgggagcattgattgaaattgacccacggtacttaactaatattgaaaataaagggcaacaccccagcatacaagttctttatgaccttgtatcgttacttcatgtttccgttgatgaatttttcttacctgctaataacttggtaaaaagcacccgacgattacagatagagaaatacatggatagctttacagacaaagaactatccttaatggaatctttagccagcggtatcaacgaagcaagaaacatcgaagac

SEQ ID NO: 4152 - protein, 117 aa, Streptococcus agalactiae
MRKKEDKYDFRAFGLAIKEARLKRGLTREQVGALIEIDPRYLTNIENKGQHPSIQVLYDLVSLLHVSVDEFFLPANNLVKSTRRLQIEKYMDSFTDKELSLMESLASGINEARNIED

SEQ ID NO: 4153 - DNA, 186 bp, Streptococcus agalactiae
atgcttttttggctattcagaacttttttacaaagtttatttatcagtaatgcaacaaatccccctttcacattgggactaagagtgaaaggagataaacgagcaaggctcacttcctttcctagacagaaagggggtgagaaacatgaaaccatcttcttttcagaccacaatagaaaatcagtt

SEQ ID NO: 4154 - protein, 62 aa, Streptococcus agalactiae
MLFWLFRTFLQSLFISNATNPPFTLGLRVKGDKRARLTSFPRQKGGEKHETIFFSDHNRKSV

SEQ ID NO: 4155 - DNA, 126 bp, Streptococcus agalactiae
atggcggttagttccgttggctcttttcttatcgaaacgtattcgattacttttattcagttttcaaagaacaatggctcgttagcctatcaaaacacattgaaagctcaatatgctttggtggaa

SEQ ID NO: 4156 - protein, 42 aa, Streptococcus agalactiae
MAVSSVGSFLIETYSITFIQFSKNNGSLAYQNTLKAQYALVE

SEQ ID NO: 4157 - DNA, 201 bp, Streptococcus agalactiae
atgaagcagactgacattcctatttgggaacgttataccctaaccattgaagaagcgtcaaaatattttcgtattggcgaaaacaagctacgacgcttggcagaggaaaataaaaatgcaaattggctgattatgaatggcaatcgtattcagattaaacgaaaacaatttgaaaaaattatagatacattggacgcaatc

SEQ ID NO: 4158 - protein, 67 aa, Streptococcus agalactiae
MKQTDIPIWERYTLTIEEASKYFRIGENKLRRLAEENKNANWLIMNGNRIQIKRKQFEKIIDTLDAI

SEQ ID NO: 4159 - DNA, 1215 bp, Streptococcus agalactiae
atgtcagaaaaaagacgtgacaataaaggtcgaatcttaaagactggagagagccaacgaaaagacggaagatacttatacaaatatatagattcatttggagaaccgcaatttgtttactcgtggaaacttgtggctacagaccgagtaccagcaggaaagcgtgattgtatctcacttagagagaaaatcgcagagttacagaaagacattcatgatggtattgatgttgtaggaaagaaaatgacactctgccagctttacgcaaaacagaacgctcaaagaccaaaggttagaaaaaacactgaaactggacgcaaatatcttatggatattttgaagaaagacaagttaggtgtaagaagtattgacagtattaagccatcagacgctaaagaatgggctattagaatgagtgaaaatggttatgcttatcaaaccatcaataactacaaacgttctttaaaggcttcattctatattgctatacaagatgattgtgttcggaagaatccatttgactttcaactgaaagcagttcttgatgatgatactgtccctaagaccgtactaacagaagaacaggaagaaaaactgttagcctttgcaaaagctgataaaacctacagcaaaaattatgatgaaattctgatactcttaaaaacaggtcttcgtatttcagagtttggtggtttgacacttccagatttagattttgagaatcgtcttgtcaatatagaccatcagctattgagagatactgaaattgggtactacattgaaacaccaaagaccaaaagtggcgaacgtcaagttcctatggttgaagaagcctatcaagcatttaagcgagtgttagcgaatcgaaagaatgataagcgtgttgagattgatggatatagtgatttcctctttcttaatagaaagaactatccaaaagtggcaagtgattacaacggcatgatgaaaggtcttgttaagaaatacaataagtataacgaggataaattgccacacatcactccacatagtttgcgacatacattctgtaccaactatgcaaatgcaggaatgaatccaaaggcattacagtacattatgggacatgctaatatagccatgacgctgaactattacgcacatgcaacattcgattctgcaatggcagaaatgaaacgcttgaataaagagaagcaacaggagcgtcttgttgct

SEQ ID NO: 4160 - protein, 405 aa, Streptococcus agalactiae
MSEKRRDNKGRILKTGESQRKDGRYLYKYIDSFGEPQFVYSWKLVATDRVPAGKRDCISLREKIAELQKDIHDGIDVVGKKMTLCQLYAKQNAQRPKVRKNTETGRKYLMDILKKDKLGVRSIDSIKPSDAKEWAIRMSENGYAYQTINNYKRSLKASFYIAIQDDCVRKNPFDFQLKAVLDDDTVPKTVLTEEQEEKLLAFAKADKTYSKNYDEILILLKTGLRISEFGGLTLPDLDFENRLVNIDHQLLRDTEIGYYIETPKTKSGERQVPMVEEAYQAFKRVLANRKNDKRVEIDGYSDFLFLNRKNYPKVASDYNGMMKGLVKKYNKYNEDKLPHITPHSLRHTFCTNYANAGMNPKALQYIMGHANIAMTLNYYAHATFDSAMAEMKRLNKEKQQERLVA

SEQ ID NO: 4161 - DNA, 609 bp, Streptococcus agalactiae
atgaatatgaaattatcaaaacgttaccgcttttggcagaaggttattaaggctttgggtgtcttagcgttaatagcgactcttgtcttagttgtttatttgtacaaacttggtattttgaatgatagcaatgaattaaaagacctagtacacaagtatgaattttggggtccaatgatttttattgtggctcaaattgtacagattgtttttccagtaattcctggaggtgttacaacagtagcaggtttcttaatttttggtcctaccttaggctttatttataactatattgggattatcatcggaagtgtcatccttttttggttagtcaaattttatggacgaaaattcgttttgctatttatggatcagaagacatttgataaatatgagtctaagctagaaacatccggatatgaaaagttttttatcttttgtatggcatctcccatttcaccagcggacatcatggtgatgattaccggtctatctaatatgtctattaagcgctttgtgacaatcattatgataacgaaacctatttctatcatcggttatagctatttgtggatttatggcggtgatattttgaaaaattttttgaat

SEQ ID NO: 4162 - protein, 203 aa, Streptococcus agalactiae
MNMKLSKRYRFWQKVIKALGVLALIATLVLVVYLYKLGILNDSNELKDLVHKYEFWGPMIFIVAQIVQIVFPVIPGGVTTVAGFLIFGPTLGFIYNYIGIIIGSVILFWLVKFYGRKFVLLFMDQKTFDKYESKLETSGYEKFFIFCMASPISPADIMVMITGLSNMSIKRFVTIIMITKPISIIGYSYLWIYGGDILKNFLN

SEQ ID NO: 4163 - DNA, 354 bp, Streptococcus pyogenes
ttggcccctgtaacaggttttatttataattatgtaggcatcattattggcagtatagccctcttcttgctcgttaagacttatggtcgtaaatttatcttactctttgtaaatgacaaaacattttacaagtatgaaaggcgtttggagacaccaggatatgaaaaattatttattttttgtatggcatcgcctgtttctccagctgatattatggttatgattacgggattgacggacatgtctttaaagcgctttgtaactattcttttaataactaaaccaatttctattatcggctacagttatttatttatttttggaaaagatgttatatcttggttcttacagcat

SEQ ID NO: 4164 - protein, 118 aa, Streptococcus pyogenes
LAPVTGFIYNYVGIIIGSIALFLLVKTYGRKFILLFVNDKTFYKYERRLETPGYEKLFIFCMASPVSPADIMVMITGLTDMSLKRFVTILLITKPISIIGYSYLFIFGKDVISWFLQH

SEQ ID NO: 4165 - DNA, 636 bp, Streptococcus agalactiae
atggctagtattttaaaaaaacatttagagaaacgtttagagcttaaaaatgatcctatgaggacagatatgagtactggtgccagttaccctaaatatggattctcggtaggaaagtacacatatggatatcaacaattcttttacgaaggcgttaacttaaaagaaattggagcattttgctcaatagcccagaacgttactattactggtctgaatcatccaaccgatcacattaccactaacccttttatttactataagtcaaggggatttataaatgaggatagggcggacttaatagatgaaaagaaaaatggaaaagttattattggcaacgatgtctggataggaactaatgtcactatacttccatctgttacaataggtaatggagcaattattggagcaggttcagttattaccaaagacattcctgactatgctgttgtcgctggaacacctgctaaaattatcaaatatcgcttttcagaggaagaaataacattattaaatgcatctcagtggtggaattggtcagatgaagctattaaggaacatattagcgaattttcagataagaaggaattcttcaatactctaaaaagtatttccgaaaacaaaaatcataaactc

SEQ ID NO: 4166 - protein, 212 aa, Streptococcus agalactiae
MASILKKHLEKRLELKNDPMRTDMSTGASYPKYGFSVGKYTYGYQQFFYEGVNLKEIGAFCSIAQNVTITGLNHPTDHITTNPFIYYKSRGFINEDRADLIDEKKNGKVIIGNDVWIGTNVTILPSVTIGNGAIIGAGSVITKDIPDYAVVAGTPAKIIKYRFSEEEITLLNASQWWNWSDEAIKEHISEFSDKKEFFNTLKSISENKNHKL

SEQ ID NO: 4167 - DNA, 1104 bp, Streptococcus agalactiae
gtgatgtcaaatataataacttatttaaaaaataattcaaacttaacttttgatgaattagcattaaacgatgttgacattctttgtttaaatgaatttggctatatttcttttgaaaaacttataaacactacagaaatgaagtcagttttagtctgtgagttatatcatgagtaccttcaaactatggctaaatcatatagctttatgttcacatcacaacgacatgatttatgtcagttaatgatgacctcgaaacgttttaaaaacttaactttatcttattatcgagctgagattagtttagaatttgaaaaacaatttgcagctatggtttttactattcctaacattaattatcatcaggttgtatttcgtggtactgatgccaaccttattggttggaaagaagattttaaattgacttatatgagagaaatatcggctcatcgttcagcgattaaatacttaaatacaatactgccttattttgataaagtagttctctcaggtcattctaaggggggtaatttagccttgtacgctgcaatgtttacaaagccagatttaaaagcaaaaattgatttgatttggcttattgactccccaggactacaaaaaactttgttacctactacagagtataaaactactaaacaaaagtgcattcgcttactaccagaagaatctattgttggtatgatgctttatagtgatatagagccgctaattattagtagcaatgcgcgtggaattctgcaacacgatgttacaacttgggaaattcaagaaccagctattttaaagactggaacaggactatcgctaaaaagtatttgttttgaaaagacatttcaacagtggatggctgaattaaaaagtcaagaaagaaaattattttttgatttattatttgatagcttcctatcaagtggcgtatctagtttggatgacttcaacttggcttccagagcaaaaatgatgaaagcttttcatagctttagagaactagatgatgataaaaaaaggttatttaacaaatctttaaaattattagtaaccatattttggggagcttatcatgataatagcagagagactaag

SEQ ID NO: 4168 - protein, 368 aa, Streptococcus agalactiae
MMSNIITYLKNNSNLTFDELALNDVDILCLNEFGYISFEKLINTTEMKSVLVCELYHEYLQTMAKSYSFMFTSQRHDLCQLMMTSKRFKNLTLSYYRAEISLEFEKQFAAMVFTIPNINYHQVVFRGTDANLIGWKEDFKLTYMREISAHRSAIKYLNTILPYFDKVVLSGHSKGGNLALYAAMFTKPDLKAKIDLIWLIDSPGLQKTLLPTTEYKTTKQKCIRLLPEESIVGMMLYSDIEPLIISSNARGILQHDVTTWEIQEPAILKTGTGLSLKSICFEKTFQQWMAELKSQERKLFFDLLFDSFLSSGVSSLDDFNLASRAKMMKAFHSFRELDDDKKRLFNKSLKLLVTIFWGAYHDNSRETK

SEQ ID NO: 4169 - DNA, 2790 bp, Streptococcus agalactiae
atggcttctacaaataatgtttcagatacaaacacacgttttgctaaagaggagttagaagaggttttcgaagaattagggacaactcaaggtggtttatcagatgaagaggttgctgtacgtcagaaaaaatatggtttaaacctgttatctgaagtaaagcaagaatcgattattttattgtttctgaaaaattttactagtcttatggcaatactattatgggttggaggatttgtggctattgtttctaatagcttagagctaggtcttgccatttggatggttaatgtgattaatggtatttttagtttcattcaggaataccgtgcaagccaagcaacacaagctctcgagaaaatgttaccatcttattcacgtgttcttagaaaaggctcagaagaaaagatattatcagagcaactagtcccaggcgatattgttcttattgaagaaggagaccgtatttcagcagatggtcgcttgattaaaacaacagatttgcaagtaaaccaatcagccttgacaggggaatcaaatcctatttataaagatagcaatgttgaaaacgaccagtctaaaacattgattgaatgtgataatatggttttcgcaggaacgacggtctccagtggtagcgcaacaatggttgttacggcaattggaatgcaaactcaatttggtcaaatcgctgatttaacacaagggatgaaatcagaaaaaagccctcttcaaagagaacttgatcggttgaccaaacagatttctatcatttcaattacggtaggaattatctttttcttagcagcgactttttttgttaaggagccagtgtcaaaatcatttatctttgccttggggatgatcgttgcatttatcccagaaggtttactacctaccgttacactttctctagctatggcagtccaacgaatggctaaagaacacgcacttgtcaaaaaactttcttcagttgagactcttggagcaacctcagttatctgttctgataagactggtacattaacgcaaaatgaaatgaccgtcaatcatttgtggcaaaatggaaagagttaccaagtgacaggactgggttatgctccagaaggacagattctttttgaaggtgacaatatttgctttggtaatagtgatagaggagacttagaaaaacttattcgttttgctcatctctgtagcaacgctcaagtattaccaccaaatgatgatcgttcaacttatactgtacttggagatccgacagaagcttgtttgaatgttttattggaaaaatcagggataaacatacaagaaaatcgtaagtttgcaccacgtttgaaagaattaccttttgattcggttagaaaacgcatgacaactattcatagcttaggaggcgatgaaaaggataaaaaaatttcaattacaaaaggtgcgccgaaagaaatacttgatttatcagattatgtcttatctgatggcaaagttatccccttaaacaaggaagaacgtaataaaatacagttggctaacgatacatttgctaaagatggacttcgcgtcttagctgtttcatactgcgatattgaaggcttttcaaaagaacaatggacgcaagaaaatttggaacaacacatggtgtttatagggttgatagcaatgagtgatccacctcgtgaaggcgttcgcgaagctattgataaatgtcatgcagcaagcattcgtattattatggtgactggagattacggattaacggcactaagtatcgctaaaaatattggtattattcgtaacgatgatgctaaagtaatttcaggtttagagttatcagaaatgacggatagccaattgaaaaaagaattgtcaggtgaagtcgtttttgctcgtgtagcaccagaacaaaaatatcgagtagtaacgatattacaggagatgggtgaagtagtagcagttacaggagacggggtcaatgatgcgcctgcgctaaaaaaatccgatattggtgtagccatgggtgttaccggtactgatgttgctaaagaatcagctgatatgattctgacagatgatcattttgcttctattgtacatgctgtggaagaaggacgggctgtttatcaaaacattaagaaattcttgacgtatatttttaatagtaatactcctgaggctgttccgtcggcattcttccttttttctaaaggttttattcctttaccattgactgtaatgcaaatacttgctgttgatttgggaaccgatatgcttcccgctttaggtctgggcgtggaaccaccagaaacagacgttatgaatcgtcctccaagacggctaacagatcgcttattggacaaagggctacttataaaatctttcctttggtacggcactattgaatccgtattagctatgggtggttttttctgggctcattacttacgttatggtaattttacttttttcgtcgcaaacggcataccgtacagagaagcgacaactatgacacttggagctattatctttagccagataggtatggttatgaatagcagaacgagctatcaatctattaaagcactatctatttttggtaataaattaattaattttggtataataatggagattttagcatttttagtcttagtatacgtgccactattccataacttattcaacacagcaagcctaggtttatcacattggctctatttaataagctgcccatttatcatgataggtttagatgaagttcggaaattattcagcagtagaaagaataaacgg

SEQ ID NO: 4170 - protein, 930 aa, Streptococcus agalactiae
MASTNNVSDTNTRFAKEELEEVFEELGTTQGGLSDEEVAVRQKKYGLNLLSEVKQESIILLFLKNFTSLMAILLWVGGFVAIVSNSLELGLAIWMVNVINGIFSFIQEYRASQATQALEKMLPSYSRVLRKGSEEKILSEQLVPGDIVLIEEGDRISADGRLIKTTDLQVNQSALTGESNPIYKDSNVENDQSKTLIECDNMVFAGTTVSSGSATMVVTAIGMQTQFGQIADLTQGMKSEKSPLQRELDRLTKQISIISITVGIIFFLAATFFVKEPVSKSFIFALGMIVAFIPEGLLPTVTLSLAMAVQRMAKEHALVKKLSSVETLGATSVICSDKTGTLTQNEMTVNHLWQNGKSYQVTGLGYAPEGQILFEGDNICFGNSDRGDLEKLIRFAHLCSNAQVLPPNDDRSTYTVLGDPTEACLNVLLEKSGINIQENRKFAPRLKELPFDSVRKRMTTIHSLGGDEKDKKISITKGAPKEILDLSDYVLSDGKVIPLNKEERNKIQLANDTFAKDGLRVLAVSYCDIEGFSKEQWTQENLEQHMVFIGLIAMSDPPREGVREAIDKCHAASIRIIMVTGDYGLTALSIAKNIGIIRNDDAKVISGLELSEMTDSQLKKELSGEVVFARVAPEQKYRVVTILQEMGEVVAVTGDGVNDAPALKKSDIGVAMGVTGTDVAKESADMILTDDHFASIVHAVEEGRAVYQNIKKFLTYIFNSNTPEAVPSAFFLFSKGFIPLPLTVMQILAVDLGTDMLPALGLGVEPPETDVMNRPPRRLTDRLLDKGLLIKSFLWYGTIESVLAMGGFFWAHYLRYGNFTFFVANGIPYREATTMTLGAIIFSQIGMVMNSRTSYQSIKALSIFGNKLINFGIIMEILAFLVLVYVPLFHNLFNTASLGLSHWLYLISCPFIMIGLDEVRKLFSSRKNKR

SEQ ID NO: 4171 - DNA, 2679 bp, Streptococcus pyogenes
ttgtctaaagaacaaagacatgaagcattttacacgcaaagtgaagagaccgtactggctcaattagagaccagtcgcgaaggtcttacgtctgcccaagcaaaagagcgcttagcagagtatggtcgtaatgagcttgatgaaggcgaaaaacgaagtttatttatgaaattccttgatcaatttaaggatttgatgattattattttgattgtggcagcccttctttcagttcttacagaggggatggaaggtttgacagacgccattattatcttggctgttgttatcctaaatgctgcttttggtgtttaccaagaaggacaagctgaagctgctattgaagccttgaaatcaatgtcaagtccactggctcgtattcgccgcgatgggcatgtgactgagatagactctaaagaattggtccctggagatattgtcttgctagaagcgggagatgttgtccctgctgatctgcgtcttttggaagctaactccttaaaaatcgaagaagcagcgcttactggagaatctgtaccggttgaaaaagacttgtcaacggctgtttcagaagatgccggtattggtgatcgcgtcaatatgggatatcaaaactcaaatgtgacatatggtcgtgggattggggttatcactaacactggcatgtacaccgaggttgggcatattgctggtatgcttgctaatgctgatgagacagatacaccattgaagcaaaaccttgacaacctttctaagattttgacttatgcgatccttgtgattgcagcggtgacttttgctgttggagtcttcttgcgtggtcaacacccgcttgaaggcttgatgacttcagtagcgcttgctgttgcagctattccagagggacttcctgcgattgttactgttgtgctttctcttggaactcaagtacttgctaaacgtaacgccattatccgtaaattaccagctgttgaaacgctaggatcaactgaaatcattgcttctgataaaacgggtaccttgacaatgaatcaaatgaccgttgaaaaagtttataccaacgggacactccaaagttcatcagctgatattgcttttgacaatacgacacttcgtgtaatgaactttgctaatgatactaaagttgatccttcagggaagttaattggtgacccaacagaaacagctttggtagagtttgggttagaccacaattttgacgtacgtgaggctatggtggcagaacctcgtgtggcagaactgccatttgattctgaccgtaagttgatgtcaaccattcataaacaagctgatggcaaatatttcatcgctgttaaaggtgcaccagatcagttattgaaacgtgtcacacagattgaagaaaatggacaaattcgtcctattacggatgctgataaaaaaaccattcttgataccaataagagtcttgccaaacaagctcttcgtgtcttgatgatggcttacaaatattctgatgcccttccaacactggaaacagaaattgttgaggctaatcttgtcttctctggtttggtagggatgattgaccctgaacgtcctgaagcagcacaggctgttaaagtagctaaggaagctggcattcgtccaatcatgattactggtgaccaccaagatacagcaaaagctattgcgaaacgtcttggtattatcgaagaagatggcgttgatcatgtctttacaggtgctgaactcaacgaattatcagatgaagagttccaaaaagtctttaaacaatactccgtgtatgcccgtgtatctcctgagcataaagttcgtatcgttaaggcttggcaaaatgaaggcaaagttgttgccatgactggcgatggggttaacgatgcaccatctcttaaaacggcagatattggtattggtatgggaattacaggtacagaggtttctaagggagcttctgacatggttcttgccgatgataactttgcaaccattatcgttgcggttgaagaaggacgtaaggtcttctcaaacattcaaaaaacaattcaatacttactttctgctaacatggcagaagtctttaccatcttccttgcaaccttgtttggttgggatgtgcttcaaccagttcacttgctttggattaacttggtaactgataccctaccagctattgctcttggtgttgaacctgctgagcctggtgtgatgaaacacaaacctcgtggacgtaagtcaagcttctttgatggtggggtgaaggaagccattctttaccaaggtgccttccaaaccattttggtgcttggggtttatggttttgccttgatgttcccagaacacacaagctatcatgatgtccatgcagatgctttgaccatggcttatgtgaccctcggtttgattcagttggtacatgcctacaacgtgaaatctgtttaccaatccatctttactgttggattgttcaaaaacaaattgttcaactattctattccagtggcctttgtagcattaatggcaacagttgttgttcctggatttaatcaattctttcatgtgacacacttgacgatcacacaatggttagtggttattatcggaagtctcttgatggttgttcttgttgaattggtgaaagctgttcaacgatcacttggtcaagatgaaaaagcaatt

SEQ ID NO: 4172 - protein, 893 aa, Streptococcus pyogenes
LSKEQRHEAFYTQSEETVLAQLETSREGLTSAQAKERLAEYGRNELDEGEKRSLFMKFLDQFKDLMIIILIVAALLSVLTEGMEGLTDAIIILAVVILNAAFGVYQEGQAEAAIEALKSMSSPLARIRRDGHVTEIDSKELVPGDIVLLEAGDVVPADLRLLEANSLKIEEAALTGESVPVEKDLSTAVSEDAGIGDRVNMGYQNSNVTYGRGIGVITNTGMYTEVGHIAGMLANADETDTPLKQNLDNLSKILTYAILVIAAVTFAVGVFLRGQHPLEGLMTSVALAVAAIPEGLPAIVTVVLSLGTQVLAKRNAIIRKLPAVETLGSTEIIASDKTGTLTMNQMTVEKVYTNGTLQSSSADIAFDNTTLRVMNFANDTKVDPSGKLIGDPTETALVEFGLDHNFDVREAMVAEPRVAELPFDSDRKLMSTIHKQADGKYFIAVKGAPDQLLKRVTQIEENGQIRPITDADKKTILDTNKSLAKQALRVLMMAYKYSDALPTLETEIVEANLVFSGLVGMIDPERPEAAQAVKVAKEAGIRPIMITGDHQDTAKAIAKRLGIIEEDGVDHVFTGAELNELSDEEFQKVFKQYSVYARVSPEHKVRIVKAWQNEGKVVAMTGDGVNDAPSLKTADIGIGMGITGTEVSKGASDMVLADDNFATIIVAVEEGRKVFSNIQKTIQYLLSANMAEVFTIFLATLFGWDVLQPVHLLWINLVTDTLPAIALGVEPAEPGVMKHKPRGRKSSFFDGGVKEAILYQGAFQTILVLGVYGFALMFPEHTSYHDVHADALTMAYVTLGLIQLVHAYNVKSVYQSIFTVGLFKNKLFNYSIPVAFVALMATVVVPGFNQFFHVTHLTITQWLVVIIGSLLMVVLVELVKAVQRSLGQDEKAI

SEQ ID NO: 4173 - DNA, 432 bp, Streptococcus agalactiae
atgaaagaaacacaagaagaattacgtcagcgtattggacatacagcttatcaagtaacccaaaattcagctacggaacatgcttttactgggaagtatgatgatttttttgaagaggggatatatgtagatatcgtcagtggagaggttttattctcttctttagataaatttcaatctggttgtggttggccagcattttcaaaaccaattgagaatcgaatggtgacaaatcatcaagatcactctcatggaatgcatcgtattgaggttaggagtcgtcaagctgactctcatttagggcatgtatttaatgatggaccggttgatgcaggtggtttacgctattgtatcaattcagctgccttagattttattccttatgaccagatggcaaagagaggctatggggactacctatcactttttgat

SEQ ID NO: 4174 - protein, 144 aa, Streptococcus agalactiae
MKETQEELRQRIGHTAYQVTQNSATEHAFTGKYDDFFEEGIYVDIVSGEVLFSSLDKFQSGCGWPAFSKPIENRMVTNHQDHSHGMHRIEVRSRQADSHLGHVFNDGPVDAGGLRYCINSAALDFIPYDQMAKRGYGDYLSLFD

SEQ ID NO: 4175 - DNA, 435 bp, Streptococcus pyogenes
atggaaacatcagatgagttaaaacaacgcattggtgatctttcttacgaggtcacccagcatgcagcaacagaatctccctttacaggagaatatgataatttttttgagaagggtatctatgtcgatatcgtcagtggtgaggtcttgttttcatcactggataaatttaattctggctgtggttggcctgccttttcaaaacctattgaaaatcgtatggtcacaaaccacgatgactcttcttatgggatgagacgagttgaggttaaaagccgtgaagcaggatcgcatttggggcatgtctttagtgacggccccaaagaagctggaggcttgcgttactgtatcaattcagcagctcttaaatttattccttatgaccagatggaaaaagaaggctatgcccaatggctcacattgtttgatgagaca

SEQ ID NO: 4176 - protein, 145 aa, Streptococcus pyogenes
METSDELKQRIGDLSYEVTQHAATESPFTGEYDNFFEKGIYVDIVSGEVLFSSLDKFNSGCGWPAFSKPIENRMVTNHDDSSYGMRRVEVKSREAGSHLGHVFSDGPKEAGGLRYCINSAALKFIPYDQMEKEGYAQWLTLFDET

SEQ ID NO: 4177 - DNA, 462 bp, Streptococcus agalactiae
atgattcgtagagcgaaagaaaaagatttgcctgatattgcagagctattgaaacaaattttaatgttacatcatgaggttcgcccagatatttttcatacaagaggaagtaagttttctaaagaacaattgaaagaaatgctgatagacgaatcaaagcctatctttgtttatgaatcagacgagggtaaagttgttgcccacttgtttcttcaattacaagaaaaacgtgacttacctcgaaagtcatttaaaactctctatatagatgatttgtgcattgatgaggaagtaagaggtcagcaaattggacaaaagttgatggattttgcaagacaatatgctaagaaacatgggtgttataatataactttaaatgtttggaatgataatcagagagcggtctctttttatgaaaaattaggttttaaacctcaacaaactcaaatggaggagatacta

SEQ ID NO: 4178 - protein, 154 aa, Streptococcus agalactiae
MIRRAKEKDLPDIAELLKQILMLHHEVRPDIFHTRGSKFSKEQLKEMLIDESKPIFVYESDEGKVVAHLFLQLQEKRDLPRKSFKTLYIDDLCIDEEVRGQQIGQKLMDFARQYAKKHGCYNITLNVWNDNQRAVSFYEKLGFKPQQTQMEEIL

SEQ ID NO: 4179 - DNA, 657 bp, Streptococcus agalactiae
atgactatggttaaaagagaagatgtgattttaaatgcaactgaaaatatggttcaccataaattaaaaaatgatccaagtggccatgactggtttcatattgttagagtaagaaatcttgcggtagaattagcacacaaagaaggggctaatacctttatttgtcaaatggctgcacttttgcatgatattattgatgacaaaatctgccaagatagtaagcaagcgtcgtatgaattgactcaatggttatatagtcaagatcttgccatagcagaagtagaacatatccttgatattcttgaaaatatttcattcaaagcaggaactggattgactatgaaaacattggaaggtcaaattgttcaagatgcagatcgcctagatgctatgggggctattggtattgcaagaacgatggcttattcagggagtaaaggacgtttaattcatgaccctaacttaaaaccacgagaaaacctcactttagaagagtatcgtaatggtcaggatacagctatcattcatttttacgaaaaattattaaagttaaaagaccttatgaatacaaaacaagggaaaatgcttgctcaaaaacgtcatgattttttagaactatatttagccgaattttatgctgaatggaatggtaaacgt

SEQ ID NO: 4180 - protein, 219 aa, Streptococcus agalactiae
MTMVKREDVILNATENMVHHKLKNDPSGHDWFHIVRVRNLAVELAHKEGANTFICQMAALLHDIIDDKICQDSKQASYELTQWLYSQDLAIAEVEHILDILENISFKAGTGLTMKTLEGQIVQDADRLDAMGAIGIARTMAYSGSKGRLIHDPNLKPRENLTLEEYRNGQDTAIIHFYEKLLKLKDLMNTKQGKMLAQKRHDFLELYLAEFYAEWNGKR

SEQ ID NO: 4181 - DNA, 2631 bp, Streptococcus agalactiae
atgaaaggtcaaaaaattattgctctagctggtcttgtcctgtcatgccattttgctcttacggcatgtcatactcaagaacacaaaaattctcatcatattaaaacaaagcaggttgctaagaaaaaagctaataaaaagaaagtctctgttaaggaaagtcataaaaaacgcaagggtgttgcaggggttgactttccaactgatgatggctttttactgactaaagattcgaagattttatctcatacagattctggaatcgttgtagcacatggaaatcattctcattttattttttactctgatttaaaaggttcaaaatttagctatttaatccctaatgctaatacaaaaactaataaaaatcaagcggtaagaaactttaaagcaggggcggtagctgttaatacattaaatgatggctatgtttttaatcccgcagatattgtttcagaagatgctaatggctacgtggtcagacatggtgatcatttccactatattccaaaagcaagtttatctcagcaaaagcaagtacaagcaagtagagctgtttcacgtttaggaaatcaaagtaatagccattacagggttaatagttctaaaattgcagggcttcactacccaacaagtaatggtttcttatttaatggacgaggaataaaaggcactaccccaacaggtattttagtagaacatcataatcatctgcattttattagttttgctgatttaagaaaaggggggtggggatcaattgctgaccgttaccaaccacaaaagaaagctgattctaaaaaacagtcaccatcaagtaaaaagccaagaactgaaaatactttacctaaggacatcaaagataagctagcttaccttgctcgtgaattacatttagatatttcacgtatcagagtccttaaaacactaaatggtgaaattggatttgaatacccacatgatgatcatacacatgttattatggccaaagatattgatctaagtaagccaattccaaatccacatcatgatgatgaagatcatcacaaaggtcatcaccatgatgagtccgaccataagcatgaagaacacgagcacactaagtcaaataaattatctgatgaagatcaaaagaaattaatttatttagcagagaagcttggtttaaatcctaatcaaattgaagtattaacgtcagaggatggaagtatcatctttaagtatccacatgatgaccactcacacaccatagcaagtaaggatattgaaattgggaagcctatcccagatggacaccacgatcactctcatgcaaaagataaagttggtatggcaactctaaaacaaattggttttgatgatgagattattcaggatattctgcatgcagatgctccaacaccattcccatcaaatgaaactaatcctgaaaaaatgcgtcagtggcttgcaactgttactaagattaacattggacaaagaaccaatccattccagcgttttggtctatcattgatgcctaatattgaagttctaggaattgggtttactccgattaatgatatgacgccagttttgcaattcaaaaaacttaaacagctttggatgacaaatactggtattacagattattctttccttgataagatgccactattagaaggattggatatttcacaaaacggtattaaggatttatctttccttacaaaatataaacaattaagtcttattgctgcagctaataatggcattacttcgctaaaaccattggctgaattaccaaaccttcaattcttagttttgagtcataacaatatctctgacttgacaccgttatcaaacttgacaaaactccaagaattgtaccttgatcataataatgtgaagaatttaagtgcactttctggtaaaaaagatttgaaagttctagatttatcaaacaataaatccgcagacttatcgactctaaaaacaactagtcttgagacgcttcttttaaatgagacgaatacaagcaatctaagtttcttaaagcaaaatcctaaggtatctaatttaacaattaataatgcgaaattagcatcattagatggtattgaagagagcgatgaaattgttaaagtagaagctgaagggaaccaaattaagtcactagtattgaaaaataaacaaggttcgttaaaattcttgaatgtgactaataatcagttaacatcacttgaaggtgttaataattatacttcacttgagaccttaagtgtttctaaaaataaacttgaatctttagatattaaaacacctaacaaaacagttacaaatcttgattttagccataacaatgttccaacatcacaattgaaattgaatgaaaaaaatattcctgaagcagtagctaagaattttccagcagttgtagaaggttcaatggttggaaatggtagtcttgctgaaaaagcagctatggcttctaaagaggacaaacaagtttcagataatactaatcaccaaaaaaacactgaaaaatctgctcaagcgaatgctgatagtaaaaaagaaaaccctaaaacacatgatgaacatcatgaccatgaagaaacagatcatgcacatgtaggtcatcatcaccat

SEQ ID NO: 4182 - protein, 877 aa, Streptococcus agalactiae
MKGQKIIALAGLVLSCHFALTACHTQEHKNSHHIKTKQVAKKKANKKKVSVKESHKKRKGVAGVDFPTDDGFLLTKDSKILSHTDSGIVVAHGNHSHFIFYSDLKGSKFSYLIPNANTKTNKNQAVRNFKAGAVAVNTLNDGYVFNPADIVSEDANGYVVRHGDHFHYIPKASLSQQKQVQASRAVSRLGNQSNSHYRVNSSKIAGLHYPTSNGFLFNGRGIKGTTPTGILVEHHNHLHFISFADLRKGGWGSIADRYQPQKKADSKKQSPSSKKPRTENTLPKDIKDKLAYLARELHLDISRIRVLKTLNGEIGFEYPHDDHTHVIMAKDIDLSKPIPNPHHDDEDHHKGHHHDESDHKHEEHEHTKSNKLSDEDQKKLIYLAEKLGLNPNQIEVLTSEDGSIIFKYPHDDHSHTIASKDIEIGKPIPDGHHDHSHAKDKVGMATLKQIGFDDEIIQDILHADAPTPFPSNETNPEKMRQWLATVTKINIGQRTNPFQRFGLSLMPNIEVLGIGFTPINDMTPVLQFKKLKQLWMTNTGITDYSFLDKMPLLEGLDISQNGIKDLSFLTKYKQLSLIAAANNGITSLKPLAELPNLQFLVLSHNNISDLTPLSNLTKLQELYLDHNNVKNLSALSGKKDLKVLDLSNNKSADLSTLKTTSLETLLLNETNTSNLSFLKQNPKVSNLTINNAKLASLDGIEESDEIVKVEAEGNQIKSLVLKNKQGSLKFLNVTNNQLTSLEGVNNYTSLETLSVSKNKLESLDIKTPNKTVTNLDFSHNNVPTSQLKLNEKNIPEAVAKNFPAVVEGSMVGNGSLAEKAAMASKEDKQVSDNTNHQKNTEKSAQANADSKKENPKTHDEHHDHEETDHAHVGHHHH

SEQ ID NO: 4183 - DNA, 2376 bp, Streptococcus pyogenes
atgaaaacgaaaaaagttattattttagttggtctattgttatcatctcagttgactttgatagcttgtcaatcacgaggtaatggtacatatcccattaaaacgaaacaatcacgtaagggaatgacgtcaaacaaaattaaaccgattaaaaaaagcaaaaagacaaacaagactcacaaaggtgtggcgggtgtcgattttcctacagatgatgggtttattttaaccaaagactcaaaaatcttatcaaaaacagatcagggaatcgttgttgaccatgatggtcattcgcattttattttttatgccgatttaaagggaagtccatttgaataccttattccaaaaggagcaagtttagctaagccagctgttgctcagcgagcagctagtcaagggacttctaaagtagcagatcctcatcaccattatgaatttaacccagcggatattgtggctgaagatgctttaggctacacggttcgccacgatgatcacttccattatattttgaagtcaagcttatcaggtcagacacaggcacaagctaaacaggttgctactcgcttgccacaaaccagtagccttgtttcaacagctacagctaatggtattccaggcttgcatttcccaacctcagatggttttcaatttaacggtcaaggtattgttggggtaacaaaagacagtattttagtggaccacgatggtcacttacatcctatttcttttgcggaccttcgtcagggtggctgggcacatgtggcagatcaatacgatcccgctaaaaaagcagaaaagccagcagaaacccatcagacaccagagctatctgaacgtgaaaaggaataccaagaaaaattagcttatttggcagaaaaattggggattgatccatcaactattaaacgtgtggaaacacaagacggtaaacttggtttggaataccctcaccatgaccacgcacacgtattgatgttatctgatattgaaatcggaaaagacattccagatccacatgctattgagcatgcccgtgaattggaaaaacataaggttggaatggataccttgcgtgccttagggtttgatgaagaagtgattttggatatcgttcgcactcacgatgctccaaccccattcccatcaaatgaaaaagatccgaatatgatgaaagaatggttagcaacggttatcaaacttgacttgggcagccgtaaagatcctttgcaacgtaaaggactttcactgttacccaacttagaaactttaggaattggctttacaccaatcaaagatatctcacctgttttgcaatttaaaaaattgaaacagttgttaatgacaaaaacaggggtgactgattatagatttttggataatatgccacagttagaaggcattgatatttcacaaaacaatctcaaagatattagtttcttgagcaaatataaaaacttaactctagtagcggctgctgataatggtattgaagatattaggccgcttggtcaattaccaaatctcaaattcctcgtattgagtaacaataagatttctgatttaagcccactggcatcgttacatcaattgcaagaattgcacattgataataatcagattacagatttaagccctgtttctcataaagaatcattgacggttgttgatttatcaagaaatgctgatgttgacttagcaacacttcaagcacccaaattagaaacgttaatggtcaatgataccaaggtttctcatttggatttcttgaaaaataatcctaatctatctagcctatctattaaccgtgcgcaattgcaatctcttgaaggtattgaagcaagtagcgtcattgtcagagtagaagcagaaggtaaccaaattaaatcgcttgtgcttaaagacaagcaagggtcacttactttcttggatgtgacaggcaaccagttgacttctctagaaggtgttaataattttacagcacttgacattttaagcgtgtctaaaaaccaattaacaaatgtcaacctatctaaacccaataagacagttactaacattgatattagtcataacaatatctcattagcagaccttaaattgaacgagcaacatattccagaagccattgcgaaaaacttcccagcggtttacgaaggttctatggtaggtaatggaacagctgaagaaaaagcagctatggctactaaggcgaaagaaagtgctcaagaagcatcggaatcacatgactacaaccataatcatacctatgaagatgaagaaggtcatgctcacgagcacagagacaaagatgatcacgaccatgaacatgaggatgaaaatgaagctaaagatgagcaaaaccatgctgac

SEQ ID NO: 4184 - protein, 792 aa, Streptococcus pyogenes
MKTKKVIILVGLLLSSQLTLIACQSRGNGTYPIKTKQSRKGMTSNKIKPIKKSKKTNKTHKGVAGVDFPTDDGFILTKDSKILSKTDQGIVVDHDGHSHFIFYADLKGSPFEYLIPKGASLAKPAVAQRAASQGTSKVADPHHHYEFNPADIVAEDALGYTVRHDDHFHYILKSSLSGQTQAQAKQVATRLPQTSSLVSTATANGIPGLHFPTSDGFQFNGQGIVGVTKDSILVDHDGHLHPISFADLRQGGWAHVADQYDPAKKAEKPAETHQTPELSEREKEYQEKLAYLAEKLGIDPSTIKRVETQDGKLGLEYPHHDHAHVLMLSDIEIGKDIPDPHAIEHARELEKHKVGMDTLRALGFDEEVILDIVRTHDAPTPFPSNEKDPNMMKEWLATVIKLDLGSRKDPLQRKGLSLLPNLETLGIGFTPIKDISPVLQFKKLKQLLMTKTGVTDYRFLDNMPQLEGIDISQNNLKDISFLSKYKNLTLVAAADNGIEDIRPLGQLPNLKFLVLSNNKISDLSPLASLHQLQELHIDNNQITDLSPVSHKESLTVVDLSRNADVDLATLQAPKLETLMVNDTKVSHLDFLKNNPNLSSLSINRAQLQSLEGIEASSVIVRVEAEGNQIKSLVLKDKQGSLTFLDVTGNQLTSLEGVNNFTALDILSVSKNQLTNVNLSKPNKTVTNIDISHNNISLADLKLNEQHIPEAIAKNFPAVYEGSMVGNGTAEEKAAMATKAKESAQEASESHDYNHNHTYEDEEGHAHEHRDKDDHDHEHEDENEAKDEQNHAD

SEQ ID NO: 4185 - DNA, 1830 bp, Streptococcus agalactiae
atgaatattgaagatttgaagaaacgtcaagaaaagattagaaacttttcgattatcgctcatattgaccatggaaaatcaaccttagcagaccgtattttagagaaaacagaaacggtttctagtcgtgaaatgcaggcgcaactgttggactctatggatctagaacgtgagcgtggaattactataaagttaaatgctattgagcttaattatactgctaaagatggtgaaacttacatttttcacttgattgacacgccagggcatgttgacttcacatatgaagtatcacgttcattggcagcttgtgagggtgctatactggttgttgatgcagcccaaggaattgaagctcaaactctggcaaatgtttatttggctctagacaatgatttagagatactaccagttattaataaaattgatttaccagcagcagatccagaacgtgtacgtgcagaagtagaggatgttattggtctagatgcttcagaagctgtgcttgcctcagctaaggcagggattggtattgaagaaattttagagcagatcgttgaaaaagttcctgcaccgactggggaagtagatgctcctcttcaagctctaatttttgattctgtttatgatgcttatcgtggagtaattcttcaagtaaggattgtaaatggtatggttaagccaggagataagattcaaatgatgtctaatggtaaaaccttcgacgttactgaggttggtattttcactcccaaagcagttggacgtgattttttagcaactggagatgtagggtatattgctgcctcaattaaaacggttgctgatacacgtgttggtgataccattacccttgctaataacccagcaatagaacccttgcatggctataagcaaatgaacccaatggtttttgccggtctttatccaattgaatcaaataagtataacgatctgcgtgaagcccttgaaaaattacaattgaatgatgctagtctacagtttgaaccggaaacatcacaagcattagggtttggtttccgttgtggtttcttaggacttttacatatggacgttatccaagagcgcttggaacgagagttcaatattgatcttattatgactgcaccatcagtagtttatcatgttaatacaactgacggtgaaatgcttgaagtttcgaatccatctgaatttcctgatcctactcgtgttgacagcattgaagaaccatatgttaaggcgcaaattatggttcctcaagaatttgtcggtgctgtaatggagttagcacaacgtaaacgtggtgactttgtaacaatggattatattgatgataatcgtgttaatgttatttaccaaattcctttagctgaaattgtgtttgacttctttgataagcttaaatcatcaacacgtggctatgctagttttgattatgaaatttccgaatatcgtcgctcacaattagwtaaaatggatattcttttaaatggtgataaagtggatgctttaagctttattgttcacaaagaatttgcctatgaacgtggtaaattgatcgttgataagttgaaaaaaatcattcctcgtcagcagtttgaagttcctatccaagcagctattggacaaaaaattgtggcccgttctgatataaaagcactacgtaaaaatgtcttagcaaaatgttatggtggtgacgtttcacgtaaacgtaagttgcttgaaaaacaaaaagctggtaaaaagcgcatgaaagcaattggttccgtcgaagttcctcaggaagctttcttaagtgttttatcaatggacgatgatgacaaaaaa

SEQ ID NO: 4186 - protein, 610 aa, Streptococcus agalactiae
  MISC_FEATURE (1)..(610): Xaa = Any Amino Acid
MNIEDLKKRQEKIRNFSIIAHIDHGKSTLADRILEKTETVSSREMQAQLLDSMDLERERGITIKLNAIELNYTAKDGETYIFHLIDTPGHVDFTYEVSRSLAACEGAILVVDAAQGIEAQTLANVYLALDNDLEILPVINKIDLPAADPERVRAEVEDVIGLDASEAVLASAKAGIGIEEILEQIVEKVPAPTGEVDAPLQALIFDSVYDAYRGVILQVRIVNGMVKPGDKIQMMSNGKTFDVTEVGIFTPKAVGRDFLATGDVGYIAASIKTVADTRVGDTITLANNPAIEPLHGYKQMNPMVFAGLYPIESNKYNDLREALEKLQLNDASLQFEPETSQALGFGFRCGFLGLLHMDVIQERLEREFNIDLIMTAPSVVYHVNTTDGEMLEVSNPSEFPDPTRVDSIEEPYVKAQIMVPQEFVGAVMELAQRKRGDFVTMDYIDDNRVNVIYQIPLAEIVFDFFDKLKSSTRGYASFDYEISEYRRSQLXKMDILLNGDKVDALSFIVHKEFAYERGKLIVDKLKKIIPRQQFEVPIQAAIGQKIVARSDIKALRKNVLAKCYGGDVSRKRKLLEKQKAGKKRMKAIGSVEVPQEAFLSVLSMDDDDKK

SEQ ID NO: 4187 - DNA, 1830 bp, Streptococcus pyogenes
atgaacagtcaagatttaaaaaaacgtcaggagaagattcgtaatttctccattatcgcacatattgaccatggcaaatctactctcgctgaccgcattttggaaaagacagagacggtttcgtctcgtgaaatgcaggctcagttattggactccatggatttggagcgtgagcgtgggattaccatcaagttaaacgccattgagcttaattacacggctaaagatggggaaacctacattttccaccttattgataccccagggcatgtggactttacttatgaagtatcgcgttcgttggcagcctgtgagggagcgattttagttgttgatgcagcgcagggaattgaagcgcagacattggctaatgtttacctagcccttgataatgatttggaaattttaccggttatcaataaaattgatttgcctgctgctgaccctgagagagtccgtcatgaagtagaagatgtcattggacttgatgcttctgaggctgttctggcatcagccaaggctggtattgggatcgaagagattcttgagcaaattgttgagaaggttcctgctcctacgggtgatgtggatgcgcctttacaggccttgatttttgactctgtgtatgatgcttaccgaggggtaattttgcaggttcggattgtgaacggtattgtcaagcctggcgataaaatccagatgatgtctaatggaaaaacctttgatgttacagaagttgggattttcactcctaaggcagttggacgagatttccttgcgacgggagatgttggttatgttgcggcttctatcaaaacggtagcagatacccgtgtgggggatacggtgactttagctaataaccctgctaaggaagccttgcatggctacaagcagatgaacccgatggtctttgcagggatttatccgattgaatcaaataaatacaatgacttgcgtgaagcacttgaaaaattacaactgaacgatgccagtttacagtttgaacccgaaacgtcacaagcgcttggatttggttttcgatgcggttttttaggcttgcttcacatggatgtgattcaagaacgtttggaacgtgaatttaacattgatttgatcatgacagcaccatctgtagtctaccatgttcacacaacagatgaggacatgattgaagtgtctaacccttcagaatttccagacccaacacgggtggcttttattgaagagccttatgttaaagcgcaaatcatggtgccacaagagttcgtaggggctgttatggaattatcgcagcgcaagcgtggtgattttgtgaccatggattacattgatgataaccgtgtcaatgtgatctaccaaatcccgctggctgaaattgtgtttgatttctttgataaattgaaatcctcaacgcgaggctatgcgagttttgattatgacatgtcagaataccgcaggtcacaattggtgaaaatggacattcttttgaacggtgataaggtcgatgcgctcagctttattgttcataaagaatttgcttatgaacgcgggaaaattattgttgagaaattgaaaaaaatcattccacgtcaacagtttgaagttccgatccaagccgctattggtcaaaaaattgttgcgcgttcagacatcaaggcccttcgtaaaaacgttttagcgaagtgttatggtggtgacgtgtctcgtaaacgtaaattgctcgaaaaacaaaaggctggtaaaaaacggatgaaggctattggttctgtcgaagtccctcaagaagccttcttgagtgttctttcaatggatgacgataccaagaaa

SEQ ID NO: 4188 - protein, 610 aa, Streptococcus pyogenes
MNSQDLKKRQEKIRNFSIIAHIDHGKSTLADRILEKTETVSSREMQAQLLDSMDLERERGITIKLNAIELNYTAKDGETYIFHLIDTPGHVDFTYEVSRSLAACEGAILVVDAAQGIEAQTLANVYLALDNDLEILPVINKIDLPAADPERVRHEVEDVIGLDASEAVLASAKAGIGIEEILEQIVEKVPAPTGDVDAPLQALIFDSVYDAYRGVILQVRIVNGIVKPGDKIQMMSNGKTFDVTEVGIFTPKAVGRDFLATGDVGYVAASIKTVADTRVGDTVTLANNPAKEALHGYKQMNPMVFAGIYPIESNKYNDLREALEKLQLNDASLQFEPETSQALGFGFRCGFLGLLHMDVIQERLEREFNIDLIMTAPSVVYHVHTTDEDMIEVSNPSEFPDPTRVAFIEEPYVKAQIMVPQEFVGAVMELSQRKRGDFVTMDYIDDNRVNVIYQIPLAEIVFDFFDKLKSSTRGYASFDYDMSEYRRSQLVKMDILLNGDKVDALSFIVHKEFAYERGKIIVEKLKKIIPRQQFEVPIQAAIGQKIVARSDIKALRKNVLAKCYGGDVSRKRKLLEKQKAGKKRMKAIGSVEVPQEAFLSVLSMDDDTKK

SEQ ID NO: 4189 - DNA, 414 bp, Streptococcus agalactiae
atggaacaaaccttttttatgataaaacctgatggtgtaaaacgtggttttattggagaagttattagtcgtattgagcgtcgaggcttctctattgatcgcttagaggttagatatgcagatgcagatattttgaaaagacattatgcagaactgacggatagaccattctttccaacattagtagattatatgactagtggtccagtaatcattggagttatttcgggagaagaggtcatttcaacttggcgcaccatgatggggagtactaaccccaaagatgcccttccaggaactattcgaggagattttgcacaagctccctctccaaaccaagcgacatgtaatattgttcatgggtcagactcacctgaatctgcaactcgcgagatagccatttggttcaataac

SEQ ID NO: 4190 - protein, 138 aa, Streptococcus agalactiae
MEQTFFMIKPDGVKRGFIGEVISRIERRGFSIDRLEVRYADADILKRHYAELTDRPFFPTLVDYMTSGPVIIGVISGEEVISTWRTMMGSTNPKDALPGTIRGDFAQAPSPNQATCNIVHGSDSPESATREIAIWFNN

SEQ ID NO: 4191 - DNA, 144 bp, Streptococcus pyogenes
atgatgagagtaaccaatcctaaggatgctctttgcggaaccattcgtgagaattttgctcaggctcctggtgatgatggaggtatttttaacatggtgcatgggtctcattcaagagactctgctaggcgtgagatcgctctt

SEQ ID NO: 4192 - protein, 48 aa, Streptococcus pyogenes
MMRVTNPKDALCGTIRENFAQAPGDDGGIFNMVHGSHSRDSARREIAL

SEQ ID NO: 4193 - DNA, 195 bp, Streptococcus agalactiae
ttgggtctagcagcaagttttggaaccattcgaaacagcacagctctaaaactttatgcaaagcagtcaccagcatttagaagttttggaaccattcgaaacagcacagctctaaaacaattgacgcttgatagtttaaatcttttaagttttggaaccattcgaaacagcacagctctaaaacacagcttgcgg

SEQ ID NO: 4194 - protein, 65 aa, Streptococcus agalactiae
MGLAASFGTIRNSTALKLYAKQSPAFRSFGTIRNSTALKQLTLDSLNLLSFGTIRNSTALKHSLR

SEQ ID NO: 4195 - DNA, 174 bp, Streptococcus pyogenes
ttgagttatgttcatataagttttgggaccattcaaaacagcatagctctaaaacaaaaagcgcaagaagaaatcaaccagcgcagttttgggaccattcaaaacagcatagctctaaaacctcgtagactatttttgtctaaaaaatttcgtaatcgcactatttgtctcagc

SEQ ID NO: 4196 - protein, 58 aa, Streptococcus pyogenes
LSYVHISFGTIQNSIALKQKAQEEINQRSFGTIQNSIALKPRRLFLSKKFRNRTICLS

SEQ ID NO: 4197 - DNA, 663 bp, Streptococcus agalactiae
atgatcaagattaattttccaattttagatgaaccattagtgttaagtaatgctacgattttaacgatagaagatgtttcagtttattcttcattggtgaaacatttttatcaatatgacgtagatgaacatttgaaattatttgatgataagcagaaaagtctgaaggcaacagagttaatgctggttacagatatcttaggatacgatgtcaactcagcacctattctaaagttgatacatggtgacttagaaaatcaattcaacgaaaagccagaagtgaaatcaatggtagaaaaattagcagctactattacagaacttatcgcatttgagtgtctagagaatgagcttgatttagaatacgatgaaattaagattttagaactcattaaggcactgggagtcaaaattgagacacagagcgacactatctttgaaaaatgttttgaaattatacaagtttaccattatttaacgaaaaagaatctcttggtttttgttaatagcggagcttatcttaccaaagatgaagttataaaattatgtgaatacatcaatttaatgcaaaagtcagtactctttctagaacctagaagactctatgatttaccgcaatatgttattgataaggattatttcttgataggcgaaaatatggta

SEQ ID NO: 4198 - protein, 221 aa, Streptococcus agalactiae
MIKINFPILDEPLVLSNATILTIEDVSVYSSLVKHFYQYDVDEHLKLFDDKQKSLKATELMLVTDILGYDVNSAPILKLIHGDLENQFNEKPEVKSMVEKLAATITELIAFECLENELDLEYDEIKILELIKALGVKIETQSDTIFEKCFEIIQVYHYLTKKNLLVFVNSGAYLTKDEVIKLCEYINLMQKSVLFLEPRRLYDLPQYVIDKDYFLIGENMV

SEQ ID NO: 4199 - DNA, 684 bp, Streptococcus pyogenes
ttgtatttcttggggaggcttttgatgaatcttaatttttccttactagatgaaccgattccattaagaggcggtacaattcttgtgctcgaagatgtctgtgtattttcaaaaatagtgcaatattgttaccaatatgaggaagattctgaacttaaattttttgatcacaagatgaaaacaatcaaagaatcagaaatcatgcttgtaacagatattttaggatttgatgttaactcctcaaccattttaaaattgattcatgcagatttagaatctcaatttaatgagaaacccgaagtgaaatcgatgattgacaaattggttgctacgattacagaactgattgtctttgaatgcttagaaaatgaattagatttagagtatgatgaaatcacaatcctggaattgattaagtccttaggagtaaaagtagaaacgcaaagtgatactatttttgaaaaatgtctagagatacttcaaattttcaaatatctcactaagaaaaagttgcttatttttgtcaatagcggagcttttctaacaaaggatgaagtggctagtttacaagagtatatatcattgacaaatttaacagttctctttttagaaccacgtgaactatatgattttccgcagtatattttagatgaagattatttcttaataactaaaaatatggta

SEQ ID NO: 4200 - protein, 228 aa, Streptococcus pyogenes
LYFLGRLLMNLNFSLLDEPIPLRGGTILVLEDVCVFSKIVQYCYQYEEDSELKFFDHKMKTIKESEIMLVTDILGFDVNSSTILKLIHADLESQFNEKPEVKSMIDKLVATITELIVFECLENELDLEYDEITILELIKSLGVKVETQSDTIFEKCLEILQIFKYLTKKKLLIFVNSGAFLTKDEVASLQEYISLTNLTVLFLEPRELYDFPQYILDEDYFLITKNMV

SEQ ID NO: 4201 - DNA, 339 bp, Streptococcus agalactiae
atgagttatcggtatatgcgaatgattttaatgtttgatatgcctactgaaacagcagaagaacggaaggcgtatcgtaagtttagaaagtttctcttgagcgaaggctttatcatgcatcagttttctgtttatagtaaattattactcaataatacagctaataatgctatgataggtcggcttaaagtgaataatcctaaaaagggtaatatcacactcttaacagttacggaaaaacaatttgcgagaatggtttacctccatggagaacgcaacacaagtgttgccaactctgatagtcgcttggttttcctaggagattcttatgatcaagat

SEQ ID NO: 4202 - protein, 113 aa, Streptococcus agalactiae
MSYRYMRMILMFDMPTETAEERKAYRKFRKFLLSEGFIMHQFSVYSKLLLNNTANNAMIGRLKVNNPKKGNITLLTVTEKQFARMVYLHGERNTSVANSDSRLVFLGDSYDQD

SEQ ID NO: 4203 - DNA, 339 bp, Streptococcus pyogenes
atgagttatagatatatgagaatgatacttatgtttgatatgccgacggacaccgctgaggaacgaaaagcctatcgaaaatttcggaaatttttacttagtgaagggtttatcatgcatcaattttctatttatagtaagttgctgttgaataatacagctaacaatgccatgattggtcggctgagggagcataatcctaataaaggaaatattacattactaacggtcacggaaaaacagtttgcacgaatgatttatttacatggtgaaagaaataattgtattgcaaactccgatgaaagacttgtatttcttggggaggcttttgatgaatct

SEQ ID NO: 4204 - protein, 113 aa, Streptococcus pyogenes
MSYRYMRMILMFDMPTDTAEERKAYRKFRKFLLSEGFIMHQFSIYSKLLLNNTANNAMIGRLREHNPNKGNITLLTVTEKQFARMIYLHGERNNCIANSDERLVFLGEAFDES

SEQ ID NO: 4205 - DNA, 867 bp, Streptococcus agalactiae
atggcaggttggcgaaccgttgttgtaaatacacattctaagctctcttataaaaataatcatctgatttttaaagattcttatcagacggaaatgattcatctatcagagattgacattctaatcatggaaacaacagatatcgttttgtcgaccatgctgattaaacgtttggttgatgaaaatattttagttatattttgtgacgataaacgcttgccaacagctatgttaatgccgtactatgccagacatgattcgagtttacaattatctaggcagatgtcatggattgaagatgtcaaagcagatgtttggacatcaattattgcacaaaaaattttgaatcagtctttttatctcggtgagtgttctttctttgaaaaatcccagtctattatgaatctctaccatgacttagaaccttttgatccttctaatcgtgaggggcatgctgctaggatttatttcaatacactttttggaaatgatttttcaagagagcaggataatccaataaatgctggtttagactacggatattcattgcttttgagtatgtttgcgcgtgaagttgttaagtgtggttgcatgacacaatttggcttgaagcatgctaatcaatttaatcagttcaacctagcaagcgatattatggaaccatttcgcccaatcgttgataggattatttatgaaaataggcagagtgattttgtcaaaatgaaaagagaactcttttctatgttttcagagacatacagctacaatggtaaagaaatgtatctctcaaatattgtcagcgactataccaaaaaagttattaagtcgctaaatagtgatgggaatggaattccggagtttaggata

SEQ ID NO: 4206 - protein, 289 aa, Streptococcus agalactiae
MAGWRTVVVNTHSKLSYKNNHLIFKDSYQTEMIHLSEIDILIMETTDIVLSTMLIKRLVDENILVIFCDDKRLPTAMLMPYYARHDSSLQLSRQMSWIEDVKADVWTSIIAQKILNQSFYLGECSFFEKSQSIMNLYHDLEPFDPSNREGHAARIYFNTLFGNDFSREQDNPINAGLDYGYSLLLSMFAREVVKCGCMTQFGLKHANQFNQFNLASDIMEPFRPIVDRIIYENRQSDFVKMKRELFSMFSETYSYNGKEMYLSNIVSDYTKKVIKSLNSDGNGIPEFRI

SEQ ID NO: 4207 - DNA, 867 bp, Streptococcus pyogenes
atggctggttggcgtactgttgtggtaaatacccactcgaaattatcctataagaataatcatctgatttttaaggatgcctataaaacggagctgatccatttatcagaaattgatattttgttattagaaacgaccgatattgtcttgtccactatgctggtaaaacggctagtggatgagaatgtccttgtcatattctgtgatgataaacgattaccaacagctatgctgatgcctttttatggtcgtcatgattcgagtttacagcttgggaaacaaatgtcctggtcagaaacagtcaaatcgcaggtttggacgacgattattgctcaaaagattttgaatcaatcttgctatctaggagcatgctcctattttgaaaaatcccaatctattatggatttatatcatggtttggaaaattttgatccgagtaatcgagaagggcatgcagcgagaatttattttaatacactttttgggaacgatttctcaagagatttggagcatccaatcaatgcaggtctggattatggttatactttattattgagtatgtttgcgcgtgaagtggttgtgtctggatgtatgactcagtttgggcttaaacacgctaatcagtttaatcagttcaattttgctagcgatattatggaaccatttaggcctttagtggataagattgtttatgaaaatcgaaatcagccttttcccaaaataaagagagagttatttactttgttttcagatacattttcatataatggtaaagagatgtatctcacgaatattattagcgattatactaaaaaagttgtcaaagctctgaataatgaagggaaaggagttcctgaatttaggata

SEQ ID NO: 4208 - protein, 289 aa, Streptococcus pyogenes
MAGWRTVVVNTHSKLSYKNNHLIFKDAYKTELIHLSEIDILLLETTDIVLSTMLVKRLVDENVLVIFCDDKRLPTAMLMPFYGRHDSSLQLGKQMSWSETVKSQVWTTIIAQKILNQSCYLGACSYFEKSQSIMDLYHGLENFDPSNREGHAARIYFNTLFGNDFSRDLEHPINAGLDYGYTLLLSMFAREVVVSGCMTQFGLKHANQFNQFNFASDIMEPFRPLVDKIVYENRNQPFPKIKRELFTLFSDTFSYNGKEMYLTNIISDYTKKVVKALNNEGKGVPEFRI

SEQ ID NO: 4209 - DNA, 4110 bp, Streptococcus agalactiae
atgaataagccatattcaataggccttgacatcggtactaattccgtcggatggagcattattacagatgattataaagtacctgctaagaagatgagagttttagggaacactgataaagaatatattaagaagaatctcataggtgctctgctttttgatggcgggaatactgctgcagatagacgcttgaagcgaactgctcgtcgtcgttatacacgtcgtagaaatcgtattctatatttacaagaaatttttgcagaggaaatgagtaaagttgatgatagtttctttcatcgattagaggattcttttctagttgaggaagataagagagggagcaagtatcctatctttgcaacattgcaggaagagaaagattatcatgaaaaattttcgacaatctatcatttgagaaaagaattagctgacaagaaagaaaaagcagaccttcgtcttatttatattgctctagctcatatcattaaatttagagggcatttcctaattgaggatgatagctttgatgtcaggaatacagacatttcaaaacaatatcaagattttttagaaatctttaatacaacttttgaaaataatgatttgttatctcaaaacgttgacgtagaggcaatactaacagataagattagcaagtctgcgaagaaagatcgtattttagcgcagtatcctaaccaaaaatctactggcatttttgcagaatttttgaaattgattgtcggaaatcaagctgacttcaagaaatatttcaatttggaggataaaacgccgcttcaattcgctaaggatagctacgatgaagatttagaaaatcttcttggacagattggtgatgaatttgcagacttattctcagcagcgaaaaagttatatgatagtgtccttttgtctggcattcttacagtaatcgacctcagtaccaaggcgccactttcagcttctatgattcagcgttatgatgaacatagagaggacttgaaacagttaaaacaattcgtaaaagcttcattgccggaaaaatatcaagaaatatttgctgattcatcaaaagatggctacgctggttatattgaaggtaaaactaatcaagaagctttttataaatacctgtcaaaattgttgaccaagcaagaagatagcgagaattttcttgaaaaaatcaagaatgaagatttcttgagaaaacaaaggacctttgataatggctcaattccacaccaagtccatttgacagagctgaaagctattatccgccgtcaatcagaatactatcccttcttgaaagagaatcaagataggattgaaaaaatccttacctttagaattccttattatatcgggccactagcacgtgagaagagtgattttgcatggatgactcgcaaaacagatgacagtattcgaccttggaattttgaagacttggttgataaagaaaaatctgcggaagcttttatccatcgtatgaccaacaatgatttttatcttcctgaagaaaaagttttaccaaagcatagtcttatttatgaaaaatttacggtctataatgagttgactaaggttagatataaaaatgagcaaggtgagacttatttttttgatagcaatattaaacaagaaatctttgatggagtattcaaggaacatcgtaaggtatccaagaagaagttgctagattttctggctaaagaatatgaggagtttaggatagtagatgttattggtctagataaagaaaataaagctttcaacgcctcattgggaacttaccacgatctcgaaaaaatactagacaaagattttctagataatccagataatgagtctattctggaagatatcgtccaaactctaacattatttgaagacagagaaatgattaagaagcgtcttgaaaactataaagatctttttacagagtcacaactaaaaaaactctatcgtcgtcactatactggctggggacgattgtctgctaagttaatcaatggtattcgagataaagagagtcaaaaaacaatcttggactatcttattgatgatggtagatctaatcgcaactttatgcagttgataaatgatgatggtctatctttcaaatcaattatcagtaaggcacaggctggtagtcattcagataatctaaaagaagttgtaggtgagcttgcaggtagccctgctattaaaaagggaattctacaaagtttgaaaattgttgatgagcttgttaaagtcatgggatacgaacctgaacaaattgtggttgagatggcgcgtgagaatcaaacaacaaatcaaggtcgtcgtaactctcgacaacgctataaacttcttgatgatggcgttaagaatctagctagtgacttgaatggcaatattttgaaagaatatcctacggataatcaagcgttgcaaaatgaaagacttttcctttactacttacaaaacggaagagatatgtatacaggggaagctctagatattgacaatttaagtcaatatgatattgaccacattattcctcaagctttcataaaagatgattctattgataatcgtgttttggtatcatctgctaaaaatcgtggaaagtcagatgatgttcctagccttgaaattgtaaaagattgtaaagttttctggaaaaaattacttgatgctaagttaatgagtcagcgtaagtatgataatttgactaaggcagagcgcggaggcctaacttccgatgataaggcaagatttatccaacgtcagttggttgagacacgacaaattaccaagcatgttgcccgtatcttggatgaacgctttaataatgagcttgatagtaaaggtagaaggatccgcaaagttaaaattgtaaccttgaagtcaaatttggtttcaaatttccgaaaagaatttggattctataaaattcgtgaagttaacaattatcaccatgcacatgatgcctatcttaatgcagtagttgctaaagctattctaaccaaatatcctcagttagagccagaatttgtctacggcgactatccaaaatataatagttacaaaacgcgtaaatccgctacagaaaagctatttttctattcaaatattatgaacttctttaaaactaaggtaactttagcggatggaaccgttgttgtaaaagatgatattgaagttaataatgatacgggtgaaattgtttgggataaaaagaaacactttgcgacagttagaaaagtcttgtcataccctcagaacaatatcgtgaagaagacagagattcagacaggtggtttctctaaggaatcaatcttggcgcatggtaactcagataagttgattccaagaaaaacgaaggatatttatttagatcctaagaaatatggaggttttgatagtccgatagtagcttactctgttttagttgtagctgatatcaaaaagggtaaagcacaaaaactaaaaacagttacggaacttttaggaattaccatcatggagaggtccagatttgagaaaaatccatcagctttccttgaatcaaaaggctatttaaatattagggctgataaactaattattttgcccaagtatagtctgttcgaattagaaaatgggcgtcgtcgattacttgctagtgctggtgaattacaaaaaggtaatgagctagccttaccaacacaatttatgaagttcttataccttgcaagtcgttataatgagtcaaaaggtaaaccagaggagattgagaagaaacaagaatttgtaaatcaacatgtctcttattttgatgacatccttcaattaattaatgatttttcaaaacgagttattctagcagatgctaatttagagaaaatcaataagctttaccaagataataaggaaaatatatcagtagatgaacttgctaataatattatcaatctatttacttttaccagtctaggagctccagcagcttttaaattttttgataaaatagttgatagaaaacgctatacatcaactaaagaagtacttaattctaccctaattcatcaatctattactggactttatgaaacacgtattgatttgggtaagttaggagaagat

SEQ ID NO: 4210 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 4211 - DNA, 4104 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgac

SEQ ID NO: 4212 - protein, 1368 aa, Streptococcus pyogenes [sequence omitted]

SEQ ID NO: 4213 - DNA, 669 bp, Streptococcus agalactiae
atgaatggacatttaatgaaggataagttattagtagttttaacttggatttggattatatcgttagcaactctagctacaatttatattgcttggttgatctatcctatagaaattcagtttttaaaattagaaaaggttgtgtatttaaaggctgaaacaatttattataattttaataagttgatgatatatctgactcatccttttatctctgatttaaatatgcccagctttccttcttcagaggatggtttaaagcattttgcggatgtaaaatatctttttactctagcgcatgggctttttgttatactaacttttccagttatttattttttaagacgtggatggaagcaaaaaagtatctttctatatgaaggctttttcaagatagctattatgttgcctatttttattgtagtatgtgcctttctgttgggttttgaccagtttttcactctatttcatgaggtgctttttccaggagattctacttggcaatttaatcctctaacggatccagtaatttggatacttcctgaaacttttttcctccattgtttcatcatttttttgttaatctatgaaacaataactataattcttttgataataggtagaaaacatttaaaattaagaaaatataaaaacaaaatgcaagcctta

SEQ ID NO: 4214 - protein, 223 aa, Streptococcus agalactiae
MNGHLMKDKLLVVLTWIWIISLATLATIYIAWLIYPIEIQFLKLEKVVYLKAETIYYNFNKLMIYLTHPFISDLNMPSFPSSEDGLKHFADVKYLFTLAHGLFVILTFPVIYFLRRGWKQKSIFLYEGFFKIAIMLPIFIVVCAFLLGFDQFFTLFHEVLFPGDSTWQFNPLTDPVIWILPETFFLHCFIIFLLIYETITIILLIIGRKHLKLRKYKNKMQAL

SEQ ID NO: 4215 - DNA, 642 bp, Streptococcus pyogenes
gtggaggttgtgatggtagaaaacactaaattactatgtagctgggtatggttattagcgttagctattctcataacgatctattcaacgtggctgtggtatcctcttgaggtggaccatctaaagttagaacaagttgtttttatgagcaaggatgctatcttgcataactataacggactactcaattacctcaccaatccttttgtgacaaggttggaatttgctaattttcactcatcggcagacggactcaagcattttgcagatgtgaagtggctttttcacctaactcaagtcgtttttcttggccttctttacccaacccttaagactttcacacaaaggttaaaaaccaaacgtttctggctccttcaaaaacctttaatactagcagctttgtttcctcttatgattggtctaatggctagtttcattgggtttgaacatttttttactctttttcatcaggtgctttttgtaggagatagcagctggctctttgatcccttgaaagattctgtgatttggatccttccagaagtctttttcttgcactgtttccttttctttatgatagtttacgaaatcatcctgtggagcttagtaggtttagcaagatggcagcgcctaaatgtagaa

SEQ ID NO: 4216 - protein, 214 aa, Streptococcus pyogenes
VEVVMVENTKLLCSWVWLLALAILITIYSTWLWYPLEVDHLKLEQVVFMSKDAILHNYNGLLNYLTNPFVTRLEFANFHSSADGLKHFADVKWLFHLTQVVFLGLLYPTLKTFTQRLKTKRFWLLQKPLILAALFPLMIGLMASFIGFEHFFTLFHQVLFVGDSSWLFDPLKDSVIWILPEVFFLHCFLFFMIVYEIILWSLVGLARWQRLNVE

SEQ ID NO: 4217 - DNA, 768 bp, Streptococcus agalactiae
atggcttataaaggatatcttattgatttagatggtactatttacaaagggaaaagtcgtatcccagcaggagagcgttttatcgaacgtttgcaagaaaaaggcattccttatatgttagtaactaataatacgactcgtacaccagaaagcgttcaggaaatgcttcgaggcttcaatgttgaaacaccacttgaaacaatctataccgcaactatggctacggttgactatatgaatgatatgaaccgtggaaaaacagcttacgttattggtgaagaagggcttaaaaaagctattgcagatgcaggttatgtggaggatacaaaaaatccagcctatgtggttgttggtttagattggaatgttacttatgataaattggcaactgctacgttagcaattcaaaatggtgctttatttattggaaccaatccagatttgaatattcctactgaacgtggtttattacccggtgctggctccttaaatgctttattagaagccgcaacgcgtataaaaccagtctttattggaaagccaaatgccatcattatgaataaggcacttgaaattttaaatattcctagaaatcaagcagtcatggtcggtgataattatttgacagatatcatggctggtattaataatgatattgatactttgttagtaacaacgggttttacaacagttgaagaagtaccagatttaccaattcaaccaagttatgttttagcaagtttagatgaatggacatttaatgaagga

SEQ ID NO: 4218 - protein, 256 aa, Streptococcus agalactiae
MAYKGYLIDLDGTIYKGKSRIPAGERFIERLQEKGIPYMLVTNNTTRTPESVQEMLRGFNVETPLETIYTATMATVDYMNDMNRGKTAYVIGEEGLKKAIADAGYVEDTKNPAYVVVGLDWNVTYDKLATATLAIQNGALFIGTNPDLNIPTERGLLPGAGSLNALLEAATRIKPVFIGKPNAIIMNKALEILNIPRNQAVMVGDNYLTDIMAGINNDIDTLLVTTGFTTVEEVPDLPIQPSYVLASLDEWTFNEG

SEQ ID NO: 4219 - DNA, 762 bp, Streptococcus pyogenes
gtgccttataagggttatttaattgatttagacggaacgatttaccaagggaaaaaccgtattccagcaggggagcggtttatcaaacgcctacaagaaagaggcattccctatttattagtgactaataataccacaagaacacccgaaatggtgcaaagcatgctggctaatcagtttcatgttgagacaagcattgagaccatttatacggctaccatggcaaccgtcgattacatgaatgacatgaaccgtggcaagacagcttacgttattggagaaacagggctcaaatcagctattgcagcagcaggttacgtagaagaacttgagaatcccgcttacgtggtggttggtttagacagtcaggtgacctatgagatgttggctatagccaccttggctattcaaaaaggtgccctctttattgggacaaatcctgatttaaacattccaaccgaacgtggtttgatgccaggagcaggtgcattgaatgccttactagaagctgccacacgtgtaaaacctgtttttattggcaagcccaacgctatcattatgaataaatcactagaggtattgggcattcagcgctctgaggctgtcatggttggcgataattacttgactgatatcatggcaggtattcaaaatgatattgcaacgatcctcgtgacaacaggctttaccagacctgaagaggtaccaaccttaccaattcagccagatcatgtcctatccagccttgatgagtggaggttg

SEQ ID NO: 4220 - protein, 254 aa, Streptococcus pyogenes
VPYKGYLIDLDGTIYQGKNRIPAGERFIKRLQERGIPYLLVTNNTTRTPEMVQSMLANQFHVETSIETIYTATMATVDYMNDMNRGKTAYVIGETGLKSAIAAAGYVEELENPAYVVVGLDSQVTYEMLAIATLAIQKGALFIGTNPDLNIPTERGLMPGAGALNALLEAATRVKPVFIGKPNAIIMNKSLEVLGIQRSEAVMVGDNYLTDIMAGIQNDIATILVTTGFTRPEEVPTLPIQPDHVLSSLDEWRL

SEQ ID NO: 4221 - DNA, 735 bp, Streptococcus agalactiae
atgggtttattatatcgagaaacttacgaagtgcctttttatgaatcagacactaatcattatatgaaattaccgcagttgttggctttagcgttacaaatttcagccaaacaatctttaaaattaggaataggcgatgacatcgtttttaaaagatacggattggtttgggtcgttacagattatattattgatattgagcgtttacccaagcatgctgaaaagatagtcattgagactgaagccaaagctcataataaattattgtgttaccgctatttttatatttatggtgaagacgggcaaaaaataataacgatttcatctgcttttgtcttaatggattttaaaacacggaagattcatcctgttcttgatgatattacttcaatttaccaatcccaaagaatcaaaaaagttattcgagggccgaaatatcatcccattggagatagtaaagttaaacaataccatgttcgttattttgatttagatatgaatggacatgttaataatagtaagtatctagaatggatgtatgatgtgttggacttagattttctaagtagccacattcctaaaaaaattgatttaaaatatattaaggaaattcaatatggaacggatattaagtctcattggtatcaagatggtcttgtgacacgtcatgatattattggtggcgatgctattcatgctcaagctaggattgaatggcaggaaaaaaaggaggat

SEQ ID NO: 4222 - protein, 245 aa, Streptococcus agalactiae
MGLLYRETYEVPFYESDTNHYMKLPQLLALALQISAKQSLKLGIGDDIVFKRYGLVWVVTDYIIDIERLPKHAEKIVIETEAKAHNKLLCYRYFYIYGEDGQKIITISSAFVLMDFKTRKIHPVLDDITSIYQSQRIKKVIRGPKYHPIGDSKVKQYHVRYFDLDMNGHVNNSKYLEWMYDVLDLDFLSSHIPKKIDLKYIKEIQYGTDIKSHWYQDGLVTRHDIIGGDAIHAQARIEWQEKKED

SEQ ID NO: 4223 - DNA, 567 bp, Streptococcus pyogenes
atgagatcactattcatcgcttgccacattttcaagaaaccatcaccattgaaacaaaagccctttcctataataaatttttttgttatcgccaattttatatttatgatcaagagggggggtcttttagtggatatcttagcctattttgctttgttaaacccagatacgcgaaaagtggcaactattccagaagatttagtagcgccatttgagactgattttgttaaaaagctacaccgtgttcctaaaatgcctcttttagaacaatcaattgatcgtgattattatgtgcgttattttgatattgatatgaatggtcatgtcaacaacagtaaatatttagattggatgtatgatgtgttggggtgtgagtttttaaaaacgcatcagcctcttaagatgactttgaaatatgttaaagaagtctcaccaggcggtcaaattacttccagttaccatttggaccaattaacttcttaccatcaaatcacctcagatgggcagctgaatgcccaagccatgattgaatggcgagcgattaaacaaacagaaagcgagacagac

SEQ ID NO: 4224 - protein, 189 aa, Streptococcus pyogenes
MRSLFIACHIFKKPSPLKQKPFPIINFFVIANFIFMIKRGGLLVDILAYFALLNPDTRKVATIPEDLVAPFETDFVKKLHRVPKMPLLEQSIDRDYYVRYFDIDMNGHVNNSKYLDWMYDVLGCEFLKTHQPLKMTLKYVKEVSPGGQITSSYHLDQLTSYHQITSDGQLNAQAMIEWRAIKQTESETD

SEQ ID NO: 4225 - DNA, 1128 bp, Streptococcus agalactiae
atgttaaagaaaccaacctcagcatatgtacacattccattttgtacccaaatatgttattattgtgatttttcaaaagtttttattaaaaatcagcctgtagacgcttatcttcaggctcttatccgtgaatttcggtcttatgatattacagaattgcgcaccttatatattggaggagggacacctacatctataagcgctgtgcaactggactatttattgacggagttaagtagagatttaaacttaaatactttagaggagttcactatcgaagctaatccaggagatttaaccgttgataaaatagaggtgcttcaaaagtcagctgtcaatagagtttctctaggagttcagacctttaatgataaacatttaaagcgtattggacgcagtcacaatgaggcacaaatttattctacaattgatgctcttaaaacagctggttttcaaaatatctctattgacctaatttatgccttacctggacaaacgatggatgatgttagaagtaatgtagccaaagctctctctctaaatattcctcatttgagtttatatagtttaattttagaacaccatactgtatttatgaataaaatgcgtcgtgggaaattacatttgccaacagaagatttagaagccgagatgtttgaatatatcatttctgaaatggaaagaaatggttttgagcattatgaaatttctaattttacaaagccgggttttgaaagtcgtcataatttgatgtactgggataatgtagaatattatggtgttggtgcaggcgcttctggttatcttgatggtattcgttatcgtaatagagggccaatacaacattatctaaagggggtttcagaaggtaatgcaaggttatctgaagaagtattatcaaaaaatgaaatgatggaagaggagcttttcctcggtcttcgtaaaaaagagggtgtttccatcggaaaatttgaacaaaaatttggaacgtcctttgagaaacgttacggtcagattgttcaagaactccaaagtgatgggcttttgaaagaaaataatggttttatccagatgactaaaaaaggtctcttcttaggagatacggttgccgagaaatttattgtggag

SEQ ID NO: 4226 - protein, 376 aa, Streptococcus agalactiae
MLKKPTSAYVHIPFCTQICYYCDFSKVFIKNQPVDAYLQALIREFRSYDITELRTLYIGGGTPTSISAVQLDYLLTELSRDLNLNTLEEFTIEANPGDLTVDKIEVLQKSAVNRVSLGVQTFNDKHLKRIGRSHNEAQIYSTIDALKTAGFQNISIDLIYALPGQTMDDVRSNVAKALSLNIPHLSLYSLILEHHTVFMNKMRRGKLHLPTEDLEAEMFEYIISEMERNGFEHYEISNFTKPGFESRHNLMYWDNVEYYGVGAGASGYLDGIRYRNRGPIQHYLKGVSEGNARLSEEVLSKNEMMEEELFLGLRKKEGVSIGKFEQKFGTSFEKRYGQIVQELQSDGLLKENNGFIQMTKKGLFLGDTVAEKFIVE

SEQ ID NO: 4227 - DNA, 1224 bp, Streptococcus pyogenes
ttgtcagctcgtaaaatacttttccaagccatgaagaatcaagggaaatggtttattcatagaaacattttatcatcaaagtggtataataagaccatgtcaaaaaaacctacttcagcctatgtgcacattcctttttgcacacaaatttgttattattgcgatttttcaaaagtctttatccaaaatcaacctgttgatgcttatttgaaagccttgattcaagaatttgactcttatggcattcgagacctaaaaaccctttatattggaggaggtacgcctacagctatcactgctaaacagttggagtatctcctaaatcaccttgaacgaaacctcaatttagatgatcttgaagaattcacaattgaggcaaatcctggtgatttgacgccagaaaaaattgcggtgcttcagaggtcagctgtcaatcggatttccttgggggtgcagacttttaataacaagcaattaaagcagattggccgtagccataatgaagaacaaatttatagcaccattgccaatttaaaaactgcaggctttcacaatatttccattgatttaatttatgccttgccaggtcaaaccttagatcaagtcaaggaaaatgttgctaaagctttggcacttgatattccccaccttagtctttatagccttattttggaacatcacactgtttttatgaacaaaatgcgacgtggtaaacttaacttaccaacggaagacttggaagcggaaatgtttgagtacattatttcagaaatggaagctaatggttttgagcattatgaaatttccaattttaccaaaccaggttttgaaagtcgccataacttgatgtattgggataatgtggagtattttggatgtggtgcaggggcttcaggttaccttaatggcattcgttatcagaatcgggtgcccatccagcattatcttaaagcggttgaagcagggaatgctagactaaatgaagaagtgctgcgcaaagaggaaatgatggaagaggaactctttttgggcttacgtaaaaagacaggagtctccatccagcggttccaagaaaaatttggtatgtcttttgaggagcgttatggaaatattgttagggagcttcaaaaccaaggactgcttgtcaaagatgacgcctttgtcagaatgactaaaaagggtcttttcttaggtgattctgttgctgagcggtttatattagat

SEQ ID NO: 4228 - protein, 408 aa, Streptococcus pyogenes
LSARKILFQAMKNQGKWFIHRNILSSKWYNKTMSKKPTSAYVHIPFCTQICYYCDFSKVFIQNQPVDAYLKALIQEFDSYGIRDLKTLYIGGGTPTAITAKQLEYLLNHLERNLNLDDLEEFTIEANPGDLTPEKIAVLQRSAVNRISLGVQTFNNKQLKQIGRSHNEEQIYSTIANLKTAGFHNISIDLIYALPGQTLDQVKENVAKALALDIPHLSLYSLILEHHTVFMNKMRRGKLNLPTEDLEAEMFEYIISEMEANGFEHYEISNFTKPGFESRHNLMYWDNVEYFGCGAGASGYLNGIRYQNRVPIQHYLKAVEAGNARLNEEVLRKEEMMEEELFLGLRKKTGVSIQRFQEKFGMSFEERYGNIVRELQNQGLLVKDDAFVRMTKKGLFLGDSVAERFILD

SEQ ID NO: 4229 - DNA, 378 bp, Streptococcus agalactiae
atgagattatggcatcaagatattattgagttattgcctaggcagcaacttttaggacagcatagagagtgttgtgcattgagagggaatgggtgggggagaaaacatgagactgttgattatgtttttcgatattcaccttataggttatttgcatatcatcaattagttatggaagaaatgatggagcgtgggtatcgtgtatctaaagaatggctaattgcagaatataggggaatgaagtgcccaagatatgatacacttaatcctgttgacttggagacacctatctatcccgagcacaatcaagactatctacaagaatgtctatggaatttaaaagcaaaaggaattgaccttcctataaataagataaaa

SEQ ID NO: 4230 - protein, 126 aa, Streptococcus agalactiae
MRLWHQDIIELLPRQQLLGQHRECCALRGNGWGRKHETVDYVFRYSPYRLFAYHQLVMEEMMERGYRVSKEWLIAEYRGMKCPRYDTLNPVDLETPIYPEHNQDYLQECLWNLKAKGIDLPINKIK

SEQ ID NO: 4231 - DNA, 369 bp, Streptococcus agalactiae
atgactaaagaagcagaattattatgggctaaacacaagtatttagtcttaagtaaatctcagaaaatttatttggatattagacaaactttgaaatcaccaaattgtaccgttttagacgttcagtcactcattgaccaagcagtgcttttagaagaatcaccatcacaagtgactaatgcttatatgcatatatggggctattttaaaaataaggcagagcgtcaagaaaaagaagaatttttaaccttgctggaaaaatacaggaaaacaggttatcaacgaagaaaactgttagcttttctaaaacagctattagctaaatacccaaattcttatttacaaaactcttctattttcgaagaagag

SEQ ID NO: 4232 - protein, 123 aa, Streptococcus agalactiae
MTKEAELLWAKHKYLVLSKSQKIYLDIRQTLKSPNCTVLDVQSLIDQAVLLEESPSQVTNAYMHIWGYFKNKAERQEKEEFLTLLEKYRKTGYQRRKLLAFLKQLLAKYPNSYLQNSSIFEEE

SEQ ID NO: 4233 - DNA, 384 bp, Streptococcus pyogenes
atgtctgatgctagtttgaaaacttaccaaaaacaatgggcttatcaaaagtattgggtcatggcacactcacagcagcattacaatgctttaagagaattgtttaaaggaaatcagtggtcagaagaaaaggtgttgacttttcattgtttgattgaagaagcgcaagccattcctcccacagtaaaaagcttacgaacggcatatcagcatgtttgggggtattttaaaaaggtagcgagtcaggaagaaaaagaccatttcaaagatttggatgctcagttggaaactaaatctgaggagatgctatgctttttacaagagatgactgctcattatcagccctcttatctgctatcttgccgtttgattaccaaaggtcct

SEQ ID NO: 4234 - protein, 128 aa, Streptococcus pyogenes
MSDASLKTYQKQWAYQKYWVMAHSQQHYNALRELFKGNQWSEEKVLTFHCLIEEAQAIPPTVKSLRTAYQHVWGYFKKVASQEEKDHFKDLDAQLETKSEEMLCFLQEMTAHYQPSYLLSCRLITKGP

SEQ ID NO: 4235 - DNA, 1350 bp, Streptococcus agalactiae
atgggaaaatattttggtacagatggtgttcgcggtgaagctaatgttgaactgacgccagaattggcttttaaattaggacgttttggaggatatgttctaagtcaacacgaaactgatcgtccgagagtttttgtagctcgtgatactcgtatttctggtgaaatgctggaatctgctttgattgctggtctactttcagtaggtattgaggtttataaacttggtgttttagccactcctggagtgtcttaccttgtccgtacagaaaaagctagtgcaggggttatgatttcagcaagccacaatccagcacttgataatggtattaagttctttggtagtgatggttttaaacttgatgatgatcgtgaattagaaattgaagctttacttgatgcgaaggaagacactttaccacgtccatcagcacaaggtttaggtactttagtagattatcctgaaggacttcggaaatatgagaagtttatggaatcaactggtattgatttagaaggtatgaaggttgcgttggatacagcaaatggagcagcaacagcctcagctcggaatatctttttagacttgaatgctgatataagtgttattggtgatcaaccagatggtttgaatatcaatgatggtgttggttcgacacatcctgagcaattacaaagtttagttagagaaaatggttccgacatcggtctagcttttgatggtgatagtgatcgtttgatcgctgttgatgaaaatggagagattgtagatggtgataaaattatgtttatcattgggaaatatctctctgataaagggcagcttgctcagaatacaatcgtaacaacggttatgtcaaatctcggctttcataaagcgctcgaccgtgaaggaattcataaagcgattaccgctgtaggagaccgctacgtggttgaagaaatgcgtaaatcaggatataatcttggcggagagcaatcaggccacgttattatcatggattacaatactacaggggatggacaattaacagccatccaattgactaaggtcatgaaagaaactggtaagaaattatcagagttagctagtgaagtgacgatttatcctcaaaaattagtaaatattcgtgttgaaaataacatgaaagataaagcgatggaagttcctgcaattgcggaaattattgctaaaatggaagaagagatggatggcaatggtcgtattctagtacgtcctagtggtactgagcctcttcttagagttatggcagaagcgccaacaaatgaagcggttgattattatgttgatactatcgcagatgtcgttcgtacagaaattggtttagat

SEQ ID NO: 4236 - protein, 450 aa, Streptococcus agalactiae
MGKYFGTDGVRGEANVELTPELAFKLGRFGGYVLSQHETDRPRVFVARDTRISGEMLESALIAGLLSVGIEVYKLGVLATPGVSYLVRTEKASAGVMISASHNPALDNGIKFFGSDGFKLDDDRELEIEALLDAKEDTLPRPSAQGLGTLVDYPEGLRKYEKFMESTGIDLEGMKVALDTANGAATASARNIFLDLNADISVIGDQPDGLNINDGVGSTHPEQLQSLVRENGSDIGLAFDGDSDRLIAVDENGEIVDGDKIMFIIGKYLSDKGQLAQNTIVTTVMSNLGFHKALDREGIHKAITAVGDRYVVEEMRKSGYNLGGEQSGHVIIMDYNTTGDGQLTAIQLTKVMKETGKKLSELASEVTIYPQKLVNIRVENNMKDKAMEVPAIAEIIAKMEEEMDGNGRILVRPSGTEPLLRVMAEAPTNEAVDYYVDTIADVVRTEIGLD

SEQ ID NO: 4237 - DNA, 1353 bp, Streptococcus pyogenes
atgggaaaatattttggaacagatggtgttcgtggcgaagcaaatgttgagctgacacctgagttagcttttaaactgggccgattcggtggttatgttttaagtcaacatgagaccgaaagacctaaagtttttgtggcgcgtgacacccgtatttcaggagaaatgttggagtcagccttgattgctggtctactatctgttggtattgaagtttataaacttggcgttttagcgacacctggtgtctcttatttagttagaacagaaaaagcaagtgcaggtgtgatgatttctgcaagtcataaccctgcgcttgacaatggcatcaaattctttgggaatgatgggtttaagttagctgatgaccaagaattggaaattgaagctctcttagatgctccggaggacacgcttcctcgcccgagtgcagaaggacttggaaccttggtagattatccagaaggacttcgtaaatatgaaaagttcttggtaacaactggtactgacttaagcggtatgacagttgccttagacactgctaatggagctgcttcagtgtcagcacgtgatgtctttttagatttaaatgcagaaattgctgtcattggtgaaaaaccaaatggtcttaatattaatgacggtgttggttcaacgcgtccagaacaacttcaagagttagttaaggaaacaggagcagatcttggtttagcctttgatggcgatagcgaccgtctgattgctgtggacgaaactggcgagattgttgacggtgatcgtattatgtttatcattggtaaatatttgtcagaaaaagggcttcttgctcacaataccattgtcacaacggtgatgtctaacctcggttttcataaagctttagataaacaaggtattaataaagcaattacagcagttggagaccgctatgtggttgaagaaatgcgtagctcaggatacaatctcggtggtgaacaatcaggccatgtcattatcatggactacaataccactggagatggtcagttgacagctatccaattagccaaggtgatgaaggaaactggaaaatcactttcggaattagctgctgaagtaaccatttaccctcaaaaactggtgaatattcgtgtggaaaacagcatgaaagaacgtgctatggaagttccagctattgcgaacatcattgcaaaaatggaggatgaaatggctggtaatggtcgtattctcgtgagaccaagtggtacagaacctcttcttcgtgtcatggcagaggcgccaacagatgccgaagttgattattatgtcgatactattgctgatgtcgtccgtacagaaatcggatgcgataac

SEQ ID NO: 4238 - protein, 451 aa, Streptococcus pyogenes
MGKYFGTDGVRGEANVELTPELAFKLGRFGGYVLSQHETERPKVFVARDTRISGEMLESALIAGLLSVGIEVYKLGVLATPGVSYLVRTEKASAGVMISASHNPALDNGIKFFGNDGFKLADDQELEIEALLDAPEDTLPRPSAEGLGTLVDYPEGLRKYEKFLVTTGTDLSGMTVALDTANGAASVSARDVFLDLNAEIAVIGEKPNGLNINDGVGSTRPEQLQELVKETGADLGLAFDGDSDRLIAVDETGEIVDGDRIMFIIGKYLSEKGLLAHNTIVTTVMSNLGFHKALDKQGINKAITAVGDRYVVEEMRSSGYNLGGEQSGHVIIMDYNTTGDGQLTAIQLAKVMKETGKSLSELAAEVTIYPQKLVNIRVENSMKERAMEVPAIANIIAKMEDEMAGNGRILVRPSGTEPLLRVMAEAPTDAEVDYYVDTIADVVRTEIGCDN

SEQ ID NO: 4239 - DNA, 957 bp, Streptococcus agalactiae
atgaaaaaattttttacaaataaattttggttaggcgttgtctcactctttctggctattttattatttttaacggcaactgcaacaagtatgaaccatcaagacaatagtaagattgcaggagcgtctgagacatatacacataccctaacagatgtgccaatagacatcaaatacgatagtgatgattactttattagtggatattcttatggggcagatgtctatatgtcatcggttaatcgtgttaagttagattctgaaataaatgaggatacacgaaaatttaaagtagtcgccgatttgacaaatatgaaaccagggactcacaaagtcccactaaaggtagtaaatttgccatctggtgtaaatgctacggtttctccaacaacaattacagtaactatgggtaaaaagaaaacaaaagagtttccggtttatggacatgttaatgataagcaaattaaagctggttatgcagtcgataagatgtcagttgatgtgtcaaaagttaaagttactagtgatgaatctattatagatcgtattgaccatgtcgctgccaatatccctgatgataaagttcttgatgatgattttaacaagacagttactttacaagctgtaacagcagatggtacagtattagcaagtattattcacccttctaaagcaactttatctgtcaaagtaaaaaaattgaccaagacagtaccgattaatttgataccagtaggacaattcagcgatagtatttcaaaaattaactacaagttgagtcaagaaaaagcagtaatttcaggaacaaaagaggctttagaagctatttctgttattaatgctgaggtagatatttcagacgtaactaaaaatacagaaaagaaaattaatctttctgcaaacaatgtttcagttgatcctgctcaagtaacagttcaattgacaactactaaaaaa

SEQ ID NO: 4240 - protein, 319 aa, Streptococcus agalactiae
MKKFFTNKFWLGVVSLFLAILLFLTATATSMNHQDNSKIAGASETYTHTLTDVPIDIKYDSDDYFISGYSYGADVYMSSVNRVKLDSEINEDTRKFKVVADLTNMKPGTHKVPLKVVNLPSGVNATVSPTTITVTMGKKKTKEFPVYGHVNDKQIKAGYAVDKMSVDVSKVKVTSDESIIDRIDHVAANIPDDKVLDDDFNKTVTLQAVTADGTVLASIIHPSKATLSVKVKKLTKTVPINLIPVGQFSDSISKINYKLSQEKAVISGTKEALEAISVINAEVDISDVTKNTEKKINLSANNVSVDPAQVTVQLTTTKK

SEQ ID NO: 4241 - DNA, 954 bp, Streptococcus pyogenes
atgaaacgatttttaaatagtcgtccttggttaggaatggtatcagtcttttttgcgattctcctttttttaactgcagcatcgagcaatcataataactctagctcgcaaatttatagtccgattgaaacctatacgcatagccttaaagatgtaccaattgatatgaagtatgatagtgacaaatattttatcagtgggtattcttatggtgcggaagtttatctaacctccactaatcgtatcaaattagattctgaagtgaacaatgatacacgtaattttaagattgtggcggatctaacacatagtcatccaggtacagtaagtgtcaacctaagagtagaaaaccttccttctggggtgacagctaccgtatctccagataaaatatcagtcacaattggcaaaaaagaatctaaggtatttcctgttagaggaagcgttgatgctaaacaaattgcaaatggttatgaaattagcaaaattgaaacgggggttaataaggttgaagtgaccagtgatgaatctaccattgctttaattgatcacgttgtggcaaagttacctgatgatcaagtgttagataggaattatagtagtcgagtgaccttacaagctgtctcagctgatggaactattttagcaagtgcaattgatcctgcaaaaacaaatttatcagttgctgtaaaaaaaataacgaaatcagtcccgattagagttgaggcagtggggatgatggatgatagcttatcagatattcaatacaaattgtcaaaacaaacagctgttatctcaggtagtcgagaggtcttagaagatattgatgaaattattgcagaagttaacatttctgatgtcactaaaaatactagtaagaccgtgagtttgtcttctagtcaggtgtcaattgagccgtcagtagtgaccgttcagttgacaaccaccaaaaaa

SEQ ID NO: 4242 - protein, 318 aa, Streptococcus pyogenes
MKRFLNSRPWLGMVSVFFAILLFLTAASSNHNNSSSQIYSPIETYTHSLKDVPIDMKYDSDKYFISGYSYGAEVYLTSTNRIKLDSEVNNDTRNFKIVADLTHSHPGTVSVNLRVENLPSGVTATVSPDKISVTIGKKESKVFPVRGSVDAKQIANGYEISKIETGVNKVEVTSDESTIALIDHVVAKLPDDQVLDRNYSSRVTLQAVSADGTILASAIDPAKTNLSVAVKKITKSVPIRVEAVGMMDDSLSDIQYKLSKQTAVISGSREVLEDIDEIIAEVNISDVTKNTSKTVSLSSSQVSIEPSVVTVQLTTTKK

SEQ ID NO: 4243 - DNA, 126 bp, Streptococcus agalactiae
atgaaaatattaattaacaattcactggaaatatctgcatctaatgggatacctgtagctatatactcttgcaaagtttgggtacgttcaattgaaatcaaggctcctattttacgcggactcata

SEQ ID NO: 4244 - protein, 42 aa, Streptococcus agalactiae
MKILINNSLEISASNGIPVAIYSCKVWVRSIEIKAPILRGLI

SEQ ID NO: 4245 - DNA, 849 bp, Streptococcus agalactiae
atggatattttttcagctattgattcaaagttttgggcgagcattatggaaaatccatggatgatccttattcatctcatggatattatcatagtagctgttctgatttataaatttatcaaagcgctagcaggcacaaaaattatgtccttaattcagggcgttattttgtttatcatcattagatttgtgtcagaatggatagggctaacaacgattacatttttgatgaatcagattgttacttatggtgtaattgcaggtgttgtcatctttgctccagagattagaacaggtctcgaaaaatttgggcgaacaccacaactatttacgcaacgttctcaattaagcagtgatgaaaagctagtagatgcccttgttaaggcagttgcttatatgagtccgcgtaaaataggagccttgatttcaattgaacgtacccaaactttgcaagagtatatagctacaggtatcccattagatgcagatatttccagtgaattgttaattaatattttcattcctaatacaccactgcatgatggtgctgttattgtaaaagataaaaaaattgctacagcatgctcgtacttacctctatcagaatcatcttcgatttcaaaagaatttggaacacgccacagagcagcgattggtctatcagagaattcagatgcactaacagttattgtttctgaagagactggtggtatttctgttgctttgaaaggtgaatttttacatgatctttctaaagatagctttgaagcaattctgagaactcagttgattcaaaatcaagaggaaaactcaaaattagcttggtataatcaactattgaggaggaag

SEQ ID NO: 4246 - protein, 283 aa, Streptococcus agalactiae
MDIFSAIDSKFWASIMENPWMILIHLMDIIIVAVLIYKFIKALAGTKIMSLIQGVILFIIIRFVSEWIGLTTITFLMNQIVTYGVIAGVVIFAPEIRTGLEKFGRTPQLFTQRSQLSSDEKLVDALVKAVAYMSPRKIGALISIERTQTLQEYIATGIPLDADISSELLINIFIPNTPLHDGAVIVKDKKIATACSYLPLSESSSISKEFGTRHRAAIGLSENSDALTVIVSEETGGISVALKGEFLHDLSKDSFEAILRTQLIQNQEENSKLAWYNQLLRRK

SEQ ID NO: 4247 - DNA, 849 bp, Streptococcus pyogenes
atgaataatttatctagtatcgatattaaatttttattaagcttatttgcggatccttggctgctggcagtgcatcttttagatattctaattgttgcctatttgatttatcgttttattaaagcattgactggaactaaaatcatgtctttagttcaaggggtcattttctttttggttcttcgttttattgcagagtggattggctttacgacaatcacatacttaatgaaccaagtcattacttatggtgtaattgcaggagtagtcatttttacccctgaaattcgggcaggactggagaaatttggtcgttctacgcaagtttttttacaaaaacagtacgtcagcagtgaatctgctttggtcgatgctttgattaaatctgtggcctatatgggtccacgcaagataggtgcattgattgctattgaacagactcaaaccttacaagaatatattgcgacaggaattccgctgaatgccgacatttcaagtcaactactcatcaatatttttattccgaatacgccgcttcatgatggagctgttatcgttggtcagaataagattgtggcagcctgtgcttacttgcctttgtcagaatcaaaggcaatttccaaagaatttgggacccgtcatagagcggctattggattatctgaaaactctgatgcactaactatcattgtttcagaagaaacaggagctatttcagtaactcgcaaaggccaatttttacacgatttaagcacagatgaatttgaaacggtacttaggacctacctgatgagtaattcaaatgttactttaccatggtataagaaaattctaggagggaaatctaaa

SEQ ID NO: 4248 - protein, 283 aa, Streptococcus agalactiae
MNNLSSIDIKFLLSLFADPWLLAVHLLDILIVAYLIYRFIKALTGTKIMSLVQGVIFFLVLRFIAEWIGFTTITYLMNQVITYGVIAGVVIFTPEIRAGLEKFGRSTQVFLQKQYVSSESALVDALIKSVAYMGPRKIGALIAIEQTQTLQEYIATGIPLNADISSQLLINIFIPNTPLHDGAVIVGQNKIVAACAYLPLSESKAISKEFGTRHRAAIGLSENSDALTIIVSEETGAISVTRKGQFLHDLSTDEFETVLRTYLMSNSNVTLPWYKKILGGKSK

SEQ ID NO: 4249 - DNA, 159 bp, Streptococcus agalactiae
ttgacgaccaaaaacggcacggcttttatcaaatccatccttaatttgacttggttctacaccaaaatattcagcaacagatactgccgccaaagcattgtaaatattataaaggccacccacgttgatattatattgttggccatcaataacgaaacc

SEQ ID NO: 4250 - protein, 53 aa, Streptococcus agalactiae
MTTKNGTAFIKSILNLTWFYTKIFSNRYCRQSIVNIIKATHVDIILLAINNET

SEQ ID NO: 4251 - DNA, 1341 bp, Streptococcus agalactiae
atgaaaataaatacagcactaggagtggctgccggtaagtctgctcattaccttttaagtaaaatgggacgtggctctacttatccgggtagtttagcactcaaattcgataaagatatactagatacaattgccaaagattatgaaattgtagttgtgactggtactaacggtaaaaccttaacaacagctttaacagttggtattttaaaggaagccttcggtcaggtggtaaccaacccaagtggagcaaatatgattacaggtattgtttcgaccttcctaacagctaagaaaagtaaatctggtaaaaaaatagctgtccttgaaatagacgaagcgagtttaccccgtattacacagtatataaagcctagtttgttcgtctttaccaatattttccgtgatcaaatggaccgttatggcgaaatctacacaacttatcaaatgattttagatggagctgctaacgctccgcaagctactatcttagctaacggtgacagtccactttttaattctaaaagcgtgactaaccctgtgcaattctatggatttaataccgacaaacatgagccacgattagcacactataatactgagggtattctctgtccaaagtgtcaagcaattttaacttatcgattgaacacatatgccaaccttggtgactacacttgtcctaattgtgattttgaacgtccaaaccttgattatgccttaacaaggctaacacatctgacaaatacttcatcaggtttcgttattgatggccaacaatataatatcaacgtgggtggcctttataatatttacaatgctttggcggcagtatctgttgctgaatattttggtgtagaaccaagtcaaattaaggatggatttgataaaagccgtgccgtttttggtcgtcaagaaacctttacaattggaaataaaaaatgtactttagttctgattaaaaatccggtaggagctagtcaagctcttgatatgattaaacttgctccatacccgttctctctctcagtactactgaatgccaattatgctgacggtattgatacttcttggatttgggacgctaattttgaaactattctcacgatgaatatcccagaaatatttgctggtggtgttcgccactctgaaattgctcgtcgcttacgtgtaactggttatgatgagaaacgcataaaacaagctgataaactgcaagatattatgacaatgattgagcagcaagagactgagcatgcttatattttagcaacatatacagctatgctggagtttcgtgaaattcttgctaaccacaacgctatcagaaaggagatgaat

SEQ ID NO: 4252 - protein, 447 aa, Streptococcus agalactiae
MKINTALGVAAGKSAHYLLSKMGRGSTYPGSLALKFDKDILDTIAKDYEIVVVTGTNGKTLTTALTVGILKEAFGQVVTNPSGANMITGIVSTFLTAKKSKSGKKIAVLEIDEASLPRITQYIKPSLFVFTNIFRDQMDRYGEIYTTYQMILDGAANAPQATILANGDSPLFNSKSVTNPVQFYGFNTDKHEPRLAHYNTEGILCPKCQAILTYRLNTYANLGDYTCPNCDFERPNLDYALTRLTHLTNTSSGFVIDGQQYNINVGGLYNIYNALAAVSVAEYFGVEPSQIKDGFDKSRAVFGRQETFTIGNKKCTLVLIKNPVGASQALDMIKLAPYPFSLSVLLNANYADGIDTSWIWDANFETILTMNIPEIFAGGVRHSEIARRLRVTGYDEKRIKQADKLQDIMTMIEQQETEHAYILATYTAMLEFREILANHNAIRKEMN

SEQ ID NO: 4253 - DNA, 1341 bp, Streptococcus pyogenes
atgaaaatgaagacattactcggcattattgctggcaaagctgctcaatccattttaacaaaactagggcgaggatctacttatcctggtcgattggctctagcttgtgataaagatattttaaaggatttgtctaaagactatgatattgtggtcgtcactggtactaatggtaaaacgttaacaactgctcttactgtcggtattttgaaagaggcatttggcgagataatcacaaatccaagtggtgccaatatgattactggaattacttctacttttttagctgctaaaaaagggaaatctgaaaggcaaattgctgttttagaaattgacgaggctagtcttcctagaattaccacttacttaaaacctagtctttttgtttatactaatatttttagggatcagatggaccgctacggagagatttacactacttatcagatgattgtagatggtgctcgaaatgctccaaaagcaactattctagccaatggagatagtcctattttctcttctaaggacatagttaatccagttcagtattatggttttgatactgctaagcatgctccgcagctagctcattacaacacagaagggattttatgtccaaaatgcgaacatattcttcagtatcgtctcaatacttatgcgaatctaggagactttgtttgcttaaactgtcagttccaaagaccaacgttagattatcaattaactgagctcaccgctattactcaccaaagttctgaatttgttattgatggacaaaactacaagataaatgttggtggtctttataatatttacaatgcgctcgctgccgtctctgttgctgaatttttcggtgtttctcccgagaaaatcaaggcgggctttaacaaaagtaaggcggtttttggaagacaagaaacttttactgttggtgataaatcatgcacccttatccttatcaagaatcctgttggagccagtcaggcactggaaatgattcaattggcagattatccatttagcttatcagttttattaaatgccaattacgctgatggcattgataccagctggatttgggatgctaattttgaactcattacccaaatgcccattacagaaattaatgctggcggcgtccgccactctgaaattgctagaagacttagagtcacaggatttgacgatactaagataaaacaagctgaaaagctcgagcaaatcatagaaaccattgaaaaacaagaagctaagcatgcctatattttagcaacctatacggcaatgttagaattccgtagcttacttgctgaccgccatgtcgttgaaaaggagatgatc

SEQ ID NO: 4254 - protein, 447 aa, Streptococcus agalactiae
MKMKTLLGIIAGKAAQSILTKLGRGSTYPGRLALACDKDILKDLSKDYDIVVVTGTNGKTLTTALTVGILKEAFGEIITNPSGANMITGITSTFLAAKKGKSERQIAVLEIDEASLPRITTYLKPSLFVYTNIFRDQMDRYGEIYTTYQMIVDGARNAPKATILANGDSPIFSSKDIVNPVQYYGFDTAKHAPQLAHYNTEGILCPKCEHILQYRLNTYANLGDFVCLNCQFQRPTLDYQLTELTAITHQSSEFVIDGQNYKINVGGLYNIYNALAAVSVAEFFGVSPEKIKAGFNKSKAVFGRQETFTVGDKSCTLILIKNPVGASQALEMIQLADYPFSLSVLLNANYADGIDTSWIWDANFELITQMPITEINAGGVRHSEIARRLRVTGFDDTKIKQAEKLEQIIETIEKQEAKHAYILATYTAMLEFRSLLADRHVVEKEMI

SEQ ID NO: 4255 - DNA, 783 bp, Streptococcus agalactiae
atgacttatacctcactaaaatctcctactaccaaagattataaatacactcttaatgtagctcatctttatggtaacctattaaatacttatggcgataacggaaatatcttaatgatgaaatatgtgggagaaaaactaggatgtcaaatgacatttgatatcgtttcattagaagatagatttgatcccaactattatcagatggcattttttggtggtggacaagactacgaacaagccattgttgcacgcgatcttcccagtaagaaagaagacattaacaaattcattcaaaataatggtgtagtacttgctatttgtggaggtttccaacttttaggacaatactatattcaagctaatggagaacgaatagagggcattggcgttatgggacactatacgctaaaccaaaataataatcgctatattggtgatatcaagattcacaacgatgaattcaatgaaacatattatggctttgagaatcatcaaggacgtacctttttatcagaagacgaaaaacctttaggaaccgtcatttatggaaatgggaataacaaagaagatggtactgaaggggttcattataagaatgtttttgggtcatactttcacggtccaatcctttctcgtaatgctaatctagcttaccgtcttgtggcaactgccctccgtaacaaatacggtaaagagattgtcctccctagttatgaagaaattttatctttagagattcctgaagaatacggagacgttaaatcaaaagcagattttgaa

SEQ ID NO: 4256 - protein, 261 aa, Streptococcus agalactiae
MTYTSLKSPTTKDYKYTLNVAHLYGNLLNTYGDNGNILMMKYVGEKLGCQMTFDIVSLEDRFDPNYYQMAFFGGGQDYEQAIVARDLPSKKEDINKFIQNNGVVLAICGGFQLLGQYYIQANGERIEGIGVMGHYTLNQNNNRYIGDIKIHNDEFNETYYGFENHQGRTFLSEDEKPLGTVIYGNGNNKEDGTEGVHYKNVFGSYFHGPILSRNANLAYRLVATALRNKYGKEIVLPSYEEILSLEIPEEYGDVKSKADFE

SEQ ID NO: 4257 - DNA, 789 bp, Streptococcus pyogenes
atgacatacacttcactaaaatctcccgaaaatcaagattacatctacgacctcactatcgcccatctctatggtaatcttatgaatacttatggtgataacggcaatattttaatgctcaagtatgtcgctgaaaaacttggagctagggttactgttgatattgtgtctatcaatgatacctttgaacaagacgattacgatattgttttctttggtggtggtcaagattatgaacaaagcattgttgccaaggatttgcctagcaaaaaagctgccttagcggattacattgctaataataaagtggtgcttgccatctgtggtggcttccaattactagggcaatactatgtccaagctaatggggttaaaattgatggacttggaattatgggacactacacccttaatcagcaccaaaatcgctttattggagatattaaaattcataatgacgaatttaacgaaacctattatggctttgaaaatcatcaaggacgtaccttcttatctggtgacgaaaagccacttggacgagtggtttatggcaacggtaataataaagaagaccaaactgaaggtgttcactataaaaacgtctatggtagttatttccacggtcctatcttatcacgcaatgttaatcttgcttaccgcttagtaacaacagctcttaaaaaaaagtatggatcagctatttcactacctagctatgatgatatactgaaacaagaaatcactgaagaatatgccgaccttaaaagcaaagcttcctttaataaagtt

SEQ ID NO: 4258 - protein, 263 aa, Streptococcus agalactiae
MTYTSLKSPENQDYIYDLTIAHLYGNLMNTYGDNGNILMLKYVAEKLGARVTVDIVSINDTFEQDDYDIVFFGGGQDYEQSIVAKDLPSKKAALADYIANNKVVLAICGGFQLLGQYYVQANGVKIDGLGIMGHYTLNQHQNRFIGDIKIHNDEFNETYYGFENHQGRTFLSGDEKPLGRVVYGNGNNKEDQTEGVHYKNVYGSYFHGPILSRNVNLAYRLVTTALKKKYGSAISLPSYDDILKQEITEEYADLKSKASFNKV

SEQ ID NO: 4259 - DNA, 987 bp, Streptococcus agalactiae
atgaaatatatcgttaacacgtctaatgatccggcttacaatgttgctttagaagcttacgcctttcaaaagttgacagatatcgatgaaatctttattctttggattaatgaaccggctatcattattggacgccatcaaaatacaattcaagaaattaacaaagagttcattgataaaaatggcatccatgttgtccgtcgtttgtcaggaggcggagcagtttatcatgacttgaataatttaaactacactattatttctaataatacacaagaaggtgcctttgatttccaaactttttcaaaaccagttattgatactcttgctaaattaggtgttaaagcagaatttactggtcgtaatgatttagaaatcaatggacaaaaatttgcaggaaatgctcaagcttattacaaaggtcgtatgatgcatcatggttgtcttttatttgatgttgatatgtcagtcttagggcaagcactcaaagtatctaaagacaaaattgaatctaaagggataaaatctgtacgcgcacgtgttacaaatattgttgaccatctttcagataaaattacagtacaagaatttagcgatgccattttagctcaaatgaaggaagaatatccagagatggatgaatatgttttgagtgatgccgagttatcagaaatccaagctatgcgcgataatcaatttgctacatgggattggacgtatggtaaagcacctgaatacaccattgaacgtggtgtccgctatccagctggaaaaattacgacttatgctaatgttgaaaattcaacgataaaatctgtcaaaatctttggtgacttctttggagtgaaacctgtggatgatattgaaaaaatgttggagggtgtccgctacgattacaaagatgttttagcagcgcttaaaacagttgatacaagtcaatacttctcacgtatgacacccgaagagattacaaaagctattgtagac

SEQ ID NO: 4260 - protein, 329 aa, Streptococcus agalactiae
MKYIVNTSNDPAYNVALEAYAFQKLTDIDEIFILWINEPAIIIGRHQNTIQEINKEFIDKNGIHVVRRLSGGGAVYHDLNNLNYTIISNNTQEGAFDFQTFSKPVIDTLAKLGVKAEFTGRNDLEINGQKFAGNAQAYYKGRMMHHGCLLFDVDMSVLGQALKVSKDKIESKGIKSVRARVTNIVDHLSDKITVQEFSDAILAQMKEEYPEMDEYVLSDAELSEIQAMRDNQFATWDWTYGKAPEYTIERGVRYPAGKITTYANVENSTIKSVKIFGDFFGVKPVDDIEKMLEGVRYDYKDVLAALKTVDTSQYFSRMTPEEITKAIVD

SEQ ID NO: 4261 - DNA, 987 bp, Streptococcus pyogenes
atgaaatacatcgttaacaaaagtcacaatcctgcctttaacatcgctttggaagcctatgcttttagagaactagtggaagaagacgaattgtttatcctttggatcaatgagccagctattattattggcaaacatcaaaataccattcaagaaatcaataaagaatacattgatgaacatggtattcatgttgtgcgacgtttatctggtggtggtgcggtttatcatgatttgaataacttgaactacactatcatttcaaataaaacagcggaaggcgcatttgatttcaaaaccttctcacaacctgtgattgcgactttagctgatttgggtgtaacagccaactttacaggccgtaatgatattgaaattgatggtaaaaaaatctgcggtaatgctcaagcttactacaaaggtcgcatgatgcaccatggttgccttttgtttgatgtggatatgaccgttcttggcgatgctcttaaggtaagtaaggacaagattgagtctaaaggagtgaagtctgttcgtgctcgcgtgaccaatattttaaatgaattaccagaaaaaattaccgttgaggaattttcagataaaatcttggccaagatgaaagaaacgtacccagacatgacagaatatgtcttgtcagaggatgagttggctaagattgaacaatctgccaaagagcaatttggtagctgggattggacctacggcaaagcgccagaatatacgattgaacgcaatgttcgttaccctgcaggtaaaatttcaacctttgcaaatgttgaaaattctatcattaaaaaccttaaaatctatggtgatttctttggaatcaaagatgtgcaagacattgagaacttattaattggttgtaaatatgagtaccgtgatgtttttgaacgtttaaaaacgattgatacgacccagtacttctcacgcatgaccgttgaagaagttgctaaagctattgtttct

SEQ ID NO: 4262 - protein, 329 aa, Streptococcus agalactiae
MKYIVNKSHNPAFNIALEAYAFRELVEEDELFILWINEPAIIIGKHQNTIQEINKEYIDEHGIHVVRRLSGGGAVYHDLNNLNYTIISNKTAEGAFDFKTFSQPVIATLADLGVTANFTGRNDIEIDGKKICGNAQAYYKGRMMHHGCLLFDVDMTVLGDALKVSKDKIESKGVKSVRARVTNILNELPEKITVEEFSDKILAKMKETYPDMTEYVLSEDELAKIEQSAKEQFGSWDWTYGKAPEYTIERNVRYPAGKISTFANVENSIIKNLKIYGDFFGIKDVQDIENLLIGCKYEYRDVFERLKTIDTTQYFSRMTVEEVAKAIVS

SEQ ID NO: 4263 - DNA, 1755 bp, Streptococcus agalactiae
atggcttttgatgtaattatgccaaaacttggggttgacatgcaagaaggcgaaatccttgagtggaaaaaaaatgaaggtgacaccgttaatgaaggtgatgtccttcttgaaatcatgtctgataaaaccaatatggaaatcgaagcagaagacactggtgtacttttaaaaattgtacatcaggcaggagatgttgttcccgtcactgaagtgattgcctatatcggagaagaaggtgaagaagtaggtacgtcatcaccttcagctgatgcaactatcacagctgaagatggtcaatcagtttctggacctgctgctccttcacaagagacagttgcagcagcaactcctaaagaagaacttgcagctgatgagtacgatatcgtagtcgtaggtggtgggcctgcaggttattacgcagcaatccgcggtgctcaacttggaggaaaaattgccattgttgagaaaactgaatttggcggtacgtgtttgaatgttggttgtatccctacaaaaacatatcttaaaaatgctgaaatcctagatggtttgaaagtagcagctggacgtggtatcaaccttgcttcaactaactatgcaattgatatggataagactgttgcctttaaaaattctgtagttaagacactgactggtggtgtacgtggtctcttgaaagcgaacaaagttgaaattttcaatggacttggacaagtaaaccctgataagtctgttgttattggcgataaagttatcaaaggtcgtaacgtcgtccttgcgactggttctaaggtatctcgtattaatattccaggtattgaatcaccattagtattaacatcagatgatattcttgatttacgtgaaattcctaagtcacttgctgttatgggtggtggtgtcgtaggtattgagcttggtcttgtatgggcttcatatggtgttgacgtaactgttattgaaatggctgatcgcatcattccagcaatggataaagaagtatcgctagaacttcaaaaaatccttgctaagaagggaatgaagattaaaacatcagttggtgtttctgaaattgttgaagccaataatcaattaacgcttaaattaaacaacggtgaagaagttgttgctgataaagctcttctttcaattggacgtgttccacaaatgaatggtcttgaaaatcttgagcctgaacttgagatggaacgtggacgtattaaagttaatgcttatcaagaaacttcaattccaggtatctatgcaccaggtgatgttaatggaactcgtatgttagctcatgctgcataccgtatgggtgaagtagctgctgaaaacgcactcggcggtaataagcgtaaagcacatctagatttcactccagcagctgtttatactcatcctgaagtagcaatggtggggatgacagaagagcaagcacgtgaacaatatggtgacatattagttggtaaaaatagctttacaggcaatggtcgtgctatcgcttcaaacgaagcacatggttttgtaaaagtaattgctgaacctaagtataaagagattcttggtgttcacattattggtccagctgcagcggaattgattaatgaagcttctacgattatggaaaatgagttgactgtctacgatgtagcacaatctatccatggtcacccaacattctctgaagttatgtacgaagctttcttagatgttctcggtgaagctattcacaaccctccaaaacgcaaa

SEQ ID NO: 4264 - protein, 585 aa, Streptococcus agalactiae
MAFDVIMPKLGVDMQEGEILEWKKNEGDTVNEGDVLLEIMSDKTNMEIEAEDTGVLLKIVHQAGDVVPVTEVIAYIGEEGEEVGTSSPSADATITAEDGQSVSGPAAPSQETVAAATPKEELAADEYDIVVVGGGPAGYYAAIRGAQLGGKIAIVEKTEFGGTCLNVGCIPTKTYLKNAEILDGLKVAAGRGINLASTNYAIDMDKTVAFKNSVVKTLTGGVRGLLKANKVEIFNGLGQVNPDKSVVIGDKVIKGRNVVLATGSKVSRINIPGIESPLVLTSDDILDLREIPKSLAVMGGGVVGIELGLVWASYGVDVTVIEMADRIIPAMDKEVSLELQKILAKKGMKIKTSVGVSEIVEANNQLTLKLNNGEEVVADKALLSIGRVPQMNGLENLEPELEMERGRIKVNAYQETSIPGIYAPGDVNGTRMLAHAAYRMGEVAAENALGGNKRKAHLDFTPAAVYTHPEVAMVGMTEEQAREQYGDILVGKNSFTGNGRAIASNEAHGFVKVIAEPKYKEILGVHIIGPAAAELINEASTIMENELTVYDVAQSIHGHPTFSEVMYEAFLDVLGEAIHNPPKRK

SEQ ID NO: 4265 - DNA, 1386 bp, Streptococcus agalactiae
atggctgtcgaaattattatgcctaaactcggggttgatatgcaagaaggcgaaatccttgagtggaaaaaacaggtaggtgatgttgttaatgaaggtgacgtcctacttgaaattatgtcagataaaacaaatatggagattgaagcagaagactcaggtgttttactaaaaatcacacatgggaatggagatgttgttcctgtaactgagacaattggttatattggtgctgaaggtgaagaagtaacagaagcatcttcttctgaaaatacatcagttgaagaaaacgcgacacaagtaacttcagaaccagaaaaagttgaagaaacatcagaaccaagtgtgccagcagctacaagtggtgaaaaagtacgtgccactcctgcagctcgtaaattagcaagagagatgtctattgaccttgcactagtatctggaacaggggcaaatggtcgcgttcacagagaagatgttgaaaacttcaagggtgctcaaccacgtattacaccattggcacgtcgaattgctgaagatcaaggagttgatatagcagaaatcactggcagtggtattcgtggtaaaattgttaaaaatgatgttttggctgctatgtcaccgcaagcagcagaggctcctgtagaaactaaagctacaccaacaacagaagaaaaacaattaccagaaggtgttgaagtcattaagatgtctgcaatgcgtaaggctatttctaaaggtatgactaactcttacctcactgctccaagctttacacttaactatgacattgatatgactgaaatgatggctcttcgcaagaaattaattgatccaatcatggctaaaacaggcttgaaagtcagctttactgatttgattggaatggccgttgttaagacattgatgaaaccagagcatcgatacctaaatgcttcattaattaacgatgcacaagaaattgagcttcataattttgttaatattggaatcgcagttggtcttgatgatggtttgattgttcctgttgttcacaatgctgatcaaatgtcactttctgactttgttatagcatctaaagatgttattaagaaaactcaagaaggtaaattaaaatcagctgaaatgtcaggttcaacattctcaattactaacttaggtatgtttggtactaagacgtttaacccaattatcaatcaaccgaactcagcaatccttggagtaggagctactattccgactccaacagtggttgatggtgaaattgtagctcgaccaattatggcaatgtgtttaacaattgaccaccgtattgttgatggaatgaatggtgctaagtttatggttgatcttaagaacttaatggaaaacccatttggtttacttatt

SEQ ID NO: 4266 - protein, 462 aa, Streptococcus agalactiae
MAVEIIMPKLGVDMQEGEILEWKKQVGDVVNEGDVLLEIMSDKTNMEIEAEDSGVLLKITHGNGDVVPVTETIGYIGAEGEEVTEASSSENTSVEENATQVTSEPEKVEETSEPSVPAATSGEKVRATPAARKLAREMSIDLALVSGTGANGRVHREDVENFKGAQPRITPLARRIAEDQGVDIAEITGSGIRGKIVKNDVLAAMSPQAAEAPVETKATPTTEEKQLPEGVEVIKMSAMRKAISKGMTNSYLTAPSFTLNYDIDMTEMMALRKKLIDPIMAKTGLKVSFTDLIGMAVVKTLMKPEHRYLNASLINDAQEIELHNFVNIGIAVGLDDGLIVPVVHNADQMSLSDFVIASKDVIKKTQEGKLKSAEMSGSTFSITNLGMFGTKTFNPIINQPNSAILGVGATIPTPTVVDGEIVARPIMAMCLTIDHRIVDGMNGAKFMVDLKNLMENPFGLLI

SEQ ID NO: 4267 - DNA, 1407 bp, Streptococcus pyogenes
atggcatttgaaattattatgccaaagctgggcgttgacatgcaagaaggcgagatcatcgagtggaaaaaacaagaaggtgataccgtcaatgaaggtgatatccttcttgaaatcatgtcagacaaaaccaatatggaacttgaggcagaagactcaggtgttcttcttaaaattacacgtcaagcaggtgatactgtacctgtaactgaagttatcggttacattggtgcagagggtgaatcagtagatactattgcttcaagtgaaaaaacaacagaaattccagttcctgcttcagcagacgctggaccagcagttgctccaaaagaaaatgtggcaagtccagctcctcaagtggcagcgacagctattccgcaaggaaatggcggaaaagttcgtgctactccagctgcacgtaaggcagcagcagaaatgggcattgaccttggccaagttccaggaacaggaccaaaaggacgtgtccataaagaagacgttgaaaactttaaaggtgctcaaccgaaagcttcaccacttgctcgtaaaattgcagcagacaaaggtattgatttggcaaccgtatcaggtactggctttaacggtaaggtcatgaaagaagacatcatggctattcttgaagcggctaaaccagctgaagcaaaagccccagcagctaaagaagaaaaagttgttgatcttccagaaggtgtggaacacaagccaatgtcagctatgcgtaaggcaatctctaaaggtatgacaaactcttaccttactgcccctacctttacgcttaactacgatattgacatgacagagatgattgcccttcgtaagaagttaattgacccaatcatggctaaaacaggccttaaagtcagctttacagacttgattggtatggcagtggttaaaaccttgatgaaacctgagcatgagtacatgaatgcttccctcatcaatgatgctaatgatattgaattgcaccgctttgtgaaccttggtattgccgtaggtcttgatgatggtcttatcgttcctgttatccatggggctaacaagatgtgcttgtcagatttcgtgcttgcttcaaaagatgtgattaaaaaagcgcaaactggtaagttgaaagcagctgaaatgtctggatcaaccttctctatcacaaacttgggaatgtttggtacgaagacatttaacccaattattaaccaaccaaactcagcaattcttggtgttggagcaactatcccaactccaacggttgtggatggtgagattgtttcccgtccaattatggcaatgtgcctaaccatcgaccaccgtttagttgatggtatgaacggtgcaaaattcatggttgatctcaagaaattgatggaaaatccatttgaattgttaatc

SEQ ID NO: 4268 - protein, 469 aa, Streptococcus pyogenes
MAFEIIMPKLGVDMQEGEIIEWKKQEGDTVNEGDILLEIMSDKTNMELEAEDSGVLLKITRQAGDTVPVTEVIGYIGAEGESVDTIASSEKTTEIPVPASADAGPAVAPKENVASPAPQVAATAIPQGNGGKVRATPAARKAAAEMGIDLGQVPGTGPKGRVHKEDVENFKGAQPKASPLARKIAADKGIDLATVSGTGFNGKVMKEDIMAILEAAKPAEAKAPAAKEEKVVDLPEGVEHKPMSAMRKAISKGMTNSYLTAPTFTLNYDIDMTEMIALRKKLIDPIMAKTGLKVSFTDLIGMAVVKTLMKPEHEYMNASLINDANDIELHRFVNLGIAVGLDDGLIVPVIHGANKMCLSDFVLASKDVIKKAQTGKLKAAEMSGSTFSITNLGMFGTKTFNPIINQPNSAILGVGATIPTPTVVDGEIVSRPIMAMCLTIDHRLVDGMNGAKFMVDLKKLMENPFELLI

SEQ ID NO: 4269 - DNA, 996 bp, Streptococcus agalactiae
atgagcgaaactaaagttatggctttgcgcgaagcgattaatgtcgctatgagcgaagaaatgcgcaaagatgaaaaagtatttttaatgggtgaagatgtaggtgtatatggaggagacttcggtacatctgttggtatgttagaagagtttggtgctaagcgcgttcgcgacacaccaatctcagaggctgcgattgcaggttcagctatcggtgctgcacaaacaggtttgcgtcctatcgttgatttgacattcatggattttgtaacaatcgcaatggatgctatcgttaaccaaggtgctaaaacgaattatatgtttggtggaggtctatcaactccagttactttccgtgtggcatcagggtcaggtattggttcggctgcacaacactcacaatcattagaagcttggttaacacacattccaggtctaaaagttgttgcacctggtactgttaatgagtcaaaagcacttttgaaatcttctattcttgacaataacccagttatcttcttagagccaaaagctctctatggtaagaaagaagaagttaatatggaccctgatttctatattccacttggtaaaggggatattaagcgtgaggggactgacttaacaattgtttcttatggccgtatgcttgagcgtgttatgcaagctgctgaagaagttgctgargaaggtattaacgttgaggttgttgatccacgtacacttattccgcttgataaagaattaattatcgattctgttaagaaaactggtaaattgatcttggttaacgatgcttataaaactggtggtttcactggtgaaattgcaactatggttgctgaaagtgaagcatttgattaccttgatcatcctatcgtgcgtcttgcaagtgaagatgttccagtaccgtattcacgtgtacttgaacaaggaatcttacctgatgtagcaaaaattaaagatgctatctataaagtagttaacaaaggtaaa

SEQ ID NO: 4270 - protein, 332 aa, Streptococcus agalactiae
MSETKVMALREAINVAMSEEMRKDEKVFLMGEDVGVYGGDFGTSVGMLEEFGAKRVRDTPISEAAIAGSAIGAAQTGLRPIVDLTFMDFVTIAMDAIVNQGAKTNYMFGGGLSTPVTFRVASGSGIGSAAQHSQSLEAWLTHIPGLKVVAPGTVNESKALLKSSILDNNPVIFLEPKALYGKKEEVNMDPDFYIPLGKGDIKREGTDLTIVSYGRMLERVMQAAEEVAEEGINVEVVDPRTLIPLDKELIIDSVKKTGKLILVNDAYKTGGFTGEIATMVAESEAFDYLDHPIVRLASEDVPVPYSRVLEQGILPDVAKIKDAIYKVVNKGK

SEQ ID NO: 4271 - DNA, 996 bp, Streptococcus pyogenes
atgtcagaaacaaaattaatggctttgcgtgaagcagtcaaccttgctatgactgaggaaatgcgcaaggacgaaaacattttccttatgggagaagacgtaggggtttacggaggagactttgggacttctgttggaatgattgaagaatttggccctaaacgtgttaaagataccccaatttcagaagctgctatctctggtgcggctattggtgcagctattacaggactacgtccaattgtcgacgttaccttcatggatttccttaccatcatgatggacgctatcgtgaataatggtgctaaaaataattacatgttcggtggaggccttattacccctgtaaccttccgtgtggcatcaggttctggtattggttccgctgcgcaacactcacaatctcttgaggcatggttgactcacattccaggaatcaaagttgttgctcctggtaatgccaacgatgctaaaggcttattaaaatcagctatccgtgataataacattgttcttttcatggaaccaaaagcgctttatggtaaaaaagaagaagttaaccaagatcctgacttctatatcccacttggcaaaggtgacatcaaacgtgaaggaactgatttgacaattgtgtcatacggtcgtatgttggagcgtgttcttcaagcggctgaagaagtagcagcggatggtattaacgttgaagttgttgacccacgtaccctcatcccacttgataaagagttgattattgaatctgttaagaaaacaggtaaattgatgcttgtcaacgatgcctacaagaccggtggattcattggggaaattgcaaccatgattaccgaaagtgaagcctttgattaccttgatcatccaatcgttcgtcttgcaagtgaagatgttccagtaccttatgctcgtgtacttgaacaagcaatcttaccagatgttgagaaaatcaaagctgctattgtgaaaatggcaaacaaaggcaac

SEQ ID NO: 4272 - protein, 332 aa, Streptococcus pyogenes
MSETKLMALREAVNLAMTEEMRKDENIFLMGEDVGVYGGDFGTSVGMIEEFGPKRVKDTPISEAAISGAAIGAAITGLRPIVDVTFMDFLTIMMDAIVNNGAKNNYMFGGGLITPVTFRVASGSGIGSAAQHSQSLEAWLTHIPGIKVVAPGNANDAKGLLKSAIRDNNIVLFMEPKALYGKKEEVNQDPDFYIPLGKGDIKREGTDLTIVSYGRMLERVLQAAEEVAADGINVEVVDPRTLIPLDKELIIESVKKTGKLMLVNDAYKTGGFIGEIATMITESEAFDYLDHPIVRLASEDVPVPYARVLEQAILPDVEKIKAAIVKMANKGN

SEQ ID NO: 4273 - DNA, 978 bp, Streptococcus agalactiae
ttggaggttagaatggtaactctatctaaagaacaacacttggatatgtttctaaaaatgcaacgtattcgtgatgttgatatgaaatttaacaaattggttcgtcgtggtttcgtccaagggatgactcacttctctgttggtgaagaagctgcttcagtaggtgctatccaagatttaacagattcagatatcattttctcaaaccaccgtggacacggacaaactattgcaaaaggtattgatattggtggaatgtttgctgaacttgctggtaaagcaacaggaacatcaaaaggtcgtggaggctcaatgcacttagcaaaccttgaaaaaggtaactatggaacaaacggtatcgtcggtggaggatatgcgcttgcagtaggtgctgcccttacacagcaatatgaaggaactgataacattgttatcgccttttcgggtgactcagcgactaacgagggctcattccatgagtcagttaacttagctgctgtttggaacttaccagttatcttctttatcatcaacaaccgttatggtatctcaacagacatcacatactcaactaaaattcctcacctttacatgcgtgctgatgcgtacggtattccagggcattatgttgaagatggtaatgaccttatggctgtttacgagaaaatgcatgaagttatcaattacgtgcgttcaggaaatggaccagctattgtagaggttgaatcataccgttggtttggtcattcaactgctgatgctggggtataccgtactaaagaagaagttgattcatggaaagctaaagatccagtaaaacgctaccgtgcatacttaattgaaaatgaaatcgctactgaagaagagcttgcagctattgaagcacaagtgattaaagaagttgaagaaggggttaaattcgctgaagaaagtccattccctgatatgtctgttgcatttgaagacgtttttgtggac

SEQ ID NO: 4274 - protein, 326 aa, Streptococcus agalactiae
MEVRMVTLSKEQHLDMFLKMQRIRDVDMKFNKLVRRGFVQGMTHFSVGEEAASVGAIQDLTDSDIIFSNHRGHGQTIAKGIDIGGMFAELAGKATGTSKGRGGSMHLANLEKGNYGTNGIVGGGYALAVGAALTQQYEGTDNIVIAFSGDSATNEGSFHESVNLAAVWNLPVIFFIINNRYGISTDITYSTKIPHLYMRADAYGIPGHYVEDGNDLMAVYEKMHEVINYVRSGNGPAIVEVESYRWFGHSTADAGVYRTKEEVDSWKAKDPVKRYRAYLIENEIATEEELAAIEAQVIKEVEEGVKFAEESPFPDMSVAFEDVFVD

SEQ ID NO: 4275 - DNA, 978 bp, Streptococcus pyogenes
atggaggccgaaatggtaacagtttctaaagaacaacatttagatatgttccttaaaatggaacgtattcgtgaatttgattcacgtattaataaactcgtccgtcgtggatttgtacaagggatgactcacttctcagttggtgaagaagcagccaatgttggagcggtggctcacttgtcttacgatgacattattttttcaaatcaccgtggacatggacaatcaatcgctaaagacatggaccttaataaaatgatggctgagcttgctggtaaagcaactggtgtgtctaaagggcgtggtggctcaatgcacttggctgattttgaaaaaggaaactatggtactaatggtatcgttggtggtggttacgctcttgcagttggtgctgccctcactcaacaatacaaaggaactaacaatatagctgttgctttctcaggtgatggcgctactaacgaaggatcattccacgagtctgttaatatggctgcaacatggaaacttcctgttattttcttcatcatcaacaaccgttatggaatttcaatgagcatcaataatgcaacaaatacaccacacttatacacacgtgcagaagcttacggagttcctggtttctactgtgaagatggcaatgacgtgatggctgtctatgaaacaatgggcaaagccgttgaacatgttcgtggtggaaatggtccagctattgttgaggtagaatcataccgttggtttggtcactcgactgcagatgctggtaaataccgtactaaagaagaagtggatgagtggaaagaaaaagatccaatgatcaaatatcgtacttatctgacaagcgaaggcattgccactgatgacgaattggatgctattcaagcacaagtcaaaaaagaagttgacgatgcttatgaatttgcacaaaacagtccagatccagaactttcagtagccttcgaagacgtttgggttgac

SEQ ID NO: 4276 - protein, 326 aa, Streptococcus pyogenes
MEAEMVTVSKEQHLDMFLKMERIREFDSRINKLVRRGFVQGMTHFSVGEEAANVGAVAHLSYDDIIFSNHRGHGQSIAKDMDLNKMMAELAGKATGVSKGRGGSMHLADFEKGNYGTNGIVGGGYALAVGAALTQQYKGTNNIAVAFSGDGATNEGSFHESVNMAATWKLPVIFFIINNRYGISMSINNATNTPHLYTRAEAYGVPGFYCEDGNDVMAVYETMGKAVEHVRGGNGPAIVEVESYRWFGHSTADAGKYRTKEEVDEWKEKDPMIKYRTYLTSEGIATDDELDAIQAQVKKEVDDAYEFAQNSPDPELSVAFEDVWVD

SEQ ID NO: 4277 - DNA, 1932 bp, Streptococcus agalactiae
ttgaaggtatgctataataaaactatgattatactacaaggaaacaaaattgagcgctcattttcaggtgatgtgctttttgataatattaatattcaagttgatcaacgtgatcgtattgctcttgttggacgtaatggtgctggcaaatcaacgcttcttaaaattttagttggtgaagaggctccgacaaaaggagaaataaataaaaagcgtgatttgagtttgtcctacttggcacaagatagtcgttttcaatctgaaaatacaattttccaagaaatgttacaagtttttgactcattaagagaagtagagaagcgcttacgtgaattggaattacaaatggggcaagtttcaggaagtgacctggaacaattgatgaaaacatacgatattttgtcagaagagtttcgtgaaaaaggtggctttacctatgaatcagatataaaggctattttaaatggttttaagtttaacagtgatatgtgggaaatgcctattagtgaattgtctggcgggcaaaatacacgattagcgcttgcaaaaatgctacttgaaaagccagaattacttgttttagatgaaccaacgaaccatttagacattgatacgattgcttggttagaaaattatcttgtaaattatcaaggagcccttattattgtcagccatgaccgctattttttagacaaggtagctacagtaacttatgatttaacgacacattctctagaccgctatgtaggcaattattcgaaatttatggatcttaaggcagagaaaatagcgactgaagaaaagaattttgaaaaacaacaaaaagaaattgctaagttagaagattttgtacaacgtaacattgttagggcttcaaccactaaacgagcacaagctcgtcgtaaacaattagaaaagatggaacgactcgacaaaccgaatgtagagcaaaaatcagctaatatgacttttcatgctgggaaagtctcagggaatgttgttttaacacttgagaatgcagctattggttatgaaggtgtttctttatcggagccaatcgatttggacgtgaagaaatttgatgctattgcaattgtaggtccaaatggtatcgggaaatcaactttaatcaaatcgcttgttgggcaaattccttttatcaaaggagaagcaaaattaggagcaaatgtcgaaactgggtattacgatcaaagtcaaagtaatttaacaaaaacgaatactgttttagatgagttatgggatgctttttcaacaacgccagaagttgaaattagaaaccgtttaggagcttttcttttttcaggtgatgatgttaaaaaatcagtttcaatgctatcaggtggtgaacgagcgcgtttgctattggcaaaattatctatggaaaataataattttctcatattagatgagccaacaaaccacttggatattgatagtaaagaagtcttagaaaatgcactcatcgaatttgatggcacattactttttgttagtcatgatcgctattttattaatcgtgtggcaactaaggttctcgaaatttctgataagggaagtactctctatctaggagattatgattattacctcactaagaaagccgaactagaggaattagcacgtttaaatgaagaagaagtgagtgcttcaaaaacagaaatcgacgttacatcagattatgagacacaaaaagcaaatcaaaaggaatttaggaaaattacccgtcgcgttgtagaaattgaggcgcgtttggaagttcttgaaaatgatgaaaacaatatcaatggtttaatgttagaaaccaatgacatcggaaaactctctgatttgcaaaaagagctggaatcaatccaagaagaacaattgctattaatggaagagtgggaaaatctaaatatgagactagatttg

SEQ ID NO: 4278 - protein, 644 aa, Streptococcus agalactiae
MKVCYNKTMIILQGNKIERSFSGDVLFDNINIQVDQRDRIALVGRNGAGKSTLLKILVGEEAPTKGEINKKRDLSLSYLAQDSRFQSENTIFQEMLQVFDSLREVEKRLRELELQMGQVSGSDLEQLMKTYDILSEEFREKGGFTYESDIKAILNGFKFNSDMWEMPISELSGGQNTRLALAKMLLEKPELLVLDEPTNHLDIDTIAWLENYLVNYQGALIIVSHDRYFLDKVATVTYDLTTHSLDRYVGNYSKFMDLKAEKIATEEKNFEKQQKEIAKLEDFVQRNIVRASTTKRAQARRKQLEKMERLDKPNVEQKSANMTFHAGKVSGNVVLTLENAAIGYEGVSLSEPIDLDVKKFDAIAIVGPNGIGKSTLIKSLVGQIPFIKGEAKLGANVETGYYDQSQSNLTKTNTVLDELWDAFSTTPEVEIRNRLGAFLFSGDDVKKSVSMLSGGERARLLLAKLSMENNNFLILDEPTNHLDIDSKEVLENALIEFDGTLLFVSHDRYFINRVATKVLEISDKGSTLYLGDYDYYLTKKAELEELARLNEEEVSASKTEIDVTSDYETQKANQKEFRKITRRVVEIEARLEVLENDENNINGLMLETNDIGKLSDLQKELESIQEEQLLLMEEWENLNMRLDL

SEQ ID NO: 4279 - DNA, 1905 bp, Streptococcus pyogenes
atgattattttacaaggaaacaagttagaacgctctttctcaggagatgttctttttcaaaacatatcactacaagttgatgaacgtgaccgcattgccttggttggtcctaatggagctggcaagtcgactttactaaaattattggttggggaagaaaccccaacgagcggagaagttaatactaaaaaagacctaaccttgtcttatctggctcaaaatagccgttttgaatcagatcaaacaatatatgaggaaatgctcaaggttttcgaagcattacgccaagatgaaaagcgcctgcgtcagatggaaatggatatggcaaccgtttcaggtcaagttttaacccgactgatgacagattatgatctgcttacagagcattttcgtcagcaaggcggctttacgtatgaatctgacatcaaagccattttaaatgggtttaagtttgatgagagcatgtggcagatgactatcgctgagctgtcagggggtcaaaatactcgtctggccttggctaaaatgcttttagaaaagccagaactattggtccttgatgagccaacaaaccacttagatattgaaaccattgcctggttagagaactacttggccaactatcaaggagctctaatcattgtgagtcacgaccgttattttctggacaaagtggcgaccgtgactttagatttgacgcctaacggcttagatcggtatagtggtaactattctcgttttatggccttaaaagctgaaaaactagtagccgaagaaaaacagttcgataaacaacaaaaagaaattgccaagctagaagattttgttcaaaaaaacattgtcagggcctctaccacaaaaagggctcaggctaggcgtaagcaattggaaaaaatagagcgtttggacaaacccacaggtgggcgtaaatctgctcatatgacatttcatgcagaaaaaccatcaggaaatgttgtgctaagagttgaggaagcagccatcggttatggagaccaagtcttgtccgaacctattaatgtagatatcaataagttggatgctattgccgttgtagggccaaatggtattggtaaatcaaccttgatcaagtcgattattggacaattgcctttgctcaaaggacaactcaagtatggtgccaatgtcgaaacaggttattatgaccaaacccaatcacatttgacgtctagcaacacagttttggaagaattatggcaggatttttcaactacgccagaagtcgatatcagaaaccgattaggggcttttctcttttctggagatgatgtcaaaaaatcggtggctatgctgtcaggtggagaaaaagcccgtctgcttcttgcgaagttatctatggaaaacaataattttcttgttctggacgagccgactaaccacctagacattgacagtaaagaagtgctagagaatgccctcattgactttgacggtaccttgctttttgtcagccacgaccgctatttcattaatcgtttggcaactaaggttttggaaattaccgaaaatggctcaaccctttacttaggtgactatgattattaccttgagaaaaaggcagagctagaagaattagcccgcctagcagcaggagagacagttgaggaaacaaaagaagcctctgccactgattatcagctacaaaaagctaatcaaaaagagcgtcgtcgcttgacccgccgatatgaggagattgaagcaagacttgaaaccattgaagagcgtattggtgctattcaagaagacatgcatgcctccaatgatacggcgcagttaatcgcttggcaaaaggaatgggaccaattggatcaagaacaagaagctcttatggaagaatgggaaaccatcgctgaacaaatagaatca

SEQ ID NO: 4280 - protein, 635 aa, Streptococcus pyogenes
MIILQGNKLERSFSGDVLFQNISLQVDERDRIALVGPNGAGKSTLLKLLVGEETPTSGEVNTKKDLTLSYLAQNSRFESDQTIYEEMLKVFEALRQDEKRLRQMEMDMATVSGQVLTRLMTDYDLLTEHFRQQGGFTYESDIKAILNGFKFDESMWQMTIAELSGGQNTRLALAKMLLEKPELLVLDEPTNHLDIETIAWLENYLANYQGALIIVSHDRYFLDKVATVTLDLTPNGLDRYSGNYSRFMALKAEKLVAEEKQFDKQQKEIAKLEDFVQKNIVRASTTKRAQARRKQLEKIERLDKPTGGRKSAHMTFHAEKPSGNVVLRVEEAAIGYGDQVLSEPINVDINKLDAIAVVGPNGIGKSTLIKSIIGQLPLLKGQLKYGANVETGYYDQTQSHLTSSNTVLEELWQDFSTTPEVDIRNRLGAFLFSGDDVKKSVAMLSGGEKARLLLAKLSMENNNFLVLDEPTNHLDIDSKEVLENALIDFDGTLLFVSHDRYFINRLATKVLEITENGSTLYLGDYDYYLEKKAELEELARLAAGETVEETKEASATDYQLQKANQKERRRLTRRYEEIEARLETIEERIGAIQEDMHASNDTAQLIAWQKEWDQLDQEQEALMEEWETIAEQIES

SEQ ID NO: 4281 - DNA, 1407 bp, Streptococcus agalactiae
atgttagtaatttccaagaaagagagagactttatgtctattacaaaagaatttgataccatcgcagctatttcaactcctctcggtgagggagctattggtattgtccgtatatctggtacagatgccttaaagatagcatcaaaaatttatcgtggaaaagatctatccgcgatccaatcccataccttaaactatggtcatattgtggacccagataaaaatgaaatcttggatgaagttatgttaggcgttatgcttgctccaaaaacattcacaagagaagatgttattgaaattaatacgcatggaggaattgcagttactaacgaaattcttcagttaattttacgacatggagcacgaatggctgaaccaggagaatttactaaacgtgcttttttaaatggtcgagttgacttgactcaggctgaagctgttatggatcttattagagctaaaacagataaagcaatggatattgccgttaagcaattagatggttctttaaagacactaatcaataacactcgacaagaaattttaaatactctagcccaagttgaagttaatatcgattaccctgaatatgatgacgttgaagagatgactacaacactgatgcgtgaaaaaacacaagagtttcaagcacttatggaaaatttacttcgaactgccagacgtggaaaaattcttcgagaaggactttcaacagcaatcattggtcgtccaaatgtcggtaaatccagcttactaaataacctcttacgtgaagaaaaggcgattgtgacagatattgaaggaacaactcgtgatgttattgaagaatacgtcaatattaaaggagttcctttaaaactagttgacactgctggtatccgtgatacagatgatatcgttgaaaaaattggtgttgaacgttcaaagaaggctttagaagaagccgaccttgtgttgttggttctcaatagttccgaaccactaacattacaagaccgctcccttctagaactaagtaaagaaagtaatcgtatcgtattactcaataaaacggatcttcctcaaaaaatagaagttaacgaattacctaaaaatgttattccaatttcggttttagaaaatgaaaacatcgataaaatcgaagaacgtattaacgatattttctttgacaacgctggtatggtagaacatgacgctacttatctatcaaatgctcgccatatctcactaattgaaaaagccgttgatagtttaaaagctgtcaatgagggcttggaattaggaatgcctgttgatctcttacaagtcgatatgactagaacttgggaaatacttggagaaatcactggggatgcagctccagatgaactaataactcagctcttcagccaattctgcttaggtaaa

SEQ ID NO: 4282 - protein, 469 aa, Streptococcus agalactiae
MLVISKKERDFMSITKEFDTIAAISTPLGEGAIGIVRISGTDALKIASKIYRGKDLSAIQSHTLNYGHIVDPDKNEILDEVMLGVMLAPKTFTREDVIEINTHGGIAVTNEILQLILRHGARMAEPGEFTKRAFLNGRVDLTQAEAVMDLIRAKTDKAMDIAVKQLDGSLKTLINNTRQEILNTLAQVEVNIDYPEYDDVEEMTTTLMREKTQEFQALMENLLRTARRGKILREGLSTAIIGRPNVGKSSLLNNLLREEKAIVTDIEGTTRDVIEEYVNIKGVPLKLVDTAGIRDTDDIVEKIGVERSKKALEEADLVLLVLNSSEPLTLQDRSLLELSKESNRIVLLNKTDLPQKIEVNELPKNVIPISVLENENIDKIEERINDIFFDNAGMVEHDATYLSNARHISLIEKAVDSLKAVNEGLELGMPVDLLQVDMTRTWEILGEITGDAAPDELITQLFSQFCLGK

SEQ ID NO: 4283 - DNA, 1374 bp, Streptococcus pyogenes
atgagtataactaaagaatttgatacaattaccgccatttcaacccctcttggtgaaggagctattggcattgttcgtttatcagggacagatgcgcttgccattgcacaatctgtttttaagggaaagaacttagagcaagtcgcctcacacaccattaactatggccatatcattaatcctaagacaggaactattatcgatgaagttatggtgtcagtcatgctagcccccaaaacctttacccgtgaaaatgtggttgaaatcaatacgcacggtggtattgctgtgacaaatgaaatcttgcaactattgattcgccaaggcgctagaatggcagagcctggcgaattcaccaaacgtgccttcttaaatgggcgagttgatttgactcaagctgaggctgtcatggacattattcgtgccaaaacagacaaggctatgacgattgcagtcaagcaactggatggctccctttcccagcttatcaatgacacccgtcaggaaattctcaacaccttagctcaagtcgaagtcaatattgactaccctgaatacgacgatgtggaagaaatgaccactgctctgctacgtgagaaaacacaagaattccaaagccttttggaaagtctccttcgaacagctaaacgcggtaaaattctgcgtgagggcttatcaacagctattattggtcgtccaaacgtcggtaagtcaagcttacttaataatttgttgcgagaagacaaggctattgtgactgatattgcaggaaccacccgagatgtcattgaagaatacgttaatatcaagggagttcctctaaaacttgtcgatacggccggtattcgtgagacagatgatctggtcgaacaaatcggagttgaacggtctaaaaaagctcttcaagaagctgaccttgttcttcttgtgctgaatgcttctgaaaaactgactgaccaagaccgggctttgttaaatctcagtcaggacagtaaccgtattatattgttgaataaaacggatttggaacagaagattgaattagagcaattaccagatgactacattcccatttccgttttaaccaaccagaacattaatctaatcgaagatcgtatcaaccagcttttctttgacaacgctggtttggtagagcaagatgccacttacctgtcaaatgcccgccacatttctttgattgaaaaggcagtccagagtttagaagctgtcaatgacggtttggcgcttggcatgccagttgatttactacaggttgatttaaccagaacttgggaaattctcggagaaatcacaggggatgctgctcctgatgaactcattacccaactctttagtcaattctgtcttggtaaa

SEQ ID NO: 4284 - protein, 458 aa, Streptococcus pyogenes
MSITKEFDTITAISTPLGEGAIGIVRLSGTDALAIAQSVFKGKNLEQVASHTINYGHIINPKTGTIIDEVMVSVMLAPKTFTRENVVEINTHGGIAVTNEILQLLIRQGARMAEPGEFTKRAFLNGRVDLTQAEAVMDIIRAKTDKAMTIAVKQLDGSLSQLINDTRQEILNTLAQVEVNIDYPEYDDVEEMTTALLREKTQEFQSLLESLLRTAKRGKILREGLSTAIIGRPNVGKSSLLNNLLREDKAIVTDIAGTTRDVIEEYVNIKGVPLKLVDTAGIRETDDLVEQIGVERSKKALQEADLVLLVLNASEKLTDQDRALLNLSQDSNRIILLNKTDLEQKIELEQLPDDYIPISVLTNQNINLIEDRINQLFFDNAGLVEQDATYLSNARHISLIEKAVQSLEAVNDGLALGMPVDLLQVDLTRTWEILGEITGDAAPDELITQLFSQFCLGK

SEQ ID NO: 4285 - DNA, 915 bp, Streptococcus agalactiae
atgatagtcgaacaaaaatttggaaatggttttacttggattaacattgaagcagagcaattgcgaacagaaacatcggaaattcaagcaaaatatttggatagtgagattattacatatgctctggatgattatgaacgagcctttatggaatgttctcatattaaaggaaaagaagtcttgacgattatttttaatactattgatctaaagcagaaagaaagttattatgagaccgttccgatgaccttttgcttatcacacgaccgtttgataacggtgacacggtctcgaaatagttatatgctagaactattgcaaaaatatctagaccgtaatccagatgtctctcctaaaaaatttttatttgcagctttaactttgattacaaaacaatattttaatgttgtatcgaaaattgatagagaaaaggatattctcaaccgtcaattgagagaacaaacaaccaataagcgcttattagccatgagtgacctagagacaggatccgtttatcttttgacagctgccaatcaaaatgcattggtattagagcaattagatgttcatcctagtcagcgatttaattctgaagtggaaaaagaacagttatcagatgctctcattgaagcgcatcagttagtcagtatgacacaattaaacagtcaggtactttcacaattatcatctacttttaataatgtcttaaataataacttgaacgaaaacttaacaggtttgaatatcatttcgattaatttagcgattattgcagcaattactggcttttttgggatgaatattccattacctcttacagaatcacggagttcatggttaattgttattgctacttcggtcttactttgggttattattgctcaaattttaaaacgagtttttaacttaagaaaa

SEQ ID NO: 4286 - protein, 305 aa, Streptococcus agalactiae
MIVEQKFGNGFTWINIEAEQLRTETSEIQAKYLDSEIITYALDDYERAFMECSHIKGKEVLTIIFNTIDLKQKESYYETVPMTFCLSHDRLITVTRSRNSYMLELLQKYLDRNPDVSPKKFLFAALTLITKQYFNVVSKIDREKDILNRQLREQTTNKRLLAMSDLETGSVYLLTAANQNALVLEQLDVHPSQRFNSEVEKEQLSDALIEAHQLVSMTQLNSQVLSQLSSTFNNVLNNNLNENLTGLNIISINLAIIAAITGFFGMNIPLPLTESRSSWLIVIATSVLLWVIIAQILKRVFNLRK

SEQ ID NO: 4287 - DNA, 243 bp, Streptococcus agalactiae
atgccgacaagttgctgggtgagaaactgttttaaatcatctgattctgcggatttcaaagactcgtttattttcttttctaaacgttctttgagctcacctgccgcttttactgtaaatgttgagataaacaaagagtcaatcggaacccctcttaaaagtttatctaaaatccgctcaaccattacaaaagtctttccagaaccagccgaagctgataccaggacattgttaccaaaagta

SEQ ID NO: 4288 - protein, 81 aa, Streptococcus agalactiae
MPTSCWVRNCFKSSDSADFKDSFIFFSKRSLSSPAAFTVNVEINKESIGTPLKSLSKIRSTITKVFPEPAEADTRTLLPKV

SEQ ID NO: 4289 - DNA, 3624 bp, Streptococcus agalactiae
atgatgacctttaagcctttcttaaatccagaagatattgctgttattcagacagaagaaaaaaattctgataaaaaacaaaagcgaacgcctgaacaaattgaagccatttatacttttggtaacaatgtcctggtatcagcttcggctggttctggaaagacttttgtaatggttgagcggattttagataaacttttaagaggggttccgattgactctttgtttatctcaacatttacagtaaaagcggcaggtgagctcaaagaacgtttagaaaagaaaataaacgagtctttgaaatccgcagaatcagatgatttaaaacagtttctcacccagcaacttgtcggcattcaaacagctgatattggtactatggatgcttttacgcaaaaaatagttaaccaatatggttatactttgggcatatcacctatatttaggattttacaagataaaaatgagcaagacgtcataaagaatgaggtctatgctgatttattttctgactacatgactgggaagaatgcagcttcattcataaaattagtcaaaaatttctcaggtaatcgtaaagatagcaaagcttttcgagaaatggtttataaagtttatgcttttagccagtccaccgataaccccaagcgctggatgcaaacagtttttctaaaaggtgcacaaacttacactgattttgaagctattccagatcaagaagtttcaagccttttaaatgtaatgcaaacaactgctaatcaattacgtgatttaacggatcaagaagattataagcaattaactgctaaaggggttccgacagcaaattacaaaaaacaccttaaaataattgaaaatttagtccattggtctcaagactttaatttgctgtatggaaaaaaaggattgactaatttggcacgtgatatcactaatgtgattccttcaggcaatgatgttacagttgctggcgttaaatatcctatctttaaacaattgcataatcgtatcgttggacttaagcacttagaagttatttttaagtatcaaggagaatctcttttcttgttagaattattgcaatcctttgttttagatttctcagaacaatatttacaggagaagattcaagaaaatgcttttgaattttctgatattgcccattttgcaattcaaatattggaagaaaatcatgatattaggcaactttatcaagataagtatcatgaagtaatggttgatgagtatcaggacaataaccatacccaagagagaatgttagaattattgtctaatggacataatcgtttcatggttggagacataaaacaatcaatttaccgttttcgtcaggctgatccacaaatttttaatgataaatacaaagcttaccaagacaatccaagtcaagggaaattaattattctgaaagagaattttcggagtcaatcagaggttttagacagtacaaatagtgtgtttacacatcttatggatgaagaagtaggagacattctttatgatgaaagtcaccaattaaaagctggtagtccaagacagcaagaaagacatccgaataataaaacacaagttttactattagatactgatgaagatgatatagatgacagtgatagtcaacaatatgatattagcccagctgaagcaaagttagtcgcaaaagaaattattcgattgcataaagaagagaatgttccctttcaagatatcaccctcttagtttcttcaaggacaaggaatgatggtatcttacaaacttttgaccgttatggtattcctttggtaactgacggtggggagcaaaattacttaaaatcagtcgaagtgatggtaatgcttgatactttgcggtcaattgataatcccttaaatgattatgctctagttgctcttttgagatctcccatgtttggctttaatgaagatgatttaacaagaattgctattcaggatgtcaaaatggctttttatcataaagtgaaattgtcttatcataaagaaggtcatcatagtgatttaattactccagaattatcttctaaaatagatcactttatgaaaacattccagacttggcgtgattttgctaaatggcattcgctttatgatttaatatggaaaatatataatgaccgtttttattatgattatgtaggagctctgcctaaagctgagcaacgtcaagccaatctatatgccttggcacttcgagcaaatcagtttgaaaaaacaggtttcaagggtttatcacgctttattcgaatgattgataaagttttagaaaatgaaaatgatttggcagatgttgaggtggcattaccgcaaaatgctgttaacctaatgactatacacaaatcaaaggggcttgagtttaagtatgtatttattttaaatattgataagaaattttcaatggtagacataacttcccctcttattttaagccgaaatcaaggaattggtattaaatatgttgctgatatgcgacatgaactcgaagaagagatactgcctgcagtaaaggttagcatggaaacacttccttaccaacttaataaaagagagttacgcttagctactttatcagagcaaatgcgtttactttacgtagctatgacacgtgcagagaaaaaattatatctggttggtaaggctagtcaaaccaaatgggctgatcattatgacttagtatctgaaaataatcatctcccattagctagtcgtgagacttttgtgacctttcaagattggttactggctgttcatgaaacctataagaaacaagagttgttttatgacatcaacttcgtatcattagaggaattaacagatcaccacatagggatggttaaccctagtctacctttcaatcccgataataaggtagagaatcgtcagtctgaagatatcgtgcgtgcgattagcgtgttagaatctgttgagcagattaatcaaacttataaagcggctattgagttaccgacagtgagaacaccaagtcaagtcaaaaaaatctatgagcctattctagatatagaaggtgttgatgtgatggaaactattactaaaacatcagtagattttaagttacctgatttttctacaagtaaaaagcaagacccagcagctttaggatctgctgtacatgaattaatgcaacgcatagagatgtcatctcatgtcaaaatggaagatattcaaaaagctttgacagaagtgaatgctgaaacaagtgtcaaagcggctattcagattgaaaaaatcaactattttttccaagaaacctcactcggtaagtatatacaagaagaagtagaacatctgcatcgagaggcaccttttgccatgttaaaagaagatccggagagtggtgagaaattcgttgtacgtggtattattgatgggtatctactattagaaaatcggataattctatttgattataagactgataaatttgtcaatcctctagaattaaaagaacgctatcagggacaaatggctttatatgcagaagctttaaaaaaatcttacgagatagaaaagatagacaaatacttaattcttttaggtggtaaacagctagaagtggtaaaaatggat

SEQ ID NO: 4290 - protein, 1208 aa, Streptococcus agalactiae
MMTFKPFLNPEDIAVIQTEEKNSDKKQKRTPEQIEAIYTFGNNVLVSASAGSGKTFVMVERILDKLLRGVPIDSLFISTFTVKAAGELKERLEKKINESLKSAESDDLKQFLTQQLVGIQTADIGTMDAFTQKIVNQYGYTLGISPIFRILQDKNEQDVIKNEVYADLFSDYMTGKNAASFIKLVKNFSGNRKDSKAFREMVYKVYAFSQSTDNPKRWMQTVFLKGAQTYTDFEAIPDQEVSSLLNVMQTTANQLRDLTDQEDYKQLTAKGVPTANYKKHLKIIENLVHWSQDFNLLYGKKGLTNLARDITNVIPSGNDVTVAGVKYPIFKQLHNRIVGLKHLEVIFKYQGESLFLLELLQSFVLDFSEQYLQEKIQENAFEFSDIAHFAIQILEENHDIRQLYQDKYHEVMVDEYQDNNHTQERMLELLSNGHNRFMVGDIKQSIYRFRQADPQIFNDKYKAYQDNPSQGKLIILKENFRSQSEVLDSTNSVFTHLMDEEVGDILYDESHQLKAGSPRQQERHPNNKTQVLLLDTDEDDIDDSDSQQYDISPAEAKLVAKEIIRLHKEENVPFQDITLLVSSRTRNDGILQTFDRYGIPLVTDGGEQNYLKSVEVMVMLDTLRSIDNPLNDYALVALLRSPMFGFNEDDLTRIAIQDVKMAFYHKVKLSYHKEGHHSDLITPELSSKIDHFMKTFQTWRDFAKWHSLYDLIWKIYNDRFYYDYVGALPKAEQRQANLYALALRANQFEKTGFKGLSRFIRMIDKVLENENDLADVEVALPQNAVNLMTIHKSKGLEFKYVFILNIDKKFSMVDITSPLILSRNQGIGIKYVADMRHELEEEILPAVKVSMETLPYQLNKRELRLATLSEQMRLLYVAMTRAEKKLYLVGKASQTKWADHYDLVSENNHLPLASRETFVTFQDWLLAVHETYKKQELFYDINFVSLEELTDHHIGMVNPSLPFNPDNKVENRQSEDIVRAISVLESVEQINQTYKAAIELPTVRTPSQVKKIYEPILDIEGVDVMETITKTSVDFKLPDFSTSKKQDPAALGSAVHELMQRIEMSSHVKMEDIQKALTEVNAETSVKAAIQIEKINYFFQETSLGKYIQEEVEHLHREAPFAMLKEDPESGEKFVVRGIIDGYLLLENRIILFDYKTDKFVNPLELKERYQGQMALYAEALKKSYEIEKIDKYLILLGGKQLEVVKMD

SEQ ID NO: 4291 - DNA, 3666 bp, Streptococcus pyogenes
gtgctttttaacattaatgagaaaggagagccacttgtgatttcttttgccccatttttaagccccgaagctattaaacatttgcaagaaaacgaaaggtgcagagatcagtctcaaaaacgcacagctcaacaaattgaagcaatttatactagtggccaaaatatacttgtatcagcttctgctggttcaggaaaaacctttgtaatggtcgaacgcatacttgataaaattttgagaggtgtttcaattgatcggctttttatctcaacctttactgttaaagcagctacagaactgcgtgagcggattgaaaacaaattatactcacaaattgctcaaactacagattttcaaatgaaagtttatttaacagaacaattgcaatctctttgtcaagctgatattggtactatggatgcttttgcacagaaagtagtaagtcgctatggttatagcattggcatttcatcccaatttcgtatcatgcaggataaagcagaacaagatgttttaaagcaagaggtgtttagcaaactctttaatgagtttatgaatcaaaaagaggcaccggtgtttagggctcttgtgaaaaatttttctggtaactgtaaagacacttcagcttttagagagttagtttatacttgttattcttttagccaatcgacagaaaacccaaaaatatggttgcaagaaaattttctaagcgctgctaaaacttaccaaagacttgaagatatcccggatcatgatattgaactcttacttttggcaatgcaagacactgcaaatcagctaagagatgtgactgatatggaagattatgggcagctgactaaggcaggtagccgatctgctaaatacactaaacacttaacgatcatagaaaagttgtctgattgggtgcgtgattttaaatgtttgtatggaaaagccggattggatcggttgatcagagatgtgacaggccttataccatctgggaatgatgttacagtctcgaaggtaaaataccctgtttttaagaccttgcatcaaaaattaaaacaatttaggcatttagaaacaattttaatgtatcagaaagactgtttttccttattggaacagttacaagattttgtgcttgcgttttcagaagcttatttagctgtcaaaatacaagaaagtgcttttgaattttcagatattgcacactttgcaatcaaaattttagaggaaaatacggatattcgccaatcctatcagcaacactatcatgaggtgatggttgatgaatatcaagataacaatcatatgcaagagcgactcctgaccttactatcgaacggtcataatcgctttatggtaggagatatcaaacaatcgatctatcgatttcggcaagccgatcctcagatttttaatcaaaagtttagagactatcaaaaaaaacctgagcaggggaaagtgattttactcaaagaaaactttcgtagccaatcagaggtgttaaatgtcagcaatgctgtttttagtcacttaatggacgaatcagtaggagacgtcttatacgatgagcaacatcagttaatagcaggtagtcatgctcaaacagtcccctatctagaccgtcgtgctcagttattgctatataatagcgataaagatgatggcaacgccccttcagatagtgagggtatttcatttagtgaggttacaattgttgccaaagaaattattaagcttcacaatgataagggtgtcccttttgaagacattacgttactcgtttcttcaagaacaagaaatgatatcatttctcatacattcaatcaatatggtattcctatagcaacagatggtgggcagcaaaactatcttaaatctgttgaagtgatggttatgttagatacattacgcaccattaataacccaagaaatgattatgcccttgtggctttactgcgctcaccgatgtttgcctttgatgaggatgatttagcaagaatagcacttcaaaaagacaatgagctagataaagattgcctatatgacaagatacaaagggctgtgattggaagaggtgctcatcctgaattgattcacgataccttgcttggcaagttaaatgtttttttaaagacgttgaaaagctggcgtcgatacgctaagctagggtcgttgtatgacttgatttggaaaatttttaatgatcgtttttattttgattttgtagctagtcaagcaaaagcagaacaagcacaagctaatctatacgcattagctctacgtgctaatcagtttgaaaaatcgggctataaagggctataccgttttattaaaatgattgataaggtacttgagacgcaaaatgacttagctgatgtggaagtggctactcctaaacaagctgttaatttaatgaccattcacaagtctaaaggtttacaatttccgtatgtatttatccttaattgtgacaagcgcttctcaatgacagatattcataaatcatttattctgaatcggcagcacggtatcggtatcaagtaccttgcagatatcaaaggtttacttggtgaaacaacactcaattctgttaaagtaagcatggaaaccttaccttatcaattgaacaaacaagagttgcgcttagcaactttatcagaagaaatgcgcttactgtatgttgctatgacacgagctgaaaaaaaagtttattttattggtaaagctagtaagagcaaaagtcaagaaatcacagatcctaaaaagttaggcaaacttttgccgctggctttacgagaacagttattgacattccaagattggctattagcaatagcagatatattttcaactgaagatctttattttgatgttcgctttattgaagatagtgatttgacacaagagtcagtcggacgacttcaaacaccacagttattaaatccagatgatcttaaagataatcgtcaatcagaaacaattgcacgggctttagatatgttagaagcagtgtctcaattgaatgccaattatgaagcagctattcatttgccaacagttcgaacgcctagccaacttaaggcaacttacgagcctttattagaacccattggtgtagatattatagagaaatcttctcgatcgctatctgattttactttgccacatttttcaaaaaaagcaaaagttgaagcaagtcatattggatcagctcttcatcagttgatgcaggtgctccctttgtcaaaaccgataaatcaacaaacgcttttagacgctttaagaggaattgatagtaacgaagaggtaaaaacagctcttgatctcaaaaaaatagagtcgttcttttgtgatacaagcctaggccaattttttcagacttaccaaaaacacttgtatcgagaagcgccatttgctattttaaaacttgaccctatcagtcaagaagagtatgtcctacgtggtattatagatgcctactttttgtttgatgatcatattgtattagtggactataaaacagataaatacaagcagcccattgagttaaaaaagcgttaccaacaacagttggagttatatgcagaagctctcactcaaacgtataaacttcctgtgactaagcgctatcttgttttaatgggaggtggaaagccagaaattgtcgaagtt

SEQ ID NO: 4292 - protein, 1222 aa, Streptococcus pyogenes
VLFNINEKGEPLVISFAPFLSPEAIKHLQENERCRDQSQKRTAQQIEAIYTSGQNILVSASAGSGKTFVMVERILDKILRGVSIDRLFISTFTVKAATELRERIENKLYSQIAQTTDFQMKVYLTEQLQSLCQADIGTMDAFAQKVVSRYGYSIGISSQFRIMQDKAEQDVLKQEVFSKLFNEFMNQKEAPVFRALVKNFSGNCKDTSAFRELVYTCYSFSQSTENPKIWLQENFLSAAKTYQRLEDIPDHDIELLLLAMQDTANQLRDVTDMEDYGQLTKAGSRSAKYTKHLTIIEKLSDWVRDFKCLYGKAGLDRLIRDVTGLIPSGNDVTVSKVKYPVFKTLHQKLKQFRHLETILMYQKDCFSLLEQLQDFVLAFSEAYLAVKIQESAFEFSDIAHFAIKILEENTDIRQSYQQHYHEVMVDEYQDNNHMQERLLTLLSNGHNRFMVGDIKQSIYRFRQADPQIFNQKFRDYQKKPEQGKVILLKENFRSQSEVLNVSNAVFSHLMDESVGDVLYDEQHQLIAGSHAQTVPYLDRRAQLLLYNSDKDDGNAPSDSEGISFSEVTIVAKEIIKLHNDKGVPFEDITLLVSSRTRNDIISHTFNQYGIPIATDGGQQNYLKSVEVMVMLDTLRTINNPRNDYALVALLRSPMFAFDEDDLARIALQKDNELDKDCLYDKIQRAVIGRGAHPELIHDTLLGKLNVFLKTLKSWRRYAKLGSLYDLIWKIFNDRFYFDFVASQAKAEQAQANLYALALRANQFEKSGYKGLYRFIKMIDKVLETQNDLADVEVATPKQAVNLMTIHKSKGLQFPYVFILNCDKRFSMTDIHKSFILNRQHGIGIKYLADIKGLLGETTLNSVKVSMETLPYQLNKQELRLATLSEEMRLLYVAMTRAEKKVYFIGKASKSKSQEITDPKKLGKLLPLALREQLLTFQDWLLAIADIFSTEDLYFDVRFIEDSDLTQESVGRLQTPQLLNPDDLKDNRQSETIARALDMLEAVSQLNANYEAAIHLPTVRTPSQLKATYEPLLEPIGVDIIEKSSRSLSDFTLPHFSKKAKVEASHIGSALHQLMQVLPLSKPINQQTLLDALRGIDSNEEVKTALDLKKIESFFCDTSLGQFFQTYQKHLYREAPFAILKLDPISQEEYVLRGIIDAYFLFDDHIVLVDYKTDKYKQPIELKKRYQQQLELYAEALTQTYKLPVTKRYLVLMGGGKPEIVEV

SEQ ID NO: 4293 - DNA, 3231 bp, Streptococcus agalactiae
atgaaattactttatactgatattaatcatgatatgacagaaatcttagtcaatcaggccgcgcatgctgctgaagctggatggcgtattttttatattgctccaaactctttatcttttgaaaaagagcgtgcagtattagagaaccttcctcaagaagcctcttttgctattacaattactcgctttgctcaattggcacgttattttactttaaaccagcctaatcaaaaagaaagtttaaacgatattggattagcaatgatcttttatcgtgctttagcaagttttgaagatggacaattaaaagtttttggacgattgaagcaagatgcttcctttatcagtcaattggtagacctatacaaagaattgcagacagcaaatctgagtattttagagttaaaatatttacattctcctgaaaaatttgaagatttattagctatttttctagtggtttcagatcttttaagagaaggagaatacgacaatcaatctaaaattgccttttttacagaacaagtaaggtcaggccagctagatgtggatttaaagaacactatccttatagtcgatggttttacccgtttctcagctgaagaagaagctttaattaaaagtctgagttcacgttgtcaagagattatcatcggagcttatgctagccaaaaagcgtataaggctaactttactaatggaaatatttattctgcaggggttgattttttaagatatctagcaacgacatttcaaacaaaaccagaatttatcttgtccaagtgggaaagtaaatctggttttgaaatgatttcgaaaaatatcgaaggtaaacatgattttacaaatagtagtcacattttagacgacactgctaaagattgtataacaatttgggagtgcattaatcaaaaagatgaagtggaacatgtggctagagctatacgtcagaaactttatcaaggatatcgctacaaagatattttagttttactaggagatgtagatagttataaactacaattaagtaagatttttgagcagtatgatattccttattatttcggtaaagctgaaacaatggctgcgcaccctttagttcattttatggattccttgtctcgaataaaacgttatcgatttagagctgaagatgttttaaatctttttaagacaggtatttatggagagattagccaagatgatttagattattttgaggcttatatctcatatgcagacattaaaggtcctaagaagttctttacagattttgttgtgggggctaaaaaatttgatttagggcgtcttaacactattcgtcagtccctccttactccactggaaagttttgtgaaaacgaaaaaacaagacggtataaaaacactcaaccaattcatgtttttccttactcaggtaggtttgagtgacaatttatcgcgattagttggtcaaatgtctgaaaatgaacaagaaaaacatcaagaagtttggaaaacatttacagatattttagagcagtttcaaacaatatttggtcaagaaaaattaaatttagacgaatttttatcgttattaaattcaggtatgatgcaagccgagtatcgtatggtccctgctactgttgatgtggttactgttaagtcttacgatttggtagaaccacatagtaatcaatttgtctatgccctaggcatgacacaatcacattttccaaagattgctcaaaacaaatctttaatatctgatattgaacgtcagcttataaatgatgccaatgacactgatggtcattttgacattatgacgcaagaaaatttgaagaaaaaccattttgctgccctctctctttttaatgctgctaaacaagaattagtgttgactataccacaattattgaatgagtctgaagatcagatgtcaccatatcttgtcgaactaagagatataggtgttccttttaatcataaaggacgccaatcgttaaaagaagaagctgataatattgggaattacaaagctttattatcgcgtgttgttgacttgtatcgctctgctattgacaaagagatgactaaagaagaacaaactttttggtcagttgctgttcgttatttgcgtcgtcaattaacttctaaagggattgagataccaataattacagatagtcttgatactgtgacagtttcatcagatgtgatgaccagacgcttcccagaagatgacccacttaaattatcctcatctgctttgacaactttttataataatcaatataagtattttttacaatatgtgttaggtttggaagaacaagactcaattcatccagatatgcggcaccatggaacgtaccttcatcgtgtttttgaaattctgatgaaaaaccaagggatagaatcttttgaagagaaactcaactctgcaattaataaaaccaatcaagaagatgttttcaaatccttgtattcagaagatgcagaaagtcgttattctttagaaattttagaagatatcgcgcgtgcaactgcaaccatattacgacaagatagtcagatgactgttgaaagtgaagaagaacgatttgaactaatgattgataatactataaaaattaacggtattattgaccgtatcgatcgtttatctgatggttctttgggtgtcgtggactataaatcaagcgctcaaaaattcgatatccaaaaattttataacggtctaagtccacaattagtcacctacattgatgctatcagtcgtgacaaggaagttgaacaaaaaccaccgatttttggagctatgtacttacatatgcaggaacctagacaagacttgtctaaaattaaaaatttagatgatttagtaacaaaaaatcatcaagctttaacttataaaggattattttcagaagccgaaaaagaattcttagcaaatgggaaataccatctcaaagattccctttattcagagactgaaattgctattttacaagcacataaccaatcgctttacaaaaaagcatctgagactattaagtcaggtaagtttttgatcaatccatatacagaagatgctaaaacagttgacggagatcagtttaagagtattacgggattcgaggcggataggcatatggcacgtgccagagcgctttataaattacctgctaaggaaaaacgtcaaggtttcttaacattaatgcagcaagaggaggaaaatgatgacctt

SEQ ID NO: 4294 - protein, 1077 aa, Streptococcus agalactiae
MKLLYTDINHDMTEILVNQAAHAAEAGWRIFYIAPNSLSFEKERAVLENLPQEASFAITITRFAQLARYFTLNQPNQKESLNDIGLAMIFYRALASFEDGQLKVFGRLKQDASFISQLVDLYKELQTANLSILELKYLHSPEKFEDLLAIFLVVSDLLREGEYDNQSKIAFFTEQVRSGQLDVDLKNTILIVDGFTRFSAEEEALIKSLSSRCQEIIIGAYASQKAYKANFTNGNIYSAGVDFLRYLATTFQTKPEFILSKWESKSGFEMISKNIEGKHDFTNSSHILDDTAKDCITIWECINQKDEVEHVARAIRQKLYQGYRYKDILVLLGDVDSYKLQLSKIFEQYDIPYYFGKAETMAAHPLVHFMDSLSRIKRYRFRAEDVLNLFKTGIYGEISQDDLDYFEAYISYADIKGPKKFFTDFVVGAKKFDLGRLNTIRQSLLTPLESFVKTKKQDGIKTLNQFMFFLTQVGLSDNLSRLVGQMSENEQEKHQEVWKTFTDILEQFQTIFGQEKLNLDEFLSLLNSGMMQAEYRMVPATVDVVTVKSYDLVEPHSNQFVYALGMTQSHFPKIAQNKSLISDIERQLINDANDTDGHFDIMTQENLKKNHFAALSLFNAAKQELVLTIPQLLNESEDQMSPYLVELRDIGVPFNHKGRQSLKEEADNIGNYKALLSRVVDLYRSAIDKEMTKEEQTFWSVAVRYLRRQLTSKGIEIPIITDSLDTVTVSSDVMTRRFPEDDPLKLSSSALTTFYNNQYKYFLQYVLGLEEQDSIHPDMRHHGTYLHRVFEILMKNQGIESFEEKLNSAINKTNQEDVFKSLYSEDAESRYSLEILEDIARATATILRQDSQMTVESEEERFELMIDNTIKINGIIDRIDRLSDGSLGVVDYKSSAQKFDIQKFYNGLSPQLVTYIDAISRDKEVEQKPPIFGAMYLHMQEPRQDLSKIKNLDDLVTKNHQALTYKGLFSEAEKEFLANGKYHLKDSLYSETEIAILQAHNQSLYKKASETIKSGKFLINPYTEDAKTVDGDQFKSITGFEADRHMARARALYKLPAKEKRQGFLTLMQQEEENDDL

SEQ ID NO: 4295 - DNA, 3213 bp, Streptococcus pyogenes
atgaaattaatttacacagagatgagttactcgatgacagagattttggtgaatgaagcacgaaaagctgctgaccaaggttatcgagtgttctatattgctccaaattctctttcatttgaaaaggaaagggaagtcttaaccttattgcctgaacgagggactttttcgataatagtcacccggttcgttcaaatgtcaaggtattttacagttgagagctctccttctaagcaacatctagatgacacgactttggctatgattttttatcgggccttgatgcaattaaaaccagaagatttgccgagttatggtcgtttgcaaaataattcggtttttattgaacaactagttgagttatataaagaattaaaaaacgcacaattaagcgtacatgatttaacagggttagaccatcctcaaaaacaagaagatcttattaaaattattgagcttgcagagacgatcatgattcagcaagattataatcaagatagtcctctacaatcttttgcaagagcaattaagttaggacttttaaataaccaactatcaaaaacagttgttgttattgatggtttttcacgtttttcagctgaagaggattatttattatcacttttaaataacaactgtcaagaggtcatcattggcagttatgtgagtcaaaaagcttatcaaaaatcttttattaagggaaatatctatgaggctagccttcattttttgcaagatttggctcaaaaataccatatcaagccggtatttgcgacctctaatcaagtgtttaaaccagccttttcacggctaacacaattatttgaagcaactcatgatttttcacaagtagactggcaactccaaaagagtgatcttgatcactttagcctttggcaatgtcatcatcaaaaagaggaaattgaacatgtagcaaaatccattcggcaaaagctatatgaaggttaccgttataaggatatcttagtgttgctaggagatatggatgcttatcaattacaaattgggcctatctttgataagtttgaaatcccctactatttaggaaaagcagagcctatggctgcccatccattagtccaatttatagaatcgctcgaacgaagtcagcgctataattggcgtcgtgaagacattttaaacatgttaaaatcaggactttttggttgttttgatgatagtgatattgatcgctttgaggaatatactcagtttgcagatattaaaggatttactaaattttcaaagccttttaccattaactcttctaggcagtatcctcttgactttttaaatgaaatgagacaagacatcgttttacctttgcaagaattgtttaagagtcaaaaacaacttggtgcttcacttgttgacaaattaatactttttttaaaaaagattagattagctgagaatatgcaaggtttagcacagtcccaattagaggtggaaaaaaacgaagaagtttggaaaaggtttacagatattttgacttcttttcatcatatcttcggccaagaaaaattacggctatcagattgccttgctttaattaaaacgggaatgaaatcagctcagtatcgtgttgttccagcgacattagatgttgtcactattaaatcttatgaccttgttcaaccacattcaaaacctttcgtttatgcaattggtctaactcaatcacattttcctaagcaaattcaccattcaggactactttctgatcaagagcgtgctagaattaatgaaataagaaattatcgtcattttgatattgctagtgccgaaaatagtaaaaaaaaccatcaaactgcgttatctctgtttaatgctgctactaaggagttagttcttagtgtttcaacggtaatcaacgagacattcgatgatctatctccttatcttaaagaattaataaactttgggttacctcttttggataaaggcaaaaactatctatcttatgataatagcgatattggtaactataaagctctcttgtcacaaattattgctattaaccgacaagatcttatagaaatgtcagatcaagataagatgttttggactgttgtcttacgttatctcaggaaacagttaagaaagcaacagctagagctacctacttcagattatcgtttatcaacaaagcctttgtctaaagaagttatcgaggtatgttttccaaagggaatccctttaaagctatctgcaactgctttaaccgttttttataataatcagtacaactattttttgaaatatgttttgaatttaaacaaaacagaatccattcatccagattccagaattcatggtcaatacttgcatcgtgtctttgagcggttaatgaaagatcacacgcaagaaccgtttgataataagttaaaacaagcaatctaccataccaatcaagaaagtttttttcagcaggtttaccaagataatgccgaggctgagtacagtttagctatactagaagatattgttagatcaacagcacctatcttgcaacttaaccaaaacatacaggtcattgatcaagaaaagaactttcagctggatatgggaaatgagatattagtccacgggatcattgatcgtattgaccagctgagcgacggtagcttgggcattgttgactataaatcaagcgcgaatcaatttgatattgggaccttttataatgggttgagtccacaactaatgacttacctcgcagccttaaaacagattgcaccgcacgatataaaccaattatttggggctatgtaccttcatttgcaagatcctaaattggatctagtaacatttaaacaaattgataacacattagtggagagtatctataaagcgttgacctataaaggtattttttcagaagtcgaaaaagagcatctatctactggtgcttaccaaaccaaaaatgctctttattccaatgacgaattggaaacacttttaaattataacaagtacctctatcttaaagctgctaaacacattaaaaagggacattttttgattaatccttatacaagcgatggtaagacagttcaaggagatcaattaaaagccattacccgttttgaagcagatcttgacatgggacaggcaaggcgactagtgactctccctgctaaggagaaaaaagagtgctttttaacattaatgagaaaggagagccacttg

SEQ ID NO: 4296 - protein, 1071 aa, Streptococcus pyogenes
MKLIYTEMSYSMTEILVNEARKAADQGYRVFYIAPNSLSFEKEREVLTLLPERGTFSIIVTRFVQMSRYFTVESSPSKQHLDDTTLAMIFYRALMQLKPEDLPSYGRLQNNSVFIEQLVELYKELKNAQLSVHDLTGLDHPQKQEDLIKIIELAETIMIQQDYNQDSPLQSFARAIKLGLLNNQLSKTVVVIDGFSRFSAEEDYLLSLLNNNCQEVIIGSYVSQKAYQKSFIKGNIYEASLHFLQDLAQKYHIKPVFATSNQVFKPAFSRLTQLFEATHDFSQVDWQLQKSDLDHFSLWQCHHQKEEIEHVAKSIRQKLYEGYRYKDILVLLGDMDAYQLQIGPIFDKFEIPYYLGKAEPMAAHPLVQFIESLERSQRYNWRREDILNMLKSGLFGCFDDSDIDRFEEYTQFADIKGFTKFSKPFTINSSRQYPLDFLNEMRQDIVLPLQELFKSQKQLGASLVDKLILFLKKIRLAENMQGLAQSQLEVEKNEEVWKRFTDILTSFHHIFGQEKLRLSDCLALIKTGMKSAQYRVVPATLDVVTIKSYDLVQPHSKPFVYAIGLTQSHFPKQIHHSGLLSDQERARINEIRNYRHFDIASAENSKKNHQTALSLFNAATKELVLSVSTVINETFDDLSPYLKELINFGLPLLDKGKNYLSYDNSDIGNYKALLSQIIAINRQDLIEMSDQDKMFWTVVLRYLRKQLRKQQLELPTSDYRLSTKPLSKEVIEVCFPKGIPLKLSATALTVFYNNQYNYFLKYVLNLNKTESIHPDSRIHGQYLHRVFERLMKDHTQEPFDNKLKQAIYHTNQESFFQQVYQDNAEAEYSLAILEDIVRSTAPILQLNQNIQVIDQEKNFQLDMGNEILVHGIIDRIDQLSDGSLGIVDYKSSANQFDIGTFYNGLSPQLMTYLAALKQIAPHDINQLFGAMYLHLQDPKLDLVTFKQIDNTLVESIYKALTYKGIFSEVEKEHLSTGAYQTKNALYSNDELETLLNYNKYLYLKAAKHIKKGHFLINPYTSDGKTVQGDQLKAITRFEADLDMGQARRLVTLPAKEKKECFLTLMRKESHL

SEQ ID NO: 4297 - DNA, 912 bp, Streptococcus agalactiae
ttggagatacttatgaaaatagatgacctaagaaaaagcgacaatgttgaagatcgtcgctccagtagcggaggttcattctctagcggaggaagtggattaccgattcttcaacttttattgctgcgagggagttggaaaaccaagcttgtggttttaatcatcttactgctacttggcggagggggactaaccagcatttttaatgactcatcctcaccttctagttaccaatctcagaatgtctcacgttctgttgataatagcgcaacgagagaacaaatcgatttcgttaataaagtccttggctcaactgaggatttctggtcacaagaattccaaacccaaggttttggaaattataaggaaccaaaacttgttctttacaccaattcaattcaaacaggttgtggtataggtgaatctgcttcaggaccattttattgttcagcagataaaaaaatctatcttgatatttctttttacaatgaattatcacataaatatggtgctactggtgattttgctatggcctacgtcatcgcccacgaagttggtcaccacattcaaacagagttaggcattatggataagtataatagaatgcgacacggacttactaagaaagaagcaaatgctttaaatgttcggctagaacttcaagcagattattatgcaggggtatgggctcactacatcaggggaaaaaatctcttagaacaaggagactttgaagaggccatgaatgctgcccacgccgtcggagacgatacccttcagaaagaaacctacggaaaattagtgcctgatagctttacccatggaacagctgaacaacgccaacgttggtttaacaaaggctttcaatatggtgacatccaacacggtgatactttctccgtagaacatcta

SEQ ID NO: 4298 - protein, 304 aa, Streptococcus agalactiae
MEILMKIDDLRKSDNVEDRRSSSGGSFSSGGSGLPILQLLLLRGSWKTKLVVLIILLLLGGGGLTSIFNDSSSPSSYQSQNVSRSVDNSATREQIDFVNKVLGSTEDFWSQEFQTQGFGNYKEPKLVLYTNSIQTGCGIGESASGPFYCSADKKIYLDISFYNELSHKYGATGDFAMAYVIAHEVGHHIQTELGIMDKYNRMRHGLTKKEANALNVRLELQADYYAGVWAHYIRGKNLLEQGDFEEAMNAAHAVGDDTLQKETYGKLVPDSFTHGTAEQRQRWFNKGFQYGDIQHGDTFSVEHL

SEQ ID NO: 4299 - DNA, 915 bp, Streptococcus pyogenes
atgaaaacggatgatttgagagaaagtcaacaggttgaagatagacgtggtcaatcgtctggttcttttgggggcggcggcctagggggcggtctcctgcttcaattactcttttcacgaggaggttggaaaaccaagctggttattcttctccttctcctagttatgggaggtggtggcctatctggtgttttaggaggcaagccttcttctaccaacaacaatgcctatcaatcaagccaagtaacgcgtacaaatggtgacaaggctagtcaagaacaggtttcttttgtcagtaaggtcttcgcctctaccgaggactattggactaagacatttcgtgagaaagggttaacttatcataaaccaacattagttctatatactggagcaactcaaaccgcttgtggcagggggcaagcctcttctggtcctttttattgcccaggcgatcaaaaagtgtatttagatatttctttttataatgaactatcaaccaagtacggcgcaaaaggtgattttgctatggcctatgtgattgctcatgaagttggccaccacatccaaaatgaattgggaattatggataattacgctagcgctagacaaggaaaatcaaaggctaaagccaatcagctcaacgtcaagttggaattacaagctgattactatgctggtgcctgggctaattatgttcaagggcaaggccttttggaaaaaggagatattgaggaagcaatggcagcagctcacgcagttggggatgatactctgcaagaagaaacctatggcagaaccgttcctgatagttttacacatggcacttctaagcaacgccaacgttggtttgaccgaggttaccaatatggcgactttgagcatggtgatacctttagcatcccgtatagtaagctt

SEQ ID NO: 4300 - protein, 305 aa, Streptococcus pyogenes
MKTDDLRESQQVEDRRGQSSGSFGGGGLGGGLLLQLLFSRGGWKTKLVILLLLLVMGGGGLSGVLGGKPSSTNNNAYQSSQVTRTNGDKASQEQVSFVSKVFASTEDYWTKTFREKGLTYHKPTLVLYTGATQTACGRGQASSGPFYCPGDQKVYLDISFYNELSTKYGAKGDFAMAYVIAHEVGHHIQNELGIMDNYASARQGKSKAKANQLNVKLELQADYYAGAWANYVQGQGLLEKGDIEEAMAAAHAVGDDTLQEETYGRTVPDSFTHGTSKQRQRWFDRGYQYGDFEHGDTFSIPYSKL

SEQ ID NO: 4301 - DNA, 2403 bp, Streptococcus agalactiae
atgttagtatcgtataaatggttaaaagagttagtggatgttgatgttacaacagcagaactagctgagaaaatgtcaaccactggtattgaggttgaaggtgtggagacaccagcggaaggtttatcaaaattagttgtaggtcatattgtttcgtgtgaagatgttccagatacccacttacatttgtgtcaagttgatacaggggatgatgaacttcgtcaagttgtctgtggtgctccaaatgtcaagactggtattaatgttatcgtagcggttcctggtgctcgtattgcagataactataagattaaaaaaggtaaaatccgtggtatggagtcacttggaatgatttgttcacttcaagagttgggcttatcggaaagtatcattccaaaagagttttctgatggtatccaaattttacctgagggagctatacctggtgatagtattttctcttatcttgacttagatgatgaaattattgaattatcaattacaccaaaccgtgcagatgctctttcaatgcgtggtgttgcccatgaggtagcagcaatttatgggaaaaaagttcattttgaagaaaaaaatctcattgaagaagcagaaagagcagctgataagatttctgttgtcattgaatcagataaagttttatcttactcggctcgtattgttaagaatgtaacagttgcaccaagtccacaatggcttcaaaataaactgatgaatgctggtatacgtccaattaataatgttgttgatgtgacaaactatgttcttttgacttatggtcaaccaatgcatgcttttgattttgataaatttgatgggacaactatagtagcacgtaatgctgagaatggggaaaagttaattactcttgatggtgaagagcgtgacttaatagctgatgacttggtcattgcggtaaatgatcaaccagttgctttggcaggcgttatgggaggacaatcaactgaaattggtagttcttctaagacagtggtccttgaagcggcagtatttaatggaacaagtatccgcaaaacaagtggaagactcaaccttcgttcagaatcatcttctcgctttgaaaaaggtatcaattatgatacagtttcagaggctatggattttgcggctgcaatgttacaagaattggcaggtggtcaagttctttctggtcaagttacagaaggagttcttccaactgagccggtagaggtatcaacgactcttggttacgttaatactcgtttgggaacagaacttacctatactgatattgaagaagtatttgaaaaactcggctttgctatttctggttcagaagtgaaatttactgtgttggtaccgcgtcgtagatgggatattgccattcaagctgacttagttgaagagattgcccgtatttatggttacgaaaaattaccaacaacattgccagaagccggagcgactgcaggagaattaacgagtatgcaacgcttacgtcgtagagtccgtacggttgctgaaggagcaggattatctgaaattatcacctatgctttaacaactccagaaaaagcagtgcagttctcaactcaagcaactaatataactgaacttatgtggccgatgactgttgatcgctcagcacttcgccaaaatgttgtttcaggaatgcttgatacaattgcttataacgttgctcgcaaaaacagtaaccttgcagtttatgagataggaaaagtttttgaacaaactggtaatccaaaagaagatttaccaactgaagtagagacgtttacttttgccttaacaggtctagtagaggaaaaagatttccaaacaaaatccaagccagttgatttcttctacgccaaaggtattgtagaggcgctctttattaaattaaaattagatgttacttttgtagcacaaaaaggtttagcaagtatgcacccaggtcgtacagcaactatcttattagatgggaaagagattggttttgttggtcaagtacacccacaaactgcaaaacaatatgatattcctgaaacttatgttgctgaaatcaatctatcaactattgaaagtcaaatgaaccaagcgttgatttttgaagatattacgaagtatccgtctgtatctcgcgatattgcattattacttgcagaatctgttagtcatcatgatattgtgtcagcaattgagacatcaggggtaaaacgtctaacagcgattaaactgtttgatgtctacgctggaaataatattgcagaagggtataaatcaatggcttatagcttaactttccaaaaccctaatgacaatctaacggacgaagaagtggctaaatatatggaaaaaatcactaaatcactcgttgagaaagttaatgcagaaataaga

SEQ ID NO: 4302 - protein, 801 aa, Streptococcus agalactiae
MLVSYKWLKELVDVDVTTAELAEKMSTTGIEVEGVETPAEGLSKLVVGHIVSCEDVPDTHLHLCQVDTGDDELRQVVCGAPNVKTGINVIVAVPGARIADNYKIKKGKIRGMESLGMICSLQELGLSESIIPKEFSDGIQILPEGAIPGDSIFSYLDLDDEIIELSITPNRADALSMRGVAHEVAAIYGKKVHFEEKNLIEEAERAADKISVVIESDKVLSYSARIVKNVTVAPSPQWLQNKLMNAGIRPINNVVDVTNYVLLTYGQPMHAFDFDKFDGTTIVARNAENGEKLITLDGEERDLIADDLVIAVNDQPVALAGVMGGQSTEIGSSSKTVVLEAAVFNGTSIRKTSGRLNLRSESSSRFEKGINYDTVSEAMDFAAAMLQELAGGQVLSGQVTEGVLPTEPVEVSTTLGYVNTRLGTELTYTDIEEVFEKLGFAISGSEVKFTVLVPRRRWDIAIQADLVEEIARIYGYEKLPTTLPEAGATAGELTSMQRLRRRVRTVAEGAGLSEIITYALTTPEKAVQFSTQATNITELMWPMTVDRSALRQNVVSGMLDTIAYNVARKNSNLAVYEIGKVFEQTGNPKEDLPTEVETFTFALTGLVEEKDFQTKSKPVDFFYAKGIVEALFIKLKLDVTFVAQKGLASMHPGRTATILLDGKEIGFVGQVHPQTAKQYDIPETYVAEINLSTIESQMNQALIFEDITKYPSVSRDIALLLAESVSHHDIVSAIETSGVKRLTAIKLFDVYAGNNIAEGYKSMAYSLTFQNPNDNLTDEEVAKYMEKITKSLVEKVNAEIR

SEQ ID NO: 4303 - DNA, 2418 bp, Streptococcus pyogenes
ttgggcactaaaattatgttagtatcttataaatggttaaaagaattagtagatatcgatgtgacaccagcagcacttgctgagaaaatgtcgacaacgggtatcgaggtagaaggaattgaagtccctgcagatggtttatcaaaactggttgtggggcatgtgctttcttgtgaagatgtgccagagacacatttgcatttgtgtcaggtagatacaggtgatgaaacgccacgtcaaattgtgtgtggcgcaccaaatgtgaaagcagggattaaggttatcgtggctgtgccaggtgctcgtattgcggataactataaaatcaaaaaaggcaaaatccgcggcatggaatctcttggcatgatttgttccttgcaagaacttggtttgtcagatagtattattccaaaagaattttcagatggtattcaaatcttgccagaggaggctgtgccaggtgatgctatttttaaatacctggacttggacgatcatatcattgaattgtccattacacctaaccgtgctgatgcgctttctatgcgaggtgtggcacatgaagtcgcagctatttatggcaagtcagtatcattcccccaaaaaaatctacaagaatctgataaggcaacttcagaagccattgaagtggccattgcctctgataacgttctaacttacgctagccgtgtcgttgaaaatgtcaaagttaagccaagtccacaatggttgcaaaaccttttaatgaatgctggtattcgtcctattaataatgtggttgatgtgaccaactatgtgctcttgtattttggtcaacctatgcatgcttttgattatgataaatttgaagaccataagattgtggcgcgtgcggctcgtcaaggagaaagtttggtcacacttgatggtgaaaaacgggatttgaccactgaggatcttgttattaccgtggctgacaaaccagttgctttagcaggtgttatgggtggtcaagccactgaaattgatgccaactctcagacggttgttcttgaagctgctgtttttgatggcaaatcgattcgtaaaaccagtggtcgtttaaaccttcgttcggaatcctcttcacgttttgaaaaaggggttaactatgcaactgttttagaagcacttgactttgcagcggctatgttacaagaattagcagaaggtcaagtcttatcaggccatgttcaagctggacaattgccaacagaacctgttgaagtctcaactagccttgactatgtgaatgttcgtttaggaacagaattaacttttgctgatattcaaaggatttttgaccaacttggatttggtctaacaggagatgaaacaagcttcacggtagctgttcctcggcgtcgttgggatgttagcatcccagctgacttggtggaagaaattgcgcgtatctatggttatgataagttgccaacaaccttaccagaggcagggggaacggctgcagaattaacgccaacacaggctcttcgtcgtaaagtccgtggcttagcggaaggattgggcttgactgaaatcatttcgtatgctttgacaacaccagagaaagctgttgagtttgcagtggcaccaagtcacctgacagaactcatgtggccgatgtctgtggagcgttcagcactacgtcaaaatatggtttcagggatgttagatacggttgcctataatgtggctcgtaaacaaagtaacttggctctttatgaaattggaaaaatctttgaacaagaagctaatccaaaagaagaccttcctaatgaagtgaaccattttgcttttgctatttgtggcttagtggcacaaaaagatttccaaacccaagctcaggcagtggatttttaccatgctaaaggtaacttggatactttatttgcaaaccttaacctcaaggttcaatatgtgccaaccaaagacctagcaaacatgcacccaggacggacagcgcttatcctattagatgagcaagtgattggatttgttggtcaagttcatccaggaacagcaaaggcttatagtattccagaaacctatgtggcagaattggatatggctgctttagaagcagcgttgccaagtgatcaaacttttgcggaaatcacaaaattccctgctatgacacgtgatgttgccttgttacttgaccgtgaggtgagtcatcaggccattgtaacagctattgaatcagcaggtgtaaaacgcttgactagcattaaactctttgacgtctatgaaggagcaaccattcaggctggcaaaaaatcaatggcttatagccttactttccaaaatccaaatgacaatttaacggatgaagaagttgccaaatacatggagaaaatcaccaaagcattgacagaacaagtcggtgctgaagtacgc

SEQ ID NO: 4304 - protein, 806 aa, Streptococcus pyogenes
LGTKIMLVSYKWLKELVDIDVTPAALAEKMSTTGIEVEGIEVPADGLSKLVVGHVLSCEDVPETHLHLCQVDTGDETPRQIVCGAPNVKAGIKVIVAVPGARIADNYKIKKGKIRGMESLGMICSLQELGLSDSIIPKEFSDGIQILPEEAVPGDAIFKYLDLDDHIIELSITPNRADALSMRGVAHEVAAIYGKSVSFPQKNLQESDKATSEAIEVAIASDNVLTYASRVVENVKVKPSPQWLQNLLMNAGIRPINNVVDVTNYVLLYFGQPMHAFDYDKFEDHKIVARAARQGESLVTLDGEKRDLTTEDLVITVADKPVALAGVMGGQATEIDANSQTVVLEAAVFDGKSIRKTSGRLNLRSESSSRFEKGVNYATVLEALDFAAAMLQELAEGQVLSGHVQAGQLPTEPVEVSTSLDYVNVRLGTELTFADIQRIFDQLGFGLTGDETSFTVAVPRRRWDVSIPADLVEEIARIYGYDKLPTTLPEAGGTAAELTPTQALRRKVRGLAEGLGLTEIISYALTTPEKAVEFAVAPSHLTELMWPMSVERSALRQNMVSGMLDTVAYNVARKQSNLALYEIGKIFEQEANPKEDLPNEVNHFAFAICGLVAQKDFQTQAQAVDFYHAKGNLDTLFANLNLKVQYVPTKDLANMHPGRTALILLDEQVIGFVGQVHPGTAKAYSIPETYVAELDMAALEAALPSDQTFAEITKFPAMTRDVALLLDREVSHQAIVTAIESAGVKRLTSIKLFDVYEGATIQAGKKSMAYSLTFQNPNDNLTDEEVAKYMEKITKALTEQVGAEVR

SEQ ID NO: 4305 - DNA, 558 bp, Streptococcus agalactiae
atgttaacgctattaccttactcaataggaggttttctaatgtctcaaattacttttaaaaaggttggccttgataatgtgaatattttacagaatattgctatagaaacctttcggcagacgttttctcatgataatagtgaggaacaacttcaagcatttttcaatgagtcttacactttaccagtattaaaatcggaaattacccatgctgaatctgatacttattttgtttatcttgatacagatttagtgggttatttaaaagtaaactggggaagtcagcaaactgaaaaagatcttgataaagcatttgaaattcaaaggatttatcttctagatgcctaccaagggcaaggtataggtaaggctactttcgaatttgctttggatttagcttataaatcaggcttagattgggcttggttaggtgtttgggagtttaatcataaagctcaggcattttacgctaaatacggatttgaaaaattttctgagcaccaattttcagtaggtgataaagtggatacggattggttattaagaaaaagtttacac

SEQ ID NO: 4306 - protein, 186 aa, Streptococcus agalactiae
MLTLLPYSIGGFLMSQITFKKVGLDNVNILQNIAIETFRQTFSHDNSEEQLQAFFNESYTLPVLKSEITHAESDTYFVYLDTDLVGYLKVNWGSQQTEKDLDKAFEIQRIYLLDAYQGQGIGKATFEFALDLAYKSGLDWAWLGVWEFNHKAQAFYAKYGFEKFSEHQFSVGDKVDTDWLLRKSLH

SEQ ID NO: 4307 - DNA, 1011 bp, Streptococcus agalactiae
ttgaaaatatcaactcaagaaaagcttaaagaaatgactgggaaccacactaaagaattacaagacttacgtgtacaagttttaggaaaaaaaggttctctaacagaattactaaaaggtctgaaagatttatctaatgatttacgaccagttgttggaaaacaagtcaatgaagtacgtgatattttaacaaaagcgtttgaggaacaagctaaagtagtggaagctgcgaagattcaagcacagttagagtctgagagtgtcgacgttaccttgcctggtcgtcaaatgacattaggtcaccgtcatgtcttaacacaaactagcgaagagattgaagatatctttttaggtatgggattccaagtggttgatggttttgaagttgagaaagactactataattttgaacgaatgaatttaccaaaagatcatccagcccgtgatatgcaagatactttttatattacagaagaaatcttgctacgtactcatacttcgcctgttcaagcacgaacaatggaccaacatgatttttctaaagggcctttaaaaatgatttctcctggacgtgttttccgtcgtgatactgatgatgctactcatagccatcaattccatcaaattgaaggcttagttgttggagaaaatatttcaatgggcgatctcaaaggaacacttcaactgatttctcaaaaaatgtttggagcagagcgtaaaatccgacttcgtccttcatatttcccattcacagaaccttcagttgaagttgatgtctcttgcttcaagtgcggaggtaagggatgtaatgtctgcaaacagacaggttggattgagatattgggtgctggtatggttcacccaagtgttttggaaatgtctggtattgattctgagaaatactccggttttgcctttggtttaggtcaagaacgtattgcaatgttacgctacggtatcaatgacattcgtggcttctatcaaggtgatgttcgcttcacagatcaattt

SEQ ID NO: 4308 - protein, 337 aa, Streptococcus agalactiae
MKISTQEKLKEMTGNHTKELQDLRVQVLGKKGSLTELLKGLKDLSNDLRPVVGKQVNEVRDILTKAFEEQAKVVEAAKIQAQLESESVDVTLPGRQMTLGHRHVLTQTSEEIEDIFLGMGFQVVDGFEVEKDYYNFERMNLPKDHPARDMQDTFYITEEILLRTHTSPVQARTMDQHDFSKGPLKMISPGRVFRRDTDDATHSHQFHQIEGLVVGENISMGDLKGTLQLISQKMFGAERKIRLRPSYFPFTEPSVEVDVSCFKCGGKGCNVCKQTGWIEILGAGMVHPSVLEMSGIDSEKYSGFAFGLGQERIAMLRYGINDIRGFYQGDVRFTDQF

SEQ ID NO: 4309 - DNA, 1119 bp, Streptococcus pyogenes
atggtaccgcgtgtcaacgctccgcttatcaagtggaggagtggcatgcttttttcatcgccaaaagaagggaaaactatggatttacaagcacaattagaggaattaaagacaaaaacattggagaccttacagtctttgacgggtaatcataccaaagaactgcaagatttgcgcgtggctgttcttgggaaaaagggatctttgacagaattactaaaggggctaaaagacttgtctaatgacttgcgtcctgtggttggtaaacaggtgaacgaagttcgtgacttattgacaaaagcctttgaagaacaggctaaaattgtagaggctgctaaaattcaggcccaacttgatgctgaaagcattgatgtgactttaccgggtcgtcaaatgactctggggcatcgtcatgtgttaacacaaaccagtgaagaaatcgaagatattttcttaggaatgggttttcagattgttgatggctttgaggtggaaaaagattattacaactttgagcgcatgaatttgccaaaggatcaccctgcccgtgacatgcaagatacgttttatatcacagaagaaatcttgttacgaactcacaccagtcctgtgcaggcccgtactcttgatcaacatgatttttcaaaagggcctttaaaaatggtttctccaggtcgtgttttccgtcgtgatactgatgacgctacccactcacatcaattccatcaaattgaaggtttggttgtgggcaaaaatatttccatgggagacctcaaagggacccttgaaatgatcatcaagaagatgttcggtgacgaacgtagcattcgtttgcgcccgtcatatttcccgttcacagaaccatctgttgaagtggatgtttcttgctttaaatgtggtgggaaaggctgtaatgtctgcaagaaaacaggatggattgaaattcttggtgctggtatggttcacccaagtgtcttggaaatgtcaggtgttgatgcaaaagagtattcaggctttgcctttggtttaggtcaagagcggattgccatgttgcgttatggcattaatgacattcgtggtttctatcaaggcgaccaacgtttctctgaacaatttaac

SEQ ID NO: 4310 - protein, 373 aa, Streptococcus pyogenes
MVPRVNAPLIKWRSGMLFSSPKEGKTMDLQAQLEELKTKTLETLQSLTGNHTKELQDLRVAVLGKKGSLTELLKGLKDLSNDLRPVVGKQVNEVRDLLTKAFEEQAKIVEAAKIQAQLDAESIDVTLPGRQMTLGHRHVLTQTSEEIEDIFLGMGFQIVDGFEVEKDYYNFERMNLPKDHPARDMQDTFYITEEILLRTHTSPVQARTLDQHDFSKGPLKMVSPGRVFRRDTDDATHSHQFHQIEGLVVGKNISMGDLKGTLEMIIKKMFGDERSIRLRPSYFPFTEPSVEVDVSCFKCGGKGCNVCKKTGWIEILGAGMVHPSVLEMSGVDAKEYSGFAFGLGQERIAMLRYGINDIRGFYQGDQRFSEQFN

SEQ ID NO: 4311 - DNA, 105 bp, Streptococcus agalactiae
gtggcacgcttttttttgttttcaaagctacttattttgacttggaggaaagatggatttacaaaaacaattagaagagttgaaaatatcaactcaagaaaagct

SEQ ID NO: 4312 - protein, 35 aa, Streptococcus agalactiae
MARFFLFSKLLILTWRKDGFTKTIRRVENINSRKA

SEQ ID NO: 4313 - DNA, 99 bp, Streptococcus agalactiae
ttgcagtcacggctgaactccctaagcagcttcccttggtttactagtctcacagacctctattcaattaaagactattttatcaaatttttcagtctt

SEQ ID NO: 4314 - protein, 33 aa, Streptococcus agalactiae
MQSRLNSLSSFPWFTSLTDLYSIKDYFIKFFSL

SEQ ID NO: 4315 - DNA, 813 bp, Streptococcus agalactiae
ttgcttttttcattactggcaatagggttaggtgaaagcaaatctttgcctaatgatcacattttaaaacaggtgacagatttaattattagtaatgaatctggcaaaaatacttcccttaaaaatgtatcaggaactcctagtagagagttatctgaatctgttttgactagcaatgttaaaaaacaattgggaacaaatatagcttggaaccagtcaggtgcttttatcattaatcaaaataaaacagatttgaatgctaaagtgtcaagtgcaccatatgctattaatgaaataaagaaggttaataaccaaattgttccgactaaagcaaatgccttattaacaaaagcaactcgtcaatatcgaaatcgagaagaaacagggaatggtagaacttattggaaaccagctggatggcatcagataaatggattaaaagggagctataaccacgctgtggacagaggccatttaattggttatgctttagtagggagtttaagaggatttgatgcctccacaagtaatcctaaaaatattgccacacaagcagcttgggcaaaccaagctaatagcaaccaatcaacagggcaaaattattatgaaactttagttcgtaaagcattggatcgtcataaaactgttaggtatcgtgtgactttaatttatgacagagataatcttttatcttcgggatcacatattgaggctaaatcttcagatggaagtttagaatttaacgtttttattcctaatgtacaatcgggattattatttgattatgcaacaggaaaagtgaagcagacaaag

SEQ ID NO: 4316 - protein, 271 aa, Streptococcus agalactiae
MLFSLLAIGLGESKSLPNDHILKQVTDLIISNESGKNTSLKNVSGTPSRELSESVLTSNVKKQLGTNIAWNQSGAFIINQNKTDLNAKVSSAPYAINEIKKVNNQIVPTKANALLTKATRQYRNREETGNGRTYWKPAGWHQINGLKGSYNHAVDRGHLIGYALVGSLRGFDASTSNPKNIATQAAWANQANSNQSTGQNYYETLVRKALDRHKTVRYRVTLIYDRDNLLSSGSHIEAKSSDGSLEFNVFIPNVQSGLLFDYATGKVKQTK

SEQ ID NO: 4317 - DNA, 108 bp, Streptococcus agalactiae
ttgccagtaatgaaaaaagcaaagttacaatcgaagctgttatttgtttttgtttttttgtcattgtattattctactgctaaaattaactctcaaaggaaaccacta

SEQ ID NO: 4318 - protein, 36 aa, Streptococcus agalactiae
MPVMKKAKLQSKLLFVFVFLSLYYSTAKINSQRKPL

SEQ ID NO: 4319 - DNA, 1281 bp, Streptococcus agalactiae
atggagattcaaatggataaaattattgtggaaggtgggcaaacgcagcttcaaggtcaagttgttattgaaggagctaaaaatgcagttttacctcttttagcagccacaattttaccaagccaagggaaaacattgttgaccaatgttcctatcttgtctgatgtatttacaatgaacaatgttgttcgtggtttagatattcaagttgactttaattgcgataaaaaagaaatcttagtggatgcctcaggtgatattttagatgttgcaccttatgaatttgttagtcaaatgagagcttctattgttgttttgggacctattttagctagaaatggccatgctaaggtttcaatgccaggcggttgtacaattggtagccgaccaattgaccttcatcttaaaggtttagaagctatgggagctacgattacacaaaatggtggtgatattactgcccaagctgaaaagcttaagggagctaatatatacatggattttccctcagtcggtgccactcaaaacttaatgatggctgctacacttgcttcaggcacaacaacgatagagaatgctgcacgtgaaccagaaattgtagaccttgcgcagttactaaataaaatgggagctaaagtaaagggtgctggtacggaaacattaacgatcattggtgttgatgctttacatggtacagaacatgatgttgtccaagatcgtattgaagctggaacctttatggtggcagctgctatgacttctggaaatgttctagtaaaggatgctatttgggaacataaccgtcctttaatctctaaattgatggagatgggtgttgaagtgtcagaggaagaagatggtattcgtgtaaaagctgatactaaaaaattgaagccagtgactgtgaaaacactccctcatccaggatttcctactgatatgcaagctcaatttacagctctaatggcagtagttaatggcgaatcaactatgattgagacagtttttgaaaatcgttttcaacatttggaagaaatgcgtcgcatgggattacaaacggaaattttacgagatactgcaatgattcatggtgggagagctttacaaggtgcaccggtcatgtctactgacttacgagctagtgcagctttaatcttggcaggaatggttgcgcaagggcaaacagtagttggccaattaacccatttagaccgtggttattatcaattccatgaaaaattagcggctcttggtgctaatattaaacgtgtaagtgaggcg

SEQ ID NO: 4320 - protein, 427 aa, Streptococcus agalactiae
MEIQMDKIIVEGGQTQLQGQVVIEGAKNAVLPLLAATILPSQGKTLLTNVPILSDVFTMNNVVRGLDIQVDFNCDKKEILVDASGDILDVAPYEFVSQMRASIVVLGPILARNGHAKVSMPGGCTIGSRPIDLHLKGLEAMGATITQNGGDITAQAEKLKGANIYMDFPSVGATQNLMMAATLASGTTTIENAAREPEIVDLAQLLNKMGAKVKGAGTETLTIIGVDALHGTEHDVVQDRIEAGTFMVAAAMTSGNVLVKDAIWEHNRPLISKLMEMGVEVSEEEDGIRVKADTKKLKPVTVKTLPHPGFPTDMQAQFTALMAVVNGESTMIETVFENRFQHLEEMRRMGLQTEILRDTAMIHGGRALQGAPVMSTDLRASAALILAGMVAQGQTVVGQLTHLDRGYYQFHEKLAALGANIKRVSEA

SEQ ID NO: 4321 - DNA, 1269 bp, Streptococcus pyogenes
gtggataaaataatcattgaaggtggtcaaacacgcttagaaggagaagttgttattgagggtgctaaaaacgcagttcttcctttactggcagcatctattttaccttcaaaaggaaaaacaattcttagaaacgttcctattctatctgatgtttttaccatgaataacgtggtacgtggtttagatattcgtgttgattttaatgaagcagctaacgaaatcacagttgatgcctcaggacacattttagatgaagccccttacgagtacgtgagccaaatgcgtgcctctattgttgttttaggaccaattttggcacgtaatggccacgcaaaagtatcaatgcctggaggctgtacgattggcagtaggcctattaatttgcacttaaaaggattagaggctatgggggcaacgattactcaaaaaggtggagatattaccgctcaagcagatcgactgcaaggtgccatgatttatatggacttcccatctgtaggagctacccaaaacttgatgatggctgccactttagctgatggtgtgaccactattgaaaatgctgctcgtgagcctgaaattgttgatttagctcaatttttgaataaaatgggagctagaattcgtggtgctggaacagagacgttaacgataacaggtgtcacgcatttacgaggcgtagaacatgatgttgttcaagatcgtatagaagccggtacatttatggttgcagcggcgatgacttcaggcaatgttttgattagagatgctgtttgggaacataatcgtccattgatttcaaaattaatggaaatgggtgtttctgtaacagaagaagaatacggtattcgcgttcaagcaaacacgccaaagctcaaacctgtaacggttaaaaccttgcctcatccaggttttccaacagacatgcaagctcaatttacagctttaatggcagtggtcaatggagagtctactatggttgaaactgtctttgaaaatcgatttcaacatctggaagaaatgcgacgcatgggcttacaatctgaaatccttagggaaactgccatgattcatggtggaagacaactgcaaggtgctcctgtgatgtcaacagatttacgtgccagtgctgcccttatcttgacagggattgttgctcaaggagttacaatagttaataatttggttcatttagatcgtggctactatcaatttcatgaaaaattagcaaagcttggagctactattagtcgtagcagtgaggtc

SEQ ID NO: 4322 - protein, 423 aa, Streptococcus pyogenes
VDKIIIEGGQTRLEGEVVIEGAKNAVLPLLAASILPSKGKTILRNVPILSDVFTMNNVVRGLDIRVDFNEAANEITVDASGHILDEAPYEYVSQMRASIVVLGPILARNGHAKVSMPGGCTIGSRPINLHLKGLEAMGATITQKGGDITAQADRLQGAMIYMDFPSVGATQNLMMAATLADGVTTIENAAREPEIVDLAQFLNKMGARIRGAGTETLTITGVTHLRGVEHDVVQDRIEAGTFMVAAAMTSGNVLIRDAVWEHNRPLISKLMEMGVSVTEEEYGIRVQANTPKLKPVTVKTLPHPGFPTDMQAQFTALMAVVNGESTMVETVFENRFQHLEEMRRMGLQSEILRETAMIHGGRQLQGAPVMSTDLRASAALILTGIVAQGVTIVNNLVHLDRGYYQFHEKLAKLGATISRSSEV

SEQ ID NO: 4323 - DNA, 411 bp, Streptococcus agalactiae
atggcacaattgactgttcaagtagtaacaccagatggtattagatatgaccatcacgctagtctcattactgttagaacgccagatggtgaaatgggaattttaccaggtcacataaatttgattgctccccttaatgttcatcagatgaagattaatcgttctcatcaagaaggtgtagactgggtagctgttaatggtggtataattgaagttaatgaggatcaggtgacaattgttgcggattcagcagaacgagcacgtgatatagaccttaaccgtgcagaacgggctaaggaacgcgctgagcgtgcattagaaaaagctcaaacaactcagaatattgatgagatgcgtagagctgaggttgctcttcgtcgcgcaattaaccgtattagcgtcggtaaaaag

SEQ ID NO: 4324 - protein, 137 aa, Streptococcus agalactiae
MAQLTVQVVTPDGIRYDHHASLITVRTPDGEMGILPGHINLIAPLNVHQMKINRSHQEGVDWVAVNGGIIEVNEDQVTIVADSAERARDIDLNRAERAKERAERALEKAQTTQNIDEMRRAEVALRRAINRISVGKK

SEQ ID NO: 4325 - DNA, 414 bp, Streptococcus pyogenes
atgacacaaatgactgttcaagtggtaacgccagatggaatcaaatatgatcaccatgctaaatttatttcggtaacaacaccagatggggaaatggggattttacctaatcacatcaatttgattgcacctttgcaagttcatgaaatgaaaattcgccgaggtggtgaagatgaaaaagtggactggattgcaatcaatggtggtattattgaaatcaaggataatgtggttaccattgtcgctgattctgcagaacgtgaccgtgatatcgatgtcagccgagcagagcgagcaaaactaagagcagaacgtgaaattgcacaggctgaaacaacccataatattgatgaggttcgtcgtgccaaggttgccttgcgccgcgctttgaatcgtatcaacgttagtaaaaaa

SEQ ID NO: 4326 - protein, 138 aa, Streptococcus pyogenes
MTQMTVQVVTPDGIKYDHHAKFISVTTPDGEMGILPNHINLIAPLQVHEMKIRRGGEDEKVDWIAINGGIIEIKDNVVTIVADSAERDRDIDVSRAERAKLRAEREIAQAETTHNIDEVRRAKVALRRALNRINVSKK

SEQ ID NO: 4327 - DNA, 1404 bp, Streptococcus agalactiae
atgagctcaggcaaaattgctcaggtagttggacctgtcgttgacgttgtatttgcaagtggcgacaaacttcctgagattaataatgcattgattgtctataaaaatggcgataagtcacaaaaagtagtacttgaagttgctcttgaacttggtgacggcctcgttcgtacaatcgctatggaatcaactgatgggcttacacgtggtttggaagtattagatactggtcgcgcaattagtgtgccggttggtaaggatactttgggtcgtgtcttcaacgttcttggagatgctattgaccttgaagagccttttgcagaagatgcagaacgtcaaccaatccataaaaaagcaccatcgtttgatgaattatcaacatcatcagaaatcttagaaactggtattaaagttattgacttattagcaccttacttaaaaggtggtaaagttggacttttcggtggtgcaggtgttggtaaaaccgttcttattcaagaattaatccacaacatcgcccaagaacatggtggtatttcagtatttactggtgtaggagaacgtactcgtgaagggaatgacctttattgggaaatgaaagaatctggcgttattgaaaaaacggctatggtctttggtcaaatgaatgaaccaccaggagcacgtatgcgtgtggcacttactggtcttacaatagctgagtacttccgtgatgtagaaggacaagatgtgcttctcttcattgataatatcttccgtttcacacaagctgggtcagaagtgtcagcgcttttaggtcgtatgccttcagccgttggttatcaaccaacacttgctacagaaatgggacaattacaagagcgtatcacttcaactaaaaaaggttctgttacatcaatccaagctatttatgtgccagcagatgactatactgaccctgcgccagctacagcctttgctcacttagattcaacaactaaccttgaacgtaaattgacacaaatggggatttatccagccgttgacccattagcttcaagttctcgtgcactcacaccagaaatcgttggagatgagcactatgaagttgcaacagaagtacagcgtgttcttcaacgttaccgtgagttacaagatatcattgcgattttaggtatggatgaattatcagatgaggaaaaaacgttagttggacgtgcacgtcgtatccaattcttcctttctcaaaacttcaatgttgcagaaacatttactggtcaaccaggttcatatgttccggttgaagaaactgttcgcggattcaaagaaatcctagatggtaaacatgatcaaattccagaagatgccttccgtatggttggtggtattgaggatgttatcgcaaaagcagaaaaaatgaactat

SEQ ID NO: 4328 - protein, 468 aa, Streptococcus agalactiae
MSSGKIAQVVGPVVDVVFASGDKLPEINNALIVYKNGDKSQKVVLEVALELGDGLVRTIAMESTDGLTRGLEVLDTGRAISVPVGKDTLGRVFNVLGDAIDLEEPFAEDAERQPIHKKAPSFDELSTSSEILETGIKVIDLLAPYLKGGKVGLFGGAGVGKTVLIQELIHNIAQEHGGISVFTGVGERTREGNDLYWEMKESGVIEKTAMVFGQMNEPPGARMRVALTGLTIAEYFRDVEGQDVLLFIDNIFRFTQAGSEVSALLGRMPSAVGYQPTLATEMGQLQERITSTKKGSVTSIQAIYVPADDYTDPAPATAFAHLDSTTNLERKLTQMGIYPAVDPLASSSRALTPEIVGDEHYEVATEVQRVLQRYRELQDIIAILGMDELSDEEKTLVGRARRIQFFLSQNFNVAETFTGQPGSYVPVEETVRGFKEILDGKHDQIPEDAFRMVGGIEDVIAKAEKMNY

SEQ ID NO: 4329 - DNA, 1404 bp, Streptococcus pyogenes
atgagctcaggcaaaattgctcaggttgttggtccagtagtagacgttatgtttgctagcggggacaaacttccagagattaataatgcattgattgtttataaagatagtgataaaaagcaaaaaatcgtccttgaagttgctctggaacttggtgacggtatggtgcgaacaatcgctatggaatcaactgatgggcttacacgtgggttagaagttcttgacactggtcgtgcgattagcgtaccagtaggtaaagaaactttgggacgcgtctttaatgtacttggagaaaccattgacttggaagaaccatttgcagaagacgttgaccgtcagccgatccataaaaaagcaccatcgtttgatgaattatcaacatcatcagaaattcttgaaactggtatcaaggtaattgaccttcttgccccttaccttaaaggtggtaaagttggacttttcggtggtgccggagttggtaagactgtccttatccaagaattaatccacaatatcgcccaagaacacggaggtatttcagtatttaccggtgttggtgagcgaacacgtgaaggaaatgacctttactgggaaatgaaagaatcaggcgttattgagaaaactgccatggtttttggtcaaatgaatgagccgcctggggcacgtatgcgtgtagcccttactggtttaaccattgctgagtatttccgtgatgtagaaggccaagatgttttgctctttattgataatatcttccgtttcactcaggcaggttcagaagtatcagccctcttaggccgtatgccttctgctgttggttaccaaccgacccttgctactgaaatgggacaattgcaagaacgtattacgtcaactcaaaaaggatctgttacttctatccaagcgatttatgtgccagccgatgactatactgacccagcgccagcaactgcatttgctcacttggattcaacaactaaccttgagcgtaaattgactcaaatgggtatttaccctgcggttgacccattggcttcaagttcacgggccttatcacctgaaattgttggtgaagagcactatgctgtggcaacagaggttcaacgtgtacttcagcgctaccgtgaattacaagacatcatcgctattttggggatggatgaattatcagatgaagaaaaaacattggttggacgtgcgcgtcgtatccagttcttcttatcacaaaactttaatgttgctgaacaatttacaggtcttcctggttcttacgtgccagttgctgatacagttcgcggctttaaagaaattcttgaaggaaaatacgatgaacttccagaagatgccttccgttcagttggtccaatcgaggatgtgattaaaaaagccgaaaaaatgggcttt

SEQ ID NO: 4330 - protein, 468 aa, Streptococcus pyogenes
MSSGKIAQVVGPVVDVMFASGDKLPEINNALIVYKDSDKKQKIVLEVALELGDGMVRTIAMESTDGLTRGLEVLDTGRAISVPVGKETLGRVFNVLGETIDLEEPFAEDVDRQPIHKKAPSFDELSTSSEILETGIKVIDLLAPYLKGGKVGLFGGAGVGKTVLIQELIHNIAQEHGGISVFTGVGERTREGNDLYWEMKESGVIEKTAMVFGQMNEPPGARMRVALTGLTIAEYFRDVEGQDVLLFIDNIFRFTQAGSEVSALLGRMPSAVGYQPTLATEMGQLQERITSTQKGSVTSIQAIYVPADDYTDPAPATAFAHLDSTTNLERKLTQMGIYPAVDPLASSSRALSPEIVGEEHYAVATEVQRVLQRYRELQDIIAILGMDELSDEEKTLVGRARRIQFFLSQNFNVAEQFTGLPGSYVPVADTVRGFKEILEGKYDELPEDAFRSVGPIEDVIKKAEKMGF

SEQ ID NO: 4331 - DNA, 879 bp, Streptococcus agalactiae
atggcaggctctcttagtgaaattaaagacaagattctctctacagaaaaaacaagtaagattactagtgcgatgcagatggtctcatctgctaagttggttaaatctgaacaagctgctagagattttcaagtgtatgcctctaaaattcgtcaaattactactaacctcttaaagtcagacttagtatctggatcagataaccctatgttatcttcacgtccggtgaagaaaacaggttatattgttattacttctgataagggtttagttggtggttacaattcaaaaatcttaaaagcgatgatggacactataactgactatcatactgagaatgatgattatgccatcatttcaattggtagtgttggttctgattttttcaaagcacgtggaatgaatgtttctttcgaattacgtggtttagaggaccaaccaagttttgatcaagttggtaaaattattgctcaagcagttgaaatgtacaaaaatgagttgttcgatgaattatatgtttgctacaatcaccatgttaacagtttaactagccaagtcagaatgcaacaaatgcttcctatcaaagaattggatgcagaagaggcttctgaggatagagtgattactggttttgaacttgagccaaaccgtgaagttatattggagcaattattgcctcaatatactgagagtttgatttatggagctattattgatgctaaaacagcagagcatgcggctggtatgacagctatgcagactgcaactgataatgctaaaaatgttatcaatgatttaactattcaatataaccgcgctcgtcaagcagctatcacacaggaaattacagaaattgttgcaggtgctaatgcacttgaa

SEQ ID NO: 4332 - protein, 293 aa, Streptococcus agalactiae
MAGSLSEIKDKILSTEKTSKITSAMQMVSSAKLVKSEQAARDFQVYASKIRQITTNLLKSDLVSGSDNPMLSSRPVKKTGYIVITSDKGLVGGYNSKILKAMMDTITDYHTENDDYAIISIGSVGSDFFKARGMNVSFELRGLEDQPSFDQVGKIIAQAVEMYKNELFDELYVCYNHHVNSLTSQVRMQQMLPIKELDAEEASEDRVITGFELEPNREVILEQLLPQYTESLIYGAIIDAKTAEHAAGMTAMQTATDNAKNVINDLTIQYNRARQAAITQEITEIVAGANALE

SEQ ID NO: 4333 - DNA, 873 bp, Streptococcus pyogenes
atggcaggctctctaagtgaaattaaagctaaaattatttcaactgagaaaacaagtaaaatcactagtgccatgcgtatggtttcttctgcaaaacttgttaaatctgagcaagcagctcgtgattttcaaatttacgcctcaaaaattcgccagattactacagatttattgaaatcagaattaaccataggatctgataatccgatgttggtgtctcgtcctgtcaaaaaaacaggctatattgtcatcacgtctgataaaggacttgttggaggttacaattcaaaaatcttgaaatctgttatggatatgattacagagtaccatgctgatggtgactatgaaatcatttctattggtagtgttggttcagacttcttcaaagcaagagggatgaatgtggcttttgaacttcgtggacttgcggatcaaccaagttttgaacaagtgagacaaatcatttcacaatccgttgacatgtttgtcaatgagatttttgatgagttatatgtctgttacaatcaccatgtgaatagcttaaccagccaagtccgtgttcaacagatgttgccaatttctgacttggttgctgatgaagcagcagaagaaggtgttactgggtttgaattggaacctaatcgtcatgatattttagatcaattgttacctcaattcacagaaagtttaatttatggggctatcattgatgctaaaacggctgaacatgcagcaggtatgactgccatgcagacagcaactgataacgctaagaatgtcattaacgatttgaccatccaatataaccgagctcgtcaagcagcaattacacaagaaattactgaaattgttgcaggagcaaatgcactagaa

SEQ ID NO: 4334 - protein, 291 aa, Streptococcus pyogenes
MAGSLSEIKAKIISTEKTSKITSAMRMVSSAKLVKSEQAARDFQIYASKIRQITTDLLKSELTIGSDNPMLVSRPVKKTGYIVITSDKGLVGGYNSKILKSVMDMITEYHADGDYEIISIGSVGSDFFKARGMNVAFELRGLADQPSFEQVRQIISQSVDMFVNEIFDELYVCYNHHVNSLTSQVRVQQMLPISDLVADEAAEEGVTGFELEPNRHDILDQLLPQFTESLIYGAIIDAKTAEHAAGMTAMQTATDNAKNVINDLTIQYNRARQAAITQEITEIVAGANALE

SEQ ID NO: 4335 - DNA, 90 bp, Streptococcus agalactiae
atgaattcctcagccattgctactcctgcatatggagcaatgaaaagtaatggagatggttgtgatgctgaagctgtcacaacgattgta

SEQ ID NO: 4336 - protein, 30 aa, Streptococcus agalactiae
MNSSAIATPAYGAMKSNGDGCDAEAVTTIV

SEQ ID NO: 4337 - DNA, 1503 bp, Streptococcus agalactiae
ttggcaattaatgcacaagaaattagcgctttaattaaaaagcaaattgaagacttccagccaaattttgacgtcacagaaactggtattgttacatatatcggtgatggtattgctcgtgctcgtgggctagataatgctatgagtggagaacttcttgaattttcaaatggtgcgtacggtatggctcaaaaccttgagtctaatgacgtgggtatcattattttgggtgatttctcagaaattcgtgaaggtgatgtggtaaaacgtactggtaaaattatggaagtaccagtaggggaagctatgattggacgtgtcgtcaatccgcttggtcaaccagttgatggactaggtgaaattgagacgacagcaacacgcccagttgaaacaccagcacctggtgttatgcaacgtaaatcagtttttgagcctcttcaaacaggtctcaaagcgattgatgctttggttcctatcggacgtggtcaacgcgaattgattatcggtgaccgccaaactggtaagacgtctgtagcgattgatgcaatcttgaatcaaaaaggtcaagatatgatctgtatctatgtggctatcggtcaaaaagagtctacagtacgtacacaagttgaaactttgcgtaaatacggtgcccttgattatacaatcgttgtgacagcttcagcatcacaaccatctccattacttttcattgctccatatgcaggagtagcaatggctgaggaattcatgtataacgggaaacacgttttgattgtttatgatgatttatcaaaacaagccgtagcttatcgtgaactttcgcttcttcttcgccgtcctccaggtcgcgaagcttacccaggggatgttttctaccttcatagtcgtcttttggaacgttcagctaaagtatcagatgctttaggtggaggttcgattacagcgcttccgttcattgaaacacaagcaggtgatatctcagcatatattgctacaaacgttatttcaattactgacggccaaattttcttgcaagaaaatctctttaactcaggtattcgtccagcgattgatgcaggttcatcagtatctcgtgttggtggtgcagcgcaaattaaagcgatgaagagagttgcaggtacgcttcgtctagatcttgcttcttatcgcgaacttgaggcattcactcaatttggttcagaccttgatgcagcaacacaagcaaaactaaatcgtggtcgtcgcacagtggaagtgttaaaacaaccattacacaaaccattaccagttgagaaacaagttgtgattttatatgctctaacacatggattccttgatgatgtacctgtaaatgatattttagcttttgaagaagctttgtatgattactttgatgctcattatgataatctcttcgaaacaatccgcacaacaaaagatttaccagaagaagcagaattagatgctgctattcaagcatttaaagatcaatcacaatttaaa

SEQ ID NO: 4338 - protein, 501 aa, Streptococcus agalactiae
MAINAQEISALIKKQIEDFQPNFDVTETGIVTYIGDGIARARGLDNAMSGELLEFSNGAYGMAQNLESNDVGIIILGDFSEIREGDVVKRTGKIMEVPVGEAMIGRVVNPLGQPVDGLGEIETTATRPVETPAPGVMQRKSVFEPLQTGLKAIDALVPIGRGQRELIIGDRQTGKTSVAIDAILNQKGQDMICIYVAIGQKESTVRTQVETLRKYGALDYTIVVTASASQPSPLLFIAPYAGVAMAEEFMYNGKHVLIVYDDLSKQAVAYRELSLLLRRPPGREAYPGDVFYLHSRLLERSAKVSDALGGGSITALPFIETQAGDISAYIATNVISITDGQIFLQENLFNSGIRPAIDAGSSVSRVGGAAQIKAMKRVAGTLRLDLASYRELEAFTQFGSDLDAATQAKLNRGRRTVEVLKQPLHKPLPVEKQVVILYALTHGFLDDVPVNDILAFEEALYDYFDAHYDNLFETIRTTKDLPEEAELDAAIQAFKDQSQFK

SEQ ID NO: 4339 - DNA, 1506 bp, Streptococcus pyogenes
ttggcaattaatgcacaagaaattagcgctttaattaaaaagcaaattgagaacttccagccaaatttcgatgtcacagaaactgggatcgttacctatattggtgacggtattgcacgtgcccgtggattagataatgccatgagtggtgaacttcttgaatttgaaaatggtgcctacgggatggctcaaaaccttgagtcaaatgatgtgggtattattattcttggtgatttttcagcaatccgtgaaggagatgtggttaagcgcaccggtaaaatcatggaagtaccagttggtgaagctctcattggacgtgtggtaaacccacttggacaaccagttgatggcttgggagatattgaaacaactggctttagaccagtagaaacgccagctcctggtgttatgcagcgtaaatccgtttctgaacccttacaaactggattaaaagcaattgatgctttggttccaattggtcgtgggcaacgtgagttgattatcggagaccgtcaaacaggaaaaacatccgtagctattgatgcgattttgaaccaaaaaggtcaagacatgatttgtatctatgtggctattggtcaaaaagaatcaaccgttcgtacacaagttgaaacccttcgccgttacggtgccttggattatactattgttgtgacagcgtcagcctcacaaccatcaccattgctctttatcgctccttatgcgggtgttgccatggctgaagaatttatgtaccaaggcaagcatgtcttgattgtctatgatgatttatcaaaacaagcggtggcttatcgtgaattgtctctcttgcttcgtcgtccaccaggtcgtgaggcttacccaggggatgttttctacttgcatagccgtcttttggaacgctctgcaaaagtttctgatgacttaggtggaggttctatcacagctctaccatttatcgaaacacaggccggagatatctctgcatatattgcgactaacgttatttcgattacagacggacaaatcttcttgcaagagaacctctttaattcaggaattcgtccagcgattgatgcaggatcatctgtctcacgtgtaggtggttccgctcaaattaaagcgatgaaaaaggttgctggtactcttcgtttggatttggcttcctatcgtgaattagaagcctttacccaatttggttcggaccttgatgctgcaacacaagcaaaacttaatcgtggtcgccgtacggttgaaatcttgaagcaaccattgcataaaccgttacctgttgaaaagcaagtcgttattctttatgcccttactcatggtttcttagatgatgttcctgtagatgatattttggcttttgaagaagctctttacgactactttgacgttcattacaatgatttatttgaaactatccgtaccacaaaagaccttcctgaagaagctgcccttgatgccgctattaaagcgtttaaagaacactcaaactttaagtca

SEQ ID NO: 4340 - protein, 502 aa, Streptococcus pyogenes
LAINAQEISALIKKQIENFQPNFDVTETGIVTYIGDGIARARGLDNAMSGELLEFENGAYGMAQNLESNDVGIIILGDFSAIREGDVVKRTGKIMEVPVGEALIGRVVNPLGQPVDGLGDIETTGFRPVETPAPGVMQRKSVSEPLQTGLKAIDALVPIGRGQRELIIGDRQTGKTSVAIDAILNQKGQDMICIYVAIGQKESTVRTQVETLRRYGALDYTIVVTASASQPSPLLFIAPYAGVAMAEEFMYQGKHVLIVYDDLSKQAVAYRELSLLLRRPPGREAYPGDVFYLHSRLLERSAKVSDDLGGGSITALPFIETQAGDISAYIATNVISITDGQIFLQENLFNSGIRPAIDAGSSVSRVGGSAQIKAMKKVAGTLRLDLASYRELEAFTQFGSDLDAATQAKLNRGRRTVEILKQPLHKPLPVEKQVVILYALTHGFLDDVPVDDILAFEEALYDYFDVHYNDLFETIRTTKDLPEEAALDAAIKAFKEHSNFKS

SEQ ID NO: 4341 - DNA, 534 bp, Streptococcus agalactiae
atgaataaaaagacgcaggctctaattgagcaatattcaaaaagccttgttgaagttgccattgaacataaaattgttgaaaaaatccaacaagaagtagcagctttaattgatatttttgaaacaagcgagcttgagggtgtcctgtcaagtcttgccgtttcacatgatgaaaaacaacattttgtgaagacattgcaaacatcatgttcaacttatcttgttaatttccttgaggttattgtacaaaatgaacgtgaagcacttctatatcctattttgaaatcagttgatcaggaacttatcaaagtgaatggtcaatatccaattcaaattacaactgcagttgctttgtctccagaacaaaaagaacgtctttttgatattgctaaaactaaattagctttaccaaatggacagttagttgagcacattgacccatctattgttggtggatttgttgtcaatgcaaacaataaagtaattgatgcaagtgttcgtaatcaattacatcaatttaaaatgaaattaaaa

SEQ ID NO: 4342 - protein, 178 aa, Streptococcus agalactiae
MNKKTQALIEQYSKSLVEVAIEHKIVEKIQQEVAALIDIFETSELEGVLSSLAVSHDEKQHFVKTLQTSCSTYLVNFLEVIVQNEREALLYPILKSVDQELIKVNGQYPIQITTAVALSPEQKERLFDIAKTKLALPNGQLVEHIDPSIVGGFVVNANNKVIDASVRNQLHQFKMKLK

SEQ ID NO: 4343 - DNA, 534 bp, Streptococcus pyogenes
atgaccaaaaaagaacaggctcttatcgagcaatatgcaaaaagccttgttgaggtggcgagtgaacatcattctcttgatgccttacaagctgatgtgcttgcgattttagagacgtttgtaacaactaatcttgatcaaagtctatcaagtcaagctgttccgcatgctgaaaaaataaaattgctaaccttattaaagggaaataattctgtttatatgaataatttcttgaatctcattttacaaaacgaacgtgaagcttatttgtatcaaatgcttcaggctgttttaaatgaaattgcaatagtttcaaatcagtatgatgtgactgttacctcatcactacctttgactgaggagcaaaaaagccgtgttcgagcagttgttgcaaagaaatttgctgtaacagcgggtcgtttaattgaaaaagtagatccttcgcttattggaggatttattatcagcgtcaataataaagtaattgataccagtattcgtcgtcaattgcaagcatttaaaatgaatttaaaa

SEQ ID NO: 4344 - protein, 178 aa, Streptococcus pyogenes
MTKKEQALIEQYAKSLVEVASEHHSLDALQADVLAILETFVTTNLDQSLSSQAVPHAEKIKLLTLLKGNNSVYMNNFLNLILQNEREAYLYQMLQAVLNEIAIVSNQYDVTVTSSLPLTEEQKSRVRAVVAKKFAVTAGRLIEKVDPSLIGGFIISVNNKVIDTSIRRQLQAFKMNLK

SEQ ID NO: 4345 - DNA, 495 bp, Streptococcus agalactiae
atgtcaatacttattaatagtacaacgattggtgatatcattatcgtatctggctctgtgcttctcttatttatcttaattaagacttttgcatggaaacaaatcacaggtatttttgaagcccgtgaacaaaagatagctaatgatattgatactgctgaacaggcacgtcaacaagctgaagcttttgcaactaagcgcgaggaagaactatctaacgctaaaactgaagctaatcaaatcattgataacgctaaagagacaggtcttgcaaaaggtgatcaaattatttcagaagcaaaaactgaagctgatcgattaaaagaaaaagcacatcaagatattgcccaaaataaggcagaagcactagcagatgttaagggtgaagtagcagatttaacagttttattagctgaaaaaattatggtatcaaatcttgataaagaagctcagagtaatctcattgatagctatattaaaaagctaggagatgcc

SEQ ID NO: 4346 - protein, 165 aa, Streptococcus agalactiae
MSILINSTTIGDIIIVSGSVLLLFILIKTFAWKQITGIFEAREQKIANDIDTAEQARQQAEAFATKREEELSNAKTEANQIIDNAKETGLAKGDQIISEAKTEADRLKEKAHQDIAQNKAEALADVKGEVADLTVLLAEKIMVSNLDKEAQSNLIDSYIKKLGDA

SEQ ID NO: 4347 - DNA, 492 bp, Streptococcus pyogenes
atgtcaatcacatttggtgaactcgttgggaattttattctagtaacaggttctgtaatcgtcttgttactcttgatcaaaaaattcgcttggggtgcgattgaatcgattttacagacacgctcacaacaaatctctcgagatattgatcaggctgagcaatcacgtctaagtgctcaacagttagaggcaaaaagtcaagctaacctagatgctagtcgtttacaagcaagtaaaatcattagtgatgccaaagaaattggtcaattacaaggtgataaattggtggcagaagctactgatgaagcaaaacgcttgaaagaaaaagcgttgacagatattgaacaaagcaaatcagacgctatttcagcagtcaaaacagaaatgtctgatttaacggttcttttagcggaaaaaattatgggagccaatcttgataagacggcgcaaagccagcttattgacagttatcttgatgacttaggagaagct

SEQ ID NO: 4348 - protein, 164 aa, Streptococcus pyogenes
MSITFGELVGNFILVTGSVIVLLLLIKKFAWGAIESILQTRSQQISRDIDQAEQSRLSAQQLEAKSQANLDASRLQASKIISDAKEIGQLQGDKLVAEATDEAKRLKEKALTDIEQSKSDAISAVKTEMSDLTVLLAEKIMGANLDKTAQSQLIDSYLDDLGEA

SEQ ID NO: 4349 - DNA, 714 bp, Streptococcus agalactiae
ttggaatctacaagtaatccaaccgtatcttttttaggcattgattttgatttaaccatcctagctatgtctctcttgacaattactattatctttatcttagtcttctgggctagtcgtaagatgacaataaaaccaaaaggtaagcagaatgtcttagaatatgtctatgagcttgttaataatacaatctcacaaaatttaggacactatactaaaaattatagtttattgatgtttattttattcagttttgtcttcattgctaacaacttaggattgatgacatcattgaaaacacatgagcataatttttggacatctccgaccgctaattttggtgtagatattacattatcattattagtagcatttatttgtcatattgaaggtattcgcaaaaaaggaattggtggttatctcaaaggtttcttatcaccaacaccagcaatgcttccgatgaatttattggaagaagttactaatgttgcttcattagcattgcgtctttttggtaatatcttttctggtgaagttgtcactggattacttttacaacttgcagttttatcaccatttacaggtccactagcttttgcattgaatatcgtttggacagcattctcaatgtttattggtttcatccaagcgtatgtgttcattatcttgagctcaagttatattggacacaaagttcatggtgacgaagaagaa

SEQ ID NO: 4350 - protein, 238 aa, Streptococcus agalactiae
MESTSNPTVSFLGIDFDLTILAMSLLTITIIFILVFWASRKMTIKPKGKQNVLEYVYELVNNTISQNLGHYTKNYSLLMFILFSFVFIANNLGLMTSLKTHEHNFWTSPTANFGVDITLSLLVAFICHIEGIRKKGIGGYLKGFLSPTPAMLPMNLLEEVTNVASLALRLFGNIFSGEVVTGLLLQLAVLSPFTGPLAFALNIVWTAFSMFIGFIQAYVFIILSSSYIGHKVHGDEEE

SEQ ID NO: 4351 - DNA, 714 bp, Streptococcus pyogenes
atggaagaagctaaaatacctatgctgaagcttggtccaataacctttaatttgaccctacttgctgtttgtattgtcacaattgcgattgtctttgcctttgttttttgggcaagtcgccaaatgaaattgaaaccagaagggaagcaaactgctttagaatatttaatcagttttgtggatggtattggagaagagcacttagatcataatctacaaaaatcttattcgctgttactctttaccatttttctctttgtggctgtcgctaataatttagggttatttactaagttagagacagttaatggctataacctatggacctcgccaacagccaatctggcttttgaccttgctctatctctttttattaccttaatggtacacattgaaggggttagacggcgtggcttggttgcccatttgaaacgtttggctacaccgtggccaatgactccgatgaatttattagaagagttcacaaatttcttatcacttgccattaggttattcggtaatatctttgccggggaagttgttacaggtttgattgttcaactggccaattatcgagtttattggtggccgattgctttcctagtcaatatggcgtggacagccttttcagtctttatttcctgcatacaggctttcgttttcacaaaactgacagcgacctatctaggaaagaaagtcaatgaatcagaagaa

SEQ ID NO: 4352 - protein, 238 aa, Streptococcus pyogenes
MEEAKIPMLKLGPITFNLTLLAVCIVTIAIVFAFVFWASRQMKLKPEGKQTALEYLISFVDGIGEEHLDHNLQKSYSLLLFTIFLFVAVANNLGLFTKLETVNGYNLWTSPTANLAFDLALSLFITLMVHIEGVRRRGLVAHLKRLATPWPMTPMNLLEEFTNFLSLAIRLFGNIFAGEVVTGLIVQLANYRVYWWPIAFLVNMAWTAFSVFISCIQAFVFTKLTATYLGKKVNESEE

SEQ ID NO: 4353 - DNA, 198 bp, Streptococcus agalactiae
atgaatttagctattttagcacttggtttcgccgtgatgggtgtttcaatcggtgaaggaattttggttgcaaatattgccaaatcagcggctcgtcagcctgaaatgtttagcaaactgcaaacattgatgtttacaggtgtggccttcattgaaggtaccttcttcgttctatttgcgtttacattcttagtaaga

SEQ ID NO: 4354 - protein, 66 aa, Streptococcus agalactiae
MNLAILALGFAVMGVSIGEGILVANIAKSAARQPEMFSKLQTLMFTGVAFIEGTFFVLFAFTFLVR

SEQ ID NO: 4355 - DNA, 195 bp, Streptococcus pyogenes
atgaatcctattttcgcattggctttggcctgttttggtgtttctcttgctgaaggtttcttgatggcaaatcttttcaaagcagcttctcgccaaccagaaatcattggtcaattacgttcattaatgatcttgggtgttgcctttatcgaaggtactttcttcgttacccttgttatggccttcattcttaaa

SEQ ID NO: 4356 - protein, 65 aa, Streptococcus pyogenes
MNPIFALALACFGVSLAEGFLMANLFKAASRQPEIIGQLRSLMILGVAFIEGTFFVTLVMAFILK

SEQ ID NO: 4357 - DNA, 147 bp, Streptococcus agalactiae
ttggcaatatttgcaaccaaaattccttcaccgattgaaacacccatcacggcgaaaccaagtgctaaaatagctaaattcataatagaattctcctttaaaaaatatttactccgttattttattcctatttcttgtgcatgtcaa

SEQ ID NO: 4358 - protein, 49 aa, Streptococcus agalactiae
MAIFATKIPSPIETPITAKPSAKIAKFIIEFSFKKYLLRYFIPISCACQ

SEQ ID NO: 4359 - DNA, 1428 bp, Streptococcus agalactiae
atgaaaataatgtttgttgcggcagagggtgctccctttgctaaaacaggtggtttgggagatgtgattggcgcactcccaaaatcacttagtaaaaaaggtcatgatgtcgctgttgtcatgccatattatgatatggtagaccaaaaatttggagaccaaatagaaaacctcatgtatttctatacagatgttggctggcgtcatcaatatgtaggagttaagagactttctcaagataatgttacgttctactttattgataatcaatattatttttatagaggtcatgtctatggtgattgggatgatggggagcgttttgcttatttccaattagctgctttagagttgatggagaaaatcgattttattcccgatgtcttacacgtccatgattatcatacagcaatgattcctttcttattgaaagagaagtaccactggattcaggcctataataatataagagcagtttttactattcacaatattgaatttcaagggcagtttggtccagaaatgttaggagatttatttggagttggcgctgagagatatgaagatggaactcttagatggaataattgtcttaattggatgaaagcagcaattctttactcagatagagtgacaacggtatcaccaagctacgcaaatgaaataaaaactccagaatttggtaaaggtttagatcaaattatgcgtatggaagcaggcaaattatctggaattgtaaatggtattgatagcgatttgttaaatccagaaacagatgcttttttgccatatcatttttcaaaaagcaacttagagggcaaaattaaaaataagttggctttacaggaaaatttgggcttacctcaagataaaaatgtaccattaattggtattgtttcacgacttaccgatcaaaaaggatttgatattattgcttctgaattggacaatatgcttcaacaagatattcaaatggttattttaggaacaggctatcaccattttgaagaaacgttctcttattttgctagtcgttaccctgaaaaactatctgctaatattacttttgacttaagattagcgcaacagatttatgcggcttcagatatcttcatgatgccaagtgcttttgaaccttgtggtctctcgcagatgatggctatgagatatggtagcttgcccttggtacatgaagttggaggattaaaagatactgtggtagccttcaatcaatttgatggtagtggtacaggtttttcatttaatcatttttcaggctattggttaatgcaaactctaaaactagcattagaagtttataatgattatcctgaagcgtggaaaaagttacaatggcaagctatgtcaaaagatttttcatgggatacagcatgtgttgcttacgaacaactgtatcagcaactacaa

SEQ ID NO: 4360 - protein, 476 aa, Streptococcus agalactiae
MKIMFVAAEGAPFAKTGGLGDVIGALPKSLSKKGHDVAVVMPYYDMVDQKFGDQIENLMYFYTDVGWRHQYVGVKRLSQDNVTFYFIDNQYYFYRGHVYGDWDDGERFAYFQLAALELMEKIDFIPDVLHVHDYHTAMIPFLLKEKYHWIQAYNNIRAVFTIHNIEFQGQFGPEMLGDLFGVGAERYEDGTLRWNNCLNWMKAAILYSDRVTTVSPSYANEIKTPEFGKGLDQIMRMEAGKLSGIVNGIDSDLLNPETDAFLPYHFSKSNLEGKIKNKLALQENLGLPQDKNVPLIGIVSRLTDQKGFDIIASELDNMLQQDIQMVILGTGYHHFEETFSYFASRYPEKLSANITFDLRLAQQIYAASDIFMMPSAFEPCGLSQMMAMRYGSLPLVHEVGGLKDTVVAFNQFDGSGTGFSFNHFSGYWLMQTLKLALEVYNDYPEAWKKLQWQAMSKDFSWDTACVAYEQLYQQLQ

SEQ ID NO: 4361 - DNA, 672 bp, Streptococcus agalactiae
atgccgagatcagctattgcagaggctaatcaagtcttgaccattgatgaatctgatcatgtagtgagtctaggtaaagctgtagataatgacgataaccaaaaaatgtctgctgagatttatgttatcgatacaccttggttaatcgaaaaaatggaagaggaagctcaaaataatgaaccacgtaaactccgcttcttacttcgtgatttaattgttgaaagtaatgctttggcttttgaatacactggttatttgtcaaacatttcttctattaaatcctattatgatgctaacatggacatgttaacaccaaataaattttattcgctcttcttttcaaaccaaaaagtttatactaaggtgaaaaatgaggaagctacttattttgataaacaatcaaatgtctctaattcgcaactagcctctggaagtattattaaaggttatttagaccattctatcgtttctagaaattgtctccttgaaaaagggactcgagtagtcaatagtattatctttccaaaagtaaaaatcggagaaggggcaaccattgaaaatactattattgacaaatgcgttaaggttgcatccggagttacattgaaaggtagtttagataaaccgttagtgattcctaaattttcagagattaatgaggatattatacaa

SEQ ID NO: 4362 - protein, 224 aa, Streptococcus agalactiae
MPRSAIAEANQVLTIDESDHVVSLGKAVDNDDNQKMSAEIYVIDTPWLIEKMEEEAQNNEPRKLRFLLRDLIVESNALAFEYTGYLSNISSIKSYYDANMDMLTPNKFYSLFFSNQKVYTKVKNEEATYFDKQSNVSNSQLASGSIIKGYLDHSIVSRNCLLEKGTRVVNSIIFPKVKIGEGATIENTIIDKCVKVASGVTLKGSLDKPLVIPKFSEINEDIIQ

SEQ ID NO: 4363 - DNA, 1155 bp, Streptococcus agalactiae
ttgaaaggaaagaataatatgaaaaatgaaatgttagcactcattctcgccggaggacaaggcactcgactcggaaaattgactcagagcattgcgaaacctgctgttcaatttggaggtcgttaccgtattattgactttgcgctttcaaattgtgcgaattcaggtattaataatgttggagttattactcagtatcaaccgctggaactcaatactcatattggaaacggatctagctggggactagatggtatcgattcgggagtaactgtattacagccatattctgcaacagaaggtaatcgctggtttcaaggtaccagccacgctatctatcaaaatattgactacattgatcgtattaatccagaatatgtactcattctctctggggaccacatctataaaatgaactatgatgacatgctacagacgcataaagataatttagcaagcctaacagtcgctgttttagatgttcctttaaaagaagcaagccgttttggaattatgaatactgattcaaacgaccgtattgtcgaatttgaagaaaaacctgaacatcctaagtcaacaaaggcttcaatgggaatatacatttttgactggaagagattacggacagttttaattgatggtgaaaagaacggcatagacatgtcagactttggtaaaaatgttataccagcataccttgaatcgggtgaacgtgtttatacctataattttgatgggtattggaaagatgttggtactattgaatccctttgggaagctaatatggaatatattggagaagataacaaattacatagtcgtgatcgttcatggaaaatctattctaaaaatttgattgcaccacctaatttcatgacagaagatgcaaatgttaaagattctttagttgtagatggatgctttgttgcaggaaatgttgagcactccattttatcaactaatgtccaggtaaaaccaaatgctattattaaagactcctttgttatgagtggcgcgactatcggtgaaggtgcaaagataaatcgagctattatcggtgaggatgctgttattggtgatggtgttgtgattgatggaagtaaagaagtagaagttattggttataaagaagtagcgggggttccaaatgaagat

SEQ ID NO: 4364 - protein, 385 aa, Streptococcus agalactiae
MKGKNNMKNEMLALILAGGQGTRLGKLTQSIAKPAVQFGGRYRIIDFALSNCANSGINNVGVITQYQPLELNTHIGNGSSWGLDGIDSGVTVLQPYSATEGNRWFQGTSHAIYQNIDYIDRINPEYVLILSGDHIYKMNYDDMLQTHKDNLASLTVAVLDVPLKEASRFGIMNTDSNDRIVEFEEKPEHPKSTKASMGIYIFDWKRLRTVLIDGEKNGIDMSDFGKNVIPAYLESGERVYTYNFDGYWKDVGTIESLWEANMEYIGEDNKLHSRDRSWKIYSKNLIAPPNFMTEDANVKDSLVVDGCFVAGNVEHSILSTNVQVKPNAIIKDSFVMSGATIGEGAKINRAIIGEDAVIGDGVVIDGSKEVEVIGYKEVAGVPNED

SEQ ID NO: 4365 - DNA, 1866 bp, Streptococcus agalactiae
atgtccaataaagatgagttatatacttttggaataggtgaaaattttcatctccagaattatttaggcgtacatagcgaaaatggaagcttttgtttcagagtttgggctcctaatgctgaaaatgttcaagttattggagattttacagattggcgaaatcgacctctccaaatgaacaaaaatcaagcaggagtttgggaagctaacagtttggatgcgcgcgaaggtgatttatataaatatttggttactcgtaaaggtggtcaagtagttgagaaaatcgatcctatggcagtttatatggaaagacgtcctggaactgcaagtgttattaaagttcttagaaataaaaagtgggaagatggtctttggatgggaaggcgcaaacgtctgggttttcagaagcgtccaattaatatttacgaagttcatgctggttcatggaaaaaagatgattttggacatcctatgactttttctcagttaaaagattacttaatcccctaccttgttgagatgaattatactcatgttgaatttatgcccttaatggcacatccgcttgatatgagttggggatatcaattaatggggtattttgcttttgaacatacctatggtactccagaagaatttcaagactttgtagaagcatgtcataaaaataatataggagttcttgtagattgggttccaggacactttattcagaatgacgatgctttagcctatttcgatggaactgctacttatgagtatcaaaatcatgatcgtgcgcataactatcgatggggagctctgaactttgatttaggaaaaaatcaagtacaatcctttttgatttcgagtgccttgttctggattgaacattatcatattgatggtattcgtgttgatgcggttagtaatatgttatatctcgattatgatgaaggaccatgggaagctaaccaatttggggataatcgtaatttggaaggatatcactttttaaggaaacttaacaaagtaattaaagagcgtcatcctaatgttatgatgattgctgaagagtcaacagcttctaccccaataactaaagacttagagtctggaggattgggttttgactttaaatggaatatgggctggatgaatgatatcctgcgtttttatgaagaagatcctctctataggcaatatgattttaatttagtgacttttagttttatgtatatattcaatgagaactttgtactagctttttcacatgatgaagtagtacatggtaaaaagagtatgatgcataaaatgtggggtgaccgttataatcaatttgctggtttacgtaatttatatgcatatcaaatgtgtcatcctgggaaaaaacttctctttatgggaagtgagtttggtcaatttttagaatggaaatataatgatcaactagaatgggaaaacttaaatgatgatatgaaccaaaagatgcaacgctatactaaacaattgaatcaattttataaagatcataagtgcctatggcgtattgatgattcctttgacgggctagaaattattgatgcggataataaatctgaaactgttttatcttttatacgaaaagatgataaaggcgatttgttactttgtgtctttaatatgactcctgtagaacgccctaactttactattggtgttccgcaagcgggtatttatgaagaagttttaaatactgaaatggaagagtttggaggtgtttggaaaaaccacaatcctgtaacgaaaacacaagtggctacatggaaagattatgatcatactttaagttttacattaccagcccttggggcaagtgtttggagaataaaacgtcggcttcgtaaa

SEQ ID NO: 4366 - protein, 622 aa, Streptococcus agalactiae
MSNKDELYTFGIGENFHLQNYLGVHSENGSFCFRVWAPNAENVQVIGDFTDWRNRPLQMNKNQAGVWEANSLDAREGDLYKYLVTRKGGQVVEKIDPMAVYMERRPGTASVIKVLRNKKWEDGLWMGRRKRLGFQKRPINIYEVHAGSWKKDDFGHPMTFSQLKDYLIPYLVEMNYTHVEFMPLMAHPLDMSWGYQLMGYFAFEHTYGTPEEFQDFVEACHKNNIGVLVDWVPGHFIQNDDALAYFDGTATYEYQNHDRAHNYRWGALNFDLGKNQVQSFLISSALFWIEHYHIDGIRVDAVSNMLYLDYDEGPWEANQFGDNRNLEGYHFLRKLNKVIKERHPNVMMIAEESTASTPITKDLESGGLGFDFKWNMGWMNDILRFYEEDPLYRQYDFNLVTFSFMYIFNENFVLAFSHDEVVHGKKSMMHKMWGDRYNQFAGLRNLYAYQMCHPGKKLLFMGSEFGQFLEWKYNDQLEWENLNDDMNQKMQRYTKQLNQFYKDHKCLWRIDDSFDGLEIIDADNKSETVLSFIRKDDKGDLLLCVFNMTPVERPNFTIGVPQAGIYEEVLNTEMEEFGGVWKNHNPVTKTQVATWKDYDHTLSFTLPALGASVWRIKRRLRK

SEQ ID NO: 4367 - DNA, 2298 bp, Streptococcus agalactiae
atggataatactgtcattgtacattaccatagccgaaagaaaaattactttaatttaagtttatggcagtggcgcgatggctcagagggtcaagatgctcatttttcacggtttgacagtttcggtgctgttgcgatactaaaatatcccttgccatattttttaagccattattatgtgattgttaaggataaaaattggcatcataaaacaatagattatcgcattgattgtactcaaggtggtgcacgtaaagaagtttggattgtagatggggatgacaatctgtattattctcgtcaagcagcagttagtagccatcattatagtagacgccaacctcatgcctacgacatggcaatcaatagtagagcgtttgacaaaaaatggggatttgatggttggttaggttttgaatattcagaaactaaaacggcttttagattatgggcccctactgcggaacgtgtagaactgattttatatcattcgacagatgaaacagcaagtgtatcaaaagttctttctatgaaaagagggacagccgtcaattataaaaatcataaagaaaatacccatggagtctggtttactgaacttgaaggaaactataattaccaagcatatacttatcgagtctactatagacgacgtacctttaaaattacgagagacccttattccattgcaacgactgcaaatggtaaaaggtctattgttattgctccagaagcattaactccggaagggtttaaaataagtcatggaaaagaagctaagtggcggctcgaaaaccccaatcaagcagtcatttacgaaatgcatgtgcgtgatttttcgatatctgagacttcaggagttaagacagattatcacggaaaatttaagggattgcatcaaaaaggtacggttaatcagcatggtgataaaacgacctttgattatgtacaagacctaggagttaactatatccaacttcaaccaattttcgatcatcatcagacatttgatgatgatggtcactatgcttataattggggatatgatcctgaaaactacaatgttccagaagcaagcttctctagtaatccacatgaacctgcaacgcgtattttagaattaaaatctgctatccaagcgtaccatgatgcaggcattggtgttattatggatgttgtctataatcatactttttcatcaactgattctgcatttcaactaacggttccagattattattatcgaatgaatcacaatggaacatttcaaaatgggtcaggctgtggtaatgaaacagctagtgaaaaagaaatgtgtcgtaagtatattcttgattcagttttgtattgggtgaaagaatataatattgatggttttcgatttgatttgatgggactacatgatgtagaaacgatgaacattataagaaatgagctaaataaaatcgaccctcgtattttggtttatggagaaggatgggacatgggagctggtctcacgcctcaaaataaagctaaaaaagataatgcttatcagatgcctggaattggctttttcaatgatgatgtaagagacgctgtcaaaggtgcggaaatttacggagaatttaaaaaaggcttagtttctggaaacagtacagaagatattgttgcaaaaggcattttaggaagtgatgagttagtatcatacattgatcctagtcaagttttaaattatgttgaagcacatgacaactacaacttaaatgatttgctatgggaattacatcctaatgacaacgagaaacaacatatttaccgagttgaagtagctagtgctatgaatctattgatgcaagggatggctttcatgcaattaggtcaggagtttcttcgaacaaagtgttatcctacaggtgataaaggtcaacttactcaagcagataaagaaagggctatgaattcttacaatgccccagaccaagttaatcaggtcaactgggataatgttacctttcataagagtactattaattttattaggaaaataattactttgaagacaaactctccttacttttcttattctagctttgaagagattcgcaaacatgtttttgtagagtctgctcaataccattcaggtttcataagttttacagtcgaagaacataagaaaataaaaataattttcaatattaaaggaaaacgcttgcagaattctttcataggtgatataataatatcaaatcatgaagaaggaaaagcgatagattcattagatgatgagctttctgtaatgatccttgatatcacaaaa

SEQ ID NO: 4368 - protein, 766 aa, Streptococcus agalactiae
MDNTVIVHYHSRKKNYFNLSLWQWRDGSEGQDAHFSRFDSFGAVAILKYPLPYFLSHYYVIVKDKNWHHKTIDYRIDCTQGGARKEVWIVDGDDNLYYSRQAAVSSHHYSRRQPHAYDMAINSRAFDKKWGFDGWLGFEYSETKTAFRLWAPTAERVELILYHSTDETASVSKVLSMKRGTAVNYKNHKENTHGVWFTELEGNYNYQAYTYRVYYRRRTFKITRDPYSIATTANGKRSIVIAPEALTPEGFKISHGKEAKWRLENPNQAVIYEMHVRDFSISETSGVKTDYHGKFKGLHQKGTVNQHGDKTTFDYVQDLGVNYIQLQPIFDHHQTFDDDGHYAYNWGYDPENYNVPEASFSSNPHEPATRILELKSAIQAYHDAGIGVIMDVVYNHTFSSTDSAFQLTVPDYYYRMNHNGTFQNGSGCGNETASEKEMCRKYILDSVLYWVKEYNIDGFRFDLMGLHDVETMNIIRNELNKIDPRILVYGEGWDMGAGLTPQNKAKKDNAYQMPGIGFFNDDVRDAVKGAEIYGEFKKGLVSGNSTEDIVAKGILGSDELVSYIDPSQVLNYVEAHDNYNLNDLLWELHPNDNEKQHIYRVEVASAMNLLMQGMAFMQLGQEFLRTKCYPTGDKGQLTQADKERAMNSYNAPDQVNQVNWDNVTFHKSTINFIRKIITLKTNSPYFSYSSFEEIRKHVFVESAQYHSGFISFTVEEHKKIKIIFNIKGKRLQNSFIGDIIISNHEEGKAIDSLDDELSVMILDITK

SEQ ID NO: 4369 - DNA, 1017 bp, Streptococcus agalactiae
atgaagaaacaaaaaaaagcgcgtttaatttataacccaacttctggtcaagaaattatgaaaaaaaatgtagcggaagttcttgatatacttgaaggatttgggtatgaaacatcagcctttcaaacaacaccaactaaaaattctgccagagatgaagctactagagctgctcaagctggttttgatttgattgttgcagcaggtggagatggtactattaatgaagttgttaatggtattgcacctttgaaacgtcgtcctaagatggcaattattccaactggaacaactaatgattttgctcgtgccttaaaaataccgcgaggtaatcctattgaagcaactaaattaattggtaaaaatcaaatcgttaagatggacattggtcaagctcaagaggacaattattttattaatattgcagctgcaggtagtttgacagagttaacttatagtgtaccaagtcaattgaaaacaacgtttggctatcttgcttatctagcaaagggtgttgaattattacctcgagttcgaaaagtaccagtcaaaattactcacgataagggtgaatttatcggtgatgcttcaatgatttttgttgccatcacaaattctgtaggagggtttgaacaaattgcacctgatgccaaattggatgatgggaaatttacccttattttagtaaaaactgcaaatcttattgagattatgcatctcattcgtttggtgctagcaggtggaaaacatattaatgataaacgagtagagtatattaaaacgtcttatctaactatcgaacccctatcagacgagcgtatgatgattaacttagatggagaatatggaggagatgctcccattactctagcaaaccttaaaaatcatattaggttctttgctaatactgatgaaatttcagatgatgctttagttttagataaagatgaactagcgatagaagctattgcacagaagtttgctaatgaggtagatgatttagaaggattaggagat

SEQ ID NO: 4370 - protein, 339 aa, Streptococcus agalactiae
MKKQKKARLIYNPTSGQEIMKKNVAEVLDILEGFGYETSAFQTTPTKNSARDEATRAAQAGFDLIVAAGGDGTINEVVNGIAPLKRRPKMAIIPTGTTNDFARALKIPRGNPIEATKLIGKNQIVKMDIGQAQEDNYFINIAAAGSLTELTYSVPSQLKTTFGYLAYLAKGVELLPRVRKVPVKITHDKGEFIGDASMIFVAITNSVGGFEQIAPDAKLDDGKFTLILVKTANLIEIMHLIRLVLAGGKHINDKRVEYIKTSYLTIEPLSDERMMINLDGEYGGDAPITLANLKNHIRFFANTDEISDDALVLDKDELAIEAIAQKFANEVDDLEGLGD

SEQ ID NO: 4371 - DNA, 1020 bp, Streptococcus pyogenes
atgaaaaaacaattgagagcacgtctcatttataatccaacgtcaggacaagaacttatgagaaaaagtgttcctgaagttttagacatattagaagggttcgggtatgaaacatctgcctttcaaacaacagcccaaaagaactctgctctaaatgaagcaagaagagcggcaaaggcaggttttgacttattgattgctgctggaggtgatggcactattaacgaagtggtcaatggaattgctcccttgaaaaagcgccctaaaatggccattattccaacaggtaccactaatgattttgctagagcattaaaagtaccaagaggaaatccgagccaagcagcaaaacttatcggaaaaaatcagactatccagatggatattggtagagctaagaaagatacttatttcatcaatattgctgcagcaggaagtttgacggaattaacttacagtgtaccaagtcagttaaaaacgatgtttggatacttggcttatcttgctaaaggagtagaactgctcccaagagttagcaatgtgcctgttaaaattacgcatgacaaaggcgtctttgaaggtcaagtttctatgatttttgcagctattaccaattctgttgggggatttgaaatgattgctcctgatgcaaaactagatgacggtatgtttacgctcattttaataaagacagcaaatctttttgaaattgtacatcttttgcgtttgattttggatggtggtaagcatattacagatcgccgtgtcgaatacattaagaccagtaaaatagtcattgaaccccaatgtggtaagcgaatgatgattaatttagatggcgagtacggaggagatgctccaattacattagagaacctaaaaaatcatatcactttttttgcagatactgatttgatttctgatgacgctttagtcttagatcaggacgaattggaaattgaggaaatcgtaaagaaatttgctcatgaagtagaagacttaggacaagaattagaagaa

SEQ ID NO: 4372 - protein, 340 aa, Streptococcus pyogenes
MKKQLRARLIYNPTSGQELMRKSVPEVLDILEGFGYETSAFQTTAQKNSALNEARRAAKAGFDLLIAAGGDGTINEVVNGIAPLKKRPKMAIIPTGTTNDFARALKVPRGNPSQAAKLIGKNQTIQMDIGRAKKDTYFINIAAAGSLTELTYSVPSQLKTMFGYLAYLAKGVELLPRVSNVPVKITHDKGVFEGQVSMIFAAITNSVGGFEMIAPDAKLDDGMFTLILIKTANLFEIVHLLRLILDGGKHITDRRVEYIKTSKIVIEPQCGKRMMINLDGEYGGDAPITLENLKNHITFFADTDLISDDALVLDQDELEIEEIVKKFAHEVEDLGQELEE

SEQ ID NO: 4373 - DNA, 1956 bp, Streptococcus agalactiae
atggaaaatcgtatgaatgaattagtatctttgttgaatcagtacgcaaaagagtattatacacaagataatcccacagtttctgacagtcaatatgaccagttatatcgagagttagtagaattagaaaagcaacatccagaaaacattttgccaaatagtcccacacatcgagtgggtggtttagttttagaaggctttgaaaaataccaacatgaatatcctttgtattcattgcaggatgctttctcaaaagaagaattgatagcctttgataaacgtgttaaagcagagtttccaactgctgcttatatggcagagctgaaaattgatggtctatctgtctcgttgacttatgtaaatggtgttttacaggttggggcaacacgtggtgatggcaatattggagaaaatattactgaaaatttaaagcgtgttcatgatattcctctacatttagaccaaagtttagatattactgttcgcggagagtgctaccttcccaaagaatcttttgaagctattaacatagaaaaacgagcaaatggtgagcaggaatttgctaatcctaggaatgcagcagcaggaaccttgcgccaattaaacacaggaattgttgcgaaacgtaaattagcaacttttctttatcaagaagctagccctacgcaaaaagaaacacaagatgatgttttaaaagagctagaaagctatggcttttcagtcaatcatcatcgtttaattagctcgtctatggagaaaatttgggattttatccaaactatagaaaaagatagagtttccctcccttatgatatcgatggtattgttattaaggttaatagcatagcaatgcaagaagagctgggcttcactgtaaaggcacctcgttgggcgattgcatataaatttcctgctgaagaaaaggaagcagaaatattatctgttgattggacagttgggcgaacaggagtcgtaacaccaacagctaacctaactccagttcaactagcagggacaaccgttagtagggccactctgcataatgtagattatattgccgaaaaagatatccgtattggagatactgttgttgtatacaaagcaggggatatcatccctgcagtcttaaatgtcgttatgagtaagcgaaaccagcaagaagtcatgcttattcctaaactatgtccttcttgtggtagtgaattagttcattttgaaggtgaggtggctttacgttgtattaatccgctgtgccccaaccaaatcaaagaacgtttagctcattttgctagccgagatgctatgaatattacaggttttggtccatccttagtcgaaaaattatttgatgctcatttaatagcagatgttgcagatatttatcgtttaagtatagagaatttattaactttagatggtattaaagagaaatctgcaactaagatttatcatgcaatccaatcttcaaaagaaaattctgctgaaaaacttctttttggcctaggtattcgtcatgtgggaagcaaggcgagccgccttttattggaggaatttggtaatttgaggcaactaagtcaagcaagtcaagaaagtattgcctcaattgatggactaggaggggttattgccaaatcacttcataccttctttgaaaaagaagaggtagataaactactagaggaattaacttcctataacgttaattttaattatctaggaaaacgagttagtacagatgcacaactttcaggtttaacagtcgttttaaccggtaagcttgaaaaaatgactcgtaatgaagcaaaagagaaattacaaaaccttggtgctaaggtgacaggtagcgtttctaaaaagactgatttaattgttgcaggaagcgatgcaggaagtaaactaaccaaggctcaagatttagggattacaatacaagatgaagactggttactcaacctt

SEQ ID NO: 4374 - protein, 652 aa, Streptococcus agalactiae
MENRMNELVSLLNQYAKEYYTQDNPTVSDSQYDQLYRELVELEKQHPENILPNSPTHRVGGLVLEGFEKYQHEYPLYSLQDAFSKEELIAFDKRVKAEFPTAAYMAELKIDGLSVSLTYVNGVLQVGATRGDGNIGENITENLKRVHDIPLHLDQSLDITVRGECYLPKESFEAINIEKRANGEQEFANPRNAAAGTLRQLNTGIVAKRKLATFLYQEASPTQKETQDDVLKELESYGFSVNHHRLISSSMEKIWDFIQTIEKDRVSLPYDIDGIVIKVNSIAMQEELGFTVKAPRWAIAYKFPAEEKEAEILSVDWTVGRTGVVTPTANLTPVQLAGTTVSRATLHNVDYIAEKDIRIGDTVVVYKAGDIIPAVLNVVMSKRNQQEVMLIPKLCPSCGSELVHFEGEVALRCINPLCPNQIKERLAHFASRDAMNITGFGPSLVEKLFDAHLIADVADIYRLSIENLLTLDGIKEKSATKIYHAIQSSKENSAEKLLFGLGIRHVGSKASRLLLEEFGNLRQLSQASQESIASIDGLGGVIAKSLHTFFEKEEVDKLLEELTSYNVNFNYLGKRVSTDAQLSGLTVVLTGKLEKMTRNEAKEKLQNLGAKVTGSVSKKTDLIVAGSDAGSKLTKAQDLGITIQDEDWLLNL

SEQ ID NO: 4375 - DNA, 1956 bp, Streptococcus pyogenes
atgaaaaaacgcataaaagaattaacagatcttcttaaccgttaccgttatgactattatactaaagatgccccatcagtttctgacagtgactatgataagctttatcgtgaactggtgactttagagcagtcatatcccgagtatgtcttgcaagatagcccaacgcagcaggttggagggactattttaaaggggtttgaaaaatatcgacatcagtatccgctttttagtttgcaggatgctttttcacgtgaggagctggatgcttttgataagcgcgtcaaggccgaatttccgaatgccacctatctagcagagttaaaaattgatggtttatctatttccttgagttatgagaatggcttcttacaggttggagcaacacggggtgatggcaatatcggtgaaaatatcacagaaaatatcaaaaaaataaaggatattccttaccaattgagtgagcctttaaccatcaccgttcgaggagaggcttacatgtctcgtcagtcctttaaagcgatcaatgaagcacgccaagaaaatggggagactgaatttgctaatcctagaaatgctgccgctgggacactaaggcagctagatacgtcagtggttgctaagcgtcaactagccacttttttgtatcaagaagctagtccgacagctagaaatcaacaaaatgaggtcttagcagaattagcagatctaggtttttcagtaaatccgtattatcaactcacatcgtctatggatgagatttgggattttatcaaaactattgaggcaaaaagagatcaattagcttatgacatagatggcgttgttattaaagttaatagcctagccatgcaagaagagctagggtttacggttaaagctccacgctgggccattgcttacaaatttccagcagaagaaaaagaggcagaaatcctttcggttgactggacagtgggacgaacaggcgtggtcacacctacagcgaatctaactcctgtgcaactagcggggacaaccgtgagtcgtgcaaccctacataatgtggattatattgccgaaaaagatatccgtattggcgatacagtgattgtatataaggcaggggacattattcctgctgtcttaaatgtcgttatgagtaagcggaaccagcaagaagtcatgcttattcctaaactatgcccatcttgtggtagtgaattagttcattttgaagatgaggttgctttgcgttgtattaatccgttgtgtcctagtttgattcagcgaagtttggagcattttgcaagtcgtgatgccatgaacattactgggctgggaccagctattgtggaaaaactatttttagcggggtttgttcatgatgttgctgatatttaccagttgaccaaagaagatttcatgcaattagatggcatcaaagaaaagtcagctgataaattgctcgctgcgattgaggcttctaaatcaaattcagctgaaaaactgttatttggtctaggaattcgtcatattggctctaaggttagtcgcttaattttagaggtatacggagatatttctgctcttttaaccgctaaagaagaggaaatcgcaaggatagatggtcttggctcaacgattgctcaatcacttactcaatactttgaacaaaaaacggctgcgattttagtagacgagttaaagacagcaggtgtcaacatgcattactcaggtcaaaaagttaatagtgacgcagcgctttttggtctaactgttgttttaactggcaaattaaatcagctgaaccgaaatgaggccaaagataaattagaggcattaggtgccaaagttactggaagtgtatctaagaaaacagatttagttattgcaggtagtgacgctggttctaagctagaaaaagcaaagagcttaggaattcggattgaagatgaagattggctacgccagctt

SEQ ID NO: 4376 - protein, 652 aa, Streptococcus pyogenes
MKKRIKELTDLLNRYRYDYYTKDAPSVSDSDYDKLYRELVTLEQSYPEYVLQDSPTQQVGGTILKGFEKYRHQYPLFSLQDAFSREELDAFDKRVKAEFPNATYLAELKIDGLSISLSYENGFLQVGATRGDGNIGENITENIKKIKDIPYQLSEPLTITVRGEAYMSRQSFKAINEARQENGETEFANPRNAAAGTLRQLDTSVVAKRQLATFLYQEASPTARNQQNEVLAELADLGFSVNPYYQLTSSMDEIWDFIKTIEAKRDQLAYDIDGVVIKVNSLAMQEELGFTVKAPRWAIAYKFPAEEKEAEILSVDWTVGRTGVVTPTANLTPVQLAGTTVSRATLHNVDYIAEKDIRIGDTVIVYKAGDIIPAVLNVVMSKRNQQEVMLIPKLCPSCGSELVHFEDEVALRCINPLCPSLIQRSLEHFASRDAMNITGLGPAIVEKLFLAGFVHDVADIYQLTKEDFMQLDGIKEKSADKLLAAIEASKSNSAEKLLFGLGIRHIGSKVSRLILEVYGDISALLTAKEEEIARIDGLGSTIAQSLTQYFEQKTAAILVDELKTAGVNMHYSGQKVNSDAALFGLTVVLTGKLNQLNRNEAKDKLEALGAKVTGSVSKKTDLVIAGSDAGSKLEKAKSLGIRIEDEDWLRQL

SEQ ID NO: 4377 - DNA, 507 bp, Streptococcus agalactiae
atgaacacatttacaactcgcgattacgctcacatggctattgtaacagctatctatatcgttttaaccataacgccaccttttaatgctattgcttatggtgcttatcaattccgtgtttcagaaatgctaaatttcttggccttttaccaccgaaaatacctttttgcggtaacgttaggatgtatgatttctaatctttatagttttggaatgattgatgtctttgtaggtggtggttcaaccttactttttgtttatcttggaaccattttattcaagcaatatcaaaaagattatctatttaatggccttattaacaaagcattctttttcttttctttcttctttgctgcttcaatgattacggtagcagttgaattgaaaattgtagcaggattacctttattattaacatggttaacgacagctgttggtgaattggcttcacttttggttggagcagtccttgtggataagttgagtagacacgtcgattttacaaaa

SEQ ID NO: 4378 - protein, 169 aa, Streptococcus agalactiae
MNTFTTRDYAHMAIVTAIYIVLTITPPFNAIAYGAYQFRVSEMLNFLAFYHRKYLFAVTLGCMISNLYSFGMIDVFVGGGSTLLFVYLGTILFKQYQKDYLFNGLINKAFFFFSFFFAASMITVAVELKIVAGLPLLLTWLTTAVGELASLLVGAVLVDKLSRHVDFTK

SEQ ID NO: 4379 - DNA, 498 bp, Streptococcus pyogenes
atgacaaaattgactgtacacgactatgttcacattgggctagtagctgccttgtatgttgtcttaactattaccccgcctttaaatgcgatttcttatgggatgtatcaatttagaatatctgaaatgatgaatttcttagctttttatcatcgcaagtatattattgcggtgactcttggatgtatgattgctaacttttatagtttcggactgattgatgtctttgtaggcggcggttcaactcttatttttgtgaccttaggtgttattttgtttagtaagtatcaaaaagattatctttttaatggtatttttaataaagcttttgtttacttttctttcttttttgcaacttccatgtttaatgtagcaatcgaactttacttctttggagcaccatttttattaacatggtttacaactgcgttaggagaattagtatctctgctcataggatcacttattattgataagttgtctcaaagaatttccttt

SEQ ID NO: 4380 - protein, 166 aa, Streptococcus pyogenes
MTKLTVHDYVHIGLVAALYVVLTITPPLNAISYGMYQFRISEMMNFLAFYHRKYIIAVTLGCMIANFYSFGLIDVFVGGGSTLIFVTLGVILFSKYQKDYLFNGIFNKAFVYFSFFFATSMFNVAIELYFFGAPFLLTWFTTALGELVSLLIGSLIIDKLSQRISF

SEQ ID NO: 4381 - DNA, 918 bp, Streptococcus agalactiae
atgaaattaaaaaaattctttgaggatttgctggctaaactagaatatagacccattcaagtttttatgcgtcattttcaaagtgcagagatggacttatcagccatagcagttgcttattatctattagtgacagcttttccattactagttattgctgctaatatttttccttattttcatattaatgtgtcggatttattgtcacttatgcaaaaaaatcttccgaaaaatatttatgaacctgcctcacgcttagcagtagatgctttttcgaaaccgtctaccggcattttgggattcgcgtcattaacagctttttggacaatgtctaaaagtttgacctctcttcaaaaagccattaataaagcatacggtgttgaccaacacagagactttgtgattagtcgtttagtgggtgtggggactgggctgatcatcctatttttactgacttttgttttaattttttcaaccttttcaaaaccagttttacagataattgtaaacatgtatgatttgggagatactctaacggcgtggcttttaaatcttgcacaaccagttacatttttgactatatttttaggtattggaattttatactttattttacctaacgcacgaattagaaaagtacgttatgtcattccagggacattattttcaacgtttgttattggtttttttagtaatttaattagccaatacgtcttaaatagggttgagaaaatggtagatattaaaacgtttggttcggtcgttatctttatcttaatgctatggtttattttcttagcccacattatgattttaggtgcaatactgaatgccagcgttcaagaaattgcgacaggaaaaattgaatcaaggcgtggagatattatgtctcttatccaaaaatccaaagaagaaaaa

SEQ ID NO: 4382 - protein, 306 aa, Streptococcus agalactiae
MKLKKFFEDLLAKLEYRPIQVFMRHFQSAEMDLSAIAVAYYLLVTAFPLLVIAANIFPYFHINVSDLLSLMQKNLPKNIYEPASRLAVDAFSKPSTGILGFASLTAFWTMSKSLTSLQKAINKAYGVDQHRDFVISRLVGVGTGLIILFLLTFVLIFSTFSKPVLQIIVNMYDLGDTLTAWLLNLAQPVTFLTIFLGIGILYFILPNARIRKVRYVIPGTLFSTFVIGFFSNLISQYVLNRVEKMVDIKTFGSVVIFILMLWFIFLAHIMILGAILNASVQEIATGKIESRRGDIMSLIQKSKEEK

SEQ ID NO: 4383 - DNA, 963 bp, Streptococcus pyogenes
atggcagaaaaaaaatggtttgataaggtactgtccaagtggcagtatgaacccattcaagtctttatgaggcatttacaaagtgcagaaatggatttatctgccattgcggttgcgtattaccttatcttaacggcctttccattaattgttattgcagccaatatttttccttacctcaatattgatattgctgatttgttacgtttaatgaagcaaaatttgcctaaagatatttttagaccggcttctgcaattgtagaaaatattttctctaaaccgtctggaagtgttttgggagtagcgactttgacaggattatggacaatgtctcgaagtttgacatcgctacaaaaagctattaataaagcctatggcgcttctcagcatcgagatttctttatcggacacttggttggtttgttgaccagtttaattattttatttttattagcctttgccttaatcttttcaatattttctaaagctgctattcaagtgctggataagcattaccatttgagtgataatatcacaacgattttcttgctcctcattcaacctattacagttttgattatttttgttggcttgatgctactatattttttattacccaatgttaagattaaaaaaattcgctacattttaccaggaaccctatttacatcttttgtgatgacatttttgagtaatctggttggcaattacgttgtgtataatgttgagcggatggtagatattaaaatgtttggttcagttatgatttttatcatcatgctatggtttattttcttagcaagaatcctgattttaggagctatatttaatgcgacctatcaagaaatgtccttggggaaattagaaggtcgtagtggtgatatgatcgctatccttaaaaaaacacttgggaatgattcagatctatctccttcacagtctatcgaagatagtcacactgat

SEQ ID NO: 4384 - protein, 321 aa, Streptococcus pyogenes
MAEKKWFDKVLSKWQYEPIQVFMRHLQSAEMDLSAIAVAYYLILTAFPLIVIAANIFPYLNIDIADLLRLMKQNLPKDIFRPASAIVENIFSKPSGSVLGVATLTGLWTMSRSLTSLQKAINKAYGASQHRDFFIGHLVGLLTSLIILFLLAFALIFSIFSKAAIQVLDKHYHLSDNITTIFLLLIQPITVLIIFVGLMLLYFLLPNVKIKKIRYILPGTLFTSFVMTFLSNLVGNYVVYNVERMVDIKMFGSVMIFIIMLWFIFLARILILGAIFNATYQEMSLGKLEGRSGDMIAILKKTLGNDSDLSPSQSIEDSHTD

SEQ ID NO: 4385 - DNA, 96 bp, Streptococcus agalactiae
ttgtcaaagtttaacgatgaaacgtcaacaattgatttatctaaaggttcgcttaaaaccatatctacttttaaaaggtcaccttgttttagggta

SEQ ID NO: 4386 - protein, 32 aa, Streptococcus agalactiae
MSKFNDETSTIDLSKGSLKTISTFKRSPCFRV

SEQ ID NO: 4387 - DNA, 858 bp, Streptococcus agalactiae
atgattacattaaagtcagcacgcgaaattgaagcaatggatagagcaggtgattttttagccagcatccacattggacttcgtgatattatcaaaccaggagttgatatgtgggaagttgaagaatacgttcgtagacgttgtaaagaagaaaacgtattgccattgcaaatcggggttgatggtgcagttatggattacccatatgctacttgttgtgggcttaatgatgaagtggctcatgcctttcctcgtcattataccctaaaacaaggtgaccttttaaaagtagatatggttttaagcgaacctttagataaatcaattgttgacgtttcatcgttaaactttgacaacgtggctcaaatgaaaaagtacacggaaacatatagtggtggtttggcagactcgtgttgggcttatgctgtaggtgaagtttcacaagaggtgaaagacttaatgtctgtgacaagagaagcaatgtatattgggattgaaaaagcagttatcggaaaccgcattggtgatattggagctgctattcaggattatgcagagagtcgtggttatggagttgttcgtgatttggttggtcacggtgttggtccaacaatgcatgaagagcctatggtgcctaactatggtacagcaggtcgaggtctccgtcttcgtgaggggatggttttaaccatcgaaccaatgattaatactggtacttgggaaattgatacagacatgaaaactggttgggcacataaaaccttagatggtggtctttcttgtcaatatgaacatcaatttgttatcactaaagatggtcctgttattttaacgagtcaaggagaagaaagaacttac

SEQ ID NO: 4388 - protein, 286 aa, Streptococcus agalactiae
MITLKSAREIEAMDRAGDFLASIHIGLRDIIKPGVDMWEVEEYVRRRCKEENVLPLQIGVDGAVMDYPYATCCGLNDEVAHAFPRHYTLKQGDLLKVDMVLSEPLDKSIVDVSSLNFDNVAQMKKYTETYSGGLADSCWAYAVGEVSQEVKDLMSVTREAMYIGIEKAVIGNRIGDIGAAIQDYAESRGYGVVRDLVGHGVGPTMHEEPMVPNYGTAGRGLRLREGMVLTIEPMINTGTWEIDTDMKTGWAHKTLDGGLSCQYEHQFVITKDGPVILTSQGEERTY

SEQ ID NO: 4389 - DNA, 858 bp, Streptococcus pyogenes
atgataacattaaaatcagcccgtgaaatagaagcgatggatagagcaggagacttcttagcaggtatccatattggcttaagggatattattaagcctggtgtggatatgtgggaagtggaagcatatgttcgtcgccgttgtaaagaagacaacgttcttcctttgcaaataggggttgatggtcacatgatggactatccttatgcgacctgttgtggtctaaatgacgaagtagcacatgcctttccccgtcattacattctgaaagaaggggatttgcttaaagttgacatggtactcagtgagcctttggataaatcaattgttgatgtagcagctttagattttgataacgtacctgagatgaagaaatggacaggatcttataccggtggtttagctgactcttgttgggcttatgctgttggaacaccgtctgacgaaataaagcaattaatggatgtcaccaaagaagccatgtaccgtggtattgaaaaagcagtaattggcaatcgtattggtgatattggcgcagctgttcaagaatacgctgaaagcttcggttatggtgtcgtgcgtgatcttgttggtcacggtgttggtcctacaatgcatgaagagccaatggtaccaaactatggaacagcaggtcgtggacttcgtctaaaagaaggcatggtcttgactgttgagccaatgattaatacaggaacttgggaaattgataccgacatcaagacaggttgggctcataaaaccctagatggtggtttatcttgccaatacgaacaccaatttgtgattactaaagatggtcccgttattttaacaagtcaaggagaagaaagaacttac

SEQ ID NO: 4390 - protein, 286 aa, Streptococcus pyogenes
MITLKSAREIEAMDRAGDFLAGIHIGLRDIIKPGVDMWEVEAYVRRRCKEDNVLPLQIGVDGHMMDYPYATCCGLNDEVAHAFPRHYILKEGDLLKVDMVLSEPLDKSIVDVAALDFDNVPEMKKWTGSYTGGLADSCWAYAVGTPSDEIKQLMDVTKEAMYRGIEKAVIGNRIGDIGAAVQEYAESFGYGVVRDLVGHGVGPTMHEEPMVPNYGTAGRGLRLKEGMVLTVEPMINTGTWEIDTDIKTGWAHKTLDGGLSCQYEHQFVITKDGPVILTSQGEERTY

SEQ ID NO: 4391 - DNA, 1293 bp, Streptococcus agalactiae
gtgattatcgttatgagtaaacatcaagaaattttggagtacctagaaaatttagctgttggtaagagggttagtgtacgcagtatttcaaatcatttaaaggtgagtgatggcactgcataccgcgctataaaagaggcagaaaataggggtattgttgagactagaccgcgtagtgggacagtacgtgttgctcaaaaagcaaaggttaatattgaaaaactgacttatgctgaaattgcaaggattagtgactcacaagttgttgcaggaatagagggactcagcaaggagtttagtaaattttctataggtgcaatgactcacagaaatattgaaaaatatttggtgcaaggagggttattgattgttggcgaccgtgatgagatacaacatttagccttacaacatcaaaacgctatcttagttacaggtggctttaatgtttccccatctgtttgtcgtttagcagataaacttcaaattcccgtaatggtaacacactatgatacattcacagtatcaacgatgattaatcacactttgtcaaatgccaaaattcgtactgatttaaagaccgttgaacaagtctatcagtcgcaaatggattacggtttcttagcgcaggatgataccgtaaaagaatttaatcttcttgttaaacaaactaaaaatgttcgttttccaatagtcaaccaagctaatgttgtcgttggtgttgttagtgttcaagatattcttggaaaagataaagaagtaaaattggcaacagtcatgtcaaaaaatatcattgttgctaaacctcgaatgagtctagctaatatcagtcaaaaaatgatttttgaagatttgaatatgatgccagtagtatcggatgactttgaattattaggcgttattacaagacgacaagctgtagaaaatttatcgatgtcgcaagggacggatttatacacctatagtgatcaaatcttgtctaatttacaaattgaagatggtcacttttcgtttttagtagaacccgctatgattgaccatacaggtagcttaacacaaggagttttgacggagttcttaaaagaaatttgtattcgtgtcttaactcgtaagcatcaacgcagtattgttgttaaacaaatgacactttatttcttgcaacctgttcaaattgatgaaataataatggtaacgccaacaattatttcagaaaaacggcgcgaagctacactcgatttagaattaaaattagaaaataaaattattgctaaagctatgatagcggtaaaaattaat

SEQ ID NO: 4392 - protein, 431 aa, Streptococcus agalactiae
MIIVMSKHQEILEYLENLAVGKRVSVRSISNHLKVSDGTAYRAIKEAENRGIVETRPRSGTVRVAQKAKVNIEKLTYAEIARISDSQVVAGIEGLSKEFSKFSIGAMTHRNIEKYLVQGGLLIVGDRDEIQHLALQHQNAILVTGGFNVSPSVCRLADKLQIPVMVTHYDTFTVSTMINHTLSNAKIRTDLKTVEQVYQSQMDYGFLAQDDTVKEFNLLVKQTKNVRFPIVNQANVVVGVVSVQDILGKDKEVKLATVMSKNIIVAKPRMSLANISQKMIFEDLNMMPVVSDDFELLGVITRRQAVENLSMSQGTDLYTYSDQILSNLQIEDGHFSFLVEPAMIDHTGSLTQGVLTEFLKEICIRVLTRKHQRSIVVKQMTLYFLQPVQIDEIIMVTPTIISEKRREATLDLELKLENKIIAKAMIAVKIN

SEQ ID NO: 4393 - DNA, 1293 bp, Streptococcus pyogenes
gtgataatcattatgagcaaacatcaagatattttagattatttagaaaaacttgctattggtaaaaaagtgagtgttagaagcatttcaaaccacttaaaagtaagcgatggaacagcctaccgtgctattaaagaggcagaaaatcgaggtattgtcgaaaccaaaccaagaagtggaactgttcgtattgaaaaaaaaggacgggttcgtattgaccgtctgacctattccgaaattgctcggatcagtgattcggaagtgctagcgggacatgctggtttaggacatgaatttagtaggttttcaattggtgctatgactcaacaaaatattcgtcgttacttggtcaaaggagggttattaatagttggggatcgtgaaacgattcaactcttagctcttgaaaaccataatgccattttggtgacgggcggatttccagtatccaaacgtgttattgaaatggcaaataaccaacgaatcccagttatggtaactcattatgatacctttactgtggcaacaatgattaatcacgcgctatctaatattcgtattaaaacagatctcaaaacagttgaacaggtaatgatacctattacagattatggttacctttgcgaagacagctctgttgaagaattcaatacattaataaaaaaaacacgacaagtcaggtttcctgtattagattataaaagaaaagtgattggtgtagttagtatgcgtgatgtggtggatcagttgccaacaactaagcttaccaaggtcatgtctaaaaatccaataacggctagaccaaatactagtcttgctaatattagccagaaaatgatctttgaagatttaaacatgttacctgtcactgacgaagaaaacaatttacttggtatgattactcgtagacaagcaatggaaaatttgccaaatcaccaaccaaataacccctatacttatagtgagcaaatactttctaaccttgaagaaacggttgattattatcaagtagtagttgagccaacaatgattgatagtgctggtaacatgtcaaacggtgttatttcagagttcttaaaggaaattagtatcagagccctcacgaaaaagcaccaaaaaaatatcattatcgaacaaatgatggtatactttttacatgctattcaaattgaggatgaattaaaaatatatcctaaaatcattactgaaaatagacgaagcagcaccattgatattgaaatttttgtggatgatcaagtgattgctaaagctattattacaacgaaaataaat

SEQ ID NO: 4394 - protein, 431 aa, Streptococcus pyogenes
VIIIMSKHQDILDYLEKLAIGKKVSVRSISNHLKVSDGTAYRAIKEAENRGIVETKPRSGTVRIEKKGRVRIDRLTYSEIARISDSEVLAGHAGLGHEFSRFSIGAMTQQNIRRYLVKGGLLIVGDRETIQLLALENHNAILVTGGFPVSKRVIEMANNQRIPVMVTHYDTFTVATMINHALSNIRIKTDLKTVEQVMIPITDYGYLCEDSSVEEFNTLIKKTRQVRFPVLDYKRKVIGVVSMRDVVDQLPTTKLTKVMSKNPITARPNTSLANISQKMIFEDLNMLPVTDEENNLLGMITRRQAMENLPNHQPNNPYTYSEQILSNLEETVDYYQVVVEPTMIDSAGNMSNGVISEFLKEISIRALTKKHQKNIIIEQMMVYFLHAIQIEDELKIYPKIITENRRSSTIDIEIFVDDQVIAKAIITTKIN

SEQ ID NO: 4395 - DNA, 570 bp, Streptococcus agalactiae
ttgtggtataatattatcatggatatatggacaaatttaggacggtttgcattcattgaaacagaacatgttaacctacgtcctgttgcctacactgatagggaagctttttggcgaatagcttcaaaaaggacaaatttacaatttatttttcctgttcaaaccagtaagaaggaaagtgattttcttttagttcattcttttatgaaagagccattgggagtttgggcgattgaagataaagttagtcataaaatgtttggagttatccgttttgaaaacattgatttatctaaaaagacagctgaaattggctattttttgaaagaaagttcttggggtcaaggcattatgactgaatgtctaaagacactttctttttttgcttttcgagagtttgggatggacaaattgatcatagtaacacataaagagaatattgctagtcagaaggttgctttgaaggcgcatttcaaacaatctaggagttttaaaggaagcgaccgttacacacgccgtataagagactatattgagtttcaattaactaggggtgattatcgttatgag

SEQ ID NO: 4396 - protein, 190 aa, Streptococcus agalactiae
MWYNIIMDIWTNLGRFAFIETEHVNLRPVAYTDREAFWRIASKRTNLQFIFPVQTSKKESDFLLVHSFMKEPLGVWAIEDKVSHKMFGVIRFENIDLSKKTAEIGYFLKESSWGQGIMTECLKTLSFFAFREFGMDKLIIVTHKENIASQKVALKAHFKQSRSFKGSDRYTRRIRDYIEFQLTRGDYRYE

SEQ ID NO: 4397 - DNA, 1257 bp, Streptococcus agalactiae
atgcgtaaaattattattaacggtggcaagcaactgacgggagaagttgctgtatcgggtgccaaaaatagtgtagttgccttgattcctgccactattcttgctgatgatgttgtggtcttagatggagttccggctatttctgatgttgacagtttagttgacattatggaaactatgggagctaagattaagcgttatggtgagacgcttgaaattgatccatgtggcgttaaagatattccaatgccttatggcaaaatcaatagtcttcgtgcatcctattatttctatggaagcttattggggcgttatggtcaagcaacattaggtttacctggtggttgtgatttaggcccccgtccgattgatttacatttaaaagcttttgaagcgatgggagctagtgtttcttatgaaggtgattcaatgcgtctagcaacaaacggaaagcctttgcaaggagcaaatatttatatggatactgtcagtgttggtgcgacaattaacactataatcgcagcagctaaggcaaatggccgtacggttattgaaaatgctgcacgtgaaccagaaattattgacgtggctactcttttaaataatatgggagctcatattcgtggtgctgggactgatgttattacaattgaaggtgtgaaatcgctccatggcacgcgtcatcaagtaattccagatcgtattgaagcaggaacttatattgctatggcagcagctatcggacgaggaataaaagtgaccaatgtgttatatgaacaccttgagagtttcattgctaagttagatgagatgggagttcgaatgacagttgaagaggattcaatttttgtcgaagaacaagaaaggttaaaagctgtatccataaaaacctcaccttacccaggatttgctacagatttacaacaacctctaactcctttattactaacagcagaaggaaacgggagtttattagatactatctatgagaaacgtgttaatcatgttcccgaattagcacgtatgggagctaatatttctaccctagggggcaaaatagtttatagtggtcctaatcaattatctggtgcacctgtaaaagcgacagatttgcgtgcaggcgctgctttagttatcgctggcttaatggcagagggacgaactgaaattacgaatatcgagtttattttacgtggatattctaatatcatcgagaaactaacatcattgggtgcggatatccaattggttgaggaa

SEQ ID NO: 4398 - protein, 419 aa, Streptococcus agalactiae
MRKIIINGGKQLTGEVAVSGAKNSVVALIPATILADDVVVLDGVPAISDVDSLVDIMETMGAKIKRYGETLEIDPCGVKDIPMPYGKINSLRASYYFYGSLLGRYGQATLGLPGGCDLGPRPIDLHLKAFEAMGASVSYEGDSMRLATNGKPLQGANIYMDTVSVGATINTIIAAAKANGRTVIENAAREPEIIDVATLLNNMGAHIRGAGTDVITIEGVKSLHGTRHQVIPDRIEAGTYIAMAAAIGRGIKVTNVLYEHLESFIAKLDEMGVRMTVEEDSIFVEEQERLKAVSIKTSPYPGFATDLQQPLTPLLLTAEGNGSLLDTIYEKRVNHVPELARMGANISTLGGKIVYSGPNQLSGAPVKATDLRAGAALVIAGLMAEGRTEITNIEFILRGYSNIIEKLTSLGADIQLVEE

SEQ ID NO: 4399 - DNA, 1257 bp, Streptococcus pyogenes
atgcgtaaaattattattaatggcggaaaagccttatctggagaagtggcagtttcaggggcaaaaaacagtgttgttgcgcttattccagcaatcatcttagccgatgatattgtgattcttgatggtgtacctgctattagtgatgtagatagtctgattgaaatcatggagcttatgggagcaacagtaaactatcatggtgatactttagaaattgaccctagaggggtgcaagacatcccgatgccttacggaaagattaatagtcttcgagcttcctattatttctacggtagtcttttaggtcgttttggacaagcagttgttggcttacctggtggttgcgatttaggaccaagaccaattgacttgcatttgaaggccttcgaggctatgggagttgaagtgtcttatgagggtgaaaatatgaatttatcgacaaatggtcaaaaaattcatggcgctcatatctatatggacaccgttagtgtcggtgctacaattaatactatggttgcggcaacaaaagctcaaggtaaaacggttattgaaaacgctgcacgtgagccagagattattgatgtggctactcttttgaataacatgggtgcgcatattcgtggagcaggtacagatattattacgatacaaggtgttcagaaattgcatggtactagacaccaagttattcctgatcgtattgaagcagggacttatatcgctttggcggcagctattggaaaaggtgttaagatcactaatgttctttatgagcatttagagagtttcattgctaagttagaagaaatgggtgtccgtatgacggtagaagaggatgctatctttgttgaaaagcaagaatccctcaaggctattacaattaaaacctctccttaccctggttttgccactgatttgcaacagccattaacgcccttgttgttaaaagcagatggtcgtggaacgattattgacactatatatgaaaagcgcattaaccatgtgccagagttgatgcgcatgggagcagatatctcagttattggtggtcaaattgtttatcaagggccgtctcgcctgacaggagctcaggtcaaagccactgatttacgtgccggagcggctctagtgactgctggtctaatagctgaaggcaagacagaaattactaatattgaatttatcttacgtggctatgctagtatcattgcaaaattaacagcactaggggcagatattcaattaatcgaagac

SEQ ID NO: 4400 - protein, 419 aa, Streptococcus pyogenes
MRKIIINGGKALSGEVAVSGAKNSVVALIPAIILADDIVILDGVPAISDVDSLIEIMELMGATVNYHGDTLEIDPRGVQDIPMPYGKINSLRASYYFYGSLLGRFGQAVVGLPGGCDLGPRPIDLHLKAFEAMGVEVSYEGENMNLSTNGQKIHGAHIYMDTVSVGATINTMVAATKAQGKTVIENAAREPEIIDVATLLNNMGAHIRGAGTDIITIQGVQKLHGTRHQVIPDRIEAGTYIALAAAIGKGVKITNVLYEHLESFIAKLEEMGVRMTVEEDAIFVEKQESLKAITIKTSPYPGFATDLQQPLTPLLLKADGRGTIIDTIYEKRINHVPELMRMGADISVIGGQIVYQGPSRLTGAQVKATDLRAGAALVTAGLIAEGKTEITNIEFILRGYASIIAKLTALGADIQLIED

SEQ ID NO: 4401 - DNA, 669 bp, Streptococcus agalactiae
atgaaagatacattgaaattatattttgtttgtggaactgtggattgctctaggaagaatatattgactgttgttgaagaagccttacaagcaggtataactctatttcaatttagagaaaaaggttttacagcattacaaggtaaggaaaaaattgctatggctaagcaactccaaatactttgtaagcaatatcaagttccttttattattgatgatgacattgacttagttgagttaattgatgctgatggtcttcatattggacaaaatgatttacctgttgatgaggcacggagacgtttaccagataaaatcatcggtttatctgtgagtacaatggatgaatatcagaaatcacaattatctgttgttgattacatcggaattggtccttttaatccgacacaatcaaaagcagatgctaagcctgctgttggcaataggacaacaaaggcagttagagaaattaatcaagatattccaatcgttgcaataggcggaatcactagtgattttgttcatgatattatagaatcaggtgcagatgggattgctgttatatcggctatttcaaaagcaaatcatattgtagatgcaaccagacaattgcgttatgaagttgaaaaagctctggttaataggcaaaaacacagtgatgtaatcaaa

SEQ ID NO: 4402 - protein, 223 aa, Streptococcus agalactiae
MKDTLKLYFVCGTVDCSRKNILTVVEEALQAGITLFQFREKGFTALQGKEKIAMAKQLQILCKQYQVPFIIDDDIDLVELIDADGLHIGQNDLPVDEARRRLPDKIIGLSVSTMDEYQKSQLSVVDYIGIGPFNPTQSKADAKPAVGNRTTKAVREINQDIPIVAIGGITSDFVHDIIESGADGIAVISAISKANHIVDATRQLRYEVEKALVNRQKHSDVIK

SEQ ID NO: 4403 - DNA, 813 bp, Streptococcus agalactiae
ttggaaacggtcctgtcaatcatactagctatcaaggagactaaaatgtatttagaacaattaaaagaggtaaatcctttaaccatttgtatcactaataatgtggtcaaaaactttacagccaatggtttattagctttaggagcttctccggctatgagcgagtgcatagaggacttagaagacttgttaaaagttgcagatgcattattaattaatataggaacactaacaaaagaaagttggcaactttaccaagaagcaatcaaaatagcaaataaaaaccaagttccagttgtattagatcctgtagcggcaggagcaagtcgttttcgattagaagtgtcacttgatttattgaagaattattctattagtttacttacaggaaatggtagtgaaatcgctgctttgattggtgaaaaacaagcgtctaaaggggcagatggcggaaaagtggctgatttagaatcaattgctgtaaaagccaatcaagtttttgatgtgccagtggttgtcacaggagaaactgatgctatcgctgttagaggagaagttcgcttattacaaaatggtagtcctttaatgccacttgttacaggaactggatgtctattaggggcagtattggctgcttttattggtagttctgacagaagcgatgatcttgcttgtctgacagaggccatgactgtttataatgttgctggagaaattgcagagaaggtggcaaaaggtaagggggtgggaagtttccaagttgcatttttagatgccctttcccagatgaaatcagaaatgattatggacaaa

SEQ ID NO: 4404 - protein, 271 aa, Streptococcus agalactiae
METVLSIILAIKETKMYLEQLKEVNPLTICITNNVVKNFTANGLLALGASPAMSECIEDLEDLLKVADALLINIGTLTKESWQLYQEAIKIANKNQVPVVLDPVAAGASRFRLEVSLDLLKNYSISLLTGNGSEIAALIGEKQASKGADGGKVADLESIAVKANQVFDVPVVVTGETDAIAVRGEVRLLQNGSPLMPLVTGTGCLLGAVLAAFIGSSDRSDDLACLTEAMTVYNVAGEIAEKVAKGKGVGSFQVAFLDALSQMKSEMIMDK

SEQ ID NO: 4405 - DNA, 795 bp, Streptococcus agalactiae
atgacttatttagcaccagttttaactattgcaggaactgatcctagcggtggagcagggattatggcggatttaaagacatttcaagctcgtcggacttacgggatggctgttgtgactagtgttgttgctcagaacacttgtggggttagaggcgttcagcatatagaaacagctatcattgatcaacaactagcttgtgtctatgatgatattaagccaaaggcggttaaaacaggaatgttagcggagagggaaacaattagtttagtcgcttcatatttaaaaaaatatccgcaaccttatgtattagatcctgttatggtggcaactagcggacatcgtttaattgattcagatgccgtagaagcattaaaagaagacttattgccattagcaactattatcacaccaaatttaccagaagctgaggttttagtgggatatgacttatcagatgaagtaagtattattaaagcaggttacgatattcaaaaacaatattctgttagaaatgttcttataaagggaggacatctagatggcttggctaaagattatttatttttggaaaaagaagggttgataactcttagtaatcaacgtatcaatactattcatactcatgggactgggtgtacatttgcagcagtcgttgcagcggagttagctaaagggcaatcaattctaaacgcggtaagtaccgctaaatcatttattacttcagctatcgaaacagcgcctgagttgggccttggaaacggtcctgtcaatcatactagctatcaaggagac

SEQ ID NO: 4406 - protein, 265 aa, Streptococcus agalactiae
MTYLAPVLTIAGTDPSGGAGIMADLKTFQARRTYGMAVVTSVVAQNTCGVRGVQHIETAIIDQQLACVYDDIKPKAVKTGMLAERETISLVASYLKKYPQPYVLDPVMVATSGHRLIDSDAVEALKEDLLPLATIITPNLPEAEVLVGYDLSDEVSIIKAGYDIQKQYSVRNVLIKGGHLDGLAKDYLFLEKEGLITLSNQRINTIHTHGTGCTFAAVVAAELAKGQSILNAVSTAKSFITSAIETAPELGLGNGPVNHTSYQGD

SEQ ID NO: 4407 - DNA, 762 bp, Streptococcus pyogenes
atgaaaactgattatatcgtgactatatctgggaacgatattttaagtggaggtggtctctatgctgatttagcgacttacataaggtatgacctacaggcctttgtagcggtaacttgtttaactactagatctgaagagggctttagtctatttccggtagctaaagaaattttccgtgatcagttgaatagctttacgaacgctccaatttctgctattaaaattggtttgttacctaatgcggaaatgtgtgaaatagttttggattttataaaggggcatctgggaatcccagtggttttagatcctgttctagcatgtaaagaaatagatgatgttaaaatagttcctctaagacaggagattttacaattattgccttatgtgactgttgttactccaaatttggtagaggctcagctattatctcaaaaagagattgtttctttaaaagatatgcaagaagctgctaaatatttttatcaacttggggcaaaacaggtggttatcaagggtggtaatcgatttagtcagaaaaaagctattgatcttttttatgatggtaaagagattgttaccttggaatgtcctgtacttgagaaaaataatattggcgcaggctgtacttttgcatctagtatcgctagtcagttagtaaagaaaaaaacgccactagaagctgtgaaaaactcaaaagagttagtctaccaagctattttacaatctgatagatacggagtaaaacaaagttatgcaaaa

SEQ ID NO: 4408 - protein, 254 aa, Streptococcus pyogenes
MKTDYIVTISGNDILSGGGLYADLATYIRYDLQAFVAVTCLTTRSEEGFSLFPVAKEIFRDQLNSFTNAPISAIKIGLLPNAEMCEIVLDFIKGHLGIPVVLDPVLACKEIDDVKIVPLRQEILQLLPYVTVVTPNLVEAQLLSQKEIVSLKDMQEAAKYFYQLGAKQVVIKGGNRFSQKKAIDLFYDGKEIVTLECPVLEKNNIGAGCTFASSIASQLVKKKTPLEAVKNSKELVYQAILQSDRYGVKQSYAK

SEQ ID NO: 4409 - DNA, 678 bp, Streptococcus agalactiae
atgttaaaagataagatgattgctaaaggagcaaaatatatccaatccatctatcaagatccatttattcaaggaattataaaagggcgtttagaccatgacgtaatctgccattatttacaggcagataatatctaccttgggaaatttgctgatatttatgccctgtgcttggcaaaatctgataatttacgagataaacaatttttccttgaacaaattgactttacattaaatcgggagttagcagatggtgaaggcccacatcaagccttggccgcttatactaatcgatcttatcaggatattatcgaaaagggtgtatggtacccgtcagcagatcattacattaaacatatgtattttcatttttacgaaaatggtattgctggtgctttagctgcaatgagcccatgtccatggatttaccatcaattggctaaaaaaataattgaggagaaccagtttttgaatggtaacccttttaataattggataactttttatgctaacgatacagttgaagagttaatggaaaactattttcgtatgatggattattatgcgcagaatttgtcaaaagagaagcaagctgatttggtagatgcttttgtgaaatcttgtcagcatgagagacgtttttttcaaatggcaataaatcaagaaaaatgggaggat

SEQ ID NO: 4410 - protein, 226 aa, Streptococcus agalactiae
MLKDKMIAKGAKYIQSIYQDPFIQGIIKGRLDHDVICHYLQADNIYLGKFADIYALCLAKSDNLRDKQFFLEQIDFTLNRELADGEGPHQALAAYTNRSYQDIIEKGVWYPSADHYIKHMYFHFYENGIAGALAAMSPCPWIYHQLAKKIIEENQFLNGNPFNNWITFYANDTVEELMENYFRMMDYYAQNLSKEKQADLVDAFVKSCQHERRFFQMAINQEKWED

SEQ ID NO: 4411 - DNA, 699 bp, Streptococcus agalactiae
gtgttttgcaacacgtttcttggaggtgtcatcttgttcaatttgaaaaactatcatccagctattaccttcctatgtttattaataccaaccttttcgtttagtttcacattgaggttaagaacgtctttgttatttctaattatagtagtaacactgcaatgcttcgtaaaggtttctttaaaaacttgggcgaaggtcaatctgatatcatttgtgatgggactctctttatttctagggacgtatttttggggaaaattaccccatcaattcgtcttagctagtctagtggcctgtcgtccgcttatttttatgaacgtgggtttgttatttcatgcatcacattctaattatgattttatagaatctctttatcaaactttcaaagtgcctagtcattttgcatatggtatttttgcggtctttaatcttctaccattaattaaattacaataccaacgtaatcgactcgcattccgactgaagaatcaggtaacttgggcattatcgcctagactaatattgtcagttttattaaagacgatatattgggtagaacagttagagttagcaatgctttctaaaggttttgaagtgggtaaagagcgaacacatgcttcaacttatcccgttcgttttcgagattatagtttacttggtatgagtattttattgtctataggaatgatttttaaa

SEQ ID NO: 4412 - protein, 233 aa, Streptococcus agalactiae
MFCNTFLGGVILFNLKNYHPAITFLCLLIPTFSFSFTLRLRTSLLFLIIVVTLQCFVKVSLKTWAKVNLISFVMGLSLFLGTYFWGKLPHQFVLASLVACRPLIFMNVGLLFHASHSNYDFIESLYQTFKVPSHFAYGIFAVFNLLPLIKLQYQRNRLAFRLKNQVTWALSPRLILSVLLKTIYWVEQLELAMLSKGFEVGKERTHASTYPVRFRDYSLLGMSILLSIGMIFK

SEQ ID NO: 4413 - DNA, 1284 bp, Streptococcus agalactiae
atgctatctgttgaaaaattagcttgcacccatggcgatagtcattatttatttgatgaagtgacttttagtcttaacccaggagaacgaattttaatcagtggctattcagggtgtggtaagagtacattggctcttttactatcagggttaaaagaaagtgggaaaggtcaagttttattaaacggctcattaatagaaccaagcgatgtggggtttctttttcaaaatcctgatttgcaattttgtatggatactgtggcgcatgagttgtattttattttagaaaatttacaaatagaaccggagcaaatgcaagatagaagtgagtttgtattggcacaagttggtttaaaaggatttcagaatcggttgatttatactttatctcaaggtgaaaaacagcgattagcattggcgaccatttttttaaaatctcctaaacttattattttagatgaagcttttgcgaatttggatcaagagagtgccagtcaactattacaattagttcttaattatcaagcaaacaatcaatcaatgctgattgtaatcgatcatttgattacttattatcaagatataatggatcactatttttggttggaaaaacggttgacaagggtcaattttgattatatgctcaatcgtttgaatgtcttcgaattagaaaagaaaagtcataatacaggtgacaaactgttatcaattaaagatttccaagttaaactttcaaaaaacaaattcatctcttaccttgattttgatttagcaagtggggagaggttgtgcttagatggaccaagtggcgtggggaagtctagtttgtttatgggattgttagggctttataggactaaagggaaaaaacaatttactcatagaaagcaaattcctataagctttttatttcaaaatcccttagaccaatttattttttcaacagtttatgacgaaatttttcaggtttgcaaggatagtaacaaagcgagggatattttggaaaccataaatctttgggataagaaacagttttcaccatttcaactaagtcaaggccaacagaggcgattagccattggcagtattttagctagtgatagtaaacttctattattagatgaaccaacttatggacaagatgcctatcacgctaatatgattacaactcttcttttgagttattgtcacaaaaatcattgtggggttatttttactagccatgatcctcacttaaaagagtgttttgcaacacgtttcttggaggtgtcatcttgttcaatt

SEQ ID NO: 4414 - protein, 428 aa, Streptococcus agalactiae
MLSVEKLACTHGDSHYLFDEVTFSLNPGERILISGYSGCGKSTLALLLSGLKESGKGQVLLNGSLIEPSDVGFLFQNPDLQFCMDTVAHELYFILENLQIEPEQMQDRSEFVLAQVGLKGFQNRLIYTLSQGEKQRLALATIFLKSPKLIILDEAFANLDQESASQLLQLVLNYQANNQSMLIVIDHLITYYQDIMDHYFWLEKRLTRVNFDYMLNRLNVFELEKKSHNTGDKLLSIKDFQVKLSKNKFISYLDFDLASGERLCLDGPSGVGKSSLFMGLLGLYRTKGKKQFTHRKQIPISFLFQNPLDQFIFSTVYDEIFQVCKDSNKARDILETINLWDKKQFSPFQLSQGQQRRLAIGSILASDSKLLLLDEPTYGQDAYHANMITTLLLSYCHKNHCGVIFTSHDPHLKECFATRFLEVSSCSI

SEQ ID NO: 4415 - DNA, 1452 bp, Streptococcus pyogenes
atggaaagattggggggtgcagatttggattactgttatcataatcatcacgatactgcaatgatttcagcagaacaacttgtttttacctatcatgatcaaaaaaatccagcttgtcagatatcgacttgtcaaattgcctctggacaattcattgttttgtgtggaccttctggttcaggtaaatctacctttttaaaacttcttaatggcataattcctgattattatgctggaaaatatgaaggtagactagatgtggctgattgccaagcaggcagagacagtgttgaaacattttctagatctgtggcctctgtttttcaaaatccagccagtcagtttttctatcgcgaagtccaacacgaactagtctttccttgtgaaaatcaaggtttagatgcaaaggttatcatgaagcgtctttggactttagcagaagattttgcttttgcagagctccttaacaaggatatgtttggattgtcaggagggcaaaaacaaagagttgctattgcaacggccattatgcaaggtactaatattatgctttttgatgagccaactgctaacttagatagtgcaggcatagctgctgttaaagcctatcttacccaattaaaagcagcaggaaaaaccattattgtagccgagcatcgcttacattacttgatggatttggcagataactttttctactttaaaaatggtagattaacagataagttaacaacacaaaatttgctagccttgacagatgaacaacggcaagatatgggactacgtcgcttagacttgtctgacctaaaacctgtgttagctggtaagattgagagtcaacattatcgcccagatgatagcctgtgtattgagcatctaacagttagagcgggaagcaaaatacttagatgtattgaacagcttagttttgctgtaggaagtatttctggcattacaggatcaaacgggcttggaaaatcgcaattagtttattatatagctggtatcttagacgataaaaaagcaactattaagtttcaaggcatacctttatctgccaagcaacgtttatcaaagactagtattgtcttgcaagaagtttctttgcaactatttgcagaatcggtttcaaaggaagtcaacttgggccatgaacgacatccacggacgacagaagtaatagagcggttatctttaacgactcttttagaacgtcatccagctagtttgtcaggaggtgagcaacaaagagtgatgattgccgctagtcttttggctgataaagatatcttaatttttgatgagccaagtagcggacttgatttgttacaaatgaaggctttagctaatcttctcatgcagctgaagacccaacataaggttgtcatcctcatttcacatgatgaagaacttctaagtagtgtctgcgataccatttatcaaatgctacct

SEQ ID NO: 4416 - protein, 484 aa, Streptococcus pyogenes
MERLGGADLDYCYHNHHDTAMISAEQLVFTYHDQKNPACQISTCQIASGQFIVLCGPSGSGKSTFLKLLNGIIPDYYAGKYEGRLDVADCQAGRDSVETFSRSVASVFQNPASQFFYREVQHELVFPCENQGLDAKVIMKRLWTLAEDFAFAELLNKDMFGLSGGQKQRVAIATAIMQGTNIMLFDEPTANLDSAGIAAVKAYLTQLKAAGKTIIVAEHRLHYLMDLADNFFYFKNGRLTDKLTTQNLLALTDEQRQDMGLRRLDLSDLKPVLAGKIESQHYRPDDSLCIEHLTVRAGSKILRCIEQLSFAVGSISGITGSNGLGKSQLVYYIAGILDDKKATIKFQGIPLSAKQRLSKTSIVLQEVSLQLFAESVSKEVNLGHERHPRTTEVIERLSLTTLLERHPASLSGGEQQRVMIAASLLADKDILIFDEPSSGLDLLQMKALANLLMQLKTQHKVVILISHDEELLSSVCDTIYQMLP

SEQ ID NO: 4417 - DNA, 552 bp, Streptococcus agalactiae
atgaaattgagtttaaaagatgtattattgattgctctattagcggttgttctgggcgttgtttactttggagcaggctatatttcaaatgcttttgtaccttttgtaggccctatagcgcatgaagttatttatggtatttggtttgtggcaggtccaatggctctttatatattgaggaaaccaggaaccgctattgtagcagaattgttagctgctttgatagaggttttaattggatcaatttatggaccaagtgtactcgttattggtacccttcaaggtttagggtcagaattaggctttacactatttaggtatcataattacaagttgccagcttttatattgtctgctattttgacatcaatttttagttttgcatggagtttttatgccaatggacttagtgcgttttcattttcatataacattctgatgcttatagtaagaactgtttcatctattattttcttcttattaacaaagaatatatgcgaccaattgcatagaagtggtgtactgaatgcttatgggattcatgaaaggaag

SEQ ID NO: 4418 - protein, 184 aa, Streptococcus agalactiae
MKLSLKDVLLIALLAVVLGVVYFGAGYISNAFVPFVGPIAHEVIYGIWFVAGPMALYILRKPGTAIVAELLAALIEVLIGSIYGPSVLVIGTLQGLGSELGFTLFRYHNYKLPAFILSAILTSIFSFAWSFYANGLSAFSFSYNILMLIVRTVSSIIFFLLTKNICDQLHRSGVLNAYGIHERK

SEQ ID NO: 4419 - DNA, 639 bp, Streptococcus agalactiae
ttgcagatggagttttttgttgtcaaaattttttgtaggttgttgccccttatctgtcatagagaaggagttatgatgactaatcataaaacaaaaaaattaacggttttagcaattatgattgctttagatgtttttttaacgcccatttttagaatagaaggcatggcctttatgtctagtgtggttaatattatcgctggagttataatgggaccaatctatgcattagttatggcacttgtaacggcttttattcgtattttaactcaagcaggagtagcatctgttgcacctttagctattctaggagctggtccaggagctttcttagcgggttggttttatcggttttatgcgaaagactggatgtcttgggtgggtgagtttataggaacagggataattggagcacttttatcagctccaattatggtctggttttggacttggacagcggatggaaatcacgaagtgttagctaaagcatctgcagctcaatccatttttctttttatgccaaggtttataggggcgactataattggcggtgttattgctttgttgctacttcagggattaaagcgggttcctgtatttatgacaatacaagcattatttaaaggagaaaaagtaaaa

SEQ ID NO: 4420 - protein, 213 aa, Streptococcus agalactiae
MQMEFFVVKIFCRLLPLICHREGVMMTNHKTKKLTVLAIMIALDVFLTPIFRIEGMAFMSSVVNIIAGVIMGPIYALVMALVTAFIRILTQAGVASVAPLAILGAGPGAFLAGWFYRFYAKDWMSWVGEFIGTGIIGALLSAPIMVWFWTWTADGNHEVLAKASAAQSIFLFMPRFIGATIIGGVIALLLLQGLKRVPVFMTIQALFKGEKVK

SEQ ID NO: 4421 - DNA, 543 bp, Streptococcus agalactiae
atgaaaaaaataacaactttaatcttagctagtagcttattactagttgcaacgacatcggttaaagctgatgataactttgaaatgccaacgcgttatgttaaaatgagtgaaaaatcaaaagcattttatcaaagactacaagaaaaacaacgtaaggcacatactactgtgaagacttttaataattcagaaataaggcatcaactacctcttaaacaagaaaaggctagaaatgatatctacaatttaggcattcttatttctcaggagtctaaagggttcatccaacgtattgataatgcctattctttggaaaatgtctcagatattgttaatgaagctcaggctttgtataaacgtaactatgatttatttgaaaaaatcaaatctacacgtgataaggttcaagtcttacttgcatcgcatcaagataatacagacttaaaaaacttttatgctgagttggacgatatgtatgaacatgtttatctcaatgaaagtagagtggaggcgataaacagaaatatccaaaaatataat

SEQ ID NO: 4422 - protein, 181 aa, Streptococcus agalactiae
MKKITTLILASSLLLVATTSVKADDNFEMPTRYVKMSEKSKAFYQRLQEKQRKAHTTVKTFNNSEIRHQLPLKQEKARNDIYNLGILISQESKGFIQRIDNAYSLENVSDIVNEAQALYKRNYDLFEKIKSTRDKVQVLLASHQDNTDLKNFYAELDDMYEHVYLNESRVEAINRNIQKYN

SEQ ID NO: 4423 - DNA, 2283 bp, Streptococcus agalactiae
atgaaaaagaaaagagagatggaaatgaaaaaacaatttttaaaatcagcagcgattctatcgctagcagtaacagcagtatctacaagtcagccggtaggggcgatagtgggaaaagatgaaacgaaattaagacagcaacttgggtatattgattcaaaaaaatctggaaagaaaattgatgagagatggggtgaaaaaatttataactatctaagttatgagctcattgaagcaaacgaatggattaaccgaagtgagtttcaggaacctgagtatagaactattttatcagaatttaaagataaaatagatagtattgaatactacttaattaacttaagtaatattgctaaagaagatgcgcatcaaagaaatattcttcaatcattagataaatatgaaaaaagtggaatatataatttagaccaaggtgtttataattatatatatcaagaaattagttcagcgaagcacaagttttcggatggggtagataaaatttatcgtttagatagtactttatttcctttctctgtatggtatgataaacatttagataataatgataactacaaggataataaagattttaaagagtacattgctttattaaatgaaattacacgaaaagcaaggttaggatatcaaattgtaaataaccataaagatggggagcataaagatgaagcagaaatactggatattttaatcagagatataacttttgtttcaaaagatgctcctggatataaatatattccaaataaaagaattgcagcgaaaataattgaagatttagatggaattatcaatgacttttttaagaatacaggaaaagataagccttctcttgaaaagttaaaggacacagaattccataaaaaatatcttaattcaactgaaccgtatagtattgaaactaacttaccttcaaattataaagaattgaaggaaaagcaaataaaaaaattggaatatggatacaaaaagtcttctaaaatttatacgtctgctcattatgcactatatagtgaagaaattgatgctgcaaaagaattgcttcaaaaagtgaagattgcaaaagataattataatgaaattaagtccatgaatctaagcccttcaatttttaatcagtatttacaacttcttcaaatagttataagttcagagataaatctaaaaaaggcactcgataacactgtggatttacccatagaaaataattttaatacattggacattcaatataataaattagacactgctattaagtcacttcgaaaatttgtaactaagtataaacaagaagtaagaaaagctactaagagttattctaaaaaagaattagtaaatgcagagttaacaaaagtaatttctaatgacaatattttattagacatgcaagcaattagttccaattatgggtctactaaaaagtttgtttattcagtcaaaagattaccttacgtcccgcaagtaattatgacaacaacgtctaatgtacttatgcctcaaaagcaagttgaaaaagtgaagctactcaccccatttacaatttctaataaagaagtattgaatcatgactcactagtagaaaatgatgctcaaaaacaaaaagtagaacaggaaaaaactaaatcgctagctcctcaaaaaggggctgtaaaagaacaaactgagcaaaaagtatctggaaatactcaagagatagaaaagaaatctgaaactgtggcaactccacaacaaagttcagttgcgcaaacttctgtccaacagccggctccggttcaatcagttgttcaagaatccaaagcttctcaagaggagattaatgcagcacacgatgctatttcggcgtataaatcaacagtcaatattgctaatacagccggtgtaacaactgcggaaatgaccacgctcattaatactcaaacttctaatctttctgatgttgagaaagctttaggaaataataaggttaataatggtgcagtcaatgtattgagagaagatacagctcgtcttgagaatatgatttggaatcgtgcttaccaagctattgaagaattcaacgtcgctcgtaatacttataataaccaaatcaagacagaaacagttccagttgataatgatattgaagctattttagcaggttctcaagctaaaattagccatttggacaatcgtatcggagcgcgccacatggatcaagcttttgtagctagtttattagaagttactgagatgagtaaatcaatctcatcgcgtataaaagag

SEQ ID NO: 4424 - protein, 761 aa, Streptococcus agalactiae
MKKKREMEMKKQFLKSAAILSLAVTAVSTSQPVGAIVGKDETKLRQQLGYIDSKKSGKKIDERWGEKIYNYLSYELIEANEWINRSEFQEPEYRTILSEFKDKIDSIEYYLINLSNIAKEDAHQRNILQSLDKYEKSGIYNLDQGVYNYIYQEISSAKHKFSDGVDKIYRLDSTLFPFSVWYDKHLDNNDNYKDNKDFKEYIALLNEITRKARLGYQIVNNHKDGEHKDEAEILDILIRDITFVSKDAPGYKYIPNKRIAAKIIEDLDGIINDFFKNTGKDKPSLEKLKDTEFHKKYLNSTEPYSIETNLPSNYKELKEKQIKKLEYGYKKSSKIYTSAHYALYSEEIDAAKELLQKVKIAKDNYNEIKSMNLSPSIFNQYLQLLQIVISSEINLKKALDNTVDLPIENNFNTLDIQYNKLDTAIKSLRKFVTKYKQEVRKATKSYSKKELVNAELTKVISNDNILLDMQAISSNYGSTKKFVYSVKRLPYVPQVIMTTTSNVLMPQKQVEKVKLLTPFTISNKEVLNHDSLVENDAQKQKVEQEKTKSLAPQKGAVKEQTEQKVSGNTQEIEKKSETVATPQQSSVAQTSVQQPAPVQSVVQESKASQEEINAAHDAISAYKSTVNIANTAGVTTAEMTTLINTQTSNLSDVEKALGNNKVNNGAVNVLREDTARLENMIWNRAYQAIEEFNVARNTYNNQIKTETVPVDNDIEAILAGSQAKISHLDNRIGARHMDQAFVASLLEVTEMSKSISSRIKE

SEQ ID NO: 4425 - DNA, 1194 bp, Streptococcus agalactiae
atgtcagaacgtaaacttttcacgtctgagtcagtatctgagggacatcctgataagattgctgaccaaatttccgatgcgattttagatgcaattttagagcaagatccagatgcccacgtagcagccgaaacagctgtttatacagggtcggttcatgtatttggcgaaatatcaacgacagcctatgttgatattaaccgagttgtccgtaacacaatcgctgaaattggctatgataaagctgaatatggcttctcagctgaatctgttggagtgcatccgtcactcgttgaacagtcgccagacattgcacagggagtcaatgaagctcttgaggtacgtggttctcttgaacaagatcctttagatttaattggtgcaggtgaccaaggtttgatgtttgggtttgctgttgatgaaacacctgagttaatgccattgccaatttctttagctcatcagttagttaagaaattgacagatctacgtaagtctggggaactcacttatcttcgaccagatgcaaaatctcaagtaacggttgaatatgatgaaaatgatcaaccaattcgtgtggatgcagtagttatttcgacacagcatgatcctaatgtaactaatgaccaactccataaggacgtgattgagaaagttatcaatgaagttattccaagccattatttagatgaccaaacaaaattctttatcaatcctacagggcgctttgttattggaggccctcaaggagattcaggactaacaggtcgtaagattattgtagatacttatggtggttattctcgtcatggtggtggtgcattttcaggtaaagatgctactaaagtagatcgttcagcatcttatgcagctcgttatattgcaaaaaatattgttgcagctgatttagctaaaaaagtagaagtacaacttgcttatgcaattggtgttgcccagcctgtctctgtgcgtgtagatacatttggaacaggtgttatagcagaagcagacctagaggcagctgtacgtcaaatatttgatttgcgaccagcaggcattattaatatgttggacctcaaacgacctatttatcgacaaacagcagcctatgggcatatgggacgtactgatatcgatttgccatgggagcgagttgataaagtccaggccttaaaggattttattgctagcaaa

SEQ ID NO: 4426 - protein, 398 aa, Streptococcus agalactiae
MSERKLFTSESVSEGHPDKIADQISDAILDAILEQDPDAHVAAETAVYTGSVHVFGEISTTAYVDINRVVRNTIAEIGYDKAEYGFSAESVGVHPSLVEQSPDIAQGVNEALEVRGSLEQDPLDLIGAGDQGLMFGFAVDETPELMPLPISLAHQLVKKLTDLRKSGELTYLRPDAKSQVTVEYDENDQPIRVDAVVISTQHDPNVTNDQLHKDVIEKVINEVIPSHYLDDQTKFFINPTGRFVIGGPQGDSGLTGRKIIVDTYGGYSRHGGGAFSGKDATKVDRSASYAARYIAKNIVAADLAKKVEVQLAYAIGVAQPVSVRVDTFGTGVIAEADLEAAVRQIFDLRPAGIINMLDLKRPIYRQTAAYGHMGRTDIDLPWERVDKVQALKDFIASK

SEQ ID NO: 4427 - DNA, 1194 bp, Streptococcus pyogenes
atgtcagaacgtaaacttttcacgtctgagtccgtatctgaagggcatccagataagattgcagaccaaatttcagatgctattttagatgccattttagcagaagatccagaagcccatgtggctgcagaaacttgtgtttacacaggttctgttcatgtttttggagaaatctcaacaacagcatacattgatattaaccgtgtggtccgcgacaccattgcagaaattggttatacagaagcagaatatggcttttcagcagaatcagtgggagtacatccatcacttgtagaacaatctggagatatcgctcagggggttaatgaagctttcgaaagcagagaaggtgatactgatgaccttagccatattggagcgggtgaccaagggctcatgtttggttttgccatcaatgaaacaccagaattgatgcctttaccaatttccttatctcaccaattagtgcgtcgcttggcggaattacgtaagtcaggtgagattagttatctacgtccagatgctaaatctcaagtgacagttgagtacgatgaacacgataaacctgttcgtgtggatacagtcgttatttctactcagcatgatccagaagctactaatgaccaaattcgtcaggatgtgattgaaaaagtgatcaaggctgtaattccagcagattatttagatgatgacacaaagttcttcattaatccaacaggacgttttgttattggaggtccgcaaggagactctggattgaccggacgtaagattattgtggatacctatggaggctattcacgtcatggtggcggtgctttttcaggaaaagatgcgacaaaagtggaccgttcggcttcttacgctgctcgctatattgctaaaaaccttgtggcagcaggccttgtgaccaaagctgaagtccaactagcttatgcgattggggtggctcagcctgtgtctgttcgcgtggatacatttggaacctcaacggttcctgaagctgttttagaagctgctgttcgtcaagtctttgatttacggccagcaggcattattcaaatgcttgatttaaaacgcccgatttacaaacaaacagctgcctatggtcacatggggagaacagatattgatttgccatgggagcgtttaaataaggttgatgctttagtagaagctgtaaaaacagtatta

SEQ ID NO: 4428 - protein, 398 aa, Streptococcus pyogenes
MSERKLFTSESVSEGHPDKIADQISDAILDAILAEDPEAHVAAETCVYTGSVHVFGEISTTAYIDINRVVRDTIAEIGYTEAEYGFSAESVGVHPSLVEQSGDIAQGVNEAFESREGDTDDLSHIGAGDQGLMFGFAINETPELMPLPISLSHQLVRRLAELRKSGEISYLRPDAKSQVTVEYDEHDKPVRVDTVVISTQHDPEATNDQIRQDVIEKVIKAVIPADYLDDDTKFFINPTGRFVIGGPQGDSGLTGRKIIVDTYGGYSRHGGGAFSGKDATKVDRSASYAARYIAKNLVAAGLVTKAEVQLAYAIGVAQPVSVRVDTFGTSTVPEAVLEAAVRQVFDLRPAGIIQMLDLKRPIYKQTAAYGHMGRTDIDLPWERLNKVDALVEAVKTVL

SEQ ID NO: 4429 - DNA, 933 bp, Streptococcus agalactiae
atgaaaacctacgaaaaaatttatcaaatactatcaaaaaataacaactttattagcggagaaactatggcaaatcaacttaatatttcccgcacagctatttggaaaggtataaaaacgttagaagaattaggcctagagattgagtctgtcactaacaagggctaccgattggtatcaggtgacatattattaccagaacaactcgaacaagaaattggtattaaggttagtcttaataataatagtgcttcaacccaactagatgctaaaatggggatagaaagtaaattaaagactccacacctttttttagctcctaatcaaaaaaaagctaaaggacgttttgatagacctttctttacatcaaatcaaggcggcatctatatgtctcttttattacaacctaatgtaccgattgaagatataaaaccttatactgtcatggtagcctctagtgctgtaaaagctatctcacggttaacaggaattactcctgaaattaagtgggtcaatgatatttatttagataataaaaaaatagctggtattttaaccgaggctatcgcttctgttgagagtgggttggtaacgaatgttattataggattaggtatcaatttctatatcaaagagttccctagggcgttaactaagcgcgcaggtagtctctttacagagcaaccgaccataactagaaatcaattgattacagaaatctggaatctctttttcaatattccactagaggatcacttaaaggtatatagagaaaaatccctagtcttagatagaaccgttagctttatggatggtcaaacaatgtattctgggaaagctattgatattacagataaaggatatttagtggttgagttagatgatggtcagttgaaaacacttcgcagtggcgaaatcagtctttcttcttgg

SEQ ID NO: 4430 - protein, 311 aa, Streptococcus agalactiae
MKTYEKIYQILSKNNNFISGETMANQLNISRTAIWKGIKTLEELGLEIESVTNKGYRLVSGDILLPEQLEQEIGIKVSLNNNSASTQLDAKMGIESKLKTPHLFLAPNQKKAKGRFDRPFFTSNQGGIYMSLLLQPNVPIEDIKPYTVMVASSAVKAISRLTGITPEIKWVNDIYLDNKKIAGILTEAIASVESGLVTNVIIGLGINFYIKEFPRALTKRAGSLFTEQPTITRNQLITEIWNLFFNIPLEDHLKVYREKSLVLDRTVSFMDGQTMYSGKAIDITDKGYLVVELDDGQLKTLRSGEISLSSW

SEQ ID NO: 4431 - DNA, 939 bp, Streptococcus pyogenes
atgaaaacatcagaaaaaatttatcaattactgtcacaaaccgatgacttcgtcagtggggaatatctagcagatcaactcagtatctctcgtacatccgtttggaaatccatcaaaagtctcgaaaatcaggggattcaaattgattctttaaaacacaagggctaccgcatggtacaaggtgatattttattacccaaaaccattagccaagggcttgggatgccagtcacctatacccctcacagccaatctacccaattagatgccaaacaaggaatcgaagctcataacagcgctccaaggctttacctagctcctagccaagaagctgccaaaggacgcctcgatcggcaatttttttcagctagcaccggtggtatttacatgtccatgtacctaaaacccaatgtcccttatgctgatatgcctccttatacgatgatggttgcttccagtattgtcaaagctatctcgcgattaacaggcattgatacagaaatcaaatgggtaaacgacatctatctaggtaaccataaagttgcagggattctgacagaagccattacttctgttgaaactggtttaatcaccgatgtcattattggggttggtctcaacttttttgtcaccgacttcccagaagcgattgctcaaaaggcaggttctctctttaccgaaaaaccgactatcacgcgcaatgaccttatcattgacatctggaaattattcttatctattcctgtcaaggaccatgtcaaagtttacaaagaaaaatcacttgttcttaataaacaagtgacctttatagaaaatagtcaagaaaaacgtgctattgcgattgatctcacagatcaaggacacctcattgtacagtttgaaaatggtgaccttcaaaccttgcgaagcggtgaaatcagtctttcttcttgggagaat

SEQ ID NO: 4432 - protein, 313 aa, Streptococcus pyogenes
MKTSEKIYQLLSQTDDFVSGEYLADQLSISRTSVWKSIKSLENQGIQIDSLKHKGYRMVQGDILLPKTISQGLGMPVTYTPHSQSTQLDAKQGIEAHNSAPRLYLAPSQEAAKGRLDRQFFSASTGGIYMSMYLKPNVPYADMPPYTMMVASSIVKAISRLTGIDTEIKWVNDIYLGNHKVAGILTEAITSVETGLITDVIIGVGLNFFVTDFPEAIAQKAGSLFTEKPTITRNDLIIDIWKLFLSIPVKDHVKVYKEKSLVLNKQVTFIENSQEKRAIAIDLTDQGHLIVQFENGDLQTLRSGEISLSSWEN

SEQ ID NO: 4433 - DNA, 189 bp, Streptococcus agalactiae
ttgaaacttatttttttaatcaatccgttatggatggctcctggatttttgctattttttggggagttttattacttcgagatcttcaaaaggtgtatgcgatttcaaaattcacaaaagagcttatcaaatctaccaagaagaaagactgatttcgccactgcgaagtgttttcaactgaccatcatc

SEQ ID NO: 4434 - protein, 63 aa, Streptococcus agalactiae
MKLIFLINPLWMAPGFLLFFGEFYYFEIFKRCMRFQNSQKSLSNLPRRKTDFATAKCFQLTII

SEQ ID NO: 4435 - DNA, 192 bp, Streptococcus agalactiae
atgacaaaacgacaatttatttttatggcgcttttatgctcttttgaaacttatttttttaatcaatccgttatggatggctcctggatttttgctattttttggggagttttattacttcgagatcttcaaaaggtgtatgcgatttcaaaattcacaaaagagcttatcaaatctaccaagaagaaagac

SEQ ID NO: 4436 - protein, 64 aa, Streptococcus agalactiae
MTKRQFIFMALLCSFETYFFNQSVMDGSWIFAIFWGVLLLRDLQKVYAISKFTKELIKSTKKKD

SEQ ID NO: 4437 - DNA, 306 bp, Streptococcus pyogenes
ttgacgactaaaactgaaatacataagggtaaggttttgcccttacccacgttttatctcgttacttttcttcatagtacagtatttttttgttataataaagctatgactattcgacaatttctttttatggcctttgtatgtgcctttgaaacctatttttttaatgacctgttactctctggaaattatctcttcgccttattttggggcttgttgctctttagggatttaagaagagtgcataccattaaccaactgactaaaaccattttaaaaacggctaattctcccaagaagaaagac

SEQ ID NO: 4438 - protein, 102 aa, Streptococcus pyogenes
LTTKTEIHKGKVLPLPTFYLVTFLHSTVFFCYNKAMTIRQFLFMAFVCAFETYFFNDLLLSGNYLFALFWGLLLFRDLRRVHTINQLTKTILKTANSPKKKD

SEQ ID NO: 4439 - DNA, 1662 bp, Streptococcus agalactiae
atgtatcaggccctttatcggaaatatcgtagccaaacatttgatgaaatggttggacaaagtgttatttcaactactttaaagcaagctgtgtccagcaaaaaaattagccatgcttaccttttttcaggacctaggggaactggaaaaacaagtgctgctaaaatatttgcaaaagcgatgaattgcccaaatcaaattaatggcgaaccttgtaatcattgtgatatttgtcgagatattacaaatggtagtttagaggatgtcattgaaattgatgctgcgtcaaataatggtgtcgatgaaattcgtgatatcagggacaaatcaacttatgctccaagtagggcaacctataaagtttatattattgatgaggttcatatgttgtctacaggtgccttcaatgcactattgaaaacacttgaagagccaacagaaaatgttgtttttatattagcaacaacagaactccataaaatccctgcaacaatcttatctcgtgtccagcgctttgaatttaaagcgattaaattattagctattcgagatcatttagcacagattttagataaagaagctatttcatatgatttggatgctctgacactagtcgctagacgagccgaaggtggtatgcgtgatgctttatcaattctcgatcaagccttgagtttagcgaaagataaccacatttctttagatgtagcagaagaaattacagggagcatttccttatctgctatagatgattatgtatcgaatatattggctcacgatacaactgaagcactcgctaaacttgaagtaatctttgatagtggcaaaagtatgagtcgttttgcaacagatttattgatgtacttaagagatttacttgttgttcaagcaggtggtgaagatagtcattcaagtgatacttttatagccaatcttaatgttaaacaagatattttatttgaaatgattgataaagtgacatctgttcttcctgagataaaaaatggtagccatcctaaagtttatgcagagatgatgaccatccaattgtctgaaatggtagaaaaaaattcgtcaaacatacccgcagatgtgacagcagaattagatagtcttcgtcgagagttaaaatcgttaaaaaacgaaatgagccaactctctcgagcagatcaaagttcatcaactcaaaaagtaaaggttaataataagacattcacatttaaagttgaccgtacaaagattttgaccattatggaagaaacggttgtagatagtcaacgttcacgtgaatacttagaagctttaaagagcgcttggaacgagatattagataatattacggctcaagatagagccttattaatgggatctgaacctgtcttagctaatagcgagaatgctattttggcatttgatgcggcctttaatgctgaacaagctatgaaacgtaccgatctcaatgatatatttggtaatattatgagtaaagcagcaggtttttcacctaatattttagctgtacctagaaatgattttaatcaaattcggagcgattttgcaaagaaaatgaaagctcaaaagacggaaacagaacctgaagttaatcatcaaattccagaagacttttcttatctagcagaacgaatagcaatcgttgaagat

SEQ ID NO: 4440 - protein, 554 aa, Streptococcus agalactiae
MYQALYRKYRSQTFDEMVGQSVISTTLKQAVSSKKISHAYLFSGPRGTGKTSAAKIFAKAMNCPNQINGEPCNHCDICRDITNGSLEDVIEIDAASNNGVDEIRDIRDKSTYAPSRATYKVYIIDEVHMLSTGAFNALLKTLEEPTENVVFILATTELHKIPATILSRVQRFEFKAIKLLAIRDHLAQILDKEAISYDLDALTLVARRAEGGMRDALSILDQALSLAKDNHISLDVAEEITGSISLSAIDDYVSNILAHDTTEALAKLEVIFDSGKSMSRFATDLLMYLRDLLVVQAGGEDSHSSDTFIANLNVKQDILFEMIDKVTSVLPEIKNGSHPKVYAEMMTIQLSEMVEKNSSNIPADVTAELDSLRRELKSLKNEMSQLSRADQSSSTQKVKVNNKTFTFKVDRTKILTIMEETVVDSQRSREYLEALKSAWNEILDNITAQDRALLMGSEPVLANSENAILAFDAAFNAEQAMKRTDLNDIFGNIMSKAAGFSPNILAVPRNDFNQIRSDFAKKMKAQKTETEPEVNHQIPEDFSYLAERIAIVED

SEQ ID NO: 4441 - DNA, 1668 bp, Streptococcus pyogenes
atgtatcaagctctttatcggaaataccggagccaaacgtttgacgaaatggtgggacaatcggttatttccacaactttaaagcaggcagttgaatctggcaagattagccatgcttatcttttttcaggtcctagagggactgggaaaacaagtgcggcaaagatttttgcaaaggccatgaattgtcctaaccaagtcgatggtgaaccctgtaatcaatgcgatatttgccgagatatcacgaatggaagcttggaagatgtgattgaaattgatgctgcctcgaataatggtgttgatgaaattcgtgacattcgagacaaatcaacctatgcgccaagtcgtgcgacttacaaggtttatattattgatgaggttcacatgttatcaacaggggcttttaatgcgcttttgaaaactttggaagaaccgacagaaaatgttgtctttatcttggcaacaacggaattgcataaaattccagccactattttatctcgtgtgcaacgctttgaattcaaagctattaagcaaaaagctattcgagagcatttagcctgggttttggacaaagaaggtattgcctatgaggtggatgctttaaatctcattgcaaggcgagcagaaggaggcatgcgtgatgctttatctattttagatcaggctttgagcttgtcaccagataatcaggtcgccattgcaattgccgaagaaattacaggttctatttccatacttgctctgggtgactatgttcgatatgtctcccaagaacaggctacgcaagctctggcagccttagagaccatttatgatagtgggaagagcatgagccgctttgcgacagatttattgacctatctgcgtgatttattggtggttaaagctggcggcgacaatcaacgtcagtcagctgtttttgataccaatttgtctctctcgatagatcgtatattccaaatgataacagttgttactagtcatctccctgaaatcaaaaagggaacccatcctcggatttatgccgaaatgatgactatccaattagctcagaaagagcagattttgtcccaagtaaacttgtcaggagagttaatctcagagattgaaacgctcaaaaatgagttggcacaacttaaacaacaattgtcgcagctccaatcgcgtcctgattcactggcaagatctgataaaacgaaacctaaaaccacaagctacagggttgatcgggttaccattttgaaaatcatggaagaaacggttcgaaatagccaacaatctcgacaatatctagatgctctaaaaaatgcttggaatgaaattctagataacatttctgcccaagacagagccttattgatgggctctgagcctgtcttagcaaatagtgagaatgcgattttggctttcgaggctgcctttaatgcagaacaagtcatgagccgaaataatcttaatgatatgtttggtaacattatgagtaaagctgctggtttttctcccaatattctggcagtaccaaggacagattttcagcatattcgtaaggaatttgctcagcaaatgaaatcgcaaaaagacagtgttcaagaagaacaagaagtagcgcttgatattccagaagggtttgattttttgctcgataaaataaatactattgacgac

SEQ ID NO: 4442 - protein, 556 aa, Streptococcus pyogenes
MYQALYRKYRSQTFDEMVGQSVISTTLKQAVESGKISHAYLFSGPRGTGKTSAAKIFAKAMNCPNQVDGEPCNQCDICRDITNGSLEDVIEIDAASNNGVDEIRDIRDKSTYAPSRATYKVYIIDEVHMLSTGAFNALLKTLEEPTENVVFILATTELHKIPATILSRVQRFEFKAIKQKAIREHLAWVLDKEGIAYEVDALNLIARRAEGGMRDALSILDQALSLSPDNQVAIAIAEEITGSISILALGDYVRYVSQEQATQALAALETIYDSGKSMSRFATDLLTYLRDLLVVKAGGDNQRQSAVFDTNLSLSIDRIFQMITVVTSHLPEIKKGTHPRIYAEMMTIQLAQKEQILSQVNLSGELISEIETLKNELAQLKQQLSQLQSRPDSLARSDKTKPKTTSYRVDRVTILKIMEETVRNSQQSRQYLDALKNAWNEILDNISAQDRALLMGSEPVLANSENAILAFEAAFNAEQVMSRNNLNDMFGNIMSKAAGFSPNILAVPRTDFQHIRKEFAQQMKSQKDSVQEEQEVALDIPEGFDFLLDKINTIDD

SEQ ID NO: 4443 - DNA, 495 bp, Streptococcus agalactiae
atgaacaagtctaagaaaatcgaaaattatcaattattattactacaagcgcaagctctattctcagatgaaacaaatgctcttgccaacttatcaaatgcttcagctatgctaaatgctatgcttccaaattctgtatttacaggcttttatttatttgatggagaagagttaattcttggccctttccagggtggtgtatcatgtgtgcatattactttaggaaaaggtgtttgtggtgaatctgcacaaactgctaagacgctgatcgttgatgatgttacaaagcatgctaactatatctcctgtgattcaaaagctatgagtgaaatcgtagtacctatgtttaaaaatggcaaacttctaggagttctagatttagattcttctttagtagcagattatgatgagattgatcaagaatacttagaaaaatttgtaggtattctagtagaacatacgatttggaatttggatatgtttggagttgaaaag

SEQ ID NO: 4444 - protein, 165 aa, Streptococcus agalactiae
MNKSKKIENYQLLLLQAQALFSDETNALANLSNASAMLNAMLPNSVFTGFYLFDGEELILGPFQGGVSCVHITLGKGVCGESAQTAKTLIVDDVTKHANYISCDSKAMSEIVVPMFKNGKLLGVLDLDSSLVADYDEIDQEYLEKFVGILVEHTIWNLDMFGVEK

SEQ ID NO: 4445 - DNA, 495 bp, Streptococcus pyogenes
atgaataagtctaaaaaaattgagcaataccaactaatgatagcgcaggcaaaagagctgtttgcgaatgaatcaaatgctttggctaatttgtcaaatgccagcgccctgttaaacatgacactacccaattctgtttttacgggattttacctttttgatgggcaggaattaattcttggcccttttcaaggtagggtttcttgcgtccatatcaagcttggtaaaggtgtttgtggcgaatcagctcagtctcgtcgaaccattattataaatgatgtgaagcagcatgccaactatatttcctgtgatgcggcagccatgagtgaaattgttgtgcctatggtgaaagaaggccatttgattggggtgctggacttggattctagtcttgtagctgattatgatgaggttgatcaagaatacttagaggcctttgtggatctatttcttgaaaagaccacgtttacctttaacatgtttggagttaaaaac

SEQ ID NO: 4446 - protein, 165 aa, Streptococcus pyogenes
MNKSKKIEQYQLMIAQAKELFANESNALANLSNASALLNMTLPNSVFTGFYLFDGQELILGPFQGRVSCVHIKLGKGVCGESAQSRRTIIINDVKQHANYISCDAAAMSEIVVPMVKEGHLIGVLDLDSSLVADYDEVDQEYLEAFVDLFLEKTTFTFNMFGVKN

SEQ ID NO: 4447 - DNA, 627 bp, Streptococcus agalactiae
atgcgtaaaaaacctattattattggtgttacaggtggatctggtggtggtaaaaccagtgtttctcgggcgattttatcaaatttcccagatcaaaaaattaccatgattgaacatgattcttactataaagatcaaagtcatttaacttttgaagaacgtgtaaaaaccaattatgatcatccccttgcttttgataccaatttgatgattgagcaattgaacgaattgattgagggacgtccggtcgatattccggtttatgattacacaaaacatacccgtagtgatagaactatccgccaagaaccccaggatgtcattattgttgagggaattttggtattagaagatcagcgtttgcgtgatttaatggatatcaaattatttgttgatacagatgatgatattcgtattattcgtcgtattaagcgtgatatggaagagcgcgatagaagtttagatagtattattgaacagtatacagaagttgtaaaacctatgtatcatcaatttatcgaaccaacaaagcgttatgcggatattgtaattccagaaggagtaagtaatattgtcgctattgatttaatcaataccaaagtggctagcatcttaaatgaagcaaaa

SEQ ID NO: 4448 - protein, 209 aa, Streptococcus agalactiae
MRKKPIIIGVTGGSGGGKTSVSRAILSNFPDQKITMIEHDSYYKDQSHLTFEERVKTNYDHPLAFDTNLMIEQLNELIEGRPVDIPVYDYTKHTRSDRTIRQEPQDVIIVEGILVLEDQRLRDLMDIKLFVDTDDDIRIIRRIKRDMEERDRSLDSIIEQYTEVVKPMYHQFIEPTKRYADIVIPEGVSNIVAIDLINTKVASILNEAK

SEQ ID NO: 4449 - DNA, 636 bp, Streptococcus pyogenes
ttggagtttaaaatgcttaaaaaaccgattattattggtgtaactggtggttcaggtggcggtaaaacaagtgtgtcacgcgctattttggacagttttccaaatgctcgtattgcaatgattcaacacgattcttactataaagatcagtctcacatgagttttgaagaaagggtcaagaccaattatgaccatcctctagcttttgatacagattttatgattcagcaactaaaagaattattagctggtagacctgtagatattcctatctatgattacaaaaagcatacccgcagtaatacgacctttcgtcaggatcctcaggatgttattattgttgaaggtattcttgtcctagaagatgagcgtttgcgagatttgatggatatcaagctctttgtagacacagatgacgatattcgtattattcgtcgtattaagcgtgacatgatggaacgtggcagaagcttagaaagtattattgatcagtacacaagcgtggtaaagcctatgtatcatcagtttattgagccaagtaaacgctatgctgatattgttattccagagggagttagtaatgtcgttgctattgatgttattaatagtaaaattgcgagtattcttggagaagta

SEQ ID NO: 4450 - protein, 212 aa, Streptococcus pyogenes
LEFKMLKKPIIIGVTGGSGGGKTSVSRAILDSFPNARIAMIQHDSYYKDQSHMSFEERVKTNYDHPLAFDTDFMIQQLKELLAGRPVDIPIYDYKKHTRSNTTFRQDPQDVIIVEGILVLEDERLRDLMDIKLFVDTDDDIRIIRRIKRDMMERGRSLESIIDQYTSVVKPMYHQFIEPSKRYADIVIPEGVSNVVAIDVINSKIASILGEV

SEQ ID NO: 4451 - DNA, 1080 bp, Streptococcus agalactiae
atgataacaaaatttccagaccaatggcaggataaattaacccagcgtcaatttgatgatctaacagatattcaaaataaactttttcaacctattactgatggtgataatatccttggaattagccctacaggtactggtaaaactctagcataccttttcccaacgcttcttaagttgcaacctaaaaagagccaacaactcttaattttagctccaaattcagaattagctggacaaatcttcgacgttacaaaagaatgggctgaaccattaggactgaccgcacaactattcctttcaggttctagtcaaaaacgccaaattgagcgactaaaaaaaggaccagaaattcttataggaactgctggacgcgtatttgaacttgtgaaactaaaaaaaataaaaatgatgaacattaatactatcgtccttgatgaattcgatgaattactcggcgactcacaatatcattttgtggacaatattattaatcgcgttcctcgtgatcagcaaatgatttacattagtgccaccaacaaactggacaatagtaaacttgccgataacactataacaatcgatctatctaatcaaaaacttgatactataaaacattattatattacagttgataaaagagagcgtactgacctacttcgtaaattttcaaatattcctgattttagaggtcttgtcttttttaacagcttatcagacttaggtgcatgtgaagaacgtttacaatttaatagggcctcggcagtttctttagcaagcgatattaatattaaattccgtaaagttatcttagagaaatttaaaaaccatgatatttcattactcctaggaactgatttggtagctcgtggcattgatatcgacaacctagaatatgtgattaattttgatatcgcacgcgacaaagaaacatatacacatcgttctggacgaactggtcgtatggggaaagagggatgtgttattacatttgtaacacataaagaagagctcaaacaacttaaaaaatacgccaccgttacagaacttgtacttcacaatcaaaaattacatttaaaa

SEQ ID NO: 4452 - protein, 360 aa, Streptococcus agalactiae
MITKFPDQWQDKLTQRQFDDLTDIQNKLFQPITDGDNILGISPTGTGKTLAYLFPTLLKLQPKKSQQLLILAPNSELAGQIFDVTKEWAEPLGLTAQLFLSGSSQKRQIERLKKGPEILIGTAGRVFELVKLKKIKMMNINTIVLDEFDELLGDSQYHFVDNIINRVPRDQQMIYISATNKLDNSKLADNTITIDLSNQKLDTIKHYYITVDKRERTDLLRKFSNIPDFRGLVFFNSLSDLGACEERLQFNRASAVSLASDINIKFRKVILEKFKNHDISLLLGTDLVARGIDIDNLEYVINFDIARDKETYTHRSGRTGRMGKEGCVITFVTHKEELKQLKKYATVTELVLHNQKLHLK

SEQ ID NO: 4453 - DNA, 1116 bp, Streptococcus pyogenes
atgaatatagaaacaatagtaaaaggaagacgcatgatcactaaatttccccctcaatggcaagaaaaacttgaccaagttgcatttacccatttaacgccaatccaagaacaggcctttcaacctattgttgatggtaaaaatttccttggtattagccctactgggacgggcaagaccttagcttatgtctttcctaatctattggcactgacgcctaaaaagtcccaacaactactcattttagcccctaataccgaattagctggccaaatttttgaagtcacaaaggattgggcacagccactaggcttaacggcacaactctttatttctggaaccagtcaaaaacgtcaaatcgaacgcctcaaaaaaggtcctgaaatcctgattggaacccctggacgcatttttgagctgattaaattgaaaaaaatcaagatgatgtctgtcaacaccattgttttagatgaatatgacgaactattaggtgattcccaatatgattttgttcaaaaaattagccactatgttcctcgagatcatcaaatggtatacatgagtgctactaataaggtggatcaaacttccttagctccaaatacattctgcatcgatctttcagagcaaaccaacgatgctattcagcatttttacctcatggttgacaagcgcgaacgtacagatttattacgaaaatttactaatattcctcattttagagctttggtctttttcaacagtttatctgatttgggtgctacggaagaacgtctccaatataatggagctgctgcggtttccttagcgagtgacattaatgtcaaattccgtaaaaccattctcgaaaaattcaaatcccaccaactctccttattgttagctacggatcttgttgctcggggcattgatattgataatcttgactatgtcattcattttgatgttgctcgtgataaggaaaattacactcacagagctggacgaaccggccgtatgggaaaatctggtatcgttattacctttgttagccaccctgaagacctcaaaaaattgaaaaaatttgctaaagtctctgaaatctccctcaaaaatcaacaacttcatttcatcaac

SEQ ID NO: 4454 - protein, 372 aa, Streptococcus pyogenes
MNIETIVKGRRMITKFPPQWQEKLDQVAFTHLTPIQEQAFQPIVDGKNFLGISPTGTGKTLAYVFPNLLALTPKKSQQLLILAPNTELAGQIFEVTKDWAQPLGLTAQLFISGTSQKRQIERLKKGPEILIGTPGRIFELIKLKKIKMMSVNTIVLDEYDELLGDSQYDFVQKISHYVPRDHQMVYMSATNKVDQTSLAPNTFCIDLSEQTNDAIQHFYLMVDKRERTDLLRKFTNIPHFRALVFFNSLSDLGATEERLQYNGAAAVSLASDINVKFRKTILEKFKSHQLSLLLATDLVARGIDIDNLDYVIHFDVARDKENYTHRAGRTGRMGKSGIVITFVSHPEDLKKLKKFAKVSEISLKNQQLHFIN

SEQ ID NO: 4455 - DNA, 96 bp, Streptococcus agalactiae
gtgaattatattcaacgccttaataaaaaaagaaacaagttacttgtttctttttttattttaaatgtaatttttgattgtgaagtacaagttctg

SEQ ID NO: 4456 - protein, 32 aa, Streptococcus agalactiae
MNYIQRLNKKRNKLLVSFFILNVIFDCEVQVL

SEQ ID NO: 4457 - DNA, 1251 bp, Streptococcus agalactiae
atgaagaaattaattataggtatttttagtctaattattatagcgattcttgcttggcaaggtttttcgtttttgaaacataaagaaataaaacttcaacaagctgttgttgaaaaagaaattcgcatagccgagaaaacggtagaagtggtgaaaagacagaaaactgaacgtgttctttttcttgaacctaaaggatatgacaaaagtctaagcgctgatattttaaagtggaatcaaaaaagctttgagcataaaaaattttatgacaatcaatacattattctacgtcctcaattagcagattctaactttgcaaatgttaaaaaattatccatttatcaaatcttatatcaaaaagaaaaaggaagtatgtttcaaaaatcaagtcgccttttgagaacctacttacttgatcaaaataagaaaccttttgaattagatgagcttttagctcataatatatctggatttaaggctattttagaaaatatagctccaggaactcaactaaaggaacatgatagcaataaagaatttttaaaaactggaagagtaacagatgggctagatgttaaagatggtaagttaattattaatgatttaaaattaccacttgataaattatataatgtgatcgatgagtcatatttaaaatcaagtgatctagatttagtttctaatttaaaagctaaagcaccacgtgttgcacttacctttgatgatggaccaaatgaaaaaacgactcctaaagccttagaaatccttaaaagatataatgctaaagcgactttctttgtaatgggacaaagtgctgtagggcacacagatattttacaaaggatgcatgctgaaggtcatgagattggtaatcatacatgggatcatcctaatttaaccaaactaccagcggagaaaatcaaggaagagattcataagactaatgatctgattatgaaagcaacaggacaaaaaccggtgtacttacgtcccccttacggagcaacaaatgctactgtaaaaacagtgacaggattgaaagaaatgttgtggtcagttgatacagaagactggaaaaatcataatacacaagcaatgatgaccaatatcaaaaaacaattacgtcctggaggagtgattttgatgcatgatattcaccagacaaccatagatgctctgcctacaattatggattatctgacaacccagggctattattttgttactgtaggtgaattatattcaacgcct

SEQ ID NO: 4458 - protein, 417 aa, Streptococcus agalactiae
MKKLIIGIFSLIIIAILAWQGFSFLKHKEIKLQQAVVEKEIRIAEKTVEVVKRQKTERVLFLEPKGYDKSLSADILKWNQKSFEHKKFYDNQYIILRPQLADSNFANVKKLSIYQILYQKEKGSMFQKSSRLLRTYLLDQNKKPFELDELLAHNISGFKAILENIAPGTQLKEHDSNKEFLKTGRVTDGLDVKDGKLIINDLKLPLDKLYNVIDESYLKSSDLDLVSNLKAKAPRVALTFDDGPNEKTTPKALEILKRYNAKATFFVMGQSAVGHTDILQRMHAEGHEIGNHTWDHPNLTKLPAEKIKEEIHKTNDLIMKATGQKPVYLRPPYGATNATVKTVTGLKEMLWSVDTEDWKNHNTQAMMTNIKKQLRPGGVILMHDIHQTTIDALPTIMDYLTTQGYYFVTVGELYSTP

SEQ ID NO: 4459 - DNA, 1272 bp, Streptococcus pyogenes
ttgaaaaaattaaatgttattcttgttggtttattaagcattctgatgttgagtttagctattgtgtttattaatcgttggaaactaaacgaagatagtcagcgtatagttttggctgaaaagaaaaaaaacacgtcagatttagtgatcaaagctgtaaaacatattaaaaaagatcaaaaagactattattatttttccccgataaaacaagcagatgatttttttgtagataatttacctgtttcattatacaaaaaaaagaattcagataaagaattgattttagtaaggcctaaactgcaatcttctcacctaagatcagttaacactttgactatttctaaaatagtttatcagaaaaaattttttcatttggctaaaaaatcagaaaaagttataagtacatatcacgttacagacgacttgaaaccgtttcaggtaaaggatctagtatcaggacatttagaaagaatacaagaagaagttgaaaaaaaatatccagatgctggttttaatagcgataagtataatggcttaaaagaatctaattctttattaagcgatggctttgaggtaaaatcgggaaaccttatttttgataaaaagctaacgatacctttgacgacattatttgatgttattaatccagattttttagcaaatagcgatagagctgcgtatgataattataggacctacaaagaacagcatcccaaaaaactagttgcattaacgtttgatgatggtccagatccgacgacgactcctcaagttttagatattttggcaaaataccaggctaagggaactttctttatgataggttcaaaggttgtgaataatgaaaaccttactaaacgtgttagcgacgctggccatgaaattgctaatcatacttgggatcatcctaatctgactaatctttcagtcagcgagattcaacatcaagttaatatgacgaaccaggctattgaaaaagcttgtggcaagaaacctcgctatttacgccctccatacggagctacaaatgcaactgttcagcaatcctcaggattaacacaaatgctttggacggttgatacaagagattgggaaaatcatagcactgatggcattatgactaatgtcaaaaaccaattgcaaccgggaggagttgttttaatgcatgatattcatcaaacaactatcaatgctttgccgacagttatggaatatctaaaagcagaaggatacgaatgtgtgactgtatcagaactctatgcgcatcag

SEQ ID NO: 4460 - protein, 424 aa, Streptococcus pyogenes
LKKLNVILVGLLSILMLSLAIVFINRWKLNEDSQRIVLAEKKKNTSDLVIKAVKHIKKDQKDYYYFSPIKQADDFFVDNLPVSLYKKKNSDKELILVRPKLQSSHLRSVNTLTISKIVYQKKFFHLAKKSEKVISTYHVTDDLKPFQVKDLVSGHLERIQEEVEKKYPDAGFNSDKYNGLKESNSLLSDGFEVKSGNLIFDKKLTIPLTTLFDVINPDFLANSDRAAYDNYRTYKEQHPKKLVALTFDDGPDPTTTPQVLDILAKYQAKGTFFMIGSKVVNNENLTKRVSDAGHEIANHTWDHPNLTNLSVSEIQHQVNMTNQAIEKACGKKPRYLRPPYGATNATVQQSSGLTQMLWTVDTRDWENHSTDGIMTNVKNQLQPGGVVLMHDIHQTTINALPTVMEYLKAEGYECVTVSELYAHQ

SEQ ID NO: 4461 - DNA, 1425 bp, Streptococcus agalactiae
ttgacaaaagaatatcaaaattatgtcaatggcgaatggaaatcatctgttaatcagattgagattttgtcaccaattgatgattcttcattgggattcgtgccagcgatgactcgagaagaagttgatcatgctatgaaagcgggtcgtgaggctttaccagcctgggctgctttgacagtatatgaacgtgcacaataccttcataaagccgcagacattattgaacgtgataaagaagaaattgctactgttttagcaaaagaaatttctaaagcttacaatgcttcagtaactgaggttgtaaggacagctgatcttattcgttatgcagcagaagaaggaattcgtttatcaacttcagctgacgaaggtggaaaaatggatgcttcaacaggtcataagttggctgttattcgtcgtcaaccagtaggtatcgttttagcaatcgcaccttataattaccctgttaacctctcaggatcaaaaattgcgccagctctaattggtggaaacgttgtgatgtttaaaccaccaacacaaggttcagtctcaggacttgttttagcaaaagcttttgcagaagcaggtcttccagcaggtgtctttaatactattacaggacgcggttctgagattggagattacattgttgagcatgaagaagttaattttattaactttacaggatcaacgccagttggaaaacgtattggtaagttagcaggaatgcgtccaattatgcttgagttgggtggtaaggatgcaggtgtcgtcttagctgatgctgaccttgacaacgctgctaaacaaatcgttgcaggtgcttatgattactccggacaacgctgtacggcaattaagcgtgtacttgtcgttgaagaagttgcagatgaattggcagaaaaaatatctgaaaatgtagcaaaattatcagtaggtgatccatttgataatgcaacggtgacaccggttattgatgataattcagccgactttattgaaagcttagtagtagatgcacgtcaaaaaggtgcgaaagaattgaatgaatttaaacgtgatggtcgtctattaactccaggattgtttgatcatgttactttagatatgaaactagcttgggaagagccttttggaccaattctcccaattattcgtgtcaaggatgcagaagaagctgttgctattgccaacaaatctgattttggattacaatcatcagtctttacacgtgatttccaaaaagcatttgatatagcaaataaacttgaagttggtacagttcacattaacaataagactggacgtggtcctgataatttcccattcttaggactcaaaggatctggtgcaggtgttcaaggtatcagatattcaattgaagcaatgacaaatgtaaaatcgatagtttttgatatgaaa

SEQ ID NO: 4462 - protein, 475 aa, Streptococcus agalactiae
MTKEYQNYVNGEWKSSVNQIEILSPIDDSSLGFVPAMTREEVDHAMKAGREALPAWAALTVYERAQYLHKAADIIERDKEEIATVLAKEISKAYNASVTEVVRTADLIRYAAEEGIRLSTSADEGGKMDASTGHKLAVIRRQPVGIVLAIAPYNYPVNLSGSKIAPALIGGNVVMFKPPTQGSVSGLVLAKAFAEAGLPAGVFNTITGRGSEIGDYIVEHEEVNFINFTGSTPVGKRIGKLAGMRPIMLELGGKDAGVVLADADLDNAAKQIVAGAYDYSGQRCTAIKRVLVVEEVADELAEKISENVAKLSVGDPFDNATVTPVIDDNSADFIESLVVDARQKGAKELNEFKRDGRLLTPGLFDHVTLDMKLAWEEPFGPILPIIRVKDAEEAVAIANKSDFGLQSSVFTRDFQKAFDIANKLEVGTVHINNKTGRGPDNFPFLGLKGSGAGVQGIRYSIEAMTNVKSIVFDMK

SEQ ID NO: 4463 - DNA, 1425 bp, Streptococcus pyogenes
ttggcaaaacaatataaaaatttagtgaacggtgaatggaaactatcagaaaacgagattaccatttacgcaccagcaacaggtgaagagttaggatcagttccagcgatgacgcaggcagaggtagatgctgtttacgcttcagctaaaaaggctctatcagattggcgcgctttgtcttatgtggaacgtgcagcttaccttcataaagcggctgatattttagtacgtgatgctgaaaagatcggcgcgattctttcaaaagaagtagccaaaggtcacaaggcagctgtcagtgaagttattcgtaccgctgaaatcattaattatgcagcagaagaagggcttcgtatggaaggtgaagttcttgaaggtggtagcttcgaagctgcaagtaagaagaagattgctattgttcgtcgtgaaccagttggtttagttcttgccatctcaccttttaattatcccgttaacttggcaggttctaaaattgctccagctcttattgcaggaaatgttgttgctcttaaaccaccaacacaaggctctatttctggtttgttactagcagaagcttttgcagaagctggtattccagcaggtgtctttaataccattacagggcgaggttctgttatcggtgattatatcgttgagcacgaagcggttagctttatcaactttacaggttctactccaattggggaaggaatcggtaaattagcgggtatgcgaccaattatgcttgagcttggcggtaaggattctgctatcgttttggaagatgcagatcttgctttagcagcgaaaaatattgtagccggtgcttttggttactcaggccaacgttgtacagcggttaaacgtgttcttgtgatggacaaggtggcggatcaattggcggctgagattaaaacacttgttgaaaaactaagtgtcggaatgcctgaagacgatgctgatattacaccattaattgatacatcagctgctgattttgttgaagggttgattaaagatgcaactgataagggagctactgctttgacagcctttaatcgtgaaggcaatcttatttcacccgttctctttgatcatgtgacaactgacatgcgtttggcatgggaagagccgttcggcccagtattaccaattattcgtgtaaccactgtagaagaagccatcaagatttctaatgagtctgaatatggtttgcaagcttctatttttacaactaatttcccaaaagcttttggcattgctgagcaattagaagttggaactgttcaccttaacaataaaacacaacgtggaacagataatttcccattcttaggcgctaaaaaatcaggtgcaggggtacaaggagttaaatattctatcgaagctatgacaactgttaaatctgttgtatttgatatccag

SEQ ID NO: 4464 - protein, 475 aa, Streptococcus pyogenes
LAKQYKNLVNGEWKLSENEITIYAPATGEELGSVPAMTQAEVDAVYASAKKALSDWRALSYVERAAYLHKAADILVRDAEKIGAILSKEVAKGHKAAVSEVIRTAEIINYAAEEGLRMEGEVLEGGSFEAASKKKIAIVRREPVGLVLAISPFNYPVNLAGSKIAPALIAGNVVALKPPTQGSISGLLLAEAFAEAGIPAGVFNTITGRGSVIGDYIVEHEAVSFINFTGSTPIGEGIGKLAGMRPIMLELGGKDSAIVLEDADLALAAKNIVAGAFGYSGQRCTAVKRVLVMDKVADQLAAEIKTLVEKLSVGMPEDDADITPLIDTSAADFVEGLIKDATDKGATALTAFNREGNLISPVLFDHVTTDMRLAWEEPFGPVLPIIRVTTVEEAIKISNESEYGLQASIFTTNFPKAFGIAEQLEVGTVHLNNKTQRGTDNFPFLGAKKSGAGVQGVKYSIEAMTTVKSVVFDIQ

SEQ ID NO: 4465 - DNA, 1731 bp, Streptococcus agalactiae
atgacagaaatgcttaaaggaatcgcagcctctgatggtgttgcagttgctaaagcatatctacttgtccaaccggatttgtcatttgagactgtaacagtcgaagatacaaacgcagaagaagctcgccttgatgttgcactccaagcttcacaagacgagctttctgttatccgtgagaaggcagtagaaagcttaggcgaagaagccgcagctgtatttgatgctcatttaatggttctttctgacccagaaatgattaatcaaattaaagagactattcgtgcaaaacaagtaaatgcagaaacaggtcttaaagaagtgactgatatgttcatcactatctttgaaggtatggaagataacccatacatgcaagaacgtgcagcagatatccgtgatgttgccaaacgtgtcttagcacatcttttgggtgttaaattaccaaacccagcaactatcaatgaagaatcaatcgttattgcacacgatttgacaccttctgatacagctcaattaaataaacaatttgttaaagcttttgtaacaaatattggagggcgtacaagtcactcagctattatggcacgtacactcgaaatcgcagctgttcttggtacaaatgatattactgaacgtgttcaagatggtcagttgattgctgttaatggtattactggtgaagttatcattgaaccaactgaagctcaaatttcagccttcaaggcagcaggtgaagcttatgccaaacaaaaagctgaatgggcacttcttaaggatgcacaaacagttactgctgatggtaaacattttgaattagctgctaatatcggtacacctaaagatgttgagggtgttaacgaaaatggagcagaagcagttggtctttaccgtacagagttcttatatatggattcacaagatttcccaacagaagatgagcaatatgaagcatataaagcagttcttgagggtatgaatggtaaaccagttgttgttcgtacaatggatatcggtggagataaagagcttccttactttgatcttccaaaagagatgaacccattcttaggattccgtgcattgcgtatttcaatttctgaaactggtgatgcaatgttccgcacacaaatccgagcacttcttcgtgcttcagttcatggacagctacgcatcatgttcccaatggttgctttgcttaaagaattccgtgctgctaaagctatatttgaagaagagaaagcgaacttgttagctgacggtgtagcagtagctgaaggcattgaagttggtattatgattgaaatcccagcggcagctatgcttgcagaccaatttgcaaaagaagttgatttcttctcaattggtactaatgatcttatccaatacacaatggctgcggaccgtatgaatgagcaagtttcatacctctatcaaccatacaatccatcaatccttcgtttgattaacaacgttatcaaagctgctcatgctgaaggtaaatgggcaggtatgtgtggtgagatggccggtgatcaaactgcggttccacttcttgttggtatgggattggatgaattctcaatgtcagcaacctcagtacttcgtacacgtagcttaatgaaaaaattggacacagctaaaatggaagaatacgctaatcgtgctctttcagagtgttcaactatggaagaagttatcgaacttcaaaaagaatacgttgactttgac

SEQ ID NO: 4466 - protein, 577 aa, Streptococcus agalactiae
MTEMLKGIAASDGVAVAKAYLLVQPDLSFETVTVEDTNAEEARLDVALQASQDELSVIREKAVESLGEEAAAVFDAHLMVLSDPEMINQIKETIRAKQVNAETGLKEVTDMFITIFEGMEDNPYMQERAADIRDVAKRVLAHLLGVKLPNPATINEESIVIAHDLTPSDTAQLNKQFVKAFVTNIGGRTSHSAIMARTLEIAAVLGTNDITERVQDGQLIAVNGITGEVIIEPTEAQISAFKAAGEAYAKQKAEWALLKDAQTVTADGKHFELAANIGTPKDVEGVNENGAEAVGLYRTEFLYMDSQDFPTEDEQYEAYKAVLEGMNGKPVVVRTMDIGGDKELPYFDLPKEMNPFLGFRALRISISETGDAMFRTQIRALLRASVHGQLRIMFPMVALLKEFRAAKAIFEEEKANLLADGVAVAEGIEVGIMIEIPAAAMLADQFAKEVDFFSIGTNDLIQYTMAADRMNEQVSYLYQPYNPSILRLINNVIKAAHAEGKWAGMCGEMAGDQTAVPLLVGMGLDEFSMSATSVLRTRSLMKKLDTAKMEEYANRALSECSTMEEVIELQKEYVDFD

SEQ ID NO: 4467 - DNA, 1731 bp, Streptococcus pyogenes
atgacagaaatgcttaaaggaattgcagcctcagacggcgttgctgttgctaaagcatatctactagttcagccggatttgtcatttgagactgttacagtcgcagatacaaatgcagaagaagctcgccttgatgttgcactccaagctgcacaagacgagctttctgttatccgtgaaaatgcagtagaaagcttaggtgaagaagcagcagccgtttttgatgcccatttgatggttcttgctgatccagaaatgatcagccaggttaaagaaacgattcgcgcaaaacaaacgaatgcagaaacaggtcttaaagaagtgactgacatgttcatcaccatctttgaaggcatggaagataacccatacatgcaagaacgtgcagcggacatccgcgacgttgcaaaacgtgtgttggctcaccttttaggtgtaaaacttccaaatccagctacaatcaatgaagaatcaatcgttatcgcacacgatttgacaccttcagatactgctcaacttaacaaacaatttgtaaaagcatttgttacaaatatcggtggtcgtacaagtcactcagctatcatggcacgtacacttgagatcgctgcggtacttggaacaaatgatattacaaaacgtgttaaagatggtgatgtgattgccgttaatggtatcactggtgaagtgattatcgatccaagcgaagatcaagtacttgcttttaaagaagctggtgcggcttatgccaaacaaaaagcagagtggtctctccttaaagatgcgcacactgaaacagctgatggcaaacactttgaattggctgctaatatcggtacgcctaaagacgttgaaggtgttaatgacaatggtgctgaagctgttggcctttaccgtactgagttcttgtacatggattctcaagacttcccaactgaagacgaacaatacgaagcttacaaggcagtgcttgaaggcatgaatggcaaacctgttgtggttcgtacgatggatattggtggcgacaaggaacttccttactttgaccttccaaaagaaatgaatccattccttggtttccgtgctcttcgtatttccatctctgaaactggggatgccatgttccgcacacaaatgcgtgcgcttcttcgtgcctctgttcacggacaacttcgtattatgttcccaatggttgcgcttcttaaagaattccgtgctgcaaaagcagtctttgacgaagaaaaagcaaacttgcttgcagaaggcgttgcggttgctgatgacatccaagttggtatcatgattgagattcctgcagctgctatgcttgcagaccaatttgctaaggaagttgatttcttctcaattggaacaaacgaccttatccaatacactatggcagcagaccgtatgaacgaacaagtatcatacctttaccaaccatacaacccatcaatattacgtttgatcaacaatgtgatcaaagcagcgcacgctgaaggtaaatgggcaggtatgtgtggtgagatggcaggtgaccaacaagctgttccacttcttgtcggaatgggcttggatgagttttctatgtcagcaacttcagtacttcgtacgcgtagtttaatgaagaaacttgactctgctaagatggaagaatatgcaaatcgtgcgcttacagaatgttcaacagcagaagaagttcttgaactttctaaagaatacgtttctgaagat

SEQ ID NO: 4468 - protein, 577 aa, Streptococcus pyogenes
MTEMLKGIAASDGVAVAKAYLLVQPDLSFETVTVADTNAEEARLDVALQAAQDELSVIRENAVESLGEEAAAVFDAHLMVLADPEMISQVKETIRAKQTNAETGLKEVTDMFITIFEGMEDNPYMQERAADIRDVAKRVLAHLLGVKLPNPATINEESIVIAHDLTPSDTAQLNKQFVKAFVTNIGGRTSHSAIMARTLEIAAVLGTNDITKRVKDGDVIAVNGITGEVIIDPSEDQVLAFKEAGAAYAKQKAEWSLLKDAHTETADGKHFELAANIGTPKDVEGVNDNGAEAVGLYRTEFLYMDSQDFPTEDEQYEAYKAVLEGMNGKPVVVRTMDIGGDKELPYFDLPKEMNPFLGFRALRISISETGDAMFRTQMRALLRASVHGQLRIMFPMVALLKEFRAAKAVFDEEKANLLAEGVAVADDIQVGIMIEIPAAAMLADQFAKEVDFFSIGTNDLIQYTMAADRMNEQVSYLYQPYNPSILRLINNVIKAAHAEGKWAGMCGEMAGDQQAVPLLVGMGLDEFSMSATSVLRTRSLMKKLDSAKMEEYANRALTECSTAEEVLELSKEYVSED

SEQ ID NO: 4469 - DNA, 261 bp, Streptococcus agalactiae
atggcttcaaaagatttccacattgttgcagaaacaggtattcacgcacgtccagctactttgcttgtccaaacagctagcaaatttgcttcagacatcacgcttgattacaaaggtaaagcagtaaaccttaaatcaatcatgggtgttatgagtcttggtgttggtcaaggtgctgatgttactatttcagcagaaggtgcagatgcagatgatgcaattgcagctatcgaagaaacaatgacaaaagaaggattggca

SEQ ID NO: 4470 - protein, 87 aa, Streptococcus agalactiae
MASKDFHIVAETGIHARPATLLVQTASKFASDITLDYKGKAVNLKSIMGVMSLGVGQGADVTISAEGADADDAIAAIEETMTKEGLA

SEQ ID NO: 4471 - DNA, 261 bp, Streptococcus pyogenes
atggcttcaaaagactttcacattgttgcagaaacaggtattcatgcgcgtccagcgactttgcttgttcaaacagctagcaaatttgcttcagacatcactcttgactacaaaggtaaagcagtaaatctaaaatcaatcatgggtgttatgagtcttggtgttggtcaaggtgcagatgttactatctcagctgaaggtgcagatgctgaagatgccattgcagcaattgaagaaacaatgactaaagagggattggca

SEQ ID NO: 4472 - protein, 87 aa, Streptococcus pyogenes
MASKDFHIVAETGIHARPATLLVQTASKFASDITLDYKGKAVNLKSIMGVMSLGVGQGADVTISAEGADAEDAIAAIEETMTKEGLA

SEQ ID NO: 4473 - DNA, 222 bp, Streptococcus agalactiae
atggcagctattactgttttttcgaaaaacaactgtatgcaatgtaaaatgactaagaaatttcttgaccagcacggcgctgattttgaagaaattaatattgatgaaaaaccagaaaaaattgaatatgtgaaaaatctcggcttttctgcggctccagtgattgaagctggtaatgttgttttttcaggtttccaaccaagcaaactaaaagaacttgtt

SEQ ID NO: 4474 - protein, 74 aa, Streptococcus agalactiae
MAAITVFSKNNCMQCKMTKKFLDQHGADFEEINIDEKPEKIEYVKNLGFSAAPVIEAGNVVFSGFQPSKLKELV

SEQ ID NO: 4475 - DNA, 249 bp, Streptococcus pyogenes
atggaaccattactaattttagaaggacaagacatgattacagtatattccaaaaataattgcatgcagtgcaaaatgactaagaaatttttagaacaacacggagtcaacttccaggaaattaatatcgatgaacatcctgaaaaagtggattatgtgaaaagtcttggcttcacatctgctcctgttatcgaagcagataacctcgtattttctggcttccaacctgcaaagttaaaagaattgatt

SEQ ID NO: 4476 - protein, 83 aa, Streptococcus pyogenes
MEPLLILEGQDMITVYSKNNCMQCKMTKKFLEQHGVNFQEINIDEHPEKVDYVKSLGFTSAPVIEADNLVFSGFQPAKLKELI

SEQ ID NO: 4477 - DNA, 2157 bp, Streptococcus agalactiae
atgagtttaaaaaatattggcgatgtatcttactttcgcctaaataatgaaattaaccgtcctgttaatggacaaatcccactccataaagataaagaagccttaactgcttttttcaaagaaaacgtacagcctaattcaaaagcttttgactcaatcactgataaaattgcttacctccttaagtatgattatcttgaagaagctttcctcaataaatatcgtcctgaatttattgaagaattatctaccaaactcttcgataaaaagtttcgttttaaatccttcatggcagcctataagttttatcagcagtatgcattaaaaacaaatgatggagaatactatttagaaagtattgaagatcgcgttctctttaacgctctttattttgcagacggtgatgaagaactagcaactgacttagctctagaaatgatttcacaacgctatcaacctgcaacaccaagttttttaaatgctggtcgaagtcgtcgcggagaattagtctcatgtttcttaatccaagtaactgatgatatgaatgctattggtcgttcgattaattcagctcttcaattatctcgtattggtggtggggttggaatatcacttagtaaccttcgtgaggctggagctcctatcaaaggttttgctggtgctgcttctggagtcgttccagtcatgaaattatttgaagacagtttttcttactccaaccaacttggacaacgccaaggtgctggagttgtttaccttgacgttttccatccagatattatttcattcttatcaactaaaaaagaaaatgctgatgaaaaagtacgtgttaaaacattgtcattagggattactgtacccgataaattctatgaactagcacgtaacaatcaagaaatgtacttgtttagtccttatagtatcgaacgtgaatatggtgttcctttcagctatattgatattaccgaaaaatacgatgaattagtcgctaaccctaatatcactaaaacaaaaatcaatgctcgtgatttagaaacagagatttctaaacttcaacaagaatcaggttatccttacatcatcaatattgacactgctaatcgtactaaccctgttgatggaaaaattatcatgtcaaatctttgctctgagattttgcaagtacaaaaaccaagtcttatcaatgatgctcaagaataccttgaaatgggaactgatatttcttgtaaccttggctcaactaatgttttaaatatgatgacatctcctgattttggaaaatcaattaaaacaatgactcgtgctttaactttcgttactgactcatcaaatattgaagctgttccaactattaaaaacggaaatgctcaagcacatacatttggacttggagcaatgggactccactcctatttggcaaaaaatcatatcgaatatggtagtccagaatcaattgaatttactgatatttatttcatgctaatgaactactggaccttagtagaatcaaacaatattgcccgcgaacgtcaaacaacatttgtaggttttgaaaaatcaaaatacgctgacggtacatactttgataaatatgtatctggaaaatttgttccacaatctgacaaagtaaaatccctatttgctaatcattttatccccgaagctaaagattgggaaaaccttagatacgcagttatgaaagacggactatatcatcaaaatcggcttgcagttgctccgaatggttctatttcgtatatcaacgattgttcagcatctatccaccctattacacaacgtattgaagagcgtcaagagaaaaaaatcgggaaaatttattatccagctaatggcttagctacagatactatcccttattacacttctgcctatgatatggatatgcgtaaagtaatagacgtctatgccgcagcaactgagcacgtagaccaaggtctctcaatgacactctttttacgaagcgaattaccaaaggagttgtacgagtggaaaacagaaagtaagcagactactcgcgacctttcaatcctacgcaactatgctttcaacaaaggtgtgaaatcaatctactatatccgtacttttacagatgatggtagcgaagtcggagctaatcaatgcgaaagttgtgtcatc

SEQ ID NO: 4478 - protein, 719 aa, Streptococcus agalactiae
MSLKNIGDVSYFRLNNEINRPVNGQIPLHKDKEALTAFFKENVQPNSKAFDSITDKIAYLLKYDYLEEAFLNKYRPEFIEELSTKLFDKKFRFKSFMAAYKFYQQYALKTNDGEYYLESIEDRVLFNALYFADGDEELATDLALEMISQRYQPATPSFLNAGRSRRGELVSCFLIQVTDDMNAIGRSINSALQLSRIGGGVGISLSNLREAGAPIKGFAGAASGVVPVMKLFEDSFSYSNQLGQRQGAGVVYLDVFHPDIISFLSTKKENADEKVRVKTLSLGITVPDKFYELARNNQEMYLFSPYSIEREYGVPFSYIDITEKYDELVANPNITKTKINARDLETEISKLQQESGYPYIINIDTANRTNPVDGKIIMSNLCSEILQVQKPSLINDAQEYLEMGTDISCNLGSTNVLNMMTSPDFGKSIKTMTRALTFVTDSSNIEAVPTIKNGNAQAHTFGLGAMGLHSYLAKNHIEYGSPESIEFTDIYFMLMNYWTLVESNNIARERQTTFVGFEKSKYADGTYFDKYVSGKFVPQSDKVKSLFANHFIPEAKDWENLRYAVMKDGLYHQNRLAVAPNGSISYINDCSASIHPITQRIEERQEKKIGKIYYPANGLATDTIPYYTSAYDMDMRKVIDVYAAATEHVDQGLSMTLFLRSELPKELYEWKTESKQTTRDLSILRNYAFNKGVKSIYYIRTFTDDGSEVGANQCESCVI

SEQ ID NO: 4479 - DNA, 2157 bp, Streptococcus pyogenes
atgagtctcaaagatcttggcgatatttcatattttcgcctaaataatgaaattaaccgtcctgttaatggtaaaattccacttcataaagacaaagaagctttaaaagctttttccgctgaaaatgtgctgccaaacaccatgtcttttacttccattacggaaaaaattgagtatttaatctcaaatgattacattgaatcagcttttattcagaaataccgccctgaatttattactgaattagatagcataatcaaatcagaaaattttcgctttaaatcatttatggcagcctacaagttctaccagcaatacgccttaaaaacaaatgatggagagcattatttagaaaaccttgaagaccgtgtcttgtttaatgctttgtattttgcagatggtcaagaagacttagcaaaagatttagccgttgaaatgattaaccaacgttaccaaccggctactccttcctttttaaatgctggtcgaagccgtcgtggtgaattggtctcttgtttcttgattcaagtaactgatgacatgaactctatcggacgttctatcaactctgctttgcaattatcccgtattggtggaggagttgggattaccttgtctaacctccgtgaagctggcgcaccaatcaaaggctatgctggtgcagcctcaggagttgttcctgttatgaaattatttgaagatagtttttcttattcaaatcaacttgggcaacgtcaaggagctggtgttgtttacctaaatgtttttcatcctgatatcattgctttcttatctactaaaaaagaaaatgccgatgaaaaggtgcgtgttaaaaccttgtcactagggattaccgttcctgataaattctacgaattagctcgtaaaaacgaggacatgtatctctttagtccttacaatgttgaaaaagaatatggcattccctttaactatctcgacattaccaatatgtacgatgagttagtggcgaaccctaaaattactaagactaaaattaaagctcgtgatcttgaaacagagatttcaaaattacaacaagaatctggttacccttatatcatcaatattgatacagctaataaagctaatcctatcgatggaaaaatcatcatgagcaacttgtgttctgaaattttacaagttcaaacacctagccttatcaatgatgcgcaagagtttgtagaaatgggaactgatatttcatgtaacttaggttccactaatatcctgaacatgatgacctcaccagactttggccgttctattaagaccatgacacgtgccctaacttttgttactgattcatcaagcattgaagctgttccaaccattaaacatggcaatagccaagctcatacttttggccttggagctatgggactacattcttaccttgctcaacatcatattgaatatggcagtccagaatccatcgagtttactgatatttactttatgctcctgaattattggaccttggtcgaatccaataacatcgctcgtgagcgccaaactacctttgttggctttgagaactctaagtacgctaatggtagttactttgataaatacgttacaggacactttgttccaaaatctgatttggtgaaagatctgttcaaagaccattttattccgcaagcttcagattgggaggctcttcgcgacgccgttcaaaaagatggtctttatcatcaaaaccgactagcagttgctccaaatggctctatttcttatatcaatgactgctctgcttctattcacccaatcacacaacgcatcgaagagcgtcaagaaaagaaaattggtaaaatctactatcctgcaaatggtttgtctacggataccattccttactatacatctgcttacgatatggacatgcgcaaagttattgatgtctatgccgctgcgaccgaacatgtggaccaaggcttgtcattaactctattccttcgtagtgagttgcctatggagctttatgagtggaaaacacaaagcaaacaaaccactcgtgatttatccatcttacgaaactacgctttcaataaaggcattaaatctatctactatatccgtacctttacggatgatggggaagaagtgggcgcaaaccaatgtgaatcttgtgtcatt

SEQ ID NO: 4480 - protein, 719 aa, Streptococcus pyogenes
MSLKDLGDISYFRLNNEINRPVNGKIPLHKDKEALKAFSAENVLPNTMSFTSITEKIEYLISNDYIESAFIQKYRPEFITELDSIIKSENFRFKSFMAAYKFYQQYALKTNDGEHYLENLEDRVLFNALYFADGQEDLAKDLAVEMINQRYQPATPSFLNAGRSRRGELVSCFLIQVTDDMNSIGRSINSALQLSRIGGGVGITLSNLREAGAPIKGYAGAASGVVPVMKLFEDSFSYSNQLGQRQGAGVVYLNVFHPDIIAFLSTKKENADEKVRVKTLSLGITVPDKFYELARKNEDMYLFSPYNVEKEYGIPFNYLDITNMYDELVANPKITKTKIKARDLETEISKLQQESGYPYIINIDTANKANPIDGKIIMSNLCSEILQVQTPSLINDAQEFVEMGTDISCNLGSTNILNMMTSPDFGRSIKTMTRALTFVTDSSSIEAVPTIKHGNSQAHTFGLGAMGLHSYLAQHHIEYGSPESIEFTDIYFMLLNYWTLVESNNIARERQTTFVGFENSKYANGSYFDKYVTGHFVPKSDLVKDLFKDHFIPQASDWEALRDAVQKDGLYHQNRLAVAPNGSISYINDCSASIHPITQRIEERQEKKIGKIYYPANGLSTDTIPYYTSAYDMDMRKVIDVYAAATEHVDQGLSLTLFLRSELPMELYEWKTQSKQTTRDLSILRNYAFNKGIKSIYYIRTFTDDGEEVGANQCESCVI

SEQ ID NO: 4481 - DNA, 969 bp, Streptococcus agalactiae
ttggagaaaaccatgacaacttactacgaagctataaactggaacgaaattgaagatgttattgataaatcaacttgggaaaaactaaccgaacaattttggctcgatacacgtatccctttatcaaatgacttagacgattggcgcaaactttctgctcaagaaaaagatcttgttggcaaggtttttggaggcttaaccctacttgataccatgcaatcagaaactggtgttgaagctattcgtgccgatgttcgcacgcctcacgaagaagctgtcttaaacaatattcaattcatggaatctgttcacgctaaatcttattcttcaattttctcaactttaaatactaaatcagaaattgaagaaattttcgagtggactaataataatgagttccttcaagaaaaagcacgtattatcaatgacatttatgctaatggaaatgcccttcaaaaaaaggtggcttccacctacctcgaaactttccttttttattctggctttttcacacctctttactatttgggaaataataagttagcaaatgttgctgaaatcattaaattaattattcgtgatgaatctgtacatggtacttatatcggttacaaattccagcttggttttaacgaattaccagaagatgagcaagagaattttcgtgattggatgtatgacctcctttatcagctgtatgaaaacgaagaaaaatacaccaagacactttatgatggcgtaggatggactgaagaagttatgacctttttacgctacaatgctaataaagctcttatgaatttaggacaagatcctttattcccagatacagcaaatgatgtcaacccaattgttatgaatggtatttcaacaggaacatcaaaccatgacttcttctctcaagtaggtaatggttacctacttggtagcgttgaagctatgcatgatgatgactataactatggatta

SEQ ID NO: 4482 - protein, 323 aa, Streptococcus agalactiae
MEKTMTTYYEAINWNEIEDVIDKSTWEKLTEQFWLDTRIPLSNDLDDWRKLSAQEKDLVGKVFGGLTLLDTMQSETGVEAIRADVRTPHEEAVLNNIQFMESVHAKSYSSIFSTLNTKSEIEEIFEWTNNNEFLQEKARIINDIYANGNALQKKVASTYLETFLFYSGFFTPLYYLGNNKLANVAEIIKLIIRDESVHGTYIGYKFQLGFNELPEDEQENFRDWMYDLLYQLYENEEKYTKTLYDGVGWTEEVMTFLRYNANKALMNLGQDPLFPDTANDVNPIVMNGISTGTSNHDFFSQVGNGYLLGSVEAMHDDDYNYGL

SEQ ID NO: 4483 - DNA, 957 bp, Streptococcus pyogenes
atgactacatattatgaagcaattaactggaatgaaatcgaagacgtcattgacaagtcaacttgggaaaagttgaccgaacaattttggcttgatacccgtatccctttatcaaatgacttagacgattggcgcaaactttctcttcaagaaaaagatcttgttggcaaggtttttggaggattaaccctacttgataccatgcaatcagaaactggtgtcgaagctattcgtgctgatgttcgcactcctcacgaagaagctgtcttaaacaatattcaattcatggaatctgttcacgctaaatcttattcgtctatcttttcaaccttaaacaccaaaaaagaaattgaagagatctttgagtggactaataataatgagtttcttcaagaaaaagcacgtattatcaatgacatttacgctaatggagatgccttacaaaagaaagttgcctcaacatatctcgaaactttccttttttattctggctttttcacccctctttactatttgggaaataataagctagcaaatgttgctgaaatcattaaactaattattcgtgatgaatctgtacatggtacttatatcggttacaaattccagcttggttttaacgaactaccagaagatgagcaagagaattttcgtgattggatgtatgacctcctttatcagctgtatgaaaatgaagaaaaatacaccaaaacgctttatgatggcgtagggtggactgaggaagttatgacctttttacgctacaatgctaacaaagctcttatgaatttaggacaagatcctttattcccagatactgcaaacgatgttaacccaattgttatgaatggtatttcaacaggaacatcaaaccatgactttttctcacaggtagggaatggctatcttcttggttctgtagaagctatgtctgatgacgattataattatggactc

SEQ ID NO: 4484 - protein, 319 aa, Streptococcus pyogenes
MTTYYEAINWNEIEDVIDKSTWEKLTEQFWLDTRIPLSNDLDDWRKLSLQEKDLVGKVFGGLTLLDTMQSETGVEAIRADVRTPHEEAVLNNIQFMESVHAKSYSSIFSTLNTKKEIEEIFEWTNNNEFLQEKARIINDIYANGDALQKKVASTYLETFLFYSGFFTPLYYLGNNKLANVAEIIKLIIRDESVHGTYIGYKFQLGFNELPEDEQENFRDWMYDLLYQLYENEEKYTKTLYDGVGWTEEVMTFLRYNANKALMNLGQDPLFPDTANDVNPIVMNGISTGTSNHDFFSQVGNGYLLGSVEAMSDDDYNYGL

SEQ ID NO: 4485 - DNA, 264 bp, Streptococcus agalactiae
ttggaaagaacaaagtgcaataagccccaaattaagccagcaaatagaccgtattttgtaccacgacgtaatgcaaaaagtatcagaggaattgctccaaaagagggagtgaaccatgacgcaaaatcaggaatcattgataaagccatagcaagcgctgcaaaaatagcagtttcaataagacaggtagtgttgttattttttgacataaaaaatctcctttttttatacagcaaaggagattcttttgtcatttgtcatgtt

SEQ ID NO: 4486 - protein, 88 aa, Streptococcus agalactiae
MERTKCNKPQIKPANRPYFVPRRNAKSIRGIAPKEGVNHDAKSGIIDKAIASAAKIAVSIRQVVLLFFDIKNLLFLYSKGDSFVICHV

SEQ ID NO: 4487 - DNA, 606 bp, Streptococcus agalactiae
atgacaaaagaatctcctttgctgtataaaaaaaggagattttttatgtcaaaaaataacaacactacctgtcttattgaaactgctatttttgcagcgcttgctatggctttatcaatgattcctgattttgcgtcatggttcactccctcttttggagcaattcctctgatactttttgcattacgtcgtggtacaaaatacggtctatttgctggcttaatttggggcttattgcactttgttctttccaaagtatattaccttagtttatcccaagtttttatagaatacatcttagcatttataagtatgggacttgcaggcgtattttctgctaaatttaaagatgcacttagcagcagctctaaaactaaagctttatcattagcattatctggagcaatattagcaacacttgttcgttatgtttggcattatatcgctggtgttattttttgggctagttatgcaccaaaaggtatgtctgctacattatactcattaagcgtcaatggtactgctggtttgttaactctattttttgtagtcattagtattattattttagttatcagctaccctagcttctttttacctaagaaa

SEQ ID NO: 4488 - protein, 202 aa, Streptococcus agalactiae
MTKESPLLYKKRRFFMSKNNNTTCLIETAIFAALAMALSMIPDFASWFTPSFGAIPLILFALRRGTKYGLFAGLIWGLLHFVLSKVYYLSLSQVFIEYILAFISMGLAGVFSAKFKDALSSSSKTKALSLALSGAILATLVRYVWHYIAGVIFWASYAPKGMSATLYSLSVNGTAGLLTLFFVVISIIILVISYPSFFLPKK

SEQ ID NO: 4489 - DNA, 561 bp, Streptococcus pyogenes
atgtcaccaaacaccaatgtcaaataccttatcgaagctgctatttttgctgcattggcgatgaccctttcatttattccagattttgctggctggtttagtccttcttatggtgctattgcactggttattttctctttgcgccgtgggttaaagtacggcatgttggcgggtctcatttgggggctacttcactttgtacttggaaaagtttactatctcagcatgtcccaagtctttattgaatatatcttagcctttacctctatgggattagccggtagtttctctgatagtttgattaaaactttaagaagacaacaaaccttttttgccgtttttcttgcaataatggctagtttactagccgttacagtacgttacttgtggcacttccttgcaggaatcattttctggggcagttacgcccctaaaggcatgtccgctgtctggtattcttttagcgttaatggtacagctggtgtcctaacttttttaataacatgtttagcgttaatgattgctttaccaattcatcctcaattatttgatcccaaagac

SEQ ID NO: 4490 - protein, 187 aa, Streptococcus pyogenes
MSPNTNVKYLIEAAIFAALAMTLSFIPDFAGWFSPSYGAIALVIFSLRRGLKYGMLAGLIWGLLHFVLGKVYYLSMSQVFIEYILAFTSMGLAGSFSDSLIKTLRRQQTFFAVFLAIMASLLAVTVRYLWHFLAGIIFWGSYAPKGMSAVWYSFSVNGTAGVLTFLITCLALMIALPIHPQLFDPKD

SEQ ID NO: 4491 - DNA, 759 bp, Streptococcus agalactiae
atgatgaaaaattttataaaacaaagtgatactacatttgttcgaattatcaaaagtcttttaattggtggttttataggggccatacttggttccgtaggagctctttttatcatatttggtcaagataagtacttatctgaaattaatattgttcaatatttcctatgggttagtcgtattgttgtaattataacagctctctttagtctcatctacctctatcagattcaaaaatatcagaaagtttttttcaatgttgatgaaagtcaatctgaagaaatttatcgccagattaatttaagacattcttatgggatgacttttgtgtcaatttcaatagtactcagtatagttaatactttatttaactataaactaaatatttttgatgattcagttactttagttattccaatatatgatttatcactgctatttgttttattgggtttacatatatattttttaaaggtatatcggaatatccgaggtataaaaatgacagtcgctccaactttaaaagagttgaaaaacaatgtcttacaattggacgaagcagagttggaatcaaattataagatgtgttttgatattgtcatgaatttaagtggttttattttccctacgatctattttgtattattctttatctcatttgtttttcaaaaagtggagattgtagcaattattataacaacatctattcatatctacattctcattaagtctttaaaagcagcacgtcatttttataga

SEQ ID NO: 4492 - protein, 253 aa, Streptococcus agalactiae
MMKNFIKQSDTTFVRIIKSLLIGGFIGAILGSVGALFIIFGQDKYLSEINIVQYFLWVSRIVVIITALFSLIYLYQIQKYQKVFFNVDESQSEEIYRQINLRHSYGMTFVSISIVLSIVNTLFNYKLNIFDDSVTLVIPIYDLSLLFVLLGLHIYFLKVYRNIRGIKMTVAPTLKELKNNVLQLDEAELESNYKMCFDIVMNLSGFIFPTIYFVLFFISFVFQKVEIVAIIITTSIHIYILIKSLKAARHFYR

SEQ ID NO: 4493 - DNA, 759 bp, Streptococcus pyogenes
atgaaaaagaagaagaatagttttttacgcttgttaaaaatgtcattgctatcaagtttggcgggagggattataggtggcatggttggagcctttttaggttaccatggagggagattagatcatctcacgttcctaaaagatgatgtgattaacctgattatcttattaaatcgtctagtagttgtcacagacctcacactttcttttgtttttttaacgcaactgaaaaaagagacagctgtttataacacaattgaagaggatgatatttctgaaaatggttaccgtcagctgaataaaaagcatgcttataccatgttattgattgccgtagcttctattttatccatgtgcaatgtgctacttggtctgaccttaactaatgattcacagcatgccatgctggccattccgcttctggatatccttttattattaatggtcattccttttcaagctttagccatgaaacgttacaatgccattcggggaaccgatgttccttattttccaaatttgaaagaattaaaacataatatcatggctctagatgaggcagagttacaagcctatcataagacatcgtttgaaagtgtgttgtcattaaatggagtcatcatcccttccttgtatgtgattttattttttgtctatctattcactggtcaagtggagttaacagccatcttagttttggtgttaattcagctctatttactcgttaagagtgcaacaatgaccagacaattttaccgt

SEQ ID NO: 4494 - protein, 253 aa, Streptococcus pyogenes
MKKKKNSFLRLLKMSLLSSLAGGIIGGMVGAFLGYHGGRLDHLTFLKDDVINLIILLNRLVVVTDLTLSFVFLTQLKKETAVYNTIEEDDISENGYRQLNKKHAYTMLLIAVASILSMCNVLLGLTLTNDSQHAMLAIPLLDILLLLMVIPFQALAMKRYNAIRGTDVPYFPNLKELKHNIMALDEAELQAYHKTSFESVLSLNGVIIPSLYVILFFVYLFTGQVELTAILVLVLIQLYLLVKSATMTRQFYR

SEQ ID NO: 4495 - DNA, 291 bp, Streptococcus agalactiae
atggtcatgacgtatattggtgtacctaaagagcaaaaggcactcagtcgtaggggtaaacaattagaaaaaataaatcagggaggaaaaacacttatgtcacaaatgattcaagatttagtaggaagcacatgtatgatttatttagaggatggttctcaaactcatccttatgagattttaaaggtagatgaggattgggtacagattcgtcgcaacttgaaacgaagtaaagaggaggtgcgtattgtccgtattcatgatatcaaggaattgcgtccagtcaataaa

SEQ ID NO: 4496 - protein, 97 aa, Streptococcus agalactiae
MVMTYIGVPKEQKALSRRGKQLEKINQGGKTLMSQMIQDLVGSTCMIYLEDGSQTHPYEILKVDEDWVQIRRNLKRSKEEVRIVRIHDIKELRPVNK

SEQ ID NO: 4497 - DNA, 816 bp, Streptococcus agalactiae
atgaatctattattttctattgatgatatgtacgtagatcattttaaagtgatgctttattcgcttgtccgacaaaccaagaatcgtaagttagagatatatgtcttacaaaaaacattactcaaacgtcatacagaacttattcaatatactcaaaatttagaagttggctatcatccaataattgtaggtaccgaagtatttgctcaggcacctacaactgatcgctatccagatacaatatattatcgacttttggctcataaatttttacctgagaccttagataggatactttatttagatgcagatatgctttgcttaaatgatttctcaagtttatatgatatggagttaggtgatcaactatatgcagcggcaagtcataatactgatggtaagtttctagattatgtcaataaattacggttaaaaaatgtagagctagaatcctcttatttcaatacaggggtactcttgatgaacttgcctgctatacgaaaagttgttcatcaacaaactatcttagattacataatgcaaaaccgtggtcgtctaatcttaccagatcaggatatcttaaatggcttatacgctaatttggttaaaccaatacctgatgaaatttataattatgatgctaggtatagtcttatttatcaattaaaaagtcgcaatgaatgggatttagagtgggttattaaccatactgtttttttacattttgcaggacgagataaaccatggaaaaaagattatagaggacgttactcgggcctttataagtttatggctaaagaggctttaactaaaaat

SEQ ID NO: 4498 - protein, 272 aa, Streptococcus agalactiae
MNLLFSIDDMYVDHFKVMLYSLVRQTKNRKLEIYVLQKTLLKRHTELIQYTQNLEVGYHPIIVGTEVFAQAPTTDRYPDTIYYRLLAHKFLPETLDRILYLDADMLCLNDFSSLYDMELGDQLYAAASHNTDGKFLDYVNKLRLKNVELESSYFNTGVLLMNLPAIRKVVHQQTILDYIMQNRGRLILPDQDILNGLYANLVKPIPDEIYNYDARYSLIYQLKSRNEWDLEWVINHTVFLHFAGRDKPWKKDYRGRYSGLYKFMAKEALTKN

SEQ ID NO: 4499 - DNA, 105 bp, Streptococcus agalactiae
atgctaccaacaacggccattgctccaatacaaacggtacaagttgaggtgacgaatgcctccacaaatttaatatcgttaccacttcctgttttttgcttaaga

SEQ ID NO: 4500 - protein, 35 aa, Streptococcus agalactiae
MLPTTAIAPIQTVQVEVTNASTNLISLPLPVFCLR

SEQ ID NO: 4501 - DNA, 714 bp, Streptococcus agalactiae
atggttggtttaggaacagttatcaatgttattcttattatagttggaggctttgtaggtttatttttgaaaaattttttgaaagaatcacttcaaaagagccttatgcaagccatgggagttgcagttttatttatttcgatatcaggtgttttggagaaaatgatgttagtcgaaaagtcacatctcatctctaatcatacaaatatgatgattattactcttgctctaggtacggtacttggagagttgctatcactagattcgtatattgataaatttgggaactatcttaagcaaaaaacaggaagtggtaacgatattaaatttgtggaggcattcgtcacctcaacttgtaccgtttgtattggagcaatggccgttgttggtagcattcaagatggtatagcagcagatcattcgattttatttgctaagggaatgttagacatgattattattgcaattatgacagtgtctttagggaaaggagctctattttctgcacttcctgtcgctttactacaaggtagccttacgattgttgcttttttcatggggagtctacttaatccatcatctttagattaccttaacttagtaggaaatatgcttatattctgtgtcggtgttaatttactctttaacctaaatattaaagttatcaatatgttgccagcaattattttagctatattatggggaagttttata

SEQ ID NO: 4502 - protein, 238 aa, Streptococcus agalactiae
MVGLGTVINVILIIVGGFVGLFLKNFLKESLQKSLMQAMGVAVLFISISGVLEKMMLVEKSHLISNHTNMMIITLALGTVLGELLSLDSYIDKFGNYLKQKTGSGNDIKFVEAFVTSTCTVCIGAMAVVGSIQDGIAADHSILFAKGMLDMIIIAIMTVSLGKGALFSALPVALLQGSLTIVAFFMGSLLNPSSLDYLNLVGNMLIFCVGVNLLFNLNIKVINMLPAIILAILWGSFI

SEQ ID NO: 4503 - DNA, 2616 bp, Streptococcus agalactiae
atgaaagaattatcgtctgcacaaatccgccaaatgtggttggatttctggaaatccaaaggacattccgttgagccttcagctaacttggttcctgttaatgacccaacgcttctttggatcaactcaggtgttgcaaccttgaaaaaatattttgatggttcagtgattccagaaaatccacgtattaccaatgcacaaaaatcaattcgtactaatgatattgaaaatgttggtaaaacagcacgtcaccatactatgtttgaaatgcttggtaacttctcaattggagactatttccgtgatgaagctattgagtggggatttgaactcttgacaagtcctgaatggtttgacttccctaaagacaagctctacatgacttattacccagatgacaaggattcatataaccgttggattgcttgtggcgttgaaccaagtcacttggtgccaatcgaggataacttctgggaaatcggtgctggtccttcaggtccagatactgagattttcttcgaccgtggtgaagattttgatccagaaaatattggacttcgtcttttggctgaagatatcgaaaacgatcgttacatcgaaatctggaacattgttctctcacaattcaatgctgacccagccgtaccacgttcagaatacaaagaattgccaaacaaaaacattgatacgggtgcgggtcttgaacgtcttgcagctgttatgcaaggggcaaaaacaaactttgaaactgaccttttcatgcctatcatccgtgaagtagagaaattgtcaggtaaaacttacgatccagatggcgacaacatgagcttcaaggttatcgctgatcacatccgtgcgctttcatttgccatcggtgatggtgcgcttcctggaaatgaaggtcgtggttatgttcttcgtcgtcttctccgtcgtgcggttatgcacggtcgccgtcttggcatcaacgaaactttcctttacaaattggttccgactgttggacaaatcatggaaagctactatccagaagtgcttgaaaaacgtgattttattgagaaaatcgttaaacgtgaggaagaaacatttgctcgtactatcgatgctggtagcggtcacttagattcattgcttgcgcagcttaaggctgaaggtaaagacacacttgaaggtaaagatatcttcaaactttatgatacttatggattcccagttgaattgacagaggaattggcagaagatgcaggctataagattgaccacgaaggctttaagtcagccatgaaagaacaacaagaccgtgcgcgtgcagctgttgttaagggtggttcgatggggatgcaaaatgaaaccctagctggtattgttgaagaatcacgattcgaatacgacacatatagtcttgaatcaagtctttcagtcatcatcgctgacaatgaacgtactgaagcagtttcagaaggtcaagctcttcttgtctttgctcaaacaccattctatgctgaaatgggtggacaggttgctgaccacggtgtcatcaaaaatgataagggtgacacagttgctgaggttgttgatgttcaaaaagcaccaaatggtcaacctctacacactgtaaacgttttggcatcactttcagttggaacaaactacacacttgaaatcaacaaagagcgtcgtttggctgttgagaaaaaccacacagcaactcacttgctccatgcagctcttcacaatgttatcggtgaacacgcaactcaggctggttcattgaacgaagaagaattcttgcgctttgattttactcactttgaagcagtaagcaatgaggaacttcgtcacattgaacaagaagttaatgagcaaatttggaacgatcttacgatcacaacgactgaaactgacgttgaaaccgcaaaagagatgggagcaatggcactttttggtgagaaatatggtaaagtggttcgtgtggttcaaattggtaattattctgttgaactttgcggtggaactcacttaaataattcttcagaaatcggtctcttcaagattgtcaaagaagaaggtattggttcaggtactcgtcgtattattgcagttactggtagacaagcttttgaagcttatcgtaaccaagaggatgcactaaaagagatcgctgctactgtaaaagctccgcaattgaaagatgcagcagctaaagtacaagctcttagcgactcacttcgtgatcttcaaaaagaaaatgtagagcttaaagaaaaagcagcagctgcagcagctggtgatgtctttaaagatattcaagaagctaagggcgtgcgcttcattgctagtcaagttgatgttgcagacgcaggtgcacttcgtacatttgctgataactggaaacaaaaagactactctgatgtgcttgttctcgtagcagctattggtgagaaggttaatgtccttgttgcaagcaaaactaaagatgtccacgctggtaacatgatcaaaggattggcaccaattgtagcaggtcgtggtggtggtaaaccagacatggctatggcaggtggtagcgatgcaagtaaaattgcagagttgctagcagcagttgcagaaaattta

SEQ ID NO: 4504 - protein, 872 aa, Streptococcus agalactiae
MKELSSAQIRQMWLDFWKSKGHSVEPSANLVPVNDPTLLWINSGVATLKKYFDGSVIPENPRITNAQKSIRTNDIENVGKTARHHTMFEMLGNFSIGDYFRDEAIEWGFELLTSPEWFDFPKDKLYMTYYPDDKDSYNRWIACGVEPSHLVPIEDNFWEIGAGPSGPDTEIFFDRGEDFDPENIGLRLLAEDIENDRYIEIWNIVLSQFNADPAVPRSEYKELPNKNIDTGAGLERLAAVMQGAKTNFETDLFMPIIREVEKLSGKTYDPDGDNMSFKVIADHIRALSFAIGDGALPGNEGRGYVLRRLLRRAVMHGRRLGINETFLYKLVPTVGQIMESYYPEVLEKRDFIEKIVKREEETFARTIDAGSGHLDSLLAQLKAEGKDTLEGKDIFKLYDTYGFPVELTEELAEDAGYKIDHEGFKSAMKEQQDRARAAVVKGGSMGMQNETLAGIVEESRFEYDTYSLESSLSVIIADNERTEAVSEGQALLVFAQTPFYAEMGGQVADHGVIKNDKGDTVAEVVDVQKAPNGQPLHTVNVLASLSVGTNYTLEINKERRLAVEKNHTATHLLHAALHNVIGEHATQAGSLNEEEFLRFDFTHFEAVSNEELRHIEQEVNEQIWNDLTITTTETDVETAKEMGAMALFGEKYGKVVRVVQIGNYSVELCGGTHLNNSSEIGLFKIVKEEGIGSGTRRIIAVTGRQAFEAYRNQEDALKEIAATVKAPQLKDAAAKVQALSDSLRDLQKENVELKEKAAAAAAGDVFKDIQEAKGVRFIASQVDVADAGALRTFADNWKQKDYSDVLVLVAAIGEKVNVLVASKTKDVHAGNMIKGLAPIVAGRGGGKPDMAMAGGSDASKIAELLAAVAENL

SEQ ID NO: 4505 - DNA, 2616 bp, Streptococcus pyogenes
atgaaagaattatcgtctgcacaaatccgccaaatgtggttggatttctggaaatctaaaggacattgcgttgagccttcagctaacttggttcctgtgaacgacccaacgcttctttggatcaactcaggtgttgcaaccttgaaaaaatattttgatggttcagtgattccagaaaatccacgtattaccaatgcacaaaaatcaattcgtactaatgatattgaaaatgttggtaaaacagcacgtcaccatactatgtttgaaatgcttggtaacttctcaattggagactatttccgtgatgaagctattgagtggggatttgaactcttgacaagtccagactggtttgatttccctaaagacaagctctacatgacttattacccagatgacaaggattcgtataaccgttggattgcttgtggcgttgaaccaagtcacttggtgccgatcgaggataacttctgggaaatcggtgctggtccttcaggtccagatacggagattttcttcgaccgtggtgaagatttcgatccagaaaatatcggacttcgcctcttggctgaagatatcgaaaacgatcgttacatcgaaatctggaacatcgttctctcacaattcaatgctgacccagccgtaccacgttcagaatacaaagaattaccaaacaaaaacattgatacaggtgctggtcttgaacgtcttgcagctgttatgcaaggggcaaaaacaaactttgaaactgacctcttcatgccaatcatccgtgaagtagagaagttgtcaggtaaaacttacgatccagatggcgacaacatgagtttcaaggttatcgctgaccacatccgtgcgctttcatttgctatcggtgatggtgcgcttcctggaaatgaaggtcgtggttacgttcttcgtcgtcttctccgtcgtgcggttatgcacggtcgccgtcttggcatcaacgaaactttcctttacaaattggttccgactgttggacaaatcatggaaagctactacccagaagtgcttgaaaaacgtgattttatcgagaaaatcgttaaacgtgaggaagaaacatttgctcgtactatcgatgcaggtagcggtcacttagattcattgcttgcgcagcttaaggctgaaggtaaggatactcttgaaggtaaagatatcttcaaactttatgatacttatggattcccggttgaattgacagaggaattggcagaagatgcaggctacaagattgaccacgaaggctttaagtcagccatgaaagaacaacaagaccgtgcgcgtgcagctgttgttaagggtggttcaatggggatgcaaaatgaaaccctagctggtattgttgaagaatcacgattcgaatacgacacatatagtcttgaatcaagtctttcagtcatcatcgctgataatgaacgtaccgaagctgtttcagaaggtcaagcccttcttgtctttgctcaaacaccattctatgctgaaatgggtggacaggttgctgacacaggtagaatcaaaaatgataagggtgacacagttgctgaggttgttgatgttcaaaaagcaccaaatggtcaacctctacacactgtaaacgttttagcatcactttcagttggaacaaactacacacttgaaatcaacaaagagcgtcgtttggctgttgagaaaaaccacacagctactcacttgctccatgcagctcttcacaatgttatcggtgaacacgcaactcaggctggttcattgaacgaagaagaattcttgcgctttgattttactcactttgaagcagtaagcaatgaggaacttcgtcacattgaacaagaagttaatgagcaaatttggaacgctcttacaatcacaacgactgaaactgacgttgaaaccgcaaaagagatgggagcaatggcgctttttggtgagaaatatggtaaagtggttcgtgtggttcaaattggtaattattctgttgaactttgtggtggaactcacttaaataattcttcagaaatcggtctcttcaagattgtcaaagaagaaggtattggttcaggcactcgtcgtattattgcagttactggtagacaagcttttgaagcttatcgtaaccaagaggatgccctaaaagagatcgctgctactgtaaaagctccgcaattgaaagatgcagcagctaaagtacaagctcttagcgactcgcttcgtgatcttcaaaaagaaaatgcagaacttaaagaaaaagcagcagctgcagcagctggtgatgtctttaaagatgttcaagaagctaagggcgtgcgcttcattgctagtcaagttgatgttgcagatgcaggggcacttcgtacatttgctgataactggaaacaaaaagactactctgatgtgcttgttctcgtagcagctattggtgagaaggttaatgtccttgttgcaagcaaaaccaaagatgtccacgctggtaacatgatcaaagaattggcaccaattgtagcaggtcgtggtggaggtaaaccagacatggctatggcaggtggtagcgatgcaagtaaaattgcagagctgctagcagcagttgctgaaatagtg

SEQ ID NO: 4506 - protein, 872 aa, Streptococcus pyogenes
MKELSSAQIRQMWLDFWKSKGHCVEPSANLVPVNDPTLLWINSGVATLKKYFDGSVIPENPRITNAQKSIRTNDIENVGKTARHHTMFEMLGNFSIGDYFRDEAIEWGFELLTSPDWFDFPKDKLYMTYYPDDKDSYNRWIACGVEPSHLVPIEDNFWEIGAGPSGPDTEIFFDRGEDFDPENIGLRLLAEDIENDRYIEIWNIVLSQFNADPAVPRSEYKELPNKNIDTGAGLERLAAVMQGAKTNFETDLFMPIIREVEKLSGKTYDPDGDNMSFKVIADHIRALSFAIGDGALPGNEGRGYVLRRLLRRAVMHGRRLGINETFLYKLVPTVGQIMESYYPEVLEKRDFIEKIVKREEETFARTIDAGSGHLDSLLAQLKAEGKDTLEGKDIFKLYDTYGFPVELTEELAEDAGYKIDHEGFKSAMKEQQDRARAAVVKGGSMGMQNETLAGIVEESRFEYDTYSLESSLSVIIADNERTEAVSEGQALLVFAQTPFYAEMGGQVADTGRIKNDKGDTVAEVVDVQKAPNGQPLHTVNVLASLSVGTNYTLEINKERRLAVEKNHTATHLLHAALHNVIGEHATQAGSLNEEEFLRFDFTHFEAVSNEELRHIEQEVNEQIWNALTITTTETDVETAKEMGAMALFGEKYGKVVRVVQIGNYSVELCGGTHLNNSSEIGLFKIVKEEGIGSGTRRIIAVTGRQAFEAYRNQEDALKEIAATVKAPQLKDAAAKVQALSDSLRDLQKENAELKEKAAAAAAGDVFKDVQEAKGVRFIASQVDVADAGALRTFADNWKQKDYSDVLVLVAAIGEKVNVLVASKTKDVHAGNMIKELAPIVAGRGGGKPDMAMAGGSDASKIAELLAAVAEIV

SEQ ID NO: 4507 - DNA, 516 bp, Streptococcus agalactiae
ttgctatttgtcaactttcgaggaggaagagatatggctacttttcaaattaaagaaaaaatgttttctctaggcggtaaatttactattacagacctgactgggcttccctgttatcacgttgaaggaagtttgttccctctacctaagacttttaaagtctttgacgaagaggaacatctcattagtcagattgagaagaaggttttaagttttttaccaaagtttaatgtgacattagccaatgggaatcatttcacgattaagaaagatttctcatttttgaaacctcattacaccattgaagaccttgatatggaagttaagggaaatttttgggatatggatttccaactcttaaaagacaatcaagttatagcaaacatatctcaacagtggtttcgtatgacttcaacttatcaggtagaagtttacagtgaaacttacaacgatttgacaatttcgcttgtcatagcgatcgactatgtcaaagagttagaaaaaaatgcatcaaac

SEQ ID NO: 4508 - protein, 172 aa, Streptococcus agalactiae
MLFVNFRGGRDMATFQIKEKMFSLGGKFTITDLTGLPCYHVEGSLFPLPKTFKVFDEEEHLISQIEKKVLSFLPKFNVTLANGNHFTIKKDFSFLKPHYTIEDLDMEVKGNFWDMDFQLLKDNQVIANISQQWFRMTSTYQVEVYSETYNDLTISLVIAIDYVKELEKNASN

SEQ ID NO: 4509 - DNA, 402 bp, Streptococcus agalactiae
atgaaatacacttatttagcattgtttgaagtggataaagaaaacggtggctataacatttctttccctgattttcatggagcatttagtgaagctgatagcttgaacgaggccatttttaacgctcgtgaagtccttgaaatctatacaattatgtttgaagacgagggcaaagagtttcctaaagcatcatcattcaaggctcttgcaagcaatttagcaagtgacgaagatgtgattcaggctatttcagttgatactgagcttgtccgtgagcgtgaacgctctaagattgtcaacaagactgtcacactgccaagctggcttgtggaagttggaaaagaaaacaaggtcaactttagccagctgttgcaaaaagcaatccgtgaggaattgcaagta

SEQ ID NO: 4510 - protein, 134 aa, Streptococcus agalactiae
MKYTYLALFEVDKENGGYNISFPDFHGAFSEADSLNEAIFNAREVLEIYTIMFEDEGKEFPKASSFKALASNLASDEDVIQAISVDTELVRERERSKIVNKTVTLPSWLVEVGKENKVNFSQLLQKAIREELQV

SEQ ID NO: 4511 - DNA, 1530 bp, Streptococcus agalactiae
atggtcttagataaagaaatcaaggctcaattagcgcaatatttagatttgctagaatctgatattgtattacaagctgatttaggagataacgataattctcaaaaagtaaaggattttctagatgaaattgtcgctatgtctgatcgcatcagccttgaatcaacacatttaaaacgtcaacctagttttggaattgcaaaaaaagggcatgaaagtcgcgttattttttcaggcttgccaatggggcatgaattcacatctttcattttagctttgttgcaagtctctggtcgcgcaccaaaagttgatgaagatattatcaaacgaattaaggggattgagaaaactatcaatctagaaacttatgtttcattaacttgccataattgtccagatgtcgttcaagcctttaatataatggctgttttgaatccgaatatcactcatactatgattgaaggaggcatgtatcaagacgaagtcaaatcaaaaggtatcatgtctgttcctactgtttataaggaccaagaagaatttacttctggccgtgctacaattgaacagcttttagaacaactagatggacctcttgatgctgaagcatttgctgacaaaggtgtctatgatgttctagttattggtggtggtcctgcaggtaacagtgctgcaatttatgccgcccgtaaagggttaaaaacaggtattttagcagaaacttttggtggacaagttatcgaaacagttggtattgagaacatgattggtacactgtacacagaaggccctaaattaatggctcaaattgaagagcataccaaatcttacgatattgatattatcaagagtcaattagcaactggcattgagaaaaaagaattagttgaggtaacactggctaacggagctattttacaagctaaaactgctatcctagctctgggtgctaagtggcgaaatatcaacgttcctggcgaggaagaattccgcaataaaggtgttacttactgtccacattgtgatggccctcttttcgaaggaaaagatgttgctgttataggtggtggtaattcaggtatggaagctgctttagatctagccggtgtcactaaacatgttacagtcctagaattcttacctgagctcaaagcagaccaagtactgcaagaacgagcagctaaaactgacaatttaactattcttaagaatgttgctactaaagatatcgttggtgaagatcatgtcactggtttaaactataccgatcgtgatacaaacgaagaaaaacacattgatttagaaggtgtttttgtacaaattggtcttgtaccaagtacatcttggctcaaggatagcggcattgaactcaatgaacgtcaagaaattgtcgttgataaatttggctcaacaaatatccctggtatttttgctgcaggtgactgtacagatgctgcctacaagcaaatcattatttccatggggtctggtgccacagctgccattggcgcatttgattatttaatcagacaa

SEQ ID NO: 4512 - protein, 510 aa, Streptococcus agalactiae
MVLDKEIKAQLAQYLDLLESDIVLQADLGDNDNSQKVKDFLDEIVAMSDRISLESTHLKRQPSFGIAKKGHESRVIFSGLPMGHEFTSFILALLQVSGRAPKVDEDIIKRIKGIEKTINLETYVSLTCHNCPDVVQAFNIMAVLNPNITHTMIEGGMYQDEVKSKGIMSVPTVYKDQEEFTSGRATIEQLLEQLDGPLDAEAFADKGVYDVLVIGGGPAGNSAAIYAARKGLKTGILAETFGGQVIETVGIENMIGTLYTEGPKLMAQIEEHTKSYDIDIIKSQLATGIEKKELVEVTLANGAILQAKTAILALGAKWRNINVPGEEEFRNKGVTYCPHCDGPLFEGKDVAVIGGGNSGMEAALDLAGVTKHVTVLEFLPELKADQVLQERAAKTDNLTILKNVATKDIVGEDHVTGLNYTDRDTNEEKHIDLEGVFVQIGLVPSTSWLKDSGIELNERQEIVVDKFGSTNIPGIFAAGDCTDAAYKQIIISMGSGATAAIGAFDYLIRQ

SEQ ID NO: 4513 - DNA, 1530 bp, Streptococcus pyogenes
atggcattaagtcctgatattaaagaacaacttgcccaatacctcaccctgttagaagctgatcttgttttgcaagtttcccttggtgacaatgagcagtctcaaaaagtcaaagactttgtggaagaaatagctgctatgtctgagcgtatttctattgaaaacatcactttagaccgacaaccaagctttaaggttgcgaaaaaaggtcacggtagtggggttgtctttgctggtcttcctttaggccacgaattgacgtcctttattcttgctctcttgcaagtatctggacgtgctccaaaagtggatcaagatgttattgatcgcatcaaggccattgaccgtccgttgcattttgaaacttatgtcagcttaacctgccataactgcccagatgttgttcaagctttaaacattatgtccgtcttgaacgacaagatttcacacactatggtagaaggcggcatgttccaagatgaagtgaaagcaaaaggcattatgtctgtccctactgtctttttagacggggaagaattcacttctggtcgcgctaccattgagcaactcttagaacaaatcgctggcccactttctgaggaagcctttgctgataaaggcctctatgatgtccttgttattggtggtggccctgcgggcaatagcgctgctatctatgcagctcgtaaaggactaaaaacaggtttacttgctgaaacctttggtggtcaggtcatggaaacggtcggcatcgaaaacatgattggtaccctttacactgaaggaccaaaattaatggccgaagtggaggcccatactaagtcttatgatgttgatattatcaaagcacaactagctacttctattgagaaaaaagaaaacatcgaggttactctagctaatggtgcggttctacaagccaaaactgctatcttagctcttggggccaaatggcgtaacattaatgttcctggtgaagatgaattccgtaataaaggggtgacttactgccctcactgtgacggtcctctctttgaaggcaaagatgttgctgttatcggtggtgggaactctggattagaagcggcccttgacttggctggtcttgctaaacacgtttacgttttagaattcttgcctgaacttaaagctgacaaagtgcttcaagaccgcgcagctaagactaacaatatgaccatcatcaaaaatgttgctactaaggacattgttggagaggaccatgttacaggtcttaactacactgagcgtgatagcggtgaagacaaacaccttgaccttgaaggggtctttgttcaaattggtcttgttccaaacacagcttggctcaaagatagtggtgtcaacctaaccgaccgcggagaaatcattgtggataaacatgggtcaaccaatattcctggtatctttgctgctggggactgtactgattcagcttataaacaaatcattatttccatggggtctggtgctactgctgccatcggtgcctttgactacttgattcgtcaa

SEQ ID NO: 4514 - protein, 510 aa, Streptococcus pyogenes
MALSPDIKEQLAQYLTLLEADLVLQVSLGDNEQSQKVKDFVEEIAAMSERISIENITLDRQPSFKVAKKGHGSGVVFAGLPLGHELTSFILALLQVSGRAPKVDQDVIDRIKAIDRPLHFETYVSLTCHNCPDVVQALNIMSVLNDKISHTMVEGGMFQDEVKAKGIMSVPTVFLDGEEFTSGRATIEQLLEQIAGPLSEEAFADKGLYDVLVIGGGPAGNSAAIYAARKGLKTGLLAETFGGQVMETVGIENMIGTLYTEGPKLMAEVEAHTKSYDVDIIKAQLATSIEKKENIEVTLANGAVLQAKTAILALGAKWRNINVPGEDEFRNKGVTYCPHCDGPLFEGKDVAVIGGGNSGLEAALDLAGLAKHVYVLEFLPELKADKVLQDRAAKTNNMTIIKNVATKDIVGEDHVTGLNYTERDSGEDKHLDLEGVFVQIGLVPNTAWLKDSGVNLTDRGEIIVDKHGSTNIPGIFAAGDCTDSAYKQIIISMGSGATAAIGAFDYLIRQ

SEQ ID NO: 4515 - DNA, 558 bp, Streptococcus agalactiae
atgtcattagtcggaaaagaaattattgaattttcagctcaagcttatcacgatggaaaattcatcactgttacaaatgaagacgttaaaggaaaatgggcagttttttgtttctacccagcagacttttcatttgtttgcccaactgaacttggtgaccttcaagagcaatacgaaacacttaaatctcttgatgtagaagtttattctgtctctactgatactcattttgttcataaagcatggcatgatgactcagatgtcgttggtactatcacatatcctatgattggtgacccttcacaccttatttcacaaggttttgatgtccttggacaagatggtctagcacaacgtggtacatttatcattgatccagacggtgtcatccaaatgatggaaattaatgctgatggcatcggacgtgatgcaagtactctcattgataaagtccgtgctgctcaatacatccgccaacatacaggtgaagtttgtccagctaaatggaaagaaggagctgaaactttaactcctagtttagaccttgtaggtaaaatt

SEQ ID NO: 4516 - protein, 186 aa, Streptococcus agalactiae
MSLVGKEIIEFSAQAYHDGKFITVTNEDVKGKWAVFCFYPADFSFVCPTELGDLQEQYETLKSLDVEVYSVSTDTHFVHKAWHDDSDVVGTITYPMIGDPSHLISQGFDVLGQDGLAQRGTFIIDPDGVIQMMEINADGIGRDASTLIDKVRAAQYIRQHTGEVCPAKWKEGAETLTPSLDLVGKI

SEQ ID NO: 4517 - DNA, 558 bp, Streptococcus pyogenes
atgtctctaattggaaaagaaattgctgaattttcagctcaagcttatcacgatggaaaattcatcactgttacaaatgaagacgttaaaggaaaatgggcagttttttgtttctacccagcagacttttcatttgtttgcccaactgaactcggtgaccttcaagagcaatacgaaacactgaaatctcttggtgtagaagtttattctgtctctactgatactcattttgttcataaagcttggcatgatgattcagatgtggttggcactatcacataccctatgattggtgacccttcacaccttatttcacaagcctttgaagtgcttggcgaagacggacttgctcaacgtggaacatttatcgttgatccagatggtattatccaaatgatggaaattaatgctgatggtattggacgtgacgctagcaccttgattgataaaattcacgctgcccaatacgtccgtaaacatccaggtgaagtttgtccagctaaatggaaagaaggcgctgaaactttgacaccaagtcttgatttagttggtaaaatt

SEQ ID NO: 4518 - protein, 186 aa, Streptococcus pyogenes
MSLIGKEIAEFSAQAYHDGKFITVTNEDVKGKWAVFCFYPADFSFVCPTELGDLQEQYETLKSLGVEVYSVSTDTHFVHKAWHDDSDVVGTITYPMIGDPSHLISQAFEVLGEDGLAQRGTFIVDPDGIIQMMEINADGIGRDASTLIDKIHAAQYVRKHPGEVCPAKWKEGAETLTPSLDLVGKI

SEQ ID NO: 4519 - DNA, 768 bp, Streptococcus agalactiae
atggcagtaatttcaatgaaacaacttcttgaggctggtgttcactttggtcaccaaactcgtcgctggaaccctaagatggctaagtacatcttcacagaacgtaatggtatccacgttatcgaccttcaacaaactgtaaaattagctgaccaagcttacgaatttgttcgtgatgctgcagcaaacgatgcagttatcttgtttgttggtactaagaaacaagcagctgaagctgttgctgaagaagctaaacgtgctggtcaatacttcattaaccaccgttggttaggtggaactcttactaactggggaactatccaaaaacgtattgctcgtttgaaagaaatcaaacgtatggaagaagaaggaacttttgaacttcttcctaagaaagaagttgcattgttaaacaaacaacgtgcacgtcttgaaaaattcttgggtggtatcgaagatatgccacgcatcccagatgtaatgtatgttgttgacccacataaagagcaaatcgctgttaaagaagctaaaaaacttggtattccagttgtagctatggttgacactaacgctgatccagatgatatcgatgttatcatcccagcaaacgatgacgctattcgcgccgttaaattaattacttctaaattagctgatgcagttattgaaggtcgtcaaggtgaagatgctgacgttgacttcgctcaagaagcacaagcagattcaattgaagaaatcgttgaagtagttgaaggatcaaacaacgac

SEQ ID NO: 4520 - protein, 256 aa, Streptococcus agalactiae
MAVISMKQLLEAGVHFGHQTRRWNPKMAKYIFTERNGIHVIDLQQTVKLADQAYEFVRDAAANDAVILFVGTKKQAAEAVAEEAKRAGQYFINHRWLGGTLTNWGTIQKRIARLKEIKRMEEEGTFELLPKKEVALLNKQRARLEKFLGGIEDMPRIPDVMYVVDPHKEQIAVKEAKKLGIPVVAMVDTNADPDDIDVIIPANDDAIRAVKLITSKLADAVIEGRQGEDADVDFAQEAQADSIEEIVEVVEGSNND

SEQ ID NO: 4521 - DNA, 765 bp, Streptococcus pyogenes
atggcagtaatttcaatgaaacaacttcttgaggctggtgttcactttggtcaccaaactcgtcgctggaaccctaagatggctaaatacatcttcacagagcgtaacggtatccacgttatcgatcttcaacaaactgtaaaattagctgaccaagcttacgaatttgttcgtgatgctgcagcaaacgatgctgtcatcttgttcgttggtactaaaaaacaagctgctgaagcagttgctgacgaagcaacgcgtgcaggccaatacttcatcaaccaccgttggttgggtggaacgcttaccaactggggaactatccaaaaacgtatcgctcgtttgaaagaaatcaaacgtatggaagaagaaggaacctttgacgttcttcctaagaaagaagttgcacttcttaacaaacaacgcgctcgtcttgaaaaattcttgggcggtatcgaagatatgcctcgtatcccagacgtaatgtacgttgttgacccacataaagaacaaatcgctgttaaagaagctaaaaaacttggtatcccagtcgtagcgatggttgatacaaacgctgatccagatgatatcgatatcatcattccagctaacgatgacgctatccgcgccgttaaattaatcactgctaaattagctgacgctattatcgaaggccgtcaaggtgaagatgcagacgttgcttttgaagctgacactcaagcagattcaatcgaagaaatcgttgaagttgtcgaaggcgacaacgct

SEQ ID NO: 4522 - protein, 255 aa, Streptococcus pyogenes
MAVISMKQLLEAGVHFGHQTRRWNPKMAKYIFTERNGIHVIDLQQTVKLADQAYEFVRDAAANDAVILFVGTKKQAAEAVADEATRAGQYFINHRWLGGTLTNWGTIQKRIARLKEIKRMEEEGTFDVLPKKEVALLNKQRARLEKFLGGIEDMPRIPDVMYVVDPHKEQIAVKEAKKLGIPVVAMVDTNADPDDIDIIIPANDDAIRAVKLITAKLADAIIEGRQGEDADVAFEADTQADSIEEIVEVVEGDNA

SEQ ID NO: 4523 - DNA, 1038 bp, Streptococcus agalactiae
atggcagaaatcacagctaaacttgtaaaagaattgcgtgaaaaatcaggtgcaggcgttatggacgctaaaaaagcattagtagaaactgatggtgaccttgataaagcgattgaattacttcgcgaaaaaggtatggctaaagcagctaaaaaagcagaccgtgttgctgctgaaggtttaacaggtgtttatgttgatggtaacgttgcagcagttattgaagttaacgctgagactgactttgttgctaaaaacgaccaatttgtaacattagttaatgaaactgctaaagttattgcagaaggacgtccttcaaacaatgaagaagcacttgctttaacaatgccttcaggtgaaactttagaacaagcatttgtaactgcaactgctacaattggtgaaaaaatttcattccgtcgcttcgctttagttgaaaagactgatgagcaacattttggtgcataccaacataatggtggacgtatcggagtaattactgttgttgaaggtggcgacgatgcacttgctaaacaagtatcaatgcacgttgcagctatgaagccaactgttctttcatatactgaacttgatgcacaatttgttcatgatgaattagcacagttgaaccacaaaattgagcaagacaacgagagtcgtgctatggttaacaaaccagctcttccattccttaaatatggatcaaaagctcaattgactgatgaagttattgcccaagcagaagaagacatcaaagcagaattagctgcagaaggtaaaccagaaaaaatctgggataaaatcgttccaggtaaaatggatcgtttcatgcttgacaacactaaagttgaccaagagtacacactccttgctcaagtttacatcatggatgatagcaaaacagttgaagcttatcttgagtcagtaaatgctaaagcagttgctttcgtacgttttgaagttggagaaggtattgagaaagcttctaacgactttgaagcagaagttgcagctacaatggcagcagcacttgaaaaa

SEQ ID NO: 4524 - protein, 346 aa, Streptococcus agalactiae
MAEITAKLVKELREKSGAGVMDAKKALVETDGDLDKAIELLREKGMAKAAKKADRVAAEGLTGVYVDGNVAAVIEVNAETDFVAKNDQFVTLVNETAKVIAEGRPSNNEEALALTMPSGETLEQAFVTATATIGEKISFRRFALVEKTDEQHFGAYQHNGGRIGVITVVEGGDDALAKQVSMHVAAMKPTVLSYTELDAQFVHDELAQLNHKIEQDNESRAMVNKPALPFLKYGSKAQLTDEVIAQAEEDIKAELAAEGKPEKIWDKIVPGKMDRFMLDNTKVDQEYTLLAQVYIMDDSKTVEAYLESVNAKAVAFVRFEVGEGIEKASNDFEAEVAATMAAALEK

SEQ ID NO: 4525 - DNA, 1134 bp, Streptococcus pyogenes
ttgtctttaacaatcgaaaaccaaacggggcagaaagcaaaccgctctgtctcgttttttgaaaccaaaacaaatatcatttggaggatactacacatggcagaaattacagctaagcttgtaaaagaattacgtgaaaaatctggtgctggcgttatggacgctaaaaaagcacttgttgaaacagatggtgacatggacaaagccgttgaacttcttcgtgaaaaaggaatggctaaagcagctaaaaaagctgaccgtgttgccgctgaaggtttaacaggcgtttacgttcatggtaacgttgctgctgttgttgaagttaacgctgaaacagactttgttgctaaaaatgctcaattcgttgaattggtaaacgcaactgctaaagttatcgctgaaggcaaaccagctaacaacgatgaagcacttgcacttgttatgccttcaggtgaaactcttgctgaagcttacgttaatgcaactgctaccatcggagaaaaaatctcattccgtcgttttgctttgattgaaaaagcagatgagcaacacttcggtgcttaccaacataatggtggccgtatcggggttatctcagttgtcgaaggcggcgacgatgctcttgctaaacaagtatcaatgcatatcgctgcaatgaaaccaactgttctttcatacactgagcttgatgcacaattcatcaaagatgaacttgctcaattgaaccacgctatcgaacttgacaacgaatctcgtgcaatggttgataaaccagctcttccattcttgaaatacggttcaaaagctcaattatcagacgatgtgattactgctgctgaagcagacatcaaagctgaacttgctgctgaaggcaaaccagaaaagatctgggacaaaatcatcccaggtaaaatggaccgcttcatgcttgacaacactaaagttgaccaagcttacactcttcttgcacaagtttacatcatggacgacagcaaaactgttgaagcttaccttgactcagtaaacgctaaagcgattgcttttgcacgttttgaagttggtgaaggtatcgagaaaaaagctaacgactttgaatcagaagttgcagctactatggctgctgcccttaacaac

SEQ ID NO: 4526 - protein, 378 aa, Streptococcus pyogenes
LSLTIENQTGQKANRSVSFFETKTNIIWRILHMAEITAKLVKELREKSGAGVMDAKKALVETDGDMDKAVELLREKGMAKAAKKADRVAAEGLTGVYVHGNVAAVVEVNAETDFVAKNAQFVELVNATAKVIAEGKPANNDEALALVMPSGETLAEAYVNATATIGEKISFRRFALIEKADEQHFGAYQHNGGRIGVISVVEGGDDALAKQVSMHIAAMKPTVLSYTELDAQFIKDELAQLNHAIELDNESRAMVDKPALPFLKYGSKAQLSDDVITAAEADIKAELAAEGKPEKIWDKIIPGKMDRFMLDNTKVDQAYTLLAQVYIMDDSKTVEAYLDSVNAKAIAFARFEVGEGIEKKANDFESEVAATMAAALNN

SEQ ID NO: 4527 - DNA, 207 bp, Streptococcus agalactiae
ttgaagccgataatggataatgttcccatgatgcatccagctagtataacacctagcataacagcaataacactatgtttaaattcccaatctaggaggctagctgcaagcgtgccagtccaggctcctgttccgggtaagggaatgcctacaaacaatagcaaggcaataaacaatcctttttctccagctactttttcaagtttt

SEQ ID NO: 4528 - protein, 69 aa, Streptococcus agalactiae
MKPIMDNVPMMHPASITPSITAITLCLNSQSRRLAASVPVQAPVPGKGMPTNNSKAINNPFSPATFSSF

SEQ ID NO: 4529 - DNA, 459 bp, Streptococcus agalactiae
atgaattacattattacatttttgatttcaatgattcccttagtggaactacgaggagctgtgccatttgcaatcgctaatggaatacctttgtgggaagcgctagctatcggtgttgttggaaacatgctacctgtacctatcatcttcttctttgctcgcaaagttctagaatggggagcagataaaccttatactggtaagtttttcacatggtgccttaaaaaaggacatagcggtggtcaaaaacttgaaaaagtagctggagaaaaaggattgtttattgccttgctattgtttgtaggcattcccttacccggaacaggagcctggactggcacgcttgcagctagcctcctagattgggaatttaaacatagtgttattgctgttatgctaggtgttatactagctggatgcatcatgggaacattatccattatcggcttcaacctattc

SEQ ID NO: 4530 - protein, 153 aa, Streptococcus agalactiae
MNYIITFLISMIPLVELRGAVPFAIANGIPLWEALAIGVVGNMLPVPIIFFFARKVLEWGADKPYTGKFFTWCLKKGHSGGQKLEKVAGEKGLFIALLLFVGIPLPGTGAWTGTLAASLLDWEFKHSVIAVMLGVILAGCIMGTLSIIGFNLF

SEQ ID NO: 4531 - DNA, 462 bp, Streptococcus agalactiae
gtggccataaaaaatacttccgataatattgaagaatatataaaatcattattagaacaatcaggaattgctgaaataaagcgttccaatttagctgatacttttcaagttgttcctagtcagattaattatgtcattaagacacggtttactgaaagccgtggttatgtggttgagagtaaacgaggtggtggaggttacatccgcattgctaaggttcatttttctgatcaacaccaattatttggaaatatgttatcaacgattggcgagcgtatcagtgaacaagtttttgatgatttgattcaattattattcgatgaagagataattacagaacgtgaaggaaatttgattctggcgacatcaggtgatgacgtcttaggagagcaagcctctgttattagagctcgtatgctccgtaaattattacaacgattagatagaaaaggattccattta

SEQ ID NO: 4532 - protein, 154 aa, Streptococcus agalactiae
MAIKNTSDNIEEYIKSLLEQSGIAEIKRSNLADTFQVVPSQINYVIKTRFTESRGYVVESKRGGGGYIRIAKVHFSDQHQLFGNMLSTIGERISEQVFDDLIQLLFDEEIITEREGNLILATSGDDVLGEQASVIRARMLRKLLQRLDRKGFHL

SEQ ID NO: 4533 - DNA, 459 bp, Streptococcus pyogenes
atgccaaccaaaaatacttcagacagcattgaagagtatattaaagaattattagctaagtcaggaatagcagaaattaagcggtccatgctagcagattcgtttcaagttgtcccaagtcagatcaactatgtcattaaaacccgttttacggagagtcgaggctatgaagtagagagtaaacgaggtggtggaggctatattcgtattgccaaggttcatttttcagacaaacaccatctgattggcaatttaatggcaactattgaagactgtatcagtgagcaagttttcacggactcgatacaattgctttttgacgaacacttattgacagagcgtgagggaaatatcattttggctgtggcgtctgatgatgttttaggaactgatggttcaactattcgtgcacgaatgctctatcgcttattgcaacgaattgacagaaagggaagcaat

SEQ ID NO: 4534 - protein, 153 aa, Streptococcus pyogenes
MPTKNTSDSIEEYIKELLAKSGIAEIKRSMLADSFQVVPSQINYVIKTRFTESRGYEVESKRGGGGYIRIAKVHFSDKHHLIGNLMATIEDCISEQVFTDSIQLLFDEHLLTEREGNIILAVASDDVLGTDGSTIRARMLYRLLQRIDRKGSN

SEQ ID NO: 4535 - DNA, 2445 bp, Streptococcus agalactiae
atgagtcattattccataaaattacaagaagtattcagattggcgcaatttcaagcagcacgctatgaaagtcactatttagaaagctggcatcttcttttagcaatggttttagttcatgattcagtagctggtttgacatttgctgaatatgagtctgaagttgcaattgaagagtacgaagcagcaacaattttagctttaggtagagcaccgaaagaagagattaccaattatcaatttttagagcaatcaccagctttgaaaaagatcttaaagttagcagaaaatattagtatcgtagtaggagctgaagatgtgggtactgaacatgtcttgcttgctatgttggttaataaagatttattagccacacgtatcttagagttagttggctttagaggtcaagacgatggtgaatcagttcgtatggttgatttacgtaaggctctagaacgtcatgccggttttacaaaagatgatatcaaagcaatttatgaattacgtaatcctaaaaaagcaaagtcgggtgcttctttttctgatatgatgaaaccaccgagtactgctggtgatttagctgatttcacacgtgatttatcacagatggcggttgatggggaaattgaacctgttattgggcgtgataaagaaatttcacgtatggtccaagtcttaagtcgtaaaacaaagaataatcctgtcttagttggagatgcgggtgtcggtaaaacagctttggcgtacggtctagcacaacgtattgctaatggaaatattccttatgagcttagagatatgcgtgttctagagttagatatgatgagcgttgttgctggaactcgttttcgtggtgattttgaggaacgtatgaatcaaatcattgcagatattgaagaagacggtcatattattcttttcattgatgaactgcatactattatgggttctggctctggtattgatagcacacttgatgctgctaatattttaaaaccagctttggcccgaggcactttacgcactgttggagcaacaactcaagaggaatatcaaaagcatattgaaaaagatgctgctttatctcgtcgctttgcaaaagttttagtagaagaaccaaatcttgaagacgcatatgaaattctacttggattgaagccagcgtatgaagcctttcataatgttactatttcagatgaagcagttatgactgctgtaaaagtggctcatcgttatttgacaagtaagaatttaccagactcagctatagacttacttgatgaagcttctgccactgtgcaaatgatgattaagaaaaatgctccttcgcttttaacagaagttgaccaagctattttagatgatgatatgaaatctgcttctaaagctctaaaagcaagttataagggtaaaaagcgtaagcctattgccgtaacagaagatcatattatggcaactctcagtcgtctatctggtattcctgttgaaaaattgacacaagctgatagtaaaaaatacctcaatttagaaaaagaattgcataaacgtgttatcggtcaagatgatgcagttactgccattagtcgtgctatccgtcgcaatcaatctggcattcgtactggtaagcgtcctattggttcctttatgttcttgggaccaactggtgttggtaagacagagttagcaaaagccttggcagaagtgttgtttgatgatgaatcagccctaattcgttttgatatgtcggaatatatggaaaaattcgcagcttctcacctgaatggggcacctccaggttatgttggttatgatgaaggaggagagttgactgaaaaagtacgcaataaaccatattcagttttactttttgatgaagttgaaaaagctcatccagatatttttaatgtattattacaagtgcttgatgatggcgttttaacagatagtcgaggacgaaaagttgatttttcaaatactataatcattatgacttctaatttaggagcaactgcattacgtgacgataaaacagttggttttggagctaaggatatcagccatgattatactgctatgcaaaaacgtattatggaggagcttaaaaaagcttatcgaccagagtttatcaatcgtattgatgagaaagttgtattccatagtctcagtcaagataatatgcgtgaagttgtgaaaattatggttaaacctttaattttagcgcttaaagataaaggtatggatctgaaattccagccttcagccttgaaacacttggcagaggatggctatgatatagaaatgggtgctcgtccactgcgtagaactattcaaacgcaagtagaggatcatttatcagaactactattggcaaatcaagtgaaagaggggcaagtaattaagattggcgtatccaaaggcaaattgaaatttgatattgcaaaatca

SEQ ID NO: 4536 - protein, 815 aa, Streptococcus agalactiae
MSHYSIKLQEVFRLAQFQAARYESHYLESWHLLLAMVLVHDSVAGLTFAEYESEVAIEEYEAATILALGRAPKEEITNYQFLEQSPALKKILKLAENISIVVGAEDVGTEHVLLAMLVNKDLLATRILELVGFRGQDDGESVRMVDLRKALERHAGFTKDDIKAIYELRNPKKAKSGASFSDMMKPPSTAGDLADFTRDLSQMAVDGEIEPVIGRDKEISRMVQVLSRKTKNNPVLVGDAGVGKTALAYGLAQRIANGNIPYELRDMRVLELDMMSVVAGTRFRGDFEERMNQIIADIEEDGHIILFIDELHTIMGSGSGIDSTLDAANILKPALARGTLRTVGATTQEEYQKHIEKDAALSRRFAKVLVEEPNLEDAYEILLGLKPAYEAFHNVTISDEAVMTAVKVAHRYLTSKNLPDSAIDLLDEASATVQMMIKKNAPSLLTEVDQAILDDDMKSASKALKASYKGKKRKPIAVTEDHIMATLSRLSGIPVEKLTQADSKKYLNLEKELHKRVIGQDDAVTAISRAIRRNQSGIRTGKRPIGSFMFLGPTGVGKTELAKALAEVLFDDESALIRFDMSEYMEKFAASHLNGAPPGYVGYDEGGELTEKVRNKPYSVLLFDEVEKAHPDIFNVLLQVLDDGVLTDSRGRKVDFSNTIIIMTSNLGATALRDDKTVGFGAKDISHDYTAMQKRIMEELKKAYRPEFINRIDEKVVFHSLSQDNMREVVKIMVKPLILALKDKGMDLKFQPSALKHLAEDGYDIEMGARPLRRTIQTQVEDHLSELLLANQVKEGQVIKIGVSKGKLKFDIAKS

SEQ ID NO: 4537 - DNA, 2442 bp, Streptococcus pyogenes
atgattatgtattcaacgaagatgcaagacatttttagacaggcgcagttccaagctgctcgctttgatagccattgcctggaaacttggcatgttttgttagctatggtagctgtagataattctttagcaaatatgattttaagtgaatatgatgcccaagtcgccatagaagaatatgaagctgcagctattttagccatgggcaaaacccctaaagaacagttgtctcgtgtagacttcagacctcaatctaaaactttgactaacttgttagcttttgcgcaggctattagccaaatcactagggatcaagaagtcggctctgagcatgtcttatttgctattttattgaatccagatattatggcgagtcgtttgttagaaatagctggctatcagataaaagataacggcaatgggcagccgcgattagctgacttgcgaaaagcaatagaacgtcatgcaggttacagtaaggaaatgatcaaggctattcacgaactacgtaagcctaaaaaaacgaaaacacaagggaccttttcagatatgatgaagccaccaagtacagctggtgagttgagtgatttcacaagagatttgactgaaatggcaagacaaggtttgttagaatcggtgattggacgtgaccaagaagtatctcgtatgattcaggtactaagtcgtaaaacgaaaaacaatcctgtcttggtaggtgatgcaggtgttggtaaaactgcgcttgcttatggccttgctcaacggattgcaaatggcgctattccttatgaacttaaggagatgcgtgtcctagaattagacatgatgagtgtggtagcaggaacccgttttcgtggggattttgaagagcgcatgaatcaaatcattgatgatattgaagctgatggtcagattattctttttgttgatgaactacatactattatgggttctggcagtggtattgacagtacacttgatgcggctaacattttaaaaccagcattatcgcgcggcactcttcatatggttggagcaacaactcaagaagaataccaaaaacatattgaaaaagatgcagctctttcgcgtcgttttgctaaaatattaattgaagaacctaatacagaagatgcttatcagattttgatgggcctaaaattatcttatgagacctaccataatgtctcgatatcaaatgaggcagttaaaacagctgtaaaaatggcacaccgttatttaaccagtaaaaatctccctgattcagctatcgatttactagatgaagctagtgctgctgtgcaaaacatggtgaaaaaatcagcacctgagactttaacaccaatagaccaagctcttatcaatggtgatatgaaaaaagtatctcgcctcttagctaaagaagcaaaaggtcagatgagaaaaccaacaccggtgacagaagatgatattttggcaaccttgagtaagttatcgggaattccacttgaaaaactgacgcaagctgatagtaaaaaatacctcaatttagaaaaagaactgcataagcgtgtgattggtcaggatgctgctgttacggctatttcaagagccattcgtcgtaatcagtcaggtattcgaacaggaaaacgtcctattggatcatttatgtttcttggcccaacaggagtaggtaagacagaactagcaaaggcccttgcagaagttctctttgatgatgaagcagcgcttattcgttttgatatgtctgagtacatggaaaaattcgcagcgtctaggcttaatggagcacctcctggttatgtcggctatgatgaaggaggtgaactgacacagaaagttagaaataaaccttattcagtcttgctttttgatgaagtggaaaaagcacatcctgatatttttaacgttctccttcaagtattagatgatggtatattgactgatagtcgtgggcgtaaggtcgatttttcaaatactattattatcatgaccagcaatcttggcgcaacagccctgcgcgatgataaaacggtcggttttggggtcaaagacattcaccaagaccatcaagctatggagaaacgtattttagaagaattaagaaaaacttaccgcccagaatttatcaatcgtattgatgaaaaagtggtctttcatagtctgacccaagataacatgcgcgatgtggttaaaatcatggtacagcccctgattactacattggcagaaaaaggtattacccttaaaattcagcctttggccttgaaacatttgtccgaggtcggctatgatgagcatatgggggcaagaccattacgtcgaacgctgcaaactgagatagaagataagctatcagagcttattctttctcgagaattgacaagtgggcatacgctaaaaattggattatcacatggcaaattaacgtttcacatagct

SEQ ID NO: 4538 - protein, 814 aa, Streptococcus pyogenes
MIMYSTKMQDIFRQAQFQAARFDSHCLETWHVLLAMVAVDNSLANMILSEYDAQVAIEEYEAAAILAMGKTPKEQLSRVDFRPQSKTLTNLLAFAQAISQITRDQEVGSEHVLFAILLNPDIMASRLLEIAGYQIKDNGNGQPRLADLRKAIERHAGYSKEMIKAIHELRKPKKTKTQGTFSDMMKPPSTAGELSDFTRDLTEMARQGLLESVIGRDQEVSRMIQVLSRKTKNNPVLVGDAGVGKTALAYGLAQRIANGAIPYELKEMRVLELDMMSVVAGTRFRGDFEERMNQIIDDIEADGQIILFVDELHTIMGSGSGIDSTLDAANILKPALSRGTLHMVGATTQEEYQKHIEKDAALSRRFAKILIEEPNTEDAYQILMGLKLSYETYHNVSISNEAVKTAVKMAHRYLTSKNLPDSAIDLLDEASAAVQNMVKKSAPETLTPIDQALINGDMKKVSRLLAKEAKGQMRKPTPVTEDDILATLSKLSGIPLEKLTQADSKKYLNLEKELHKRVIGQDAAVTAISRAIRRNQSGIRTGKRPIGSFMFLGPTGVGKTELAKALAEVLFDDEAALIRFDMSEYMEKFAASRLNGAPPGYVGYDEGGELTQKVRNKPYSVLLFDEVEKAHPDIFNVLLQVLDDGILTDSRGRKVDFSNTIIIMTSNLGATALRDDKTVGFGVKDIHQDHQAMEKRILEELRKTYRPEFINRIDEKVVFHSLTQDNMRDVVKIMVQPLITTLAEKGITLKIQPLALKHLSEVGYDEHMGARPLRRTLQTEIEDKLSELILSRELTSGHTLKIGLSHGKLTFHIA

SEQ ID NO: 4539 - DNA, 639 bp, Streptococcus agalactiae
atgttgattgttttagctggaaccattggagcaggtaaaagctcccttgcagctgctctaggacaacacctagggacagatgttttctatgaggcggttgataataacccagttttagatctttactatcaagatccccaaaaatatgcttttttactacaaatattctttttaaataaacgattccaatctataaaagaagcctataaggctaacaacaatgttttggatcgttctatttttgaagatgaactattcctcactctaaattataagaatggaaatgtgactaaaacagagctagatatctataaagaacttcttgcaaatatgttggaagaattagaaggtatgcctaagaagagacctgatttgctagtctacattgatgtttcatttgataaaatgttagaacgtattgacaaacgaggacgcagctttgagcaagttgattctaacccagagttatacgactactacaaacaagtccattctgaatatccagaatggtatgaaaattacgacgtttcacctaaaattcggatcgatggtaacaaacttgatttcgtcaaaaatccagaggatcttcaacacgtccttgacactattgattccgaattgcaaaaacttgatttacta

SEQ ID NO: 4540 - protein, 213 aa, Streptococcus agalactiae
MLIVLAGTIGAGKSSLAAALGQHLGTDVFYEAVDNNPVLDLYYQDPQKYAFLLQIFFLNKRFQSIKEAYKANNNVLDRSIFEDELFLTLNYKNGNVTKTELDIYKELLANMLEELEGMPKKRPDLLVYIDVSFDKMLERIDKRGRSFEQVDSNPELYDYYKQVHSEYPEWYENYDVSPKIRIDGNKLDFVKNPEDLQHVLDTIDSELQKLDLL

SEQ ID NO: 4541 - DNA, 639 bp, Streptococcus pyogenes
atgttgattgtactagctggaacaattggggctggcaagagctcgcttgctgctgcacttggagagcatttaggaactgacgttttttacgaagctgttgataataaccccgtgctagacctctactaccaagaccctaaaaaatacgcctttttacttcaaatttattttttgaataaacgatttaagtccatcaaagaagcttatcaagccgataacaacattcttgaccgctctatttttgaagacgaactcttcttaaaacttaactacaaaaatggcaatgtcactaagacagaacttgacatctatcaggaacttctcgccaacatgttagaagaactagaaggcatgcctaaaaaacgccctgatcttctcatctacattgatgtgtcttttgacaaaatgcttgagcgcattgaaagacgtggccgaagttttgagcaggtcgacggcaatcctagtcttgagcaatattaccatcaagtccacggtgaatacccaacctggtacgaagactacgaggtctctccaaaaatgaaaattgatggcaattcccttgacttcgttcaaaacccacaagatttggcgactgtcttaaaaatgattgacaccaaactcaaagagctccatttatta

SEQ ID NO: 4542 - protein, 213 aa, Streptococcus pyogenes
MLIVLAGTIGAGKSSLAAALGEHLGTDVFYEAVDNNPVLDLYYQDPKKYAFLLQIYFLNKRFKSIKEAYQADNNILDRSIFEDELFLKLNYKNGNVTKTELDIYQELLANMLEELEGMPKKRPDLLIYIDVSFDKMLERIERRGRSFEQVDGNPSLEQYYHQVHGEYPTWYEDYEVSPKMKIDGNSLDFVQNPQDLATVLKMIDTKLKELHLL

SEQ ID NO: 4543 - DNA, 975 bp, Streptococcus agalactiae
atgactcaattaaatagttcatttatgattgggaaggttgaaattcctcatcgtaccgtactagcaccgatggcaggtattaccaattctgcttttcgtactatcgctaaagaatttggtgctggtctcgttgttatggaaatgatttctgagaaagggttactttataacaacgaaaagaccttacatatgctccatatcgatgaaaatgaacatcctatgtcaattcaactatttggtggcgatgcagaaggcttaaaacgtgcagctgactttatccaaagtaatacgaaagcagatatcgtagacatcaatatgggatgtccagttaacaaagttgttaaaaacgaagctggagctaaatggttacgtgaccctgaaaaaatttatcatattgttaaagaggtaacgtctgtacttgacattccattaacagtaaaaatgcgtacaggatggtctgactcatctaatgctatagaaaatgcactcgctgccgaatctgctggtgtatctgcacttgctatgcacggtcgaacgcgtgaacaaatgtatactggcacgtgtgaccatgaaacacttggcaaggtcgctaaagctgttactagtattccttttattgctaatggtgacattcgtactgttcacgatgccaaatttatgattgaagagattggagctgacgctataatggttggacgtggtgctcgtagcaatccttacatctttacacaaattaatcatttctttgaaacaggcgaaatccttcctgacctaccatttgagaagatgttagatgttgccgaggatcatctcactcgactagttaatttaaaaggtgaaactattgccgttcgtgaatttcgagggttagcacctcattatctgcgtggaaaatcaggcgcagcaaaaattagaggagctgtttcacgtgcagaaacactagcagaagttcaagaactttttgcaggtttacgc

SEQ ID NO: 4544 - protein, 325 aa, Streptococcus agalactiae
MTQLNSSFMIGKVEIPHRTVLAPMAGITNSAFRTIAKEFGAGLVVMEMISEKGLLYNNEKTLHMLHIDENEHPMSIQLFGGDAEGLKRAADFIQSNTKADIVDINMGCPVNKVVKNEAGAKWLRDPEKIYHIVKEVTSVLDIPLTVKMRTGWSDSSNAIENALAAESAGVSALAMHGRTREQMYTGTCDHETLGKVAKAVTSIPFIANGDIRTVHDAKFMIEEIGADAIMVGRGARSNPYIFTQINHFFETGEILPDLPFEKMLDVAEDHLTRLVNLKGETIAVREFRGLAPHYLRGKSGAAKIRGAVSRAETLAEVQELFAGLR

SEQ ID NO: 4545 - DNA, 1047 bp, Streptococcus pyogenes
gtgctgagattgtttgccaattttgtggtaccaagtaccaatttaatgaaagtgatttggaggccattatcagtgataaagcttaattcttcctttaggattggtgatgtggaaatccctcaccgcactgtccttgctcccatggctggcgtgaccaattctgcctttcgtaccatcgccaaagaatttggtgctggtttggtggttatggaaatgatttccgaaaaagggcttctttacaacaatgaaaagacccttcacatgctccatattgatgaaaatgagcaccctatgtccattcaattatttggtggtgacgcagaagggttgaaacgtgcagctgatttcattcaaaccaataccaaggccgatattgttgatattaatatgggctgccctgttaataaagttgtcaaaaacgaggctggtgccaagtggctccgtgaccctgataagatttaccacattgtcaaggaagtcacgtctgttttagatattccactgactgtcaaaatgcgtacaggttgggcggatagttcacttgctgttgaaaatgcccttgccgctgagtcggcaggtgtatctgctcttgccatgcacggtcgtacccgtgaacaaatgtatacaggaacctgcgaccatgagacattagcccgagtttctaaggctatcactaagattccctttattggaaatggggacgtgcgttcggtgcaagacgccaaatttatgattgaagaaatcggtgtagatgccgtgatgattggccgcgcagccatgaacaatccttatctttttacccaaatcaatcatttctttgaaactggtcaagaattgccagatcttccctttgccaaaaaattagacatcgccaaagaccaccttaaacgcctgattaacctcaaaggtgaaaccattgctgttcgggaatttcggggcttagcaccacactatcttcgcggaacagcaggtgctgccaaagttcgtggtgctgtttcacgcgctgagactctagctgaggttgaagccatcttcgaaacagtacgc

SEQ ID NO: 4546 - protein, 349 aa, Streptococcus pyogenes
VLRLFANFVVPSTNLMKVIWRPLSVIKLNSSFRIGDVEIPHRTVLAPMAGVTNSAFRTIAKEFGAGLVVMEMISEKGLLYNNEKTLHMLHIDENEHPMSIQLFGGDAEGLKRAADFIQTNTKADIVDINMGCPVNKVVKNEAGAKWLRDPDKIYHIVKEVTSVLDIPLTVKMRTGWADSSLAVENALAAESAGVSALAMHGRTREQMYTGTCDHETLARVSKAITKIPFIGNGDVRSVQDAKFMIEEIGVDAVMIGRAAMNNPYLFTQINHFFETGQELPDLPFAKKLDIAKDHLKRLINLKGETIAVREFRGLAPHYLRGTAGAAKVRGAVSRAETLAEVEAIFETVR

SEQ ID NO: 4547 - DNA, 873 bp, Streptococcus agalactiae
atggataaaattataaaatcaatttcaacttccggttctttccgggcttatgtccttgattgtacagaaactgtaagaacagctcaagaaaaacatcagacactttcaagttctactgtagctcttgggagaacattaattgcaaatcaaattttagcagcaaatcaaaaaggaaatagtaaagtaactgtcaaggttattggagatagctcttttggtcatattatttctgtagctgatactaaaggaaatgttaaaggttacatccaaaatacgggtgttgatatcaagaaaacagctactggagaggtcttagttggacctttcatgggtaatggacactttgtcgttattaccgattacgcaactgggcaaccttacacttcaacaactccactaattacaggagaaattggagaagattttgcttattatttaaccgaaagtgagcaaacaccttctgccgtcggtttaaatgtcctcttagatgacgaggataaggttaaagttgcaggtggattcatgcttcaggtgctcccaggtgcttctgacgaagaaatttctcgctatgaaaaacgcattcaggagatgccttctatttcaagtctgctagagtctgaaaatcatatagaatctctcctttcagctatttacggagaagacgactacaagcgcttatcggaagactctttagccttctactgtgactgttcaaaagaacgttttgaagccgctctattgactttaggaactaaagaattgcaagccatgaaggatgaagataaaggtgttgaaattacttgtcaattttgcaaccagacttactatttcacagaagaagatttggagaagataattaatgactcaattaaa

SEQ ID NO: 4548 - protein, 291 aa, Streptococcus agalactiae
MDKIIKSISTSGSFRAYVLDCTETVRTAQEKHQTLSSSTVALGRTLIANQILAANQKGNSKVTVKVIGDSSFGHIISVADTKGNVKGYIQNTGVDIKKTATGEVLVGPFMGNGHFVVITDYATGQPYTSTTPLITGEIGEDFAYYLTESEQTPSAVGLNVLLDDEDKVKVAGGFMLQVLPGASDEEISRYEKRIQEMPSISSLLESENHIESLLSAIYGEDDYKRLSEDSLAFYCDCSKERFEAALLTLGTKELQAMKDEDKGVEITCQFCNQTYYFTEEDLEKIINDSIK

SEQ ID NO: 4549 - DNA, 1254 bp, Streptococcus agalactiae
atgagcgatacctttaattttgatattgaccaaattgcagacaatgctatcactaaaacagataaaacaacagaaattatttccaaccagacaacaagccaaactgggcaaattgccttttttgaaaaactaacaccagcacaaaagtctgctatctctgaaaaaacaccagctttggtagatacttttgtcggcgatcaaaatgcgctccttgattttggacaatccgcagtagaaggcgttaataccactgttaatcatatcttgtctgagcagaaaaaaattcaaattcctcaagttgatgatttactaaaaaatgctaatcgcgaactaaatggatttattgccaaatataaagatgctactccggcagaattagagaaaaaaccaaacttgattcaaaaattattcaaacaaagcaagacctcgctacaggaattttattttgactcacaaaacatcgagcaaaaaatggatatgatggcagcgaatgttgtcaaacaagaagatactttggcaagaaatatcgtctctgctgaaatgctcattgaagataatactaaatctattgaaaatttggttggagttattgcttttattgaatcgagtcaagccgaggctgctaatcgtgcaagccacttacaacaagaaattctagcattagatagccaaacgtccgagtatcaaattaaaagtaaccaattagctcgaatgactgaagttatcaataccctcgaacagcaacatcctgaatatgtcagccgtctctacgttgcatgggcaacaacaccacagatgcgaaacttggtcaaagtatcgtcagatatgcgtcagaaacttggcatgttacgtcgaaataccattccaacaatgaaactctcaatcgctcagttaggcatgatgcaacaatctgtcaaatccggtgtcactgctgatgctattgtcaacgctaataatgcagcattgcagatgctggctgaaactagtaaagaagcgattccgatgttagagaagaccgcacaaagccccactgtttctattaaatctgtcactgcattagctgaaagcttagtggctcaaaataatggtattatcgctgccatagacaaaggacgtaaggaacgtgcccaattggaatctgctgttattaaatcggctgaaacaatcaatgattctgtcaaaattcgtgataaaaaaatagttgaagccttactcaacgaaggtaaatctacccaagaaaaagttgatgagtct

SEQ ID NO: 4550 - protein, 418 aa, Streptococcus agalactiae
MSDTFNFDIDQIADNAITKTDKTTEIISNQTTSQTGQIAFFEKLTPAQKSAISEKTPALVDTFVGDQNALLDFGQSAVEGVNTTVNHILSEQKKIQIPQVDDLLKNANRELNGFIAKYKDATPAELEKKPNLIQKLFKQSKTSLQEFYFDSQNIEQKMDMMAANVVKQEDTLARNIVSAEMLIEDNTKSIENLVGVIAFIESSQAEAANRASHLQQEILALDSQTSEYQIKSNQLARMTEVINTLEQQHPEYVSRLYVAWATTPQMRNLVKVSSDMRQKLGMLRRNTIPTMKLSIAQLGMMQQSVKSGVTADAIVNANNAALQMLAETSKEAIPMLEKTAQSPTVSIKSVTALAESLVAQNNGIIAAIDKGRKERAQLESAVIKSAETINDSVKIRDKKIVEALLNEGKSTQEKVDES

SEQ ID NO: 4551 - DNA, 1260 bp, Streptococcus pyogenes
atggcagattttaattttgacattgaccaaattgctgacaatgctgttatcaaaaccgataaaaccaccgatattatctcagacttaccaactgacacaaatggccaaatctctttttttgagaaactaagtgctgaccagcagacagctattactgccaaagccccggcattggtagatacctttttggcagaccaaaatgcgctacttgattttggtcagtctgctgttgaaggggtcaatgcaacggttaatcatatcttggcagagcaaaaaaaattacagattccacaagtggatgatcttttaaaatcaaccaatcgtgaactcaatggttttatcgctaaatacaaggatgccacacctgtggaccttgataaaaagccaaactttcttcaaaaactctttaaacaaagccgtgataccctgcaagagttttattttgattctcaaaacattgagcaaaaaatggatagtatggctgcagcggttgtcaagcaagaagataccttagctcgcaatattgtctcagcagaattgttaattgaagataatactaagtccattgaacatttggtaggcgtcattgcttttatcgaagctagtcaaaaagaagctagtcagcgcgctgcggctttacaaaaagacctaaaaaccaaagacagtgctacaccagactatcaaataaaagctgatcttttggcaagaactaccgaagtcatcaacactctcgaacaacaacacaccgaatacttgagtcgcctctatgttgcttgggcgacaactccgcaaatgcgtaatctagtcaaggtctcttctgacatgcgtcaaaaactaggcatgttacgccgcaataccattccaacgatgaaactatctattgctcagttaggcatgatgcaacaatcggttaaatctggaatgactgctgatgccattattaatgctaataatgctgcccttcagatgctagcagaaacaagtaaagaagccatcccagcattggaacaatcagcacaaaaccctactttgtctatgaaatctgtgacaagtctggcagaaagtttagtagcacaaaataatgggatcattgcggcgattgatcatggacgcaaagaacgagcacaactagaaagtgctattatcaggtctgccgaaaccattaacgattctgtcaaactacgtgaccaaaatattgtgcaagcacttcttagtgaaggcaaggaaactcaaaaaacaattgataaaataactcgcgca

SEQ ID NO: 4552 - protein, 420 aa, Streptococcus pyogenes
MADFNFDIDQIADNAVIKTDKTTDIISDLPTDTNGQISFFEKLSADQQTAITAKAPALVDTFLADQNALLDFGQSAVEGVNATVNHILAEQKKLQIPQVDDLLKSTNRELNGFIAKYKDATPVDLDKKPNFLQKLFKQSRDTLQEFYFDSQNIEQKMDSMAAAVVKQEDTLARNIVSAELLIEDNTKSIEHLVGVIAFIEASQKEASQRAAALQKDLKTKDSATPDYQIKADLLARTTEVINTLEQQHTEYLSRLYVAWATTPQMRNLVKVSSDMRQKLGMLRRNTIPTMKLSIAQLGMMQQSVKSGMTADAIINANNAALQMLAETSKEAIPALEQSAQNPTLSMKSVTSLAESLVAQNNGIIAAIDHGRKERAQLESAIIRSAETINDSVKLRDQNIVQALLSEGKETQKTIDKITRA

SEQ ID NO: 4553 - DNA, 816 bp, Streptococcus agalactiae
atggttaaaaaacgctattccaaaaattctcataatctaataacattacttggtattgttgttcttgcttccctgatttcagacttttggagtgaggtgattgctactctgttaattattggtggtggttattgtgcctattacgtttatgataaaaagcgtcttaaacgttttacatcaaaccaacgtattgaagctttaaaatccgatattaaagagactgaccaagacattagacacttggaaattttaaaaaaagacaatcgttctaaggaatatatcaaattagcacatcaaatattacctcaattggacctaattcgtaatgaagcaaaccaactacaaaaagccattgagcctaatatctataaacgtatcaccaaaaaagcaaatacatttagtaatgagattaacgaacaactaataaagctacatgcctctccagaactagaacctatttctgatcaggaagatgaaatgatacgcattgctccggaattaaaaccgttctatcacaatattcaagatgaccactttgctatcttaaaaaagattgaagaggcagataacaaagctgaattagcagcaattcatcaagccaatatgaaacgttttacagatgttctggctggctacatcagaatcaaacaatctcctaaaaattttaacaatgctaaggaacgcctagaacaagcattacaagcaattaaaaaatttaatttagatttagatgaaacgctgcgccaattgaatgaaagtgatatgaaagattttgacgttagcctaagaatgatgcaaggcgaaaggaacagtaaa

SEQ ID NO: 4554 - protein, 272 aa, Streptococcus agalactiae
MVKKRYSKNSHNLITLLGIVVLASLISDFWSEVIATLLIIGGGYCAYYVYDKKRLKRFTSNQRIEALKSDIKETDQDIRHLEILKKDNRSKEYIKLAHQILPQLDLIRNEANQLQKAIEPNIYKRITKKANTFSNEINEQLIKLHASPELEPISDQEDEMIRIAPELKPFYHNIQDDHFAILKKIEEADNKAELAAIHQANMKRFTDVLAGYIRIKQSPKNFNNAKERLEQALQAIKKFNLDLDETLRQLNESDMKDFDVSLRMMQGERNSK

SEQ ID NO: 4555 - DNA, 876 bp, Streptococcus pyogenes
atgattagaaagtatgaccgcacgagcacaaaaaagaaatcactaaactggatttggctaatcattgctttttttatgatttcaagctttataggtggctcttcttttactgagtcacttctagacattttgcctgccatagccattggtggtacaggttatgctatttttcgtgttagatctcatcaaaagcggctagcaaaggccaagattgccaaacaattagaagatctaaaagcaaaaattcagctagctgatcgtaaagttcggctgttagacacttatctggcagaccatgatgacttccaatataacgtactagctcagcaattattaccacaacttagtgacatcaaagcaaaagctattacgttaaaagaccagttagatccccaaatttatcgtcgtatcaccaaaaaagccaatgacgttgaaagtgatattacccttcaactcgaaacactgcagattgccacaactcttaaccctcagcctttgaaaaccccatctcctaatcttattaacaaagcacctgagctcaaaccgtattatgataatattcagacagatcatcaagctatccttgctaaaatccaaggagccgacaatcaagaagaattgcttgcgctgcatgatgctaacatgaggaggtttgaggatatcttaacaggctacttaaaaatcaaagaagagcctaaaaattactataacgctgctgctcgtttagaacaagccaaacaagctatccaacaatttgatgaagatcttgacgaaacccttcgtcgactcaatgaaagtgatcttaaagattttgatattagccttcgaatcatgcaaggtgctactcaaagacgaacaacgcatcaccaaaaagac

SEQ ID NO: 4556 - protein, 292 aa, Streptococcus pyogenes
MIRKYDRTSTKKKSLNWIWLIIAFFMISSFIGGSSFTESLLDILPAIAIGGTGYAIFRVRSHQKRLAKAKIAKQLEDLKAKIQLADRKVRLLDTYLADHDDFQYNVLAQQLLPQLSDIKAKAITLKDQLDPQIYRRITKKANDVESDITLQLETLQIATTLNPQPLKTPSPNLINKAPELKPYYDNIQTDHQAILAKIQGADNQEELLALHDANMRRFEDILTGYLKIKEEPKNYYNAAARLEQAKQAIQQFDEDLDETLRRLNESDLKDFDISLRIMQGATQRRTTHHQKD

SEQ ID NO: 4557 - DNA, 2250 bp, Streptococcus agalactiae
gtgattatcgatcgactgttacaaagaagccactctcatctaccgattctacaagctacatttggcttagagagagaaagccttcgtattcaccaacccactcaaagggttgctcaaacaccccatcccaaaacattagggagtcgtaactatcatccttatatccaaacggattatagtgaacctcaattagaactcattacacctattgcaaaggatagccaagaagccattcgatttttgaaagctataagtgatgttgctggacgctctatcaaccacgatgaatacttatggccgctttctatgccacccaaagtgagggaagaagacatacagattgcccaattagaggatgcttttgaatatgattatcgcaaatatttggagaagacttatggaaaactaatacaatccatctctggaattcactataatctcggtttaggtcaagagttattaacttctctctttgaattgagtcaagcagataatgctattgattttcagaaccagctttacatgaaattgtctcaaaattttttacgttaccgttggttactaacttatctatacggagcgagcccagtagctgaagaagactttttagatcagaaactgaataaccctgtccggtcacttagaaatagtcacttaggttatgtgaatcataaagatattcgtatttcttatactagcttgaaggattatgtcaacgatctagaaaatgctgtaaaaagtgggcaattgattgctgagaaagaattttattcacctgttcgtctccgtggtagtaaggcctgtcgtaattatttagaaaaaggaattacatatttagagtttcgcacttttgatctcaacccatttagcccaatcggtataacgcaggaaactgttgatactgttcaccttttcttattggcgcttttgtggatagattctagtagtcatattgaccaagatatcaaggaagccaatagattaaatgaccttatagcacttagtcatccattagaaaaattacctaatcaagcaccagtttctgacttagtggatgctatgcaatctgttatccaacattttaacttatcaccttactatcaagacctattggaatctgtaaaaaggcaaattcagtcacctgaattaacggtagctggtcaacttttagaaatgattgaaggactttccttagaaacatttggacaaagacaaggacaaatttatcacgattatgcttgggaagctccctacgccttaaagggatatgaaacgatggaactttctacccaattgctactatttgacgttatccaaaaaggagtcaacttcgaagtgctggatgaacaagatcaattcctaaaattatggcacaatagtcatattgagtacgttaaaaatggtaatatgacctcaaaagataactatattgtaccgctcgctatggctaacaaagttgttacaaaaaaaatcctagatgaaaagcatttcccaactccttttggagatgaatttactgaccgtaaagaggcacttaactatttttcacaaatccaagataaaccaatcgtcgttaagccaaaatctacaaactttggtttaggcatttctatttttaaaacatcagctaacttagcttcttatgaaaaagcaattgacatcgcttttaccgaagatagtgctattcttgtggaagaatatattgagggtaccgaataccgtttcttcgtccttgagggggactgtattgctgtattgcttagggtagcagctaatgtcgttggagatggtattcatactattagtcagctagttaaacttaaaaaccaaaaccctctcagaggctatgatcatcgctctcctctagaggttattgagctcggagaagtagaacagttaatgttggaacaacaaggatacactgttaacagtatccctccagaaggaacaaaaatagaacttcgccgtaattctaatatttccactggcggtgactctatagatgtaacaaatacaatggatcctacatataaacaactagcagctgagatggcagaggctatgggggcttgggtttgtggagttgatttaattattcctaatgccactcaagcatactcaaaagataagaaaaatgctacttgcattgaactaaactttaacccattgatgtatatgcacacctactgtcaagaggggcctggtcaatctattacacctcgaattttggctaaactgttcccagaatta

SEQ ID NO: 4558 - protein, 750 aa, Streptococcus agalactiae
MIIDRLLQRSHSHLPILQATFGLERESLRIHQPTQRVAQTPHPKTLGSRNYHPYIQTDYSEPQLELITPIAKDSQEAIRFLKAISDVAGRSINHDEYLWPLSMPPKVREEDIQIAQLEDAFEYDYRKYLEKTYGKLIQSISGIHYNLGLGQELLTSLFELSQADNAIDFQNQLYMKLSQNFLRYRWLLTYLYGASPVAEEDFLDQKLNNPVRSLRNSHLGYVNHKDIRISYTSLKDYVNDLENAVKSGQLIAEKEFYSPVRLRGSKACRNYLEKGITYLEFRTFDLNPFSPIGITQETVDTVHLFLLALLWIDSSSHIDQDIKEANRLNDLIALSHPLEKLPNQAPVSDLVDAMQSVIQHFNLSPYYQDLLESVKRQIQSPELTVAGQLLEMIEGLSLETFGQRQGQIYHDYAWEAPYALKGYETMELSTQLLLFDVIQKGVNFEVLDEQDQFLKLWHNSHIEYVKNGNMTSKDNYIVPLAMANKVVTKKILDEKHFPTPFGDEFTDRKEALNYFSQIQDKPIVVKPKSTNFGLGISIFKTSANLASYEKAIDIAFTEDSAILVEEYIEGTEYRFFVLEGDCIAVLLRVAANVVGDGIHTISQLVKLKNQNPLRGYDHRSPLEVIELGEVEQLMLEQQGYTVNSIPPEGTKIELRRNSNISTGGDSIDVTNTMDPTYKQLAAEMAEAMGAWVCGVDLIIPNATQAYSKDKKNATCIELNFNPLMYMHTYCQEGPGQSITPRILAKLFPEL

SEQ ID NO: 4559 - DNA, 1044 bp, Streptococcus pyogenes
atgtccaaacaaacgttagttctattatacggaggccgctcagcagaacgtgaagtctcagtgctttcagcagagagtgtgatgcgagcagtcaactatgataagttcttagtaaaaacttattttattactcagatgggccaatttatcaaaactcagcaattttcagaaaagccatcggaatcagaacgcttgatgacaaatgagacgatagagctaactcaaaaaataaaaccaagtgatatctatgaagaaggtgcagttgtatttcctgtattacatggacctatgggagaagatggctctatccaaggtttcttagaagtgcttagaatgccatatatagggactaatgtcatgtcttctagcatagctatggataaaattactactaaacgtgtcttagaatcaattggaattccacaagttgcctatactgtttatattgacggacaagatttggaggcttgtttagttgaaactttagcaagacttacttttcctatcttcgtaaaaccagctaatatgggttcttctgtggggatttccaaagcccaaacaaaagtagaattaagaaaagcgattcagttagccctgacctatgacagtcgtgtcttgattgaacaaggcgtggttgcaagagaaattgaagttggtctccttggaaatgataaggttaaatcaactctaccaggagaagtaatcaaggacgttgatttttacgactaccaggcaaaatatgttgacaataagattacgatggccattccagcagatgtagaccagagtattgtgacagaaatgcgttcttatgctgaagtagcctttaaagccttaggtggttgtgggttgtcccgttgtgactttttcttgacccaagatggacaggtttaccttaatgaattaaacaccatgccaggctttacccaatggtctatgtatccactcttatgggaaaatatgggattggcttatccagatttgattgaagagctggtgacactggcacaagaaatgtttgaccagcgtgagagccacctgatt

SEQ ID NO: 4560 - protein, 348 aa, Streptococcus pyogenes
MSKQTLVLLYGGRSAEREVSVLSAESVMRAVNYDKFLVKTYFITQMGQFIKTQQFSEKPSESERLMTNETIELTQKIKPSDIYEEGAVVFPVLHGPMGEDGSIQGFLEVLRMPYIGTNVMSSSIAMDKITTKRVLESIGIPQVAYTVYIDGQDLEACLVETLARLTFPIFVKPANMGSSVGISKAQTKVELRKAIQLALTYDSRVLIEQGVVAREIEVGLLGNDKVKSTLPGEVIKDVDFYDYQAKYVDNKITMAIPADVDQSIVTEMRSYAEVAFKALGGCGLSRCDFFLTQDGQVYLNELNTMPGFTQWSMYPLLWENMGLAYPDLIEELVTLAQEMFDQRESHLI

SEQ ID NO: 4561 - DNA, 672 bp, Streptococcus agalactiae
atggataaagaaaaattagactattggaaaacgataataacgtttctccataatgttttaggtgataattacgaaattgttttgcatgtagtagatgaaaatgatatctatattggtgagttggttaatagtcacattagtggacgaaccataagttcacctctaacgactttcgcccttgatttaatcaagaataaagtttataaggaaaaagattttgttactaactataaggcgattgtcagccctctcaataaagaagttcgtggatctactttcttcatcaagaatgctcaaaatgaacttgaagggatgttatgtatcaaccttgatatttctgcataccaaaatattgctttggatattctagacttagttaatttaaatgttaacaaaatactacctaagtcccctcaaaaaatttctctccctcaacaggaggaacctgtagaagttctatcaggcaatattcaggatattattagtgagattgttgatcctagtcttttaaatcagaatattcatttaagtcaagaagttaaggtagaaattgtttctaaacttcacgaaaaaggtgtattccaattaaaaggtgccgtttcaaaggtcgctgaagttctcaacatctccgaaccaagcgtctatcgttatcttaaaaaaattgaaactcat

SEQ ID NO: 4562 - protein, 224 aa, Streptococcus agalactiae
MDKEKLDYWKTIITFLHNVLGDNYEIVLHVVDENDIYIGELVNSHISGRTISSPLTTFALDLIKNKVYKEKDFVTNYKAIVSPLNKEVRGSTFFIKNAQNELEGMLCINLDISAYQNIALDILDLVNLNVNKILPKSPQKISLPQQEEPVEVLSGNIQDIISEIVDPSLLNQNIHLSQEVKVEIVSKLHEKGVFQLKGAVSKVAEVLNISEPSVYRYLKKIETH

SEQ ID NO: 4563 - DNA, 678 bp, Streptococcus pyogenes
atggataaagaaacgctaaactactggaaaacggttatcacatttcttcacgatgtcttaggtgataactatgaaattattttacatgtgattgataaaaatgatatctatattggagaactcgttaatagtcatatcagtggacggtctaaacagtctcctctcaccacctttgctcttgatttgattactaataaagtctataaggaaaaagattttgtgaccaattacaaagcaatcgttagtcctcagcacaaagaagttcggggatctactttttttattaaagataaaaagggtaatctcgagggaatgctatgtattaacttagatatttcagcctatcaaggagtagctagggacctcttaaaacttgtcaatctcaatttagaacatttcatcccaactgctaaagagcctaaaacagtcacaccccagccagaagaagctgttgaaattttaacctctaacatccaagatattatcggtcaaattattgatccctcgttactgagacacaatgtacatcttagccaagatgtcaaaatagacattgttgccaagctttatgaaaaaggggtctttcagctaaaaggagccgtctcaaaagtcgctgatattctatgtatttccgaaccaagtgtttaccgctaccttaaaaaaattgaagccgatcaa

SEQ ID NO: 4564 - protein, 226 aa, Streptococcus pyogenes
MDKETLNYWKTVITFLHDVLGDNYEIILHVIDKNDIYIGELVNSHISGRSKQSPLTTFALDLITNKVYKEKDFVTNYKAIVSPQHKEVRGSTFFIKDKKGNLEGMLCINLDISAYQGVARDLLKLVNLNLEHFIPTAKEPKTVTPQPEEAVEILTSNIQDIIGQIIDPSLLRHNVHLSQDVKIDIVAKLYEKGVFQLKGAVSKVADILCISEPSVYRYLKKIEADQ

SEQ ID NO: 4565 - DNA, 1020 bp, Streptococcus agalactiae
atgaatatcattattgggaccagtcttttaatacttgtattagcgattttcactttatttaattataaagcaccctacggaacaaaagcaatgggagcattggcatctgcggcttgtgcatccttccttgtagaagcttttcaagattctttctttggtaaagttttgggatttcaatttttaagtgaagtgggtggtgctaatggttcactttctggtgtagctgcagctatattggttgctattgctattggtgtaaccccaggatacgcagttttaattggtttatctgtttctggaacaggtattattcctggtttccttgcaggatatttagtgggatttcttgttaagtggatggaaagaaatattcctggtggtttagatcttatttcaattattattattggtgcaccattaacacgtcttgtggccaaactgttgacgccgcttattaatagcactttgctcaccattggagatatcttaacatcaggtgctcatagcaaccctattttaatggggattatacttggcgggacaattgtagtagtggcgacagcaccactttcttctatggcattgacagctatgctaggattaaccggaatgcctatggctataggagccttgtctgtctttggttcgtcatttatgaatggtgtacttttccataaattaaaacttggaagtcgtaaagataatatagcttttgctgttgagcctctaactcaagctgacgtgacttcagctaaccctattccaatctatgtcactaattttgttggtggtgcagcttgtggtattttaattgccttgatgaaattagttaatgatactcctggaacagcgacaccaattgcaggatttgctgtcatgtttgcctataacccaatgataaaagtactaataaccgctctaggttgtattatcctatctttactagcaggctattttggaggcattgtttttaaagattataaattagttacaaaagaagagctacaggctagagataac

SEQ ID NO: 4566 - protein, 340 aa, Streptococcus agalactiae
MNIIIGTSLLILVLAIFTLFNYKAPYGTKAMGALASAACASFLVEAFQDSFFGKVLGFQFLSEVGGANGSLSGVAAAILVAIAIGVTPGYAVLIGLSVSGTGIIPGFLAGYLVGFLVKWMERNIPGGLDLISIIIIGAPLTRLVAKLLTPLINSTLLTIGDILTSGAHSNPILMGIILGGTIVVVATAPLSSMALTAMLGLTGMPMAIGALSVFGSSFMNGVLFHKLKLGSRKDNIAFAVEPLTQADVTSANPIPIYVTNFVGGAACGILIALMKLVNDTPGTATPIAGFAVMFAYNPMIKVLITALGCIILSLLAGYFGGIVFKDYKLVTKEELQARDN

SEQ ID NO: 4567 - DNA, 1017 bp, Streptococcus pyogenes
atggatattattattggaacaagtcttttgattcttgttttagctatttttagcttgtttaactataaggctcctcatggtgccaaggcaatgggagctttggcttcggcagcttgtgcctcttttttagttgaagcctttcaagattctttttttggtaaggttttaggctttcagtttctaagtgaagtaggcggagcaaatggctcattatcaggggtagctgctgctatcttggttgccattgcaattggtgtgtctccaggttatgccgttttgattggtttgtcagtttcaggaacgggtattatcccaggttttgtggctgggtatgtggtatcttttttaatcaagtggatggaaaaaaatattcctggtgggcttgatttaatctcgattattattgtcggtgcaccattaactcgtttcttggcgcagttaattacgccagtgatcaatagtactttattgactattggagacatcctgacctcaagtgctaatagcaaccctattatcatgggaatgatactaggcggtacgattgttgttgtagcaacagctccgctgtcatcaatggctttgacagccatgcttggtctaacaggtattccgatggctataggtgccttatctgtctttggctcttcttttatgaatggtgttcttttttaccgattaaaattgggtgaaagaaaagacaatattgcttttgctattgaaccactaacgcaggcagatgtgacgtcagccaatcccattccgatttatgtgactaattttgttggtggtgctgcatgtggtgttttgatcgccctaatgaaattggttaatgatacgccagggacagctactccgattgccggttttgcggtgatgtttgcctataatcctgtcgctaaagtgttgataacagcccttggatgtattattatcagcttaattgtgggttatattggaggttctgtctttaaaaattaccgtttagtaacaaaacaagaattacaagcgagaaac

SEQ ID NO: 4568 - protein, 339 aa, Streptococcus pyogenes
MDIIIGTSLLILVLAIFSLFNYKAPHGAKAMGALASAACASFLVEAFQDSFFGKVLGFQFLSEVGGANGSLSGVAAAILVAIAIGVSPGYAVLIGLSVSGTGIIPGFVAGYVVSFLIKWMEKNIPGGLDLISIIIVGAPLTRFLAQLITPVINSTLLTIGDILTSSANSNPIIMGMILGGTIVVVATAPLSSMALTAMLGLTGIPMAIGALSVFGSSFMNGVLFYRLKLGERKDNIAFAIEPLTQADVTSANPIPIYVTNFVGGAACGVLIALMKLVNDTPGTATPIAGFAVMFAYNPVAKVLITALGCIIISLIVGYIGGSVFKNYRLVTKQELQARN

SEQ ID NO: 4569 - DNA, 1290 bp, Streptococcus agalactiae
atgacttcagttgttgtagtaggtacccaatggggtgacgaaggtaaaggtaaaattacagattttttatctgctgacgcagaagtaattgcacgttatcaaggtggtgataacgctgggcatactatcgttattgataacaaaaaatttaaacttcatttaattccttcaggaattttcttcaaagaaaaaatttctgtcattggtaatggtgttgtcgttaatccgaaatcattagttaaagagttagcttatcttcacggagaaggtgtaacaacggataaccttcgtatttcagaccgtgcgcatgttatcttgccataccacatcaagcttgaccaactacaagaagatgctaaaggtgataataaaattggaacaaccatcaaaggaattgggccagcttacatggacaaggctgcgcgtgtcggtatccgtattgctgaccttcttgatagagaagtttttgctgagcgtttgaaaattaatttagctgagaaaaatcgtttatttgaaaaaatgtatgacagtacacctcttgaatttgatgatattttcgaagaatattatgaatatggtcaacaaattaagcaatatgtgactgatacatccgttatcttaaatgatgctcttgatgccggtaaacgtgttctttttgaaggagcacaaggagttatgctcgacattgatcaaggaacatacccatttgtaacatcttccaatccagtagcaggtggtgtcacaattggttcgggagttggaccaagtaaaattaataaagtagtaggtgtatgtaaagcttacactagccgtgtcggtgatggaccattcccaacagaactttttgatgaggttggtgaccgtattcgtgagattggtaaagagtatggtacaacgactggtcgtcctcgtcgcgttggatggtttgattctgttgttatgcgtcacagccgtcgagtatcaggtattactaatctctctctgaattcaattgatgttctttcagggcttgatacggtgaaaatttgtgtggcttatgaccttgatgggaaacgtattgactattatccagcaagccttgaacagctaaaacgttgtaaaccaatctatgaagaattaccgggctggtctgaagatattacagcttgccgtagcttagatgatcttccagaaaatgcacgtaattacgttcgccgtgttggcgaattggttggtgttcgtatttctactttctcagtagggcctggtcgtgaacaaacaaacattcttgagtctgtttggtcaaatatt

SEQ ID NO: 4570 - protein, 430 aa, Streptococcus agalactiae
MTSVVVVGTQWGDEGKGKITDFLSADAEVIARYQGGDNAGHTIVIDNKKFKLHLIPSGIFFKEKISVIGNGVVVNPKSLVKELAYLHGEGVTTDNLRISDRAHVILPYHIKLDQLQEDAKGDNKIGTTIKGIGPAYMDKAARVGIRIADLLDREVFAERLKINLAEKNRLFEKMYDSTPLEFDDIFEEYYEYGQQIKQYVTDTSVILNDALDAGKRVLFEGAQGVMLDIDQGTYPFVTSSNPVAGGVTIGSGVGPSKINKVVGVCKAYTSRVGDGPFPTELFDEVGDRIREIGKEYGTTTGRPRRVGWFDSVVMRHSRRVSGITNLSLNSIDVLSGLDTVKICVAYDLDGKRIDYYPASLEQLKRCKPIYEELPGWSEDITACRSLDDLPENARNYVRRVGELVGVRISTFSVGPGREQTNILESVWSNI

SEQ ID NO: 4571 - DNA, 1290 bp, Streptococcus pyogenes
atgacatctgtagttgttgttggtacccagtggggtgacgaaggtaaaggtaaaatcactgatttcttgtcagcggatgcagaagtaattgcacgctatcaaggtggtgataatgctggtcatacgatcgtgattgatggtaagaagtttaaacttcacttgatcccatcaggaattttcttcccgcaaaaaatttccgttattggtaatggcgttgtggtcaaccccaaatctttggtcaaagagttggcgtacctgcatgatgaaggagtgacgacagataaccttcgcatttcagaccgagctcatgtcattttaccttatcatatccagctggatcaactgcaagaagatgcaaaaggtgacaataaaatcggaacaactattaaagggattggtccagcttatatggataaagctgctcgagttggtatccgtatcgcagatttactggataaggatatctttgcagagcgcctacgcattaatttagctgagaaaaaccgtttatttgaaaaaatgtatgacagtacacctcttgattttgatgctatttttgaagaatactatgcttacggtcaagaaatcaagcaatatgtgacagatacttctgtaattttaaatgatgcacttgatgccggtaaacgtgttctttttgaaggtgcacaaggggttatgcttgatattgaccaaggaacgtacccatttgtaacgtcttcaaacccagttgctggtggtgtaaccattggttctggtgttggcccaaataaaatcaacaaagtagttggtgtctgtaaagcctacacaagccgtgtcggtgatgggccattccctacagaactctttgatgaagtgggtgagcgcattcgtgaagtgggtcatgagtacgggacaacgaccggccgtccacgtcgtgtcggttggtttgattcggttgtcatgcgccacagtcgtcgtgtatcaggtattactaacctctctctgaattcaattgatgttctttcagggcttgatacggttaagatttgtgtggcttatgaccttgatgggaaacgtattgactattacccagcaaaccttgaacaactcaaacgttgcaaaccaatctatgaagaattaccaggctggcaagaggacatcacaggtgttcgtagccttgatgagcttcctgaaaatgcccgcaactacgttcgtcgtgttggagaattggttggcgttcgcatttcaaccttctcagttggtccagggcgtgaacagaccaatattcttgagtcagtctgggcatctatc

SEQ ID NO: 4572 - protein, 430 aa, Streptococcus pyogenes
MTSVVVVGTQWGDEGKGKITDFLSADAEVIARYQGGDNAGHTIVIDGKKFKLHLIPSGIFFPQKISVIGNGVVVNPKSLVKELAYLHDEGVTTDNLRISDRAHVILPYHIQLDQLQEDAKGDNKIGTTIKGIGPAYMDKAARVGIRIADLLDKDIFAERLRINLAEKNRLFEKMYDSTPLDFDAIFEEYYAYGQEIKQYVTDTSVILNDALDAGKRVLFEGAQGVMLDIDQGTYPFVTSSNPVAGGVTIGSGVGPNKINKVVGVCKAYTSRVGDGPFPTELFDEVGERIREVGHEYGTTTGRPRRVGWFDSVVMRHSRRVSGITNLSLNSIDVLSGLDTVKICVAYDLDGKRIDYYPANLEQLKRCKPIYEELPGWQEDITGVRSLDELPENARNYVRRVGELVGVRISTFSVGPGREQTNILESVWASI

SEQ ID NO: 4573 - DNA, 645 bp, Streptococcus agalactiae
atgttattagtttataaaagaggagattgtatgcgtaaatttttccaagatgttattgtagaggtggcttattatttagagattgctttgtcagttattctggcaacagctattattttttttagtttagcactctttcatgatttgtttagcatgttgtctgttgatcaaaatgttgataagttgttccagactttccttgctcgcgccatgacaatagcagtcgggattgagttgatcaaaatgttttcaaaaccttccccagatactttaattgaagtgttattgtttgccttagctcgtcaacttgtaattgaacatggtagtgtttcagattaccttatggggattgcttcagttgctattttgtttgctgttcgtaaatatcttttcacccattttgatgggtcaagcaacattgttttacgtgctaataacaaagtcaaaaaagctaatattttagctagggttcaactaccttgtcaacccaatgaaactttaggagacttacttgttcgtcatttaaatgatgaggaaaaggacgttgctattggttcagtagtctatattaataacgttgcattgcgtgttgatagtatgcacgatggtcttgtgacgcgtgtagaaatcattaggagtctacat

SEQ ID NO: 4574 - protein, 215 aa, Streptococcus agalactiae
MLLVYKRGDCMRKFFQDVIVEVAYYLEIALSVILATAIIFFSLALFHDLFSMLSVDQNVDKLFQTFLARAMTIAVGIELIKMFSKPSPDTLIEVLLFALARQLVIEHGSVSDYLMGIASVAILFAVRKYLFTHFDGSSNIVLRANNKVKKANILARVQLPCQPNETLGDLLVRHLNDEEKDVAIGSVVYINNVALRVDSMHDGLVTRVEIIRSLH

SEQ ID NO: 4575 - DNA, 288 bp, Streptococcus agalactiae
atgtacatgaagaaagcttgcttagttggtacaaatgcaccaggtccgattaatttaacattagacataatgtctggaccaaggacagctaagattcctccaaagaaaactagcatcaatgttgctgatgcaacaactgtatcatggaaaatatttaagaatgttggtaattttaagttatcaaggttttcttcttttttaccgaagaatggcgcaactttatcaacaaaccaaattgcaaattgttgttggtgtccgatggcaaatccgccaccacctgtaaggcgt

SEQ ID NO: 4576 - protein, 96 aa, Streptococcus agalactiae
MYMKKACLVGTNAPGPINLTLDIMSGPRTAKIPPKKTSINVADATTVSWKIFKNVGNFKLSRFSSFLPKNGATLSTNQIANCCWCPMANPPPPVRR

SEQ ID NO: 4577 - DNA, 1437 bp, Streptococcus agalactiae
atggaaaacttcctagctccccttaattggttctcgcaaaatatcttgcagaatccagccttcttcgtaggtctattggtactcattgggtatcttttattgaagaaaccacttcatgatgtctttgctggttttatcaaagcgaccgttggatatttgattttgaacgtaggtgcaggaggattggttaatacattccgtccaatcttagttgctcttgctaaaaaatttaatttagaagctgctgttattgacccttactttggtttagcatcagcaaatgctaagttagaaacaatgggctttatcagtgttgcaacaacagcactcttgattggttttgggattaacattctcttggttgctcttcgtaaagtaactaaagtccgtactctttttattactggtcatatcatggtacaacaagctgcaacaatttcagtatttgtactgctcttgattccacaacttcgtaatggttttggtgcatgggctgttggtatcatttgtggtctatattgggcggtaagttctaatatgaccgttgaagcaactcaacgccttacaggtggtggcggatttgccatcggacaccaacaacaatttgcaatttggtttgttgataaagttgcgccattcttcggtaaaaaagaagaaaaccttgataacttaaaattaccaacattcttaaatattttccatgatacagttgttgcatcagcaacattgatgctagttttctttggaggaatcttagctgtccttggtccagacattatgtctaatgttaaattaatcggacctggtgcatttgtaccaactaagcaagctttcttcatgtacatccttcaaacatcattgacattctcagtttaccttttcattttgatgcaaggtgtacgcatgttcgttacagaattgacaaatgccttccaaggtatctcaaacaaacttcttccaggatcattcccagcagttgacgttgcagcttcatatggttttggttcttcaaatgcagttctttcaggatttgcttttggtttgattggtcaattaattacaatcgctctacttgttgtcttcaaaaatccaatcttgattatcacaggattcgttccagtattctttgataatgcggcaatcgctgtttatgcagataaacgtggtggctggaaagcagcagtagctctatcatttatctcaggtattattcaggtggcacttggtgctgttgctgtaggtcttttaggacttgcaggtggttatcatggaaatatcgactttgaattcccatggttagcatttggttacatcttcaagtatttaggtatcgctggttacgtgattgtatgtctcttcttcttagctattccacaacttcaatttatgaaatctaaagataaagaagcatactatcgtggtgatgcgcctgcagaa

SEQ ID NO: 4578 - protein, 479 aa, Streptococcus agalactiae
MENFLAPLNWFSQNILQNPAFFVGLLVLIGYLLLKKPLHDVFAGFIKATVGYLILNVGAGGLVNTFRPILVALAKKFNLEAAVIDPYFGLASANAKLETMGFISVATTALLIGFGINILLVALRKVTKVRTLFITGHIMVQQAATISVFVLLLIPQLRNGFGAWAVGIICGLYWAVSSNMTVEATQRLTGGGGFAIGHQQQFAIWFVDKVAPFFGKKEENLDNLKLPTFLNIFHDTVVASATLMLVFFGGILAVLGPDIMSNVKLIGPGAFVPTKQAFFMYILQTSLTFSVYLFILMQGVRMFVTELTNAFQGISNKLLPGSFPAVDVAASYGFGSSNAVLSGFAFGLIGQLITIALLVVFKNPILIITGFVPVFFDNAAIAVYADKRGGWKAAVALSFISGIIQVALGAVAVGLLGLAGGYHGNIDFEFPWLAFGYIFKYLGIAGYVIVCLFFLAIPQLQFMKSKDKEAYYRGDAPAE

SEQ ID NO: 4579 - DNA, 1431 bp, Streptococcus pyogenes
atggaaatgctcctagctcccctaaactggttctcgcaaaatattttgcaaaacccagcgttctttgtaggtcttttggttttaatcgggtatttactccttaaaaaacccatttatgaggtctttgctggttttgtaaaggctaccgttggttacttgattttgaacgttggagcaggcggtcttgtaacgacttttcgtccgatcttggttgctcttgccaagaaatttgaattgaaagccgccgttattgatccttattttggtttggctgctgctaatactaagttagaagagatgggcttcatcagtgttgctacgacagctctcttgattggatttggggtcaacattcttttggttgcacttcgcaaggtcactaaagttcgtacccttttcatcacaggtcacatcatggtccaacaggcagcgacgatttcggtctttgtccttcttttaatccctcaattccaaaatgcttttggggcatgggcagtcggtatcatctgtgggctttactgggctatcagctcaaacatgaccgttgaagcaactcaacgccttacaggtggcggtgggtttgcgattggtcaccaacaacaatttgcgatttggtttgtggataaggttgcaccgttctttggtaaaaaagaagaaaaccttgataacctaaaattaccgaccttcttaaacattttccatgatactgttgttgcgtcagcaactttgatgttggtctttttcggagctatcttggctgtccttggtccagacattatgtctgatgtggacttaatcggacctggagcattcaacccagctaagcaagctttcttcatgtatattttgcaaacctctctcaccttctcagtttatctctttatcttgatgcagggtgttcgcatgtttgtttctgaattgaccaatgcttttcaagggatctcaagcaaattgcttccagggtcattcccagcggttgacgttgcagcttcctatggctttggttcttcaaatgcggtgctttcaggatttgcctttggtttgattggtcaattaatcaccattgctcttcttgttatctttaaaaatccaatcttaattatcacaggattcgttcccgtattctttgataatgcggcaattgcggtttatgcagataaacgtggtggctggaaagcagcggtagctctatcatttatctcaggtattttgcaagttgcacttggtgctgttgctgtaggtcttttaggacttacaggtggttatcacggtaatatcgacttggttcttccatggttaccatttgggtacctcttcaaattccttggtattgcagggtatgtgcttgtttgcatcttcttacttgccattccacaattgcaattcgcaaaagctaaggacaaagaagcttactaccgtggggaagctcaa

SEQ ID NO: 4580 - protein, 477 aa, Streptococcus pyogenes
MEMLLAPLNWFSQNILQNPAFFVGLLVLIGYLLLKKPIYEVFAGFVKATVGYLILNVGAGGLVTTFRPILVALAKKFELKAAVIDPYFGLAAANTKLEEMGFISVATTALLIGFGVNILLVALRKVTKVRTLFITGHIMVQQAATISVFVLLLIPQFQNAFGAWAVGIICGLYWAISSNMTVEATQRLTGGGGFAIGHQQQFAIWFVDKVAPFFGKKEENLDNLKLPTFLNIFHDTVVASATLMLVFFGAILAVLGPDIMSDVDLIGPGAFNPAKQAFFMYILQTSLTFSVYLFILMQGVRMFVSELTNAFQGISSKLLPGSFPAVDVAASYGFGSSNAVLSGFAFGLIGQLITIALLVIFKNPILIITGFVPVFFDNAAIAVYADKRGGWKAAVALSFISGILQVALGAVAVGLLGLTGGYHGNIDLVLPWLPFGYLFKFLGIAGYVLVCIFLLAIPQLQFAKAKDKEAYYRGEAQ

SEQ ID NO: 4581 - DNA, 276 bp, Streptococcus agalactiae
atggttaaagttcttacagcatgcggaaacggcatgggatcatcaatggttatcaaaatgaaagtcgaaaatgcgcttcgtcaattaggcgttagcaactttgagtcagcatcttgctcagtcggagaagcaaaaggtttagctgcaaactacgatatcgtggttgcttcaaaccaccttatccatgaattagacggacgtacaaaaggtcatttagtaggtcttgataaccttatggatgacaatgaaataaaaacaaaactacaagaaattttg

SEQ ID NO: 4582 - protein, 92 aa, Streptococcus agalactiae
MVKVLTACGNGMGSSMVIKMKVENALRQLGVSNFESASCSVGEAKGLAANYDIVVASNHLIHELDGRTKGHLVGLDNLMDDNEIKTKLQEIL

SEQ ID NO: 4583 - DNA, 276 bp, Streptococcus pyogenes
atggttaaagtcttaacagcatgtggcaatggtatggggtcatctatggtgatcaaaatgaaagttgaaaatgcgcttcgtcaacttggtgtgacagatattcagtcagcttcttgctcagttggtgaagctaaaggtctagcttctggttatgatattgtagtggcatcaaaccacttgattcatgagcttgatggtcgtaccaaaggccacttggttggtcttgataacctgatggatgataatgaaattaaaaccaaactacaagaagtgcta

SEQ ID NO: 4584 - protein, 92 aa, Streptococcus pyogenes
MVKVLTACGNGMGSSMVIKMKVENALRQLGVTDIQSASCSVGEAKGLASGYDIVVASNHLIHELDGRTKGHLVGLDNLMDDNEIKTKLQEVL

SEQ ID NO: 4585 - DNA, 483 bp, Streptococcus agalactiae
atgaatttaaaacaagcctttatcgaaaatgactcaattcgtcttaaattatctgcaagcgattggaaagaagcaatcaaattatcaattgatccattgattgaaagtggtgctgttgatgcagaatattacgatgccattattgaatctacagaggaatttggtccgtactacattcttatgccgggtatggcgatgcctcatgctcgtccagaagcaggcgtaaaacgtgatgcattttcattaattacattaacagagccagtagtttttccagatggcaaagaagtctcagtattgttagcacttgctgcaacaagttcagctattcatacttctgttgctatccctcaaattattgccctttttgaattggaaaattcaattcagcgcttgacggaatgccaagaagcaaaagaagtccttgcaatggtagaggaatcaaaaaacagcccatatttagaaggtttagatttagaaagc

SEQ ID NO: 4586 - protein, 161 aa, Streptococcus agalactiae
MNLKQAFIENDSIRLKLSASDWKEAIKLSIDPLIESGAVDAEYYDAIIESTEEFGPYYILMPGMAMPHARPEAGVKRDAFSLITLTEPVVFPDGKEVSVLLALAATSSAIHTSVAIPQIIALFELENSIQRLTECQEAKEVLAMVEESKNSPYLEGLDLES

SEQ ID NO: 4587 - DNA, 483 bp, Streptococcus pyogenes
atgaatttaaaacaagcctttattgacaacaactccatccgattggggctaagtgctgatacttggcaagaggctgttcgattagctgttcaacctttgattgatagcaaagcagtgacgtcagcttactacgacgccatcattgcatcaacagaaaaatacggcccttattatgtgttgatgccaggtatggctatgccccatgcggaagcaggtttaggcgttaatcgtaatgcatttgctttgattacactaacaaaaccagtcaccttctcagatggtaaagaggtttctgttcttttgacgttggccgctacagacccttctattcacacaacagtggctatcccacaaattgtggccttgtttgaactagataatgccattgaacgcttggtggcctgccaaagtcctaaagaggttctagagatggtagaagaatctaaagacagtccttacttagaaggtatggacttgaatgct

SEQ ID NO: 4588 - protein, 161 aa, Streptococcus pyogenes
MNLKQAFIDNNSIRLGLSADTWQEAVRLAVQPLIDSKAVTSAYYDAIIASTEKYGPYYVLMPGMAMPHAEAGLGVNRNAFALITLTKPVTFSDGKEVSVLLTLAATDPSIHTTVAIPQIVALFELDNAIERLVACQSPKEVLEMVEESKDSPYLEGMDLNA

SEQ ID NO: 4589 - DNA, 663 bp, Streptococcus agalactiae
atgacaaaacgtttaccaaatttacaagttgcacttgaccactcagatttacaaggagctatcaaagctgccgtatcagtaggacatgaagttgatgttattgaagctggaactgtttgccttcttcaagtaggtagtgaattagttgaggtccttcgcagtctcttccctgacaaaataattgttgctgatacaaaatgtgctgatgctggtgggactgttgctaaaaataatgctgttcgcggtgcagactggatgacttgtatctgttgtgctactattccaacaatggaagcagccttaaaagctatcaaagaagaacgcggcgatcgtggagaaattcaaatcgaactatatggtgattggacttatgagcaagcgcaacaatggttggatgcaggtatttcacaagccatttatcaccaatctcgtgatgcgcttcttgctggcgaaacatggggagagaaagaccttaataaggttaaaaaattgattgatatgggcttccgagtttctgtaactggtggtttatcaactgatactcttcaattatttgaaggtgttgatgtctttacttttattgcgggtcgtggtattacagaggcagatgatccagccgcagcagcacgtgcatttaaggatgaaattaaacgtatttggggg

SEQ ID NO: 4590 - protein, 221 aa, Streptococcus agalactiae
MTKRLPNLQVALDHSDLQGAIKAAVSVGHEVDVIEAGTVCLLQVGSELVEVLRSLFPDKIIVADTKCADAGGTVAKNNAVRGADWMTCICCATIPTMEAALKAIKEERGDRGEIQIELYGDWTYEQAQQWLDAGISQAIYHQSRDALLAGETWGEKDLNKVKKLIDMGFRVSVTGGLSTDTLQLFEGVDVFTFIAGRGITEADDPAAAARAFKDEIKRIWG

SEQ ID NO: 4591 - DNA, 660 bp, Streptococcus pyogenes
atgacacatattccaaatttacaagttgctttagaccattctgacttacagggggctgttaaagcagccgttgctgtgggtcacgaagtagatgtgattgaagctggtaccgtttgtttgcttcaagtgggaagcgaactagttgaggtattacgcagcctcttcccagagaaaattatcgtagcagataccaaatgtgctgacgctggcggtacggtcgctaaaaacaatgcaaaacgtggtgctgactggatgacctgcatttgctgtgcgacgattccaaccatggaagcagccctcaaggctattaaagaagagcgcggtgaccgtggggaaattcaaatcgaactttatggtgattggacttatgagcaagctcaattatggcttgacgctgggatttcccaagcgatttaccaccaatctcgtgatgcccttcttgctggagaaacttggggtgaaaaagaccttaacaaggtgaaaacattgattgacatgggctttcgtgtctcagtaactggtgggcttgatgtagacactttgagactttttgaaggggttgatgtctttacctttatcgcagggcgaggcattactgaagcagaagatcctgctgcagcggcgcgtgccttcaaagatgaaatcaaacgtatctggggg

SEQ ID NO: 4592 - protein, 220 aa, Streptococcus pyogenes
MTHIPNLQVALDHSDLQGAVKAAVAVGHEVDVIEAGTVCLLQVGSELVEVLRSLFPEKIIVADTKCADAGGTVAKNNAKRGADWMTCICCATIPTMEAALKAIKEERGDRGEIQIELYGDWTYEQAQLWLDAGISQAIYHQSRDALLAGETWGEKDLNKVKTLIDMGFRVSVTGGLDVDTLRLFEGVDVFTFIAGRGITEAEDPAAAARAFKDEIKRIWG

SEQ ID NO: 4593 - DNA, 861 bp, Streptococcus agalactiae
atgacacgtccaataggaatttacgagaaggcaacaccaaaacattttaactggttagaacgcctacaatttgctaaagaattgggatttgattttgtagaattatccattgatgagtcagatgaacgtttggcacgtttggagtggtcaaaagaagaacgacttgagttggtcaaagctatttttgagacaggagttcgtgttccaacaattacatttagtggtcatcgtcgtttcccaatgggatctaataatcctgagaaagaagcgcgtgcgatggatatgatgaaaaaatgtatcgtctttgctcaagatattggtattcgtaatattcaattagcaggatatgatgtgtactatgaagaaaaatctccagagacacgtgcacgctttattaagaatcttcgtcaagcttgtacttgggccgaagaagcacaagttattctatctattgagattatggatgatccatttatgaattccattgagaaatatttggctgtggaaaaagagattgattctccttatctctttgtctacccagatactggaaatgtatcagcatggcataatgatctttggagtgaattttataatggacatcgctcaattgcagcgcttcatattaaagatacttatgctgttaccgaaacgtctaaaggtcaattccgtgatgttccatttggtcaagggtgtgttgattgggaagaaatgtttgctgtcattaagaaaacaaattataatggtccattcttgattgaaatgtggtcggagaactgtgagactgtagaggaaacacgtgcagccattaaagaggcgcaagattttctttacccattaatggagaaaacaggagtgaaa

SEQ ID NO: 4594 - protein, 287 aa, Streptococcus agalactiae
MTRPIGIYEKATPKHFNWLERLQFAKELGFDFVELSIDESDERLARLEWSKEERLELVKAIFETGVRVPTITFSGHRRFPMGSNNPEKEARAMDMMKKCIVFAQDIGIRNIQLAGYDVYYEEKSPETRARFIKNLRQACTWAEEAQVILSIEIMDDPFMNSIEKYLAVEKEIDSPYLFVYPDTGNVSAWHNDLWSEFYNGHRSIAALHIKDTYAVTETSKGQFRDVPFGQGCVDWEEMFAVIKKTNYNGPFLIEMWSENCETVEETRAAIKEAQDFLYPLMEKTGVK

SEQ ID NO: 4595 - DNA, 903 bp, Streptococcus pyogenes
gtgccttcaaagatgaaatcaaacgtatctgggggtaactttatggcgcgtcctattggtatttatgaaaaagcaacgccaaaacagtttacctggcgtgaacgcttgcaatttgcaaaagacttaggttttgattttgtggaaatgtctgttgatgaatcagatgctcgcttagcgcgcttagagtggactaaggaagaacggcttgatttagtgaaagccatttatgaaacaggcattcgcatcccgaccatttgtttttctggtcatagacgttacccactaggctcaaatgatcctgctattgaagctaagtcccttaaactgatgaaacaatgtattgaattggcacaggacttaggcgttcgtaccattcaattagctggttatgacgtttactatgaaaaaaaatcgcctgaaacccgtgctcgttttatcaaaaacttgagacaatcttgtgactgggccgaagaagcccaagtgatgctttctattgagattatggatgacccttttatcaactctattgagaaatacttggcagttgaaaaagagattgactcgccttatctctttgtttatcctgatgcaggcaatgtttctgcttggcataatgatttgtggagtgaattttacaatgggcacaaatccattgcagccctccacttgaaagatacttatgctgtcacggaaacctcaaaagggcagtttcgtgatgtgccatttggtcaaggttgtgtggactggcaagagctgtttgcggtcctcaagaaaaccaactacaatgggccttttttgattgaaatgtggtcagaaaattgtgacacggtggaggaaacaaaagctgctatcaaagaagctcaggacttcctttacccacttattgagaaagcggggttgaca

SEQ ID NO: 4596 - protein, 301 aa, Streptococcus pyogenes
VPSKMKSNVSGGNFMARPIGIYEKATPKQFTWRERLQFAKDLGFDFVEMSVDESDARLARLEWTKEERLDLVKAIYETGIRIPTICFSGHRRYPLGSNDPAIEAKSLKLMKQCIELAQDLGVRTIQLAGYDVYYEKKSPETRARFIKNLRQSCDWAEEAQVMLSIEIMDDPFINSIEKYLAVEKEIDSPYLFVYPDAGNVSAWHNDLWSEFYNGHKSIAALHLKDTYAVTETSKGQFRDVPFGQGCVDWQELFAVLKKTNYNGPFLIEMWSENCDTVEETKAAIKEAQDFLYPLIEKAGLT

SEQ ID NO: 4597 - DNA, 714 bp, Streptococcus agalactiae
atggcaaaatcattgcaagaaatgcgtgaacgtgtgtgtgaagctaataaatcactaccagttcatagtttagttaaatttacttggggtaacgtttctgaagttgaccgcgaagcaggattgattgttatcaaaccttcaggagttgactatgaccaattgacacctgaaaatatggttgtcacagacttagagggaaatatagtggagggggatttgaatccatcatctgatcttccaactcatgttcaactttataaagcatggccagaagtcggtggtattgttcatactcattcaacagaagcagttggttgggcacaagcgggtcgcgatattccattttatggaacaacacatgcagattatttttatgggccagtaccatgtgctaggtcacttagtgaagatgaagttaacactgcttatgaaaaagaaacaggtagcgttattatagaggaatttgaacgtcgggatttagatccaatggctgttcctggtattgttgtacgtaatcatggaccatttacttgggggaaagatccagcacaagcagtttatcactcagtcgttcttgaagaagttgctaagatgaatcgtttcactgaacaaattaatccacgtgttgaaccagctccaaaatatattatggataaacactatttacgtaagcatggaccaaatgcttattatggtcaaaaaggacaagaacat

SEQ ID NO: 4598 - protein, 238 aa, Streptococcus agalactiae
MAKSLQEMRERVCEANKSLPVHSLVKFTWGNVSEVDREAGLIVIKPSGVDYDQLTPENMVVTDLEGNIVEGDLNPSSDLPTHVQLYKAWPEVGGIVHTHSTEAVGWAQAGRDIPFYGTTHADYFYGPVPCARSLSEDEVNTAYEKETGSVIIEEFERRDLDPMAVPGIVVRNHGPFTWGKDPAQAVYHSVVLEEVAKMNRFTEQINPRVEPAPKYIMDKHYLRKHGPNAYYGQKGQEH

SEQ ID NO: 4599 - DNA, 702 bp, Streptococcus pyogenes
atggcgaaaaacttgcaagaaatgcgtgaacgtgtctgtgcggctaacaagtctctaccacaacacggtcttgtcaaatttacgtggggcaatgtctctgaagtttgtcgtgaattaggacgtattgtcatcaagccttctggggtggactacgacctcttgacaccagaaaatatggttgttacagaccttgatgggaatgtggtcgaaggtgatttgaacccttcttcagatctgccaacccatgtggaactttataaagcttggccagaagtgggcggtattgtccacactcactccacagaagctgttggttgggcacaggcaggtcgtgatattccgttttatgggactacgcatgctgactacttctatggaccagttccgtgtgctcgttctctcacaaaagcagaagttgatggggcttacgagcaagaaactggcaacgtgattttggaagaatttagcaagcgaggcttagatcctatggcggttccaggaatcgtggttcgcaatcatggcccatttacgtgggggaaaaccccagagcaagccgtttaccactcggttgtcttagaagaagtggctaggatgaatcgcttgacagaacaaatcaatccacgcgtagagccagcgccaagatacattatggataagcattatttgcgtaaacatggcccaaatgcttattacggtcaaaaa

SEQ ID NO: 4600 - protein, 234 aa, Streptococcus pyogenes
MAKNLQEMRERVCAANKSLPQHGLVKFTWGNVSEVCRELGRIVIKPSGVDYDLLTPENMVVTDLDGNVVEGDLNPSSDLPTHVELYKAWPEVGGIVHTHSTEAVGWAQAGRDIPFYGTTHADYFYGPVPCARSLTKAEVDGAYEQETGNVILEEFSKRGLDPMAVPGIVVRNHGPFTWGKTPEQAVYHSVVLEEVARMNRLTEQINPRVEPAPRYIMDKHYLRKHGPNAYYGQK

SEQ ID NO: 4601 - DNA, 699 bp, Streptococcus agalactiae
atggaccaaatgcttattatggtcaaaaaggacaagaacattaaggagaataatatgaaatactttttagatactgccgatgtttctgaaattcgtcgtcttaatcgtttaggaatcgttgatggtgttactaccaatccgactattatttcacgtgaggggcgtgactttaaagaagttattaacgaaatttgccaaatcgttgatggcccagttagtgcagaagtgacaggtttaacttgtgatgaaatggttaccgaagctagagaaatcgctaagtggtcaccaaatgttgttgttaaaattccaatgactgaagaaggtttagcagcagtttcacaattatcaaaagaaggtataaagacaaatgtgacattaatatttactgtggctcaaggtctttcggcaatgaaagctggtgcaacatttattagtccttttgtgggtcgtcttgaagatattggaacagatgcttatgctttgattcgtgaccttcgtcacattattgatttttatggtttccaatctgagattattgctgctagcattcgtggattggcgcatgtggagggcgtcgctaaatgcggtgcgcacattgccactattccagataaaacatttgcatcactatttactcacccgcttactgataaagggattgaaactttcttaaaagattgggatagtttcaagaagaag

SEQ ID NO: 4602 - protein, 233 aa, Streptococcus agalactiae
MDQMLIMVKKDKNIKENNMKYFLDTADVSEIRRLNRLGIVDGVTTNPTIISREGRDFKEVINEICQIVDGPVSAEVTGLTCDEMVTEAREIAKWSPNVVVKIPMTEEGLAAVSQLSKEGIKTNVTLIFTVAQGLSAMKAGATFISPFVGRLEDIGTDAYALIRDLRHIIDFYGFQSEIIAASIRGLAHVEGVAKCGAHIATIPDKTFASLFTHPLTDKGIETFLKDWDSFKKK

SEQ ID NO: 4603 - DNA, 642 bp, Streptococcus pyogenes
atgaaatttttcctagatacagctaatgtagccgctattaaagcgattaatgaacttggcgttgtagatggtgtcaccaccaatccaaccattatctcacgtgaaggacgtgattttgaaacagttatcaaagaaatctgtgacatcgtcgatggcccaatcagtgctgaagtgacagggctaacagcagatgctatggtagaagaagctagaagcattgctaagtggcatgacaatgtcgtcgttaaaattccaatgactacagaagggttaaaagcaacaaacattctttcaaaagaagggattaaaactaatgtgaccttgattttcacagtaagccaaggtttaatggcaatgaaagcaggcgcaacttacattagcccatttatcggtcgtttggaagatattggcacagatgcttatcaattaatcagcgaccttcgtgaaatcattgacttgtacgatttccaagcagaaatcatcgcagcaagtattcgtacaacagcccatgtggaagctgttgctaaattaggcgcacacattgcgacgattccagaccccttgtttgctaagatgacgcaacatcccttaacgacaaatggtttgaaaacctttatggaagattgggcttcctttaaaaaa

SEQ ID NO: 4604 - protein, 214 aa, Streptococcus pyogenes
MKFFLDTANVAAIKAINELGVVDGVTTNPTIISREGRDFETVIKEICDIVDGPISAEVTGLTADAMVEEARSIAKWHDNVVVKIPMTTEGLKATNILSKEGIKTNVTLIFTVSQGLMAMKAGATYISPFIGRLEDIGTDAYQLISDLREIIDLYDFQAEIIAASIRTTAHVEAVAKLGAHIATIPDPLFAKMTQHPLTTNGLKTFMEDWASFKK

SEQ ID NO: 4605 - DNA, 981 bp, Streptococcus agalactiae
atgtttgagaaggtaaccattagtgatattgcaaatttagtaggtgtgtcaaaagctacagtttcctattatctcaatgggaactataagaaaatgtctctgcaaacgaaagaaaaaatacgtttagctattaaggagactggttatcaaccaagtaagattgctcaaagtttagttacaaaaaatacccgtactattggggtcgttattgctgatattactaatccctttatttcgtctgtgatgaagggaatacatgatacttgtcaacaatttggttactcggttaactttactaactcggataatgatattgacattgagttggaaaatttaaaccgtttaaatcagcaaaacgtttcaggaattattttagattctgtagatcctaatcattcatttatagaaactttgagtaatgatcgtcttgtcatggttgatagacaagctaaagatattaaagtagatactgtagcatccgacaataaagaatcgactcaaatatttcttgaaaaaatgcaagaagctgggtatcatgacatctattttgtcacttatcccattgaagggatttcaacccgtgagcttcgttacgaaggttttaaagaagtggtcagttcaaatcctgataagttgattattatcactgaagatggtagtacacagagaattcttgatatcattgaacattcagagcaaaaaccagggttcttaatgatgaacggtccaactcttttgaattttatgaaaaaattaaatcaatcaacggtcagctaccctgaggattatggtcttgggagttatgaagatttagaatggatgcaggtgcttacaccaaacgtttcctgtataaaacaggattcatatggcattggttgcctggctgcccaatgtttaattgaaaaaattagtcaaggaaacgaaccaactactgcaaggttactagaagtaaaaaatcaaatcgttattcgtcaatctttt

SEQ ID NO: 4606 - protein, 327 aa, Streptococcus agalactiae
MFEKVTISDIANLVGVSKATVSYYLNGNYKKMSLQTKEKIRLAIKETGYQPSKIAQSLVTKNTRTIGVVIADITNPFISSVMKGIHDTCQQFGYSVNFTNSDNDIDIELENLNRLNQQNVSGIILDSVDPNHSFIETLSNDRLVMVDRQAKDIKVDTVASDNKESTQIFLEKMQEAGYHDIYFVTYPIEGISTRELRYEGFKEVVSSNPDKLIIITEDGSTQRILDIIEHSEQKPGFLMMNGPTLLNFMKKLNQSTVSYPEDYGLGSYEDLEWMQVLTPNVSCIKQDSYGIGCLAAQCLIEKISQGNEPTTARLLEVKNQIVIRQSF

SEQ ID NO: 4607 - DNA, 1017 bp, Streptococcus agalactiae
atgaagattaataaattattgtcagacagacttgaagcttgttattcagtttgtcgtttgcaaaatcaagactatgattttttattagtagcttcagaggttgaccaagcctgctttgcttatgatttgaatagcgatttagcaaaaattgttgtttgggaagatgtgggaggtaccatgagtattattccaattcccggaaccatggattttttggcaacccagaaattttacccagggtttaaggccaaagattgtcaggttgtttatgcaagttttcaaggagatcattgggacatttgtaacgcatttgattttccgtatttacatcgctttgatctcattaaaggtaaagaaaatcaactttactttataggttgtacaattgctaacagtaaagcccacactgaggattggagtgataaaggccgaatttttgttgctcgttttaatactcaaaaccatacattggaaggattgcaacaattgcctcaaactttattaaaaaatcatggatactatgccattcaggatgaaggatattcattgattacttcagtagaaggggtattcaaactcacttatccagaattttctactacaggcgactggcaattagaacggcttttcgatgaggagacaagcgatgtggtgaaagtggatattaatcaggatggcaaggatgagtatgtgattatccaaggttttcatggagatcgtttacgcatcttcactgaagatttcggtcgagaattattccattatccagaaaaaacaccatttggtcatgctatttggagtggtcgtttacttaatcagacttgttttgtattcgggtggcgatcagaaaaagcagaattaaggctttttcactttgtagatgggcacttggtttcagaattagtagatgcaaaagcagcttctagtaatgtcttagcttttgaaaaagatggaaaagcttatcttttctcagccaataacggacgtggcgaagttgctctttatcaattagtaaaa

SEQ ID NO: 4608 - protein, 339 aa, Streptococcus agalactiae
MKINKLLSDRLEACYSVCRLQNQDYDFLLVASEVDQACFAYDLNSDLAKIVVWEDVGGTMSIIPIPGTMDFLATQKFYPGFKAKDCQVVYASFQGDHWDICNAFDFPYLHRFDLIKGKENQLYFIGCTIANSKAHTEDWSDKGRIFVARFNTQNHTLEGLQQLPQTLLKNHGYYAIQDEGYSLITSVEGVFKLTYPEFSTTGDWQLERLFDEETSDVVKVDINQDGKDEYVIIQGFHGDRLRIFTEDFGRELFHYPEKTPFGHAIWSGRLLNQTCFVFGWRSEKAELRLFHFVDGHLVSELVDAKAASSNVLAFEKDGKAYLFSANNGRGEVALYQLVK

SEQ ID NO: 4609 - DNA, 954 bp, Streptococcus agalactiae
atggacaagaaaaaaatcttagtaacgggtattgtgcctaaagaaggtctaagaaagcttatggaccgatttgatgttacttattcagaagatcgcccattttcacgtgactatgtgttagagcatttatctgaatatgacggatggttactcatgggacaaaaaggcgataaagagatgattgatgcaggtgaaaacttacaaattatttctttaaatgcggttggttttgatcatgtagatactgcgtatgctaaagaaaaaggaattatagtctctaattcccctcaagcagtacgagttccgacagcggaaatgacttttgctttaattttagctgccagtaagcgccttgcattttatgatagtattgtaagaagtggagagtggattgatccgagcgaacaacgttatcaaggtttgactttgcaaggttcaacattaggtatttacggaatgggacgcatcggtttgacagtcgcaaattttgctaaagcatttgggatgactgttgtttacaatgatgtttatcgacttcctgaagataaggaaaaagagcttggtgtaacctatctcgaatttgatcagcttattaaaacagctgatgtcataaccatccacgccccagcattaccatcaacaatccacaaattcaataaagatgtttttgctaagatgaaaaatcgaagctacttaatcaacgctgctagaggcccaatcgtttctgaagaagcacttattgaagcactgaaagaaggtgaaatcgcgggtgcgggattagatgtttttgagaatgaaccacaggtatctgaaggattgagaagccttgataatgttatcatgagtccacatgctgggacaggtactattgagggacgtagaactttggctgaagaagcagctgacaacatcattgccttctttgatggcaagccacaaaatattgtcaataaa

SEQ ID NO: 4610 - protein, 318 aa, Streptococcus agalactiae
MDKKKILVTGIVPKEGLRKLMDRFDVTYSEDRPFSRDYVLEHLSEYDGWLLMGQKGDKEMIDAGENLQIISLNAVGFDHVDTAYAKEKGIIVSNSPQAVRVPTAEMTFALILAASKRLAFYDSIVRSGEWIDPSEQRYQGLTLQGSTLGIYGMGRIGLTVANFAKAFGMTVVYNDVYRLPEDKEKELGVTYLEFDQLIKTADVITIHAPALPSTIHKFNKDVFAKMKNRSYLINAARGPIVSEEALIEALKEGEIAGAGLDVFENEPQVSEGLRSLDNVIMSPHAGTGTIEGRRTLAEEAADNIIAFFDGKPQNIVNK

SEQ ID NO: 4611 - DNA, 165 bp, Streptococcus agalactiae
gtgagtccaacaccagctcgtaaggcgctaaagaaagctcgccttggattgacctttagaaaaaggctgacaataaaaatcatagcgggtacaacagttgctgcaccaaagacttcaaagaatttatgtaaagcttctagcataagttcacctttattaaattat

SEQ ID NO: 4612 - protein, 55 aa, Streptococcus agalactiae
MSPTPARKALKKARLGLTFRKRLTIKIIAGTTVAAPKTSKNLCKASSISSPLLNY

SEQ ID NO: 4613 - DNA, 1248 bp, Streptococcus agalactiae
atggttaaaactactggtctccatttaccaattgtagatattggttggcaggctggttctctcaccgccttttcttctgagattggcctctctttctttgtttttggcttgctaattgaattggggcttttcttgcttgggattacccgagtatttgtcccatctaatctttggaataactttggctatatgatttggggtacaatggcctatgcagcaacaggtaattttatattgtctttcgcatttatggtttttgtcttactctattcattagtgatgtcagaagtattggcagatcgatggtcggagtattacggtgttaaaaatgcaacgatcaactcgattcataatattgaaacccttattccagctcttattcttgatcctctttggaacctacttggtgtcaataaggtaaagttgaacccagaatcattaaagactaagttagggatatttggtgagccaatgacacttggttttatacttggtgtgattattggtgtattaggtagtttacgtaaccttgcaagtattgatacttggggaggtatacttggttttgcagttgctcttgcagcggttatgactatttttcctttgattacgggggtatttgctagtgcttttgctcctcttgctgaagcagttgaacgcaataagaaaaaagaaagtcaagctgagcaaggagcactggataaaaaacgttggtttattgcagttgatgacggtgttggttttggtgaaccagcaactattatcgcaggtctcattttagtaccaataatggttgttatttccttgattttacctggaaatgaagctttaccagtcgttgaccttattgctatcccttttatgattgaagctatgatagctgtgtcaaaaggaaatattcttaaagctattttgaatggaatcatatggttttcactaggtctttatgctgctagtgccctaggtccaatctacacagaagctgttaagcattttggaactgctttaccagcaggggtaactttgattatgagctttaatctcctagctcatcctttgacagctctagtcttctttgcttggatatctgggaacccactctatattggtgtgacagttgttatctatcttgctttcttgttcttgcttcgtactcatcgtgaatctatttacgcataccttaaaactatggctgataagaatagcggatatgaaggtagttgtgaaaaaatctttattgctgaagat

SEQ ID NO: 4614 - protein, 416 aa, Streptococcus agalactiae
MVKTTGLHLPIVDIGWQAGSLTAFSSEIGLSFFVFGLLIELGLFLLGITRVFVPSNLWNNFGYMIWGTMAYAATGNFILSFAFMVFVLLYSLVMSEVLADRWSEYYGVKNATINSIHNIETLIPALILDPLWNLLGVNKVKLNPESLKTKLGIFGEPMTLGFILGVIIGVLGSLRNLASIDTWGGILGFAVALAAVMTIFPLITGVFASAFAPLAEAVERNKKKESQAEQGALDKKRWFIAVDDGVGFGEPATIIAGLILVPIMVVISLILPGNEALPVVDLIAIPFMIEAMIAVSKGNILKAILNGIIWFSLGLYAASALGPIYTEAVKHFGTALPAGVTLIMSFNLLAHPLTALVFFAWISGNPLYIGVTVVIYLAFLFLLRTHRESIYAYLKTMADKNSGYEGSCEKIFIAED

SEQ ID NO: 4615 - DNA, 987 bp, Streptococcus agalactiae
atgaaaaaaattgatggacatgctcatattgttgatacaattgcaggatttaatggtaaaggacgtcttaatgcccttggaaacggttatgctatttgggatgatggtgatttaattaagctcatcccagacgaatacggtgacaaagcatttacagctgaagcttttttgaagtatatggatgctaatggtgtagataaagcagtcattttgcaaggtcatcttaatggttatcaaaattattatacgcatttagctattaaacgttatccagaacgttttacaggcgcattctctgttgatccatttgcagataacgcaatgcaaattgtaaaacgtcatgttgaagtccttggttttcgagctattaaatttgaaattagtcaaggagggggtatccatggataccgtggacaaaaaacgcctttccgtcttgatacagacccacatgtgagtcgtattttgacttatctgttagactatccaggatttgtagttacagttgattatggcaattgggatcaaattagtcaccaacctgatgctattgctaatttagctcgcctttatacgagtctcgattttgttgtttgtcacctctcttttccacatgttgagcattcaaatcgattgcgtgctgaacttaatatgtggaaaaacttcaacaatatctatactgatatttcagctattcaagatattgatgccccagatagttttccttttccaaaatcagaacaaaatgtacgtattgctaaagaagttcttggggctaagcgtatcatttggggaactgattctccatggtcagcgaccttcaatacttacgaagaattagctacttggctagagaatgttgatattttcagtcaagaggaactagaagatgttatgtacaataatgctgagcgtgtttactttaaagaagaacatgtaaaggctaacagagcaggtatagatgatacaaccaaagagctcaatctctat

SEQ ID NO: 4616 - protein, 329 aa, Streptococcus agalactiae
MKKIDGHAHIVDTIAGFNGKGRLNALGNGYAIWDDGDLIKLIPDEYGDKAFTAEAFLKYMDANGVDKAVILQGHLNGYQNYYTHLAIKRYPERFTGAFSVDPFADNAMQIVKRHVEVLGFRAIKFEISQGGGIHGYRGQKTPFRLDTDPHVSRILTYLLDYPGFVVTVDYGNWDQISHQPDAIANLARLYTSLDFVVCHLSFPHVEHSNRLRAELNMWKNFNNIYTDISAIQDIDAPDSFPFPKSEQNVRIAKEVLGAKRIIWGTDSPWSATFNTYEELATWLENVDIFSQEELEDVMYNNAERVYFKEEHVKANRAGIDDTTKELNLY

SEQ ID NO: 4617 - DNA, 1554 bp, Streptococcus agalactiae
ttgtacctcctttttaaatcaacaatgaggagacaaattatgacttattaccttagtattgactacggcggtacaaataccaaggcgcttatttttgacaaattaggacaccaaatcgctgtttcgagttttgaaactttaaaaaatgagactcaatctggtcatcgtcaagtaaaccttgttaaaacgtggaatgctataacttctgctattagagaggttattcaaatctcaaaactcagccctgagcagattagtgcagtagcatgtattggacatgggaaaggtctttatctgctagataataagttggagccacttgaacaaggaattttgtctacagataatcgtgccaaagatttggcgcaatatttcgaatctaaacttgataatatttgggagttgactcggcaacatattttcccttcacaaagtccagttattttacgttggcttaaagattatcagcccgaaacctataaatcaataggggcggtcctttctgcaaaggactttattcggtataagcttacaggaaaagtacagcaagaatatggtgacgcttcaggtaatcattggataaatttccaaacaggaacttatgatccagctattttagatttttttggcattagagagatagaaaactcacttcctgaacttatagatagtgcagatttagttcctgggggaattagttctcaagcagcaaaagagactggtcttgtagaagggacccccgttgttggagggctctttgacatcgatgcttgtgctcttggatcaggtgttttagagtcagatacttttagtgttatttcgggaacttggaatattaatacatatccaagtttaaaaccagcaaagcaagatagtggtcttatgacttcctattttccagatcgtcgttatctcttagaggcaagtagccctacttctgcagggaatcttaattttatgttaaaaatgctcatgcatcaagaaattgataacgctaaatctagtggaggttctatctatgataatttagaagaatttctcactcatactgatgctacacatcatggacttattttctttccgtttctttacggtagtaacacatcacaagatgctagcgcttgcttttttgggctaacaactaaatcgacgaaatctcagatgatacgtgcggtatatgaaggtattgcgtttgcacataagcagcatatcactgatttaataaaaagtaggggcagtgtgccaaaaataattcgtttctctggcggagctaccaactcaccagcatggatgcaaatgttttctgatatcttaaactttcctattgaaacagtagaaggcacagaattaggagggttaggaggagctattttagcacgtcatgctttagataagatttcgttaaaggaagcagtccaagatatggttcgtgtaaaagctatttataaacctcaattatccgaagtaaaggggtacaaaaaaaaatatcacgcttaccaaaaattattagaaacactggatcctatttggtcggaactcggtcatctgaataag

SEQ ID NO: 4618 - protein, 518 aa, Streptococcus agalactiae
MYLLFKSTMRRQIMTYYLSIDYGGTNTKALIFDKLGHQIAVSSFETLKNETQSGHRQVNLVKTWNAITSAIREVIQISKLSPEQISAVACIGHGKGLYLLDNKLEPLEQGILSTDNRAKDLAQYFESKLDNIWELTRQHIFPSQSPVILRWLKDYQPETYKSIGAVLSAKDFIRYKLTGKVQQEYGDASGNHWINFQTGTYDPAILDFFGIREIENSLPELIDSADLVPGGISSQAAKETGLVEGTPVVGGLFDIDACALGSGVLESDTFSVISGTWNINTYPSLKPAKQDSGLMTSYFPDRRYLLEASSPTSAGNLNFMLKMLMHQEIDNAKSSGGSIYDNLEEFLTHTDATHHGLIFFPFLYGSNTSQDASACFFGLTTKSTKSQMIRAVYEGIAFAHKQHITDLIKSRGSVPKIIRFSGGATNSPAWMQMFSDILNFPIETVEGTELGGLGGAILARHALDKISLKEAVQDMVRVKAIYKPQLSEVKGYKKKYHAYQKLLETLDPIWSELGHLNK

SEQ ID NO: 4619 - DNA, 759 bp, Streptococcus agalactiae
atgaaacaagaagatattattatcaatagtattgtattcaaaaaacagttagacaaaggttttacacaagttcagctcattaagttagtaaaggatttaggattttcacgatttgagatacgtcaagaattgcttcaagatccagatagagagctacccgctttaaaagcagaggctgacttttatgatatcaatctttactatagtgctaatgaagaccttatcaaaggagggaaagttaatccttatcttaataaaggccttaaagaagcatcacagttaggagctcctttcattaagctaaatgttggacaaaccagaaacttaagtaaagaagagttagaacctcttaaagagatattgaaaagccaaactattggtataaaggtggaaaataatcaagaccctaaagcagctacagtggagaattgccaatattttatgactctagtgaaagaattacaaataccaataagttttgtttttgatactgctaattgggcctttatcaaccaagacctataccaagcggtaaataacttagcttgtgataccacctaccttcactgtaaaaattttatacaggtagctggaaagccccacctctcgaagagcctcttcgaaggagagattaatctgactgatttgttaaagagtttctctaattgtgagtatctagctctagaataccccacagagttggagatattaaaaagggatgttcaacgtttaatctctatcagtaatagtcaaaacttt

SEQ ID NO: 4620 - protein, 253 aa, Streptococcus agalactiae
MKQEDIIINSIVFKKQLDKGFTQVQLIKLVKDLGFSRFEIRQELLQDPDRELPALKAEADFYDINLYYSANEDLIKGGKVNPYLNKGLKEASQLGAPFIKLNVGQTRNLSKEELEPLKEILKSQTIGIKVENNQDPKAATVENCQYFMTLVKELQIPISFVFDTANWAFINQDLYQAVNNLACDTTYLHCKNFIQVAGKPHLSKSLFEGEINLTDLLKSFSNCEYLALEYPTELEILKRDVQRLISISNSQNF

SEQ ID NO: 4621 - DNA, 1677 bp, Streptococcus agalactiae
ttgattattctcgataaaaaaagttatgacctcctcttttacctattgaaattagaggaacctgaaacagttatggcaattgccaacgcacttaatcagtctagacgtaaagtgtattatcacttagagaagataaacgatgcactgcctagcgatgtgcctcagattgttagttatccacgtgtaggaatcttgctaacagaaaaacaaaaagcagcctgtcgtcttttattagatgaagtgactgattatagttacgtcatgaaaagtagtgagaggttgcagctgtctttagtatctatcgtagtagctaaggaccgcgtaacgattgataggttgatgcaactaaacgatgtttctcgaaatactatcttaaacgatttaaacgaattaagaagtgagttagcagagaaagaatataatttacagttacaatcaacaaaatgtcgtggttattttttagatggtcacccattgtccattatccagtacttatataagctcttagatgatatctaccataatggaagtagtagttttatagacctttttaatcataaactgtctcaagcttttggtgccagcacttatttttctaaagaggttcttgattattttcatcattatctcttcatttctcaacgaagtctaggtaagaaaatcaacagtcaagatggtcagtttatgattcagattttgccttttatactaatggcttatcgtaagatgcgattaagtcctgaagtacagacctctcttaatagtgattttagcttggtttggcaacgtaaggaatatgagattgctaaagagttggctgatgagctggaagaaaattttcagttatcactggatgagattgaagtgggactagtagccatgcttatgcttagtttccgcaaggaccgtgacaatcatttagagagccaggattatgatgatatgcgagctactctaaccagttttttgaaagaattggaagaacgatatcaccttcactttgttcataaaaaggacttactaagacaacttcttactcactgcaaggcactcttatatcgtaaacgttatggtattttttctgttaatcctttaacagagcatattaaagacaaatatgaagaactttttgccataacctcgtcttctgtaaagcttttagagaaagcttggcaaatcaaattgaccgatgatgatgtagcatatctaacgattcatttaggaggggaacttcgtaatagtcaacaatctcctaataaacttaagttagttattgtatctgatgaaggaatagcgattcagaaacttcttttaaagcaatgtcaacgctacttaacaaatagtgatatagaagctgtttttacaaccgaacagtatcaaagtgtgagtgatcttatgcatgtagatatggttgtctctactagtgatgctttagaatctcgttttccgatgttagtagttcaccctgttttgacagatgatgatattattcgcttgattcgcttttctaaaaaaggtaactgtgcaaatagtaatcaatttaccaatgaacttgaaaaaacaattgctcaatatgtcaaggaagatagtgaacgctacgtgctgaaatctaagattgagaaacttattcatcaagaattgctccaagacgtccttccccttcaaagtacagtttgt

SEQ ID NO: 4622 - protein, 559 aa, Streptococcus agalactiae
MIILDKKSYDLLFYLLKLEEPETVMAIANALNQSRRKVYYHLEKINDALPSDVPQIVSYPRVGILLTEKQKAACRLLLDEVTDYSYVMKSSERLQLSLVSIVVAKDRVTIDRLMQLNDVSRNTILNDLNELRSELAEKEYNLQLQSTKCRGYFLDGHPLSIIQYLYKLLDDIYHNGSSSFIDLFNHKLSQAFGASTYFSKEVLDYFHHYLFISQRSLGKKINSQDGQFMIQILPFILMAYRKMRLSPEVQTSLNSDFSLVWQRKEYEIAKELADELEENFQLSLDEIEVGLVAMLMLSFRKDRDNHLESQDYDDMRATLTSFLKELEERYHLHFVHKKDLLRQLLTHCKALLYRKRYGIFSVNPLTEHIKDKYEELFAITSSSVKLLEKAWQIKLTDDDVAYLTIHLGGELRNSQQSPNKLKLVIVSDEGIAIQKLLLKQCQRYLTNSDIEAVFTTEQYQSVSDLMHVDMVVSTSDALESRFPMLVVHPVLTDDDIIRLIRFSKKGNCANSNQFTNELEKTIAQYVKEDSERYVLKSKIEKLIHQELLQDVLPLQSTVC

SEQ ID NO: 4623 - DNA, 1644 bp, Streptococcus pyogenes
atgatgattttagataaaaagagttatgacttgctgtcttatttacttaaactagaaacacctgagacagttatggccatttctcatgctttaaatcagtcacgtcgtaaagtttattaccagcttgacaaaattaatcaggctttgccaaagggagtagatcagattatctcttatcctagacttggcattcttttaacggcggatcaaaaagctgcttgtcgcttattattagaagaagtgactgattataattatgtcatgaaaagtgatgagcgcagacgactatcctcgatttatattgcggtttccactgagcgcgtgaccattgataaactgatgcagatcaatgatgtgtctcgtaacacgattttaaatgacctgactgagttaagggaagaactggaagacaaacaatacaagattcagcttcatgcgacaaaggctaggggatattattttggttgtcatccaatggctcttattcaatacctgtacaaattgttagtggacgtttaccaaggtggcaatactagctttattgatatattcaaccgtaaactctcagagatacaaggcttatcggtttatttttctaaagatattttgacctattttcatgagtatctttttttatctcaagctagtttaggaaagacaattaatacccaagatagccaattcatgttgcagattttacctttcatgcttttaagttatcgtaatatgcgtcttgattcagaaacaaagtctgctcttaaacaagaatttcatttgatttggaaacgtaaagaatatcacattgctcaggacttagctagagagctttaccataattttaagcttcatttggatgatatcgaagttagtatggtagcgatgttgatgttgtcttttcgaaaagatcaagatcatcacgtggaaagtcaagattacgatgacatgcgagcaaccattagtcactttattgaccagttggagagccgttatcagttacatttcacgcataaacaggatttgctgaagcggttgacgacccattgtaaggcgctcgtttaccgtaaagcttatgggatttttttagttaatcccttaacagaccatgttaaagaaaaatacgaagaattgtttgctatgactcaatcttgtgccactattttggaacaagattggacgattagcttgacagacgatgatattgcctacttgactatccatcttgggggagagctgcgtcacaataatacagagcaagaaaagaccaaactcgttattgtttcagatgatgggataggcattcaaaagttattgttcaaacagtgtcaaaggtatctagcaaatggtcagattgaagctgtttttacgacagaacagtatcagagtgtttacgatcttttagcagtcgatatgattgttgctactacagatacgctaaagactaaaatcccgatgcttattgttaaccctattttaagtgacgatgatatcatcaaattgatacgcttttcaaagcaaggacgcttgagtgagcactcccgcttttctacagagctcacaaaagcaattgaagctgttgtaaaagatgaatcagatcgttatgccttggtttctaaaattgaaaaactcattcatcgcgagctgcta

SEQ ID NO: 4624 - protein, 548 aa, Streptococcus pyogenes
MMILDKKSYDLLSYLLKLETPETVMAISHALNQSRRKVYYQLDKINQALPKGVDQIISYPRLGILLTADQKAACRLLLEEVTDYNYVMKSDERRRLSSIYIAVSTERVTIDKLMQINDVSRNTILNDLTELREELEDKQYKIQLHATKARGYYFGCHPMALIQYLYKLLVDVYQGGNTSFIDIFNRKLSEIQGLSVYFSKDILTYFHEYLFLSQASLGKTINTQDSQFMLQILPFMLLSYRNMRLDSETKSALKQEFHLIWKRKEYHIAQDLARELYHNFKLHLDDIEVSMVAMLMLSFRKDQDHHVESQDYDDMRATISHFIDQLESRYQLHFTHKQDLLKRLTTHCKALVYRKAYGIFLVNPLTDHVKEKYEELFAMTQSCATILEQDWTISLTDDDIAYLTIHLGGELRHNNTEQEKTKLVIVSDDGIGIQKLLFKQCQRYLANGQIEAVFTTEQYQSVYDLLAVDMIVATTDTLKTKIPMLIVNPILSDDDIIKLIRFSKQGRLSEHSRFSTELTKAIEAVVKDESDRYALVSKIEKLIHRELL

SEQ ID NO: 4625 - DNA, 1089 bp, Streptococcus agalactiae
atgcctaacgttaaagatattactagagaatcatggattttatcaacattcccagaatggggtacatggctaaacgaagaaattgaagaagaagttgttgctgagggcaactttgcaatgtggtggttaggaaactgtggtgtttggattaaaacaccaggtggtgctaatgttgttatggacctatggtcaaaccgcggtaaatcaacaaaaaaagtaaaagatatggttcgtggacaccaaatggctaatatggcaggtgttcgtaaactccaaccaaacttacgcgcacaaccaatggttattgatccatttgctattaatgaattggattactatcttgtttcacatttccacagtgaccacattgatatcaacactgcggcagccattattaataatcctaacttagaccatgttaaatttgttgggccatatgaatgtggtgaaatttggaaaaaatggggagttccagaagaacgaatcatcgtgattaaaccaggtgaatcatttgagtttaaagatatcaaagttactgctgttgaatcatttgaccgtacttgcttggtgacacttccagtagatggtgcagaagaacatgatggagaacttgctggtttagccgtgactgatgaagaaatggctcgtaaagcagttaactatatttttgaaacaccaggtggaacaatctatcatggagctgactcacatttttcaaattattttgctaaacatggtaaagactacaagattgacgtagctattaacaactatggtgataacccagttggtattcaggataaaatgacttcaatcgatcttcttcgtatggcagaaaatctccgtgccaaagtcattattcctgtacactacgatatctggtctaacttcatggcttctacagacgaaatcttacaattgtggaaaatgcgtaaagaacgccttcaatatgacttccatccatttatttgggaagttggaggtaaatacacttatccacaagataaagatagaattgaataccatcacccacgtggttttgatgattgcttcgaacaagaatcaaatattcaatttaaagcacttcta

SEQ ID NO: 4626 - protein, 363 aa, Streptococcus agalactiae
MPNVKDITRESWILSTFPEWGTWLNEEIEEEVVAEGNFAMWWLGNCGVWIKTPGGANVVMDLWSNRGKSTKKVKDMVRGHQMANMAGVRKLQPNLRAQPMVIDPFAINELDYYLVSHFHSDHIDINTAAAIINNPNLDHVKFVGPYECGEIWKKWGVPEERIIVIKPGESFEFKDIKVTAVESFDRTCLVTLPVDGAEEHDGELAGLAVTDEEMARKAVNYIFETPGGTIYHGADSHFSNYFAKHGKDYKIDVAINNYGDNPVGIQDKMTSIDLLRMAENLRAKVIIPVHYDIWSNFMASTDEILQLWKMRKERLQYDFHPFIWEVGGKYTYPQDKDRIEYHHPRGFDDCFEQESNIQFKALL

SEQ ID NO: 4627 - DNA, 1089 bp, Streptococcus pyogenes
atgactaaagtacaagatattacacgtgaatcatggatccttaacacgtttccagaatggggaacatggttaaatgaagaaatcgagcaagaagtcgtgccagctgacaactttgcgatgtggtggttaggaaactgtggtatctggattaagacaccaggcggtgctaatgttgtcatggacttatggtcaaatcgtgggaaagcgaccaagcaagttaaggatatggttcgtggacatcaaatggctaatatggcaggagctcgtaaattacagcccaatcttagggcccaaccaatggtgattgatccatttatgattaatgagttggattattatttggtttctcattatcatagtgaccacatcgatatcaatactgcggcagccattatcaataacccaaaacttaatcatgttaaatttgtaggaccttatgaatgtggtgaagtttggaaaaattggggtgtgccaaaagatcgtattatgatcttaaagccaggtgatagctttgaattcaaagatattaagatcaccgctgtagagtcgtttgaccgcacctgtctggtaactctcccaatacaaggagctgatgctcaagatggtgatttagcaggtttagctatcacagatgatgacatggctcgcaaagctgttaactatatttttgaaacaccaggtggtaccatctatcatggtgcggattctcatttttcgaactactttgctaaacatggacgtgattatgatattgacgttgtgttaaataactatggggaaaacccaattgggattcaagacaagatgacttctgttgaccttcttcgtatggcagaaaatctccgtgccaaagtcgttatcccagttcattatgacatttggtcaaactttatggcatcaacagatgaaatccttgaactgtggaaaatgcgcaaagaacgtctccaatatgatttccatccctttatctgggaggttggtggcaagtatacttatccacaagaccaaaatcgtatcgaataccatcatcctcgtggatttgatgactgcttcttagaagattctaatatccaatttaaagctttacta

SEQ ID NO: 4628 - protein, 363 aa, Streptococcus pyogenes
MTKVQDITRESWILNTFPEWGTWLNEEIEQEVVPADNFAMWWLGNCGIWIKTPGGANVVMDLWSNRGKATKQVKDMVRGHQMANMAGARKLQPNLRAQPMVIDPFMINELDYYLVSHYHSDHIDINTAAAIINNPKLNHVKFVGPYECGEVWKNWGVPKDRIMILKPGDSFEFKDIKITAVESFDRTCLVTLPIQGADAQDGDLAGLAITDDDMARKAVNYIFETPGGTIYHGADSHFSNYFAKHGRDYDIDVVLNNYGENPIGIQDKMTSVDLLRMAENLRAKVVIPVHYDIWSNFMASTDEILELWKMRKERLQYDFHPFIWEVGGKYTYPQDQNRIEYHHPRGFDDCFLEDSNIQFKALL

SEQ ID NO: 4629 - DNA, 2412 bp, Streptococcus agalactiae
atgttactaaaatcacaattaagattaggagaaataatgtcagaatttgatacaaaatcatatttagaaaaacttgatgcatggtggagagcagctaattatatttctgcagcacaaatgtatctaaaggataaccctctcttgagacgagagctggttgaaaacgacttaaaggttcatccaattggtcactggggcactgtacctggacaaaattttatctatgctcacttaaatcgcgctattaataaatacgatttagacatgttctatattgaaggtccaggtcatggtggtcaagttatggtatctaattcatatttagatggttcatatactgaattaaacccaaatattgagcaaacagaggatggctttaagcagttatgtaaaatcttctctttcccatgtggaattgcatcccatgctgcaccagaaacaccagggtcaattcatgaaggcggtgaacttggttacgcactttctcatgcgacaggtgccatcctagacaatccagatgttattgctgcgactgttattggtgatggtgaaggtgaaacaggaccacttatggctggttggctatctaatacctttatcaatccagtaaatgatggtgctgttctaccaatcttctatttaaatggtggtaaaatccataacccaactatctttgaacgtaagacagatgaagaattatctcagttttttgaaggattaggttggaaacctatttttgcagatgttgttgaactctctgaggatcatgcggctgctcatgctttgtttgcagaaaaattagatcaagctattcaagagattaaaaccattcaatcagaagcacgacaaaaaccagcagaagaagctatccaagcaaaattccctgtcttagttgcacgtattcctaagggttggactggtccaaaagcttgggaaggaacaccaattgaaggtggcttccgcgctcaccaagtaccaattccagtagatgcccaccatatggaacatgttgattctcttttgtcatggcttcaatcataccgtccagaagaattatttgatgaaaatggtaaaatcgttgatgagattgctgctatttcaccaaaaggtgatcgtcgcatgtccatgaatccaataaccaatgctggtattgttaaagcaatggatacagcagattggaagaaatttgctcttgatattaatgttccaggtcaaattatggcacaagatatgattgaatttggaaaatatgcagcagatttggtagatgctaatccagataatttccgtatttttggtccagatgaaacgaaatcaaatcgtcttcaagaagtgtttacacgtactagccgtcaatggcttggtcgtcgtaaaccagattatgacgaagctttaagtccagctggacgtgttattgattcccaattgtctgaacaccaagcagaaggtttcttagaaggttatgttttaactggtcgtcacggcttctttgcttcatacgaatcattccttcgcgttgtagattcaatggtaacacaacatttcaaatggttacgtaaatcaaaaacacacacaacatggcgtaaaaattatccagcgcttaacctaattgcagcttcaactgttttccaacaagatcataatggttatactcaccaagatccaggtattttaactcatttagctgaaaaaacacctgaatacattcgtgaatatttaccagcagatactaactcacttctagctgttatggataaagcgtttaaagctgaagataaaattaatttaattgtgacatctaagcaccctcgtccacaattttactctattgctgaagcagaagagttagtggcagaaggatataaggtgattgactgggcttcaaatgtgtcgcttaatcaagagccagatgttgtctttgctgcggcgggaacagaacctaacttagaagctttggcagctattagcattcttcataaggctttcccagaacttaagattagatttgttaatgtattagacatcctaaaacttcgtcatccttcacaagatgctcgcggtttatcagatgaagagtttaacaaagtctttaccacagataaacctgttatttttgctttccatggttatgaagatatgattcgagatattttctttagtcgtcacaatcataatttgcatacgcatggttaccgtgaaaatggtgacatcacaacaccatttgatatgcgcgtgatgtcagaattggaccgattccatctggcacaggatgcagctcttgcttctttaggaaataaagcacaagccttcagtgatgaaatgaatcaaatggttgcttatcacaaagactatattcgtgaacacggagacgatattccagaagtacaaaattggaaatgggaaaatatcaag

SEQ ID NO: 4630 - protein, 804 aa, Streptococcus agalactiae
MLLKSQLRLGEIMSEFDTKSYLEKLDAWWRAANYISAAQMYLKDNPLLRRELVENDLKVHPIGHWGTVPGQNFIYAHLNRAINKYDLDMFYIEGPGHGGQVMVSNSYLDGSYTELNPNIEQTEDGFKQLCKIFSFPCGIASHAAPETPGSIHEGGELGYALSHATGAILDNPDVIAATVIGDGEGETGPLMAGWLSNTFINPVNDGAVLPIFYLNGGKIHNPTIFERKTDEELSQFFEGLGWKPIFADVVELSEDHAAAHALFAEKLDQAIQEIKTIQSEARQKPAEEAIQAKFPVLVARIPKGWTGPKAWEGTPIEGGFRAHQVPIPVDAHHMEHVDSLLSWLQSYRPEELFDENGKIVDEIAAISPKGDRRMSMNPITNAGIVKAMDTADWKKFALDINVPGQIMAQDMIEFGKYAADLVDANPDNFRIFGPDETKSNRLQEVFTRTSRQWLGRRKPDYDEALSPAGRVIDSQLSEHQAEGFLEGYVLTGRHGFFASYESFLRVVDSMVTQHFKWLRKSKTHTTWRKNYPALNLIAASTVFQQDHNGYTHQDPGILTHLAEKTPEYIREYLPADTNSLLAVMDKAFKAEDKINLIVTSKHPRPQFYSIAEAEELVAEGYKVIDWASNVSLNQEPDVVFAAAGTEPNLEALAAISILHKAFPELKIRFVNVLDILKLRHPSQDARGLSDEEFNKVFTTDKPVIFAFHGYEDMIRDIFFSRHNHNLHTHGYRENGDITTPFDMRVMSELDRFHLAQDAALASLGNKAQAFSDEMNQMVAYHKDYIREHGDDIPEVQNWKWENIK

SEQ ID NO: 4631 - DNA, 1221 bp, Streptococcus agalactiae
atgacaaatattttagaagtgaagaatttaaccaaaatttttgggaaaaagcaaaaagctgctcttgaaatggttaagcaaggaaaaagtaagacagaaattcttgaaaaaacaggagcgactgtaggtgtctatgatgcgagttttgaaataaaagaaggcgaaattttcgttatcatgggactttctggttcaggaaaatcaactttagttcggatgttaaaccgtttgattgacccatcatcaggaaatatctatttagatggtaaagatattgcaaagatgaatgtagaagatttacgtaacattcgtcgtcatgatatcaacatggttttccaaaattttggtcttttcccacatcgtacaattttagaaaatacagagtttgggttagagatgcgtggtgtttctaaggaagaacgtacaacgttagctgaaaaagctttggacaatgcaggtctattaccgtttaaagatcagtaccccagtcaattatcaggaggaatgcaacagcgtgttggtttagcacgtgcccttgctaacagccctaaaatccttctgatggatgaggccttctcagctttagacccattaattcgtcgtgaaatgcaagatgagcttcttgatcttcaagacacgaataaacaaactattatttttatcagccatgatttgaatgaagcgttacgtattggtgatcgtattgctctgatgaaagatggagaaatcatgcagattggtacaggagaagagattttgactaatccggctaatgattttgttcgtgagtttgttgaagacgttgatcgctcaaaagtgttaactgctcaaaatattatgataaaacctttaacaactgttttagaaattgatggcccacaagttgctttaacaagaatgcatcgtgaggaagtctcaatgttaatggcaacgaatcgtcgtcgccaacttctgggatccctaactgcagatgctgcaattgaagctcgtaagaaagatttgccgctttctgaagtgattgataaagatgttgtaacggtctcaaaagatacagttattacagatatcatgcctttaatttatgattcatctgctccgatagccgttactgatgataatgatagactcctaggggttatcattagaggacgtgtgatcgaagcacttgctaacgttcaagatgaaacagtagtagaatcgccaaaagaaacggtagaagct

SEQ ID NO: 4632 - protein, 407 aa, Streptococcus agalactiae
MTNILEVKNLTKIFGKKQKAALEMVKQGKSKTEILEKTGATVGVYDASFEIKEGEIFVIMGLSGSGKSTLVRMLNRLIDPSSGNIYLDGKDIAKMNVEDLRNIRRHDINMVFQNFGLFPHRTILENTEFGLEMRGVSKEERTTLAEKALDNAGLLPFKDQYPSQLSGGMQQRVGLARALANSPKILLMDEAFSALDPLIRREMQDELLDLQDTNKQTIIFISHDLNEALRIGDRIALMKDGEIMQIGTGEEILTNPANDFVREFVEDVDRSKVLTAQNIMIKPLTTVLEIDGPQVALTRMHREEVSMLMATNRRRQLLGSLTADAAIEARKKDLPLSEVIDKDVVTVSKDTVITDIMPLIYDSSAPIAVTDDNDRLLGVIIRGRVIEALANVQDETVVESPKETVEA

SEQ ID NO: 4633 - DNA, 1194 bp, Streptococcus pyogenes
atggaaacaattttagaagtcaaacatctcagtaaaatttttggcaaaaaacaaaaagcagctcttgagatggtaaagactggcaaaaataagagtgagatttttaagaaaacaggcgctactgtaggtgtctatgacgctagttttgaggtcaaaaaaggtgaaatctttgttattatggggctatcaggaagtgggaaatcaacccttgtccgcatgctaaatcgtttgattgaaccttcagcaggatctatcttgctggaaggtaaagacatctcaaccatgtcagcagatcagctgcgtgaggtgcgccgccatgacattaacatggttttccaaagctttgccctctttcctcataaaaccattttggaaaataccgaatttggtttggaattacgtggcgttcccaaagaagaacgccagcgattggcagaaaaagcccttgataattcaggcctattagattttaaagaccagtacccaaaccaactatctggtgggatgcagcagcgtgtcggcctagcccgtgcgctagctaatagccctaaaattctcttaatggacgaggcattctcagcgcttgatcctttgattcgtcgtgagatgcaagatgaattacttgatttgcaagacagcatgaaacaaaccatcatctttatcagtcatgacttgaatgaagccttgcggattggtgatcggattgctttgatgaaagacggacaaattatgcaaattggtactggtgaggaaatcttgactaacccagccaatgactttgtgcgtgaattcgttgaggatgtggaccgttctaaagtcttgacagcacaaaatatcatgatcaaaccgttaacaactactgttgaattagatggacctcaagttgccttgaaccgtatgcacaacgaagaggtgtctatgttgatggcgacgaatcgccgccgccaattagtcggtagtttgacggccgatgccgctatagaggcgcgcaaaaaagggttaccgctatcagaagtgattgatcgcgatgtgagaactgtctcaaaagatactattattacagatattttgcctcttatctatgattcatctgctccgattgcagtgacagatgataataatcgtctgttaggtgtcattattcgaggacgagtgattgaagccttggctaatatctcagacgaagaccttaac

SEQ ID NO: 4634 - protein, 398 aa, Streptococcus pyogenes
METILEVKHLSKIFGKKQKAALEMVKTGKNKSEIFKKTGATVGVYDASFEVKKGEIFVIMGLSGSGKSTLVRMLNRLIEPSAGSILLEGKDISTMSADQLREVRRHDINMVFQSFALFPHKTILENTEFGLELRGVPKEERQRLAEKALDNSGLLDFKDQYPNQLSGGMQQRVGLARALANSPKILLMDEAFSALDPLIRREMQDELLDLQDSMKQTIIFISHDLNEALRIGDRIALMKDGQIMQIGTGEEILTNPANDFVREFVEDVDRSKVLTAQNIMIKPLTTTVELDGPQVALNRMHNEEVSMLMATNRRRQLVGSLTADAAIEARKKGLPLSEVIDRDVRTVSKDTIITDILPLIYDSSAPIAVTDDNNRLLGVIIRGRVIEALANISDEDLN

SEQ ID NO: 4635 - DNA, 1725 bp, Streptococcus agalactiae
ttggaaaatttattacaacataagttaccggtcgcaccatttgtagagtcaacgaccaattggattacgaaaactttttctggtttatttgactttatccagacaatcggtaatgcattgatggattggatgacaaaaacattactattcattaatcctttactttttattgtactaattacaattgctgtatttttcttagctaagaaaaaatggcaattaccgacatttactttcattggtttgctatttatctataaccaagggctgtgggaacagttgattaatacttttaacttggttttagtagcaagtttaatttctattattattggtgtaccactaggtatttggatggcaaaaagtgataaagttaaacaagttgttaatccaattcttgactttatgcaaactatgccggcattcgtttaccttattcctgcagtagccttctttggtatcggtatggtaccaggtgtctttgcctctgttgtatttgctctgcctccaacagtgcgctttactaacttggctattcgtgaaatcccacttgaattaatagaagcatctgattcatttggttcaacagttaagcaaaaattattcaaagttgaactaccacttgctaagaacactattatggcaggaatcaatcaaactatgatgttggctctttctatggtggttacaggatctatgatcggtgcacctggacttggtcgtgaggtgttatcggcgcttcaacatgctgatattggtacaggatttgttagtggtctatcgctagttattttagcaatcgtgttagaccgtgttagtcaattctttaattccaaaccgggtgagaagcaagctaaaacatcaaaagttaaaaaatgggtaggtttaggggccctggctctcttcattctagcagctcttggtcgcattgttgtcaatatgacttcaggaaatgaagccaaaggtcaaaaagtgaagatagcttatgtccaatgggattcagaagttgcttcaaccaacgttattgctgaagttttaaaatctaaaggatatgatgttgaattgacaccacttgacaatgcggtcatgtggcaaacagtcgccaatgggaatgctgattttacaacaagtgcttggttaccaaagacccacgggcaatattttaataaatacaaaaatagtttagatgacttaggtcctcacgttgagaacgtcaaaataggtttagttgttcctaaatacatgaacgtaaatagtattgaagaattatcaaatcaagcagataaacaaattacaggtatcgaaccaggtgcaggtattatgaagtctgctaaacaatcccttaaagattatccaaacctttcaagttggaagttgttatcagcatcaacaggagctatgacaacaaccttagggaaggctatcaaaaacaaagatcaagtagtcattacaggttggtcacctcactggatgtttgctaagtatgatttaaaataccttaaagatcctaagaaatcatttggtggtgaagaacatatcaatacaatagcacgcaagaatttgaaaaaagatatgccaaaagtatataaaattatcgataagttcaagtggactaaagaagatatggaatctatcatgttagatatggataaaggtatggagcctgctaaagcagctcaaaaatggattaaaaaccacaaaaaagaagtttcagagtggactaaa

SEQ ID NO: 4636 - protein, 575 aa, Streptococcus agalactiae
MENLLQHKLPVAPFVESTTNWITKTFSGLFDFIQTIGNALMDWMTKTLLFINPLLFIVLITIAVFFLAKKKWQLPTFTFIGLLFIYNQGLWEQLINTFNLVLVASLISIIIGVPLGIWMAKSDKVKQVVNPILDFMQTMPAFVYLIPAVAFFGIGMVPGVFASVVFALPPTVRFTNLAIREIPLELIEASDSFGSTVKQKLFKVELPLAKNTIMAGINQTMMLALSMVVTGSMIGAPGLGREVLSALQHADIGTGFVSGLSLVILAIVLDRVSQFFNSKPGEKQAKTSKVKKWVGLGALALFILAALGRIVVNMTSGNEAKGQKVKIAYVQWDSEVASTNVIAEVLKSKGYDVELTPLDNAVMWQTVANGNADFTTSAWLPKTHGQYFNKYKNSLDDLGPHVENVKIGLVVPKYMNVNSIEELSNQADKQITGIEPGAGIMKSAKQSLKDYPNLSSWKLLSASTGAMTTTLGKAIKNKDQVVITGWSPHWMFAKYDLKYLKDPKKSFGGEEHINTIARKNLKKDMPKVYKIIDKFKWTKEDMESIMLDMDKGMEPAKAAQKWIKNHKKEVSEWTK

SEQ ID NO: 4637 - DNA, 1725 bp, Streptococcus pyogenes
ttggaaacgatattacaaacaaaattaccagtagctcaactggtggagcagctaacggagtggctaactaaaactttctcaggtctatttgatattatgcaagtagttggtagctttttgatggattggatgaccaaaacacttttatttatccacccgttactttttattgttctagtaacagcagggatgtttttccttgctaagaaaaaatggcctttgccaacctttaccttgttaggattgctctttatttacaatcaagggttatggaagcagctaatgaatacctttactctggtgttagtagctagtttgatttcggtacttattggtattccgctggggatttggatggctaaaaatgccactgtccgtcagattgtgaatcctattttggactttatgcaaaccatgccggcttttgtttacttgattcctgccgttgccttttttggtattggtatggtgcctggagtatttgcttcagtcatctttgccttaccaccaacggttcgtttcacaaatttggccattcgtgacattccaacagaattgattgaggcctcagatgcctttgggtcaactgggaaacaaaagctctttaaagtggaattgcctttagctaaaaatactattatggcaggtgttaatcagaccatgatgttagccctttccatggtagtaacaggctccatgattggtgctcctggtttaggacgtgaagtcttgtcagcccttcaacacgctgatattggtagtggatttgtcagtggtcttgccttggttatcttggcgattgtgcttgaccgtatgacacagttgttcaatagcaaacctcaagaaaaagccaaagctggcaaaaccaataaatggattggtttagcagcccttgctgtctttttgatagctgctttaggacgcggtattatggctatgacttctggtatggcagataagggtgaaactgttaacatcgcttacgtgcagtgggattctgaggttgcctcaactcatgtgattgcagaagttttgaaaaacgaaggttaccatgtgaccttgactccgcttgacaatgccgttatgtggcaaaccgttgcaaatgggaacgctgatttttcaactagtgcttggttgccagtcacccatggccaacaatatcagaaatacaagtcaaaattagatgatttaggacctaacctaaaagggaccaaacttggtttagctgttccaaaatacatgacagatgtcaatagtattgaggacttaagcaaacaagccgatcaaaaaatcacagggatcgaaccaggtgcaggtatcatggcagcagcccaaaagactctaaaagagtatcataatctatctagttgggagttagtggcggcatcaacaggagccatgacgacttccttggatcaagcgatcaagaaaaaagatcctattgttgtgacagcttggtcaccacactggatgtttgccaagtatgacttgaagtaccttaaagatcctaaagaaatctttggctcgactgagaacatcaataccattgctcgtaaaggcttgaaaaaagaacttccaaatgtctacaaaatcattgataagttccactggacccaaaaagatatggaagcagtcatgcttgacatcaacaaaggcatgagtccagaagctgccgccaaaaaatgggtagaggcaaacaaatctaaagtatcaagttggacaaaa

SEQ ID NO: 4638 - protein, 575 aa, Streptococcus pyogenes
LETILQTKLPVAQLVEQLTEWLTKTFSGLFDIMQVVGSFLMDWMTKTLLFIHPLLFIVLVTAGMFFLAKKKWPLPTFTLLGLLFIYNQGLWKQLMNTFTLVLVASLISVLIGIPLGIWMAKNATVRQIVNPILDFMQTMPAFVYLIPAVAFFGIGMVPGVFASVIFALPPTVRFTNLAIRDIPTELIEASDAFGSTGKQKLFKVELPLAKNTIMAGVNQTMMLALSMVVTGSMIGAPGLGREVLSALQHADIGSGFVSGLALVILAIVLDRMTQLFNSKPQEKAKAGKTNKWIGLAALAVFLIAALGRGIMAMTSGMADKGETVNIAYVQWDSEVASTHVIAEVLKNEGYHVTLTPLDNAVMWQTVANGNADFSTSAWLPVTHGQQYQKYKSKLDDLGPNLKGTKLGLAVPKYMTDVNSIEDLSKQADQKITGIEPGAGIMAAAQKTLKEYHNLSSWELVAASTGAMTTSLDQAIKKKDPIVVTAWSPHWMFAKYDLKYLKDPKEIFGSTENINTIARKGLKKELPNVYKIIDKFHWTQKDMEAVMLDINKGMSPEAAAKKWVEANKSKVSSWTK

SEQ ID NO: 4639 - DNA, 1179 bp, Streptococcus agalactiae
atgagtttatccatcatgacaaaacacaaacacctaactctcttagaccgtaatgacatccaatctggtttggatagaggagaaacctttaaagccatcgggcttaatctactgaaacaccctactactatcgcaaaagaagtcaaacgaaataagcaactaagagaatcaaccaaagactgcctagactgtccgctactaagaaaagctccctatgtttgtaatgggtgtccaaagaggaggatcaactgtggttacaagaagaccttctatcttgctaagcaagctcaaagaaactatgaaaaacttttagttgaatctagagaaggaatccctttgaacaaagagaccttctggaaaatagatagagtgctttctaatggggtcaagaagggccaacgtatctatcatatcctcaaaaccaacgatctagaagtgagttcttcaaccgtttatcgacacatcaagaaaggctacctatccatcacaccaatcgacctacccagagctgtgaagttcaaaaaaaggcgaaagagcacactccctcctattccaaaagcgattaaagaagggcgacggtacgaggattttatagaacacatgaaccaatcagagctgaactcctggcttgaaatggacacggttattggacggattggtggaaaggtccttctcaccttcaatgtcgccttctgtaacttcatctttgccaaactgatggattctaagacagctatcgaaactgctaaacacatacaggtcattaagaggacactctatgataacaagagagacttcttcgaactctttcctgttatcctaacggataatggtggggaattcgctagagtggatgatattgagatagatgtttgtggacagtctcaactcttcttttgtgaccctaatcggtctgaccagaaagcaagaatcgagaagaatcataccctcgtgagagacatactgcctaaggggacttccttcgacaacttgactcaagaggacattaatctggcactatctcatatcaacagcgttaagagacaggctctaaatggtaaaacggcttatgagctattctcttttacttacggaaaagacatcgcaagtatactcggtattgaggaaattactgcggaagacgtctgccaatctcccaaactattaaaagacaaaatc

SEQ ID NO: 4640 - protein, 393 aa, Streptococcus agalactiae
MSLSIMTKHKHLTLLDRNDIQSGLDRGETFKAIGLNLLKHPTTIAKEVKRNKQLRESTKDCLDCPLLRKAPYVCNGCPKRRINCGYKKTFYLAKQAQRNYEKLLVESREGIPLNKETFWKIDRVLSNGVKKGQRIYHILKTNDLEVSSSTVYRHIKKGYLSITPIDLPRAVKFKKRRKSTLPPIPKAIKEGRRYEDFIEHMNQSELNSWLEMDTVIGRIGGKVLLTFNVAFCNFIFAKLMDSKTAIETAKHIQVIKRTLYDNKRDFFELFPVILTDNGGEFARVDDIEIDVCGQSQLFFCDPNRSDQKARIEKNHTLVRDILPKGTSFDNLTQEDINLALSHINSVKRQALNGKTAYELFSFTYGKDIASILGIEEITAEDVCQSPKLLKDKI

SEQ ID NO: 4641 - DNA, 699 bp, Streptococcus agalactiae
  misc_feature (1)..(699): n = a, c, g, or t
atgaaaaaagaaagtatatctattaaagatatcttgtggtttattattccgtcgttatttggagtattattattaatgactccatttaaatataatggtatgacaacagtagctgtctctgtaatctctaagacaattaatcaatggattaacgctgtttttcctatacattatattattttactaatcatttttatttcatgtgtgttagcactttgttatcgtctgtttagacctagctttattgaaaaaaatgacttgctaaaagaaatttctgacattaccattttctggctgattattcgtttgatcggtttggcacttggtctgatgacggttttacatattggtcctgaaatggtatgggggaaagagacaggcggccttatcctttttgatttgattggtggtttgtttaccattttccttgctgcgggttttattcttccatttttgacagaatttggtctactggagtttgttggtgtcttcctaactcccattatgcgtccattctttcagctacctggtcggtcagcagttaattgtgtagcctcatttgtaggtgatggtactattggaattgctttgaccgataagcagtatgttgagggttattataccagtagagaagctgcaacgatttccactactttttcagcagtatcaatcactttttgtcttgnnnnnttaattaat

SEQ ID NO: 4642 - protein, 233 aa, Streptococcus agalactiae
  MISC_FEATURE (1)..(233): Xaa = Any Amino Acid
MKKESISIKDILWFIIPSLFGVLLLMTPFKYNGMTTVAVSVISKTINQWINAVFPIHYIILLIIFISCVLALCYRLFRPSFIEKNDLLKEISDITIFWLIIRLIGLALGLMTVLHIGPEMVWGKETGGLILFDLIGGLFTIFLAAGFILPFLTEFGLLEFVGVFLTPIMRPFFQLPGRSAVNCVASFVGDGTIGIALTDKQYVEGYYTSREAATISTTFSAVSITFCLXXLIN

SEQ ID NO: 4643 - DNA, 1125 bp, Streptococcus agalactiae
atgcatattatcattcaaattacaatcattttgttggcaagcgttcttgcaactcttatttcaaaaagaattggaataccggctgttgttggacaactacttgtaggtatcatcatcggacctgcaatgctaggacttgttcatcaaaatcaggtattacatgtcttgtcagaaattggtgttatcttactcatgtttttagcgggtcttgaagctaattttgatcttttaaagaagtatcttaagcccagtctactggtcgcaattactggtgttattgttcctatggctctcttctacttcttgacacgcttgtttgggttccaaatcaatactgctatcttttacgggctcgtatttgctgcaactagtatttctatcacagttgaagttttacaagaatacaatcgtgtaaaaacagatactggtgctattattttaggtgctgctgttgctgatgatgtcttagctgttttgcttctgagtgtctttattgcaacaaatggaagctcttctaatatcggattacaaattatcattcaattgttattctttgttttcttatttatttgtatgaaataccttgtacctgctcttttcaaattaatcgaaaaggttcatttctttgagaaatatactattcttgctatccttatctgtttttctctatcaattttagccgataaagttggaatgagttctatcattggttcgttttttgcaggattagctattggacaaacttcttttgttgataaggtagaacataaaatttcacttcttagttacaccttctttatcccaattttcttcgcttcaattgcactacctcttaaattcgatggaatgatgtctcaccttcacacgatattaatctttactgctttggctgttttatcaaaattaattccagggtactttgtcggtcgaggctttaatttttcaaaattagaatctttaacaattggtggtggaatggtcagtcgtggcgagatggctctcattatagttcaagttggattagctgctaaaattatttcaagcactacttattccgagcttgttattgttgttatactatcaactattattgcgccatttattcttaaatattcatttaaagat

SEQ ID NO: 4644 - protein, 375 aa, Streptococcus agalactiae
MHIIIQITIILLASVLATLISKRIGIPAVVGQLLVGIIIGPAMLGLVHQNQVLHVLSEIGVILLMFLAGLEANFDLLKKYLKPSLLVAITGVIVPMALFYFLTRLFGFQINTAIFYGLVFAATSISITVEVLQEYNRVKTDTGAIILGAAVADDVLAVLLLSVFIATNGSSSNIGLQIIIQLLFFVFLFICMKYLVPALFKLIEKVHFFEKYTILAILICFSLSILADKVGMSSIIGSFFAGLAIGQTSFVDKVEHKISLLSYTFFIPIFFASIALPLKFDGMMSHLHTILIFTALAVLSKLIPGYFVGRGFNFSKLESLTIGGGMVSRGEMALIIVQVGLAAKIISSTTYSELVIVVILSTIIAPFILKYSFKD

SEQ ID NO: 4645 - DNA, 960 bp, Streptococcus agalactiae
atgagtattaaaaagctattgtttgcaggccttgcttttattttatttaccctagcgagtccagcatatgctgcatcagatgttcagaaagttattgatgaaacttatgttcaacctgattatgtcttaggttattcgctaaatcaagaacagcgtgcacagacattacaacttctgaattatgatgaatctagagacacgaaagttaaaacgctaaatactagctcatatgctaaaataatgaatatagctgatgatgcaagcatccaattatattcatctgttaaaataaaaaaattagggtctaacgataccttagcagtaaacattgttacacctgagaatattactaaagttacagaagatatgtatcgcaatgctgcagttacattaggtattgagcatgcaacgatatcagtggctgctccaataaaagtaactggggagagtgctcttgcaggtatctattattcattagagaaaaatggagcaagtgtatcatcagaaaataaacaactagcacaagaagagttaagtactttatctggtattaatgctgagaataagggtaaggaaggttatgacgccgacaagcttaatgtagctttaacggatattaagtcagccgtagctaaaggaggatctgatctttcaaaagatgatattcgaaaaattgttgaggaaacattgaaaaattatcatcttgataacgctgtaacggaaaatcaaataaatttaattgttaattttgcagttaatctttcacaaagtaatgtcatcaaaaatagtgatttcacgaacaccttgaataatttgaaagacaacattgtttcgaaagcaggatctaaatttaaaaatatcaatgtcaattttaatgctaataaagctgttgaatcaggtaagggatttttagctaatatttggcaacaaattgttaattttttccagcagtttggtagt

SEQ ID NO: 4646 - protein, 320 aa, Streptococcus agalactiae
MSIKKLLFAGLAFILFTLASPAYAASDVQKVIDETYVQPDYVLGYSLNQEQRAQTLQLLNYDESRDTKVKTLNTSSYAKIMNIADDASIQLYSSVKIKKLGSNDTLAVNIVTPENITKVTEDMYRNAAVTLGIEHATISVAAPIKVTGESALAGIYYSLEKNGASVSSENKQLAQEELSTLSGINAENKGKEGYDADKLNVALTDIKSAVAKGGSDLSKDDIRKIVEETLKNYHLDNAVTENQINLIVNFAVNLSQSNVIKNSDFTNTLNNLKDNIVSKAGSKFKNINVNFNANKAVESGKGFLANIWQQIVNFFQQFGS

SEQ ID NO: 4647 - DNA, 411 bp, Streptococcus agalactiae
atgaaattaaaggctgttcatcatattgcgataattgtttctgactatgaaaagtcaaaagacttctatgttaataagctaggatttgaaattattcgtgaaaaccatcgtccggagcgtcatgattataaattagatttacggtgcggtgatattgagcttgaaatatttggaaatcgtcttgatgatccagaatatgaaactcctcctcagagaataggtaggccgaattggccacgtgaagcatgtggtttacgacaccttgccttttacgttccagatgtggaagcgtacaaggtagaactggagaatttaggaatttttgtagagcctattcgttacgatgactatactggcaaaaagatgacctttttctttgatccagatggtttacctttagaattacatgaa

SEQ ID NO: 4648 - protein, 137 aa, Streptococcus agalactiae
MKLKAVHHIAIIVSDYEKSKDFYVNKLGFEIIRENHRPERHDYKLDLRCGDIELEIFGNRLDDPEYETPPQRIGRPNWPREACGLRHLAFYVPDVEAYKVELENLGIFVEPIRYDDYTGKKMTFFFDPDGLPLELHE

SEQ ID NO: 4649 - DNA, 414 bp, Streptococcus pyogenes
atgatgaaactaaatgccattcatcacgttgctattattgtatctgattatcatctgtcaaaagatttttatgtgaataaactcggatttgaaattatcagagaaaattatcgtcctgacaagcatgattacaaattagatttatcttgtggtcgtattgaattggagatttttggtaaggtgacaagtgaccccaactatcaagctcctcctaaacgtgtaagtgaaccagaatttaaaagtgaggcctgtggtttgaggcaccttgcatttcgtgttaccaacattgagagttatgtagatgatctaaagagcttaggaattccagtggagcctatcaggcatgatgattacacaggtgagaaaatgactttcttttttgatccggatggtttgcctttagaattacatgaa

SEQ ID NO: 4650 - protein, 138 aa, Streptococcus pyogenes
MMKLNAIHHVAIIVSDYHLSKDFYVNKLGFEIIRENYRPDKHDYKLDLSCGRIELEIFGKVTSDPNYQAPPKRVSEPEFKSEACGLRHLAFRVTNIESYVDDLKSLGIPVEPIRHDDYTGEKMTFFFDPDGLPLELHE

SEQ ID NO: 4651 - DNA, 741 bp, Streptococcus agalactiae
atgcgtaataaaaaaaaatcacatggtttctttaactttgttagatggttattggttgtattgctaattattgttgggttggctttggtgttcaataaaccaattcgcaatgctttcatagctcatcaatcaaatcattatcaaatttcacgagttagtaaaaaaacaattgaaaaaaataagaaatctaaaacaagttatgacttttcatcagtcaaatctattagtacagaatcgattttatctgctcaaacgaaatcacataatttgcctgtaataggagggattgctataccagatgtcgaaatcaatctcccaattttcaaaggactgggcaatacagagttgagttatggtgcaggaacgatgaaagaaaaccagattatgggaggcccaaataactatgccttagctagtcaccatgtctttggtttgacaggttcttctaagatgctcttttcacctttagaacatgctaagaaaggtatgaaagtttacctcactgataaaagcaaagtatacacttacactattactgaaatttcaaaggtaacaccagaacatgttgaggttattgatgatacacctggcaagagccaactcactttagtgacctgtacggatccagaagccacagaacgtattattgtgcatgctgaattagaaaaaacaggtgaattttcaacagcagatgagtcgatattaaaagcattttcgaaaaaatataatcaaattaatctc

SEQ ID NO: 4652 - protein, 247 aa, Streptococcus agalactiae
MRNKKKSHGFFNFVRWLLVVLLIIVGLALVFNKPIRNAFIAHQSNHYQISRVSKKTIEKNKKSKTSYDFSSVKSISTESILSAQTKSHNLPVIGGIAIPDVEINLPIFKGLGNTELSYGAGTMKENQIMGGPNNYALASHHVFGLTGSSKMLFSPLEHAKKGMKVYLTDKSKVYTYTITEISKVTPEHVEVIDDTPGKSQLTLVTCTDPEATERIIVHAELEKTGEFSTADESILKAFSKKYNQINL

SEQ ID NO: 4653 - DNA, 747 bp, Streptococcus pyogenes
atggtaaaaaaacaaaagcgtcgaaaaataaaatccatgtcttgggcaagaaaactactaatagctgtacttttaattctaggtttagcattgctttttaacaaacctatccgaaatacattaattgctcgaaactctaataaatatcaagtaacgaaagtttcgaaaaaacaaatcaaaaagaataaagaggctaagtcaacatttgatttccaagccgtagagccagttagtacagagagtgtcttgcaagcacaaatggcggctcagcaacttcctgttatagggggcattgccataccagagcttggcattaatttaccaatttttaaaggtttaggaaatactgagcttatttatggcgcaggaacgatgaaagaagaacaagttatgggaggagaaaataattattctcttgccagtcatcatatttttggaattacaggttcatctcaaatgctcttttcgccgcttgaaagagcacaaaatgggatgtccatctatttaacagataaagaaaaaatttacgaatacatcataaaagatgttttcacggtagctcctgaacgcgttgatgttatcgatgatacagctggtctcaaagaagtgactttagtgacttgtacagatatcgaagcaacagaacgtattattgtcaaaggagaactaaaaacagaatacgattttgataaagcgcccgccgatgtattgaaagcttttaatcattcttataaccaagtatctacc

SEQ ID NO: 4654 - protein, 249 aa, Streptococcus pyogenes
MVKKQKRRKIKSMSWARKLLIAVLLILGLALLFNKPIRNTLIARNSNKYQVTKVSKKQIKKNKEAKSTFDFQAVEPVSTESVLQAQMAAQQLPVIGGIAIPELGINLPIFKGLGNTELIYGAGTMKEEQVMGGENNYSLASHHIFGITGSSQMLFSPLERAQNGMSIYLTDKEKIYEYIIKDVFTVAPERVDVIDDTAGLKEVTLVTCTDIEATERIIVKGELKTEYDFDKAPADVLKAFNHSYNQVST

SEQ ID NO: 4655 - DNA, 2457 bp, Streptococcus agalactiae
atgcaagataaaaatttagtagatgttaatctaactagtgaaatgaaaacgagttttatcgattacgccatgagtgtcattgttgctcgtgcacttccagatgttagagatggtttaaaacctgttcatcgtcgtattttatatggtatgaatgaactaggtgtgacacctgataaacctcataagaaatcagcacgtattactggtgatgttatgggtaaataccatccacatggtgattcatctatttacgaagcaatggtgcgtatggcacaatggtggtcatatcgtcatatgctcgttgatggtcatggaaactttggttcaatggatggggatggtgctgccgcacagcgttatacagaagcacgtatgagtaaaattgctcttgagatgcttcgtgatatcaataaaaatacagttgattttcaagataactatgatggcagtgaacgtgaacctcttgttttaccagcgcgtttccctaatttattagtcaatggtgcaactggtattgctgtaggtatggcaacaaatattccaccacataatctaggtgagtctatagatgctgtcaaattggttatggataaccctgatgttactacacgggagttaatggaagttattcctggtccagattttcctactggtgccttggtgatgggacgttcaggtattcaccgtgcctatgaaactgggaagggatcaattgtcttacgttcacggactgaaattgaaacaacttcaaatgggaaagagcgtattgttgtcacagagtttccatatggcgttaataaaacaaaagtacacgagcatattgtacgtttagcacaagaaaagcgcattgaaggtattactgctgttcgtgatgaatcaagtcgtgaaggcgttcgttttgttattgaagttcgtcgtgctgcttcagcaaatgtgattttaaataatcttttcaaattaactagcttgcagacaaattttagcttcaatatgcttgctattgaaaaaggtgttccaaaaattttgtcattacgacaaatcattgataactatattgaacaccaaaaggaagttattgttcgtcgtactcagtttgacaaagctaaagcaggagcccgtgctcatatcttagaaggtttacttgtggcgcttgatcacttggatgaagttatcacaattattcgtaatagtgagacagacaccattgctcaagcagagttgatgtcacgttttgaattatcggagcgtcagagtcaagctattttagatatgcgtcttcgtcgtttaactggattagaacgcgataaaatccaatcagaatacaatgacttactagctttaattgctgatttagcagatatcttagctaagcctgaacgtgttgttaccattataaaagaagagatggatgaggttaagcgtaagtatgctgatgcccgtcgtacagaattaatgattggtgaagttttatcacttgaagatgaagaccttattgaggaagaagatgttcttattactctctcaaacaagggatatatcaagcgtctcgctcaagatgagtttagagcacaaaaacgtggaggacgcggtattcaagggactggagttaataacgatgattttgttcgtgaattggtttcaacaagtactcacgatactgtgcttttctttacaaatttagggcgtgtgtatcgtttgaaagcatatgaaattccagaatatggacgtacagctaaaggcctccctatcgttaaccttttaaaacttgacgaaggtgagacaattcaaacaattattaacgctagaaaagaagatgtcgctaataaatatttctttttcacaactcagcaaggtatagtgaaacgtacaagtgtttctgaatttagtaacattcgtcaaaatggacttcgtgctattaatttgaaagagaatgacgagttgattaacgtcctcttgattgacgaaaatgaagatgttattatcgggacacgtacaggctactctgttcgcttcaaagtgaacgctgtacgtaatatgggacgcacagcgactggggtacgaggcgttaatcttcgtgaaggtgataaagttgtgggagcttctcgtatcgttaatggacaagaagtactaatcatcactgaaaaaggttatggcaagagaacagaagcttcggaatatcctacaaaaggccgtggtggtaaaggaataaaaaccgctaatattactgctaaaaatgggccattagcacgcttagtgacgattaatggaaatgaggacatcatggtcattacagatacaggtgttattattcgaaccaatgttgctaatatttctcaaactggtcgttctaccatgggtgttaaagtgatgagacttgatcaagaagctaaaatcgtcactgttgcgctagtggaacaagaaattgaagataagtctaatatagaggatacaaaagaa

SEQ ID NO: 4656 - protein, 819 aa, Streptococcus agalactiae
MQDKNLVDVNLTSEMKTSFIDYAMSVIVARALPDVRDGLKPVHRRILYGMNELGVTPDKPHKKSARITGDVMGKYHPHGDSSIYEAMVRMAQWWSYRHMLVDGHGNFGSMDGDGAAAQRYTEARMSKIALEMLRDINKNTVDFQDNYDGSEREPLVLPARFPNLLVNGATGIAVGMATNIPPHNLGESIDAVKLVMDNPDVTTRELMEVIPGPDFPTGALVMGRSGIHRAYETGKGSIVLRSRTEIETTSNGKERIVVTEFPYGVNKTKVHEHIVRLAQEKRIEGITAVRDESSREGVRFVIEVRRAASANVILNNLFKLTSLQTNFSFNMLAIEKGVPKILSLRQIIDNYIEHQKEVIVRRTQFDKAKAGARAHILEGLLVALDHLDEVITIIRNSETDTIAQAELMSRFELSERQSQAILDMRLRRLTGLERDKIQSEYNDLLALIADLADILAKPERVVTIIKEEMDEVKRKYADARRTELMIGEVLSLEDEDLIEEEDVLITLSNKGYIKRLAQDEFRAQKRGGRGIQGTGVNNDDFVRELVSTSTHDTVLFFTNLGRVYRLKAYEIPEYGRTAKGLPIVNLLKLDEGETIQTIINARKEDVANKYFFFTTQQGIVKRTSVSEFSNIRQNGLRAINLKENDELINVLLIDENEDVIIGTRTGYSVRFKVNAVRNMGRTATGVRGVNLREGDKVVGASRIVNGQEVLIITEKGYGKRTEASEYPTKGRGGKGIKTANITAKNGPLARLVTINGNEDIMVITDTGVIIRTNVANISQTGRSTMGVKVMRLDQEAKIVTVALVEQEIEDKSNIEDTKE

SEQ ID NO: 4657 - DNA, 2484 bp, Streptococcus pyogenes
atgcaagatcgaaatttaattgacgtcaatctgacaagtgaaatgaaaacgagtttcattgactatgccatgagtgtcattgtggcaagagctttgccagatgtgcgtgatggtctgaaacctgtgcatcgtcgtattctctatgggatgaatgaactcggtgtgacacctgataaaccgcataaaaaatctgctcgtattacgggtgatgtcatgggtaaatatcacccgcatggggattcttctatttatgaagctatggttcgtatggctcagtggtggagttatcgccatatgcttgttgatgggcatggcaattttggttctatggatggtgatggtgctgccgctcaacgttatactgaagcgcgcatgagtaaaattgcgcttgaattattaagggatatcaataaaaataccgttaattttcaagataactacgatggaagcgaaagagaaccagtagtattaccagctcgctttcctaatttattagtcaatggagcgacagggattgccgttgggatggcaactaacattccgcctcataatttggcagagtctattgatgctgtcaagatggtaatggaacatccagactgtacaacaagagagttgatggaagtgatccctggacctgactttccgactggtgcccttgttatggggcgctcaggtattcatagggcttatgatactggtaaaggttctatcgttttacgctctcgaacagaaattgaaacaactcaaacaggtcgggaacgtattgtggttactgaatttccctatggcgtcaataaaacgaaagtgcatgaacacattgttcgtttagcacaagaaaaaagactagaaggtattacagcagttcgtgacgaatctagccgtgaaggagtgcgttttgttatcgagattcgtcgagaggcatccgcgacagttatcttaaataacctctttaaattaacaagtcttcagacgaatttcagttttaatatgttggctattgaaaatggtgtgcctaaaatattgtcactcagacaaatcattgataattacattagtcatcaaaaagaagttattatacgtcgcacccgatttgataaagataaagctgaagccagagctcatattttagaaggcttactgattgcccttgatcatttagacgaagtgattgctattattcgtaacagcgagacagatgtcattgctcagacagaattgatgtcacgtttcgacttgtctgaacgccaaagccaagctattttggatatgcgtttgcgtcgtttgactggtttggaacgtgataagattcaatcagaatatgatgatttgttggccttgattgctgacttatctgatattttagccaaaccagaacgtattatcactatcatcaaagaagaaatggatgagatcaagcgtaaatacgctaacccacgccgtacagaattaatggtcggtgaagtcctttctctagaagatgaagatctaattgaagaagaagatgttttgattaccttgtcaaataaaggttatatcaagcgtcttgctcaagatgaatttcgtgcccagaagcgtggtggacgtggcgtccaaggaactggagtcaacaatgacgactttgtacgtgaattgatatcaacaagtacccatgatactttgctcttctttacgaattttgggcgtgtctatcggttgaaagcttacgaaattccagaatatggtcgtacagcaaaaggtcttccaattgttaatctattgaaattagaagatggtgaaaccattcaaactattatcaacgcacgtaaggaagaaacagcaggtaaatccttcttctttacaacgaaacaaggcattgtcaaacgtacagaagtttcagaatttaataatatccgtcaaaacggtctccgtgctcttaagttgaaagagggagatcagctgattaacgtccttttgacaagcggtcaggatgacattatcattggaactcattccggatattctgttcgttttaatgaagcaagcatccgcaacatgggccgatcagctacgggtgttcgcggggttaagcttcgtgaagatgatcgcgttgttggcgcgtcacgtattcaagataaccaagaagttcttgtaattaccgaaaatggctttggtaagagaacaagtgctacagactatcctacaaaaggtagggggggaaaaggaataaaaacagctaatattacccctaaaaatggtcaattggctggattggttaccgtagatggtacagaagatatcatggtgattacaaataaaggtgtcattattcgcacaaatgttgcaaatatttcgcaaacaggtcgtgctactttgggtgttaaaattatgaaactagatgctgatgctaagattgtaacatttaccttggttcagcctgaagacagtagtatcgctgaaatcaatactgatcgtgaaaatagtatttcaaaaaataaagataat

SEQ ID NO: 4658 - protein, 828 aa, Streptococcus pyogenes
MQDRNLIDVNLTSEMKTSFIDYAMSVIVARALPDVRDGLKPVHRRILYGMNELGVTPDKPHKKSARITGDVMGKYHPHGDSSIYEAMVRMAQWWSYRHMLVDGHGNFGSMDGDGAAAQRYTEARMSKIALELLRDINKNTVNFQDNYDGSEREPVVLPARFPNLLVNGATGIAVGMATNIPPHNLAESIDAVKMVMEHPDCTTRELMEVIPGPDFPTGALVMGRSGIHRAYDTGKGSIVLRSRTEIETTQTGRERIVVTEFPYGVNKTKVHEHIVRLAQEKRLEGITAVRDESSREGVRFVIEIRREASATVILNNLFKLTSLQTNFSFNMLAIENGVPKILSLRQIIDNYISHQKEVIIRRTRFDKDKAEARAHILEGLLIALDHLDEVIAIIRNSETDVIAQTELMSRFDLSERQSQAILDMRLRRLTGLERDKIQSEYDDLLALIADLSDILAKPERIITIIKEEMDEIKRKYANPRRTELMVGEVLSLEDEDLIEEEDVLITLSNKGYIKRLAQDEFRAQKRGGRGVQGTGVNNDDFVRELISTSTHDTLLFFTNFGRVYRLKAYEIPEYGRTAKGLPIVNLLKLEDGETIQTIINARKEETAGKSFFFTTKQGIVKRTEVSEFNNIRQNGLRALKLKEGDQLINVLLTSGQDDIIIGTHSGYSVRFNEASIRNMGRSATGVRGVKLREDDRVVGASRIQDNQEVLVITENGFGKRTSATDYPTKGRGGKGIKTANITPKNGQLAGLVTVDGTEDIMVITNKGVIIRTNVANISQTGRATLGVKIMKLDADAKIVTFTLVQPEDSSIAEINTDRENSISKNKDN

SEQ ID NO: 4659 - DNA, 987 bp, Streptococcus agalactiae
atgactgcaactaaacaacataaaaaagttattctcgttggtgatggtgccgtaggttcttcttacgcttttgcacttgttaaccaaggtattgcgcaagagttaggtatcattgaaatcccagctttatttgataaagctgttggtgatgctgaagatctttcacatgcccttgcatttacatcacctaaaaaaatctacgcagctacttatgcagactgcgcagatgctgaccttgttgtcattactgctggcgcacctcaaaaaccaggtgaaactcgacttgaccttgttggtaaaaacttagcaattaacaaatcaatcgtaactcaagttgttgaatcaggtttcaacggtatcttcttagtagcggctaaccctgtagatgtacttacatattcaacttggaaattctcaggtttccctaaggaacgcgttattggttcaggtacttcacttgactctgcacgtttccgtcaagctttagcagataaaattggtgttgatgctcgttcagttcacgcatacatcatgggtgaacacggtgactcagaatttgccgtttggtcacatgctaacgttgctggtgtccaacttgaacaatggttacaagaaaatcgcgatattgatgaacaaggacttgttgatttgtttatttcagttcgtgacgctgcatactcaatcatcaacaaaaaaggtgctacatattacggtattgctgtcgcacttgctcgtattactaaagctatccttgatgatgaaaatgcagttcttccattatctgtatatcaagaaggccaatacggtgatgttaaagatgtctttatcggtcagcctgcaatcgtaggtgcacatggtatcgttcgtccagttaatatcccattaaatgatgctgaacttcaaaaaatgcaagcctcagctgaacaattaaaagatattattgacgaagcttggaaaaacccagaattccaagaagcatcaaaaaac

SEQ ID NO: 4660 - protein, 329 aa, Streptococcus agalactiae
MTATKQHKKVILVGDGAVGSSYAFALVNQGIAQELGIIEIPALFDKAVGDAEDLSHALAFTSPKKIYAATYADCADADLVVITAGAPQKPGETRLDLVGKNLAINKSIVTQVVESGFNGIFLVAANPVDVLTYSTWKFSGFPKERVIGSGTSLDSARFRQALADKIGVDARSVHAYIMGEHGDSEFAVWSHANVAGVQLEQWLQENRDIDEQGLVDLFISVRDAAYSIINKKGATYYGIAVALARITKAILDDENAVLPLSVYQEGQYGDVKDVFIGQPAIVGAHGIVRPVNIPLNDAELQKMQASAEQLKDIIDEAWKNPEFQEASKN

SEQ ID NO: 4661 - DNA, 981 bp, Streptococcus pyogenes
atgactgcaactaaacaacacaaaaaagtaatcttggtcggtgatggtgccgtcggttcatcatacgcttttgcattggtaacacaaaatattgctcaagaacttggtattattgatatttttaaagaaaaaactcaaggagatgcagaagatttaagccacgctctagcttttacatcacctaaaaaaatctatgcagctgactactcagactgtcatgatgctgatcttgttgtcttaacagctggtgctcctcaaaaaccaggtgaaacacgccttgaccttgttgaaaaaaaccttcgtatcaataaagaggttgttacacaaatcgttgcatctggtttcaaaggaatctttcttgttgctgctaacccagttgacgttttgacttactcaacatggaaattctcaggtttccctaaagagcgtgtcattggttcaggtacatctctagattcagcccgtttccgtcaagctctggctgctaaaatcggtgttgatgcgcgttcggttcacgcttacatcatgggagaacacggtgactctgaatttgctgtttggtcacacgctaacgttgctggtgtaggtctttacgactggctccaagctaatcgtgacattgatgagcaaggcctagttgatcttttcatttctgtacgtgatgctgcttactcaatcatcaataaaaaaggtgctactttctacggtattgcagttgccctagctcgtattacaaaagctattcttgatgatgaaaatgctgttcttccgctttctgttttccaagaaggccaatacgaaggtgttgaagattgctatattggtcaaccagctatcgttggagcgtatggaattgttcgtccagtaaacattccacttaacgatgctgaattacaaaaaatgcaagcctctgcaaatcaattgaaagctatcattgatgaagcctttgctaaggaagaatttgcttctgctgctaaaaac

SEQ ID NO: 4662 - protein, 327 aa, Streptococcus pyogenes
MTATKQHKKVILVGDGAVGSSYAFALVTQNIAQELGIIDIFKEKTQGDAEDLSHALAFTSPKKIYAADYSDCHDADLVVLTAGAPQKPGETRLDLVEKNLRINKEVVTQIVASGFKGIFLVAANPVDVLTYSTWKFSGFPKERVIGSGTSLDSARFRQALAAKIGVDARSVHAYIMGEHGDSEFAVWSHANVAGVGLYDWLQANRDIDEQGLVDLFISVRDAAYSIINKKGATFYGIAVALARITKAILDDENAVLPLSVFQEGQYEGVEDCYIGQPAIVGAYGIVRPVNIPLNDAELQKMQASANQLKAIIDEAFAKEEFASAAKN

SEQ ID NO: 4663 - DNA, 1368 bp, Streptococcus agalactiae
atgagtaaaatcgttgtcgtagggacaaaccacgctggtacagcagcaattaaaacaatgcttagtaattatggtgaagccaatgaaattgtaacatttgatcaaaattccaatatctctttcttaggatgtggtatggctctttggattggtgaacagattgatggtccagaaggattgttctactctgataaagagcagttggaaagtatgggagctaaggtttacatgaactctccagtacttaatattgactacgataaaaaagaagttacagctttagtagatggaaaagaacatgttgaaagttatgaaaaacttattttagcaactggttcacaacctatcattccaccaattaaaggtgttgaaattcaagaaggatctcgtgaatttaaagctactcttgaaaaccttcaatttgtgaaactttatcaaaattcagaagaagttattgaaaagttagctaaacctggtatcaatcgtgttgctgttgttggggctgggtatattggtgtagaattagcagaagctttccaacgtattggaaaagaagtaacacttgttgatgttgctgatacttgtatgggtggttactatgatcgtgactttactgatatgatgagtaaaaaccttgaagaccatggtattcgtcttgctttcggacaagctgttcaagcagttgaaggtgatggtaaagtagaacgtcttgttactgataaagaaacatttgatgttgatatggtgatcttagctgttggattccgtccaaatacagaactcggtgcaggtaaattagatacattccgtaatggcgcttgggtagttgataagaagcaagaaacaagcgtgaaagatgtttatgctataggtgattgtgcgacaatttgggataattctcgtgatgatatcaattatattgctcttgcttcaaacgccgttcgtactggtattgtagcagctcacaatgcatgtggtacagagcttgaaggtgctggtgtccaagggtcaaatggtatctcaatctatggccttaacatggtgtcaactggtttgactttagaaaaagcaaaacaagctgggtacaatgcagttgaaacaggctttaatgaccttcaaaaaccagaatttatcaaacacaataatcatgaagtagctattaagattgtctatgataaagatagccgagttatccttggttgccaaatggtctcacacgaagatgtatctatgggaattcatatgttctcacttgctattcaagaaaaagttactattgaaaagcttgctttgaccgatatcttcttcttaccacattttaataagccatataactatattacaatggctgcattaggcgctaaagat

SEQ ID NO: 4664 - protein, 456 aa, Streptococcus agalactiae
MSKIVVVGTNHAGTAAIKTMLSNYGEANEIVTFDQNSNISFLGCGMALWIGEQIDGPEGLFYSDKEQLESMGAKVYMNSPVLNIDYDKKEVTALVDGKEHVESYEKLILATGSQPIIPPIKGVEIQEGSREFKATLENLQFVKLYQNSEEVIEKLAKPGINRVAVVGAGYIGVELAEAFQRIGKEVTLVDVADTCMGGYYDRDFTDMMSKNLEDHGIRLAFGQAVQAVEGDGKVERLVTDKETFDVDMVILAVGFRPNTELGAGKLDTFRNGAWVVDKKQETSVKDVYAIGDCATIWDNSRDDINYIALASNAVRTGIVAAHNACGTELEGAGVQGSNGISIYGLNMVSTGLTLEKAKQAGYNAVETGFNDLQKPEFIKHNNHEVAIKIVYDKDSRVILGCQMVSHEDVSMGIHMFSLAIQEKVTIEKLALTDIFFLPHFNKPYNYITMAALGAKD

SEQ ID NO: 4665 - DNA, 1368 bp, Streptococcus pyogenes
atgagtaaaatcgttgttgttggtgcaaaccatgctggtacggcctgtatcaagactatgttaacaaactacggtgatgctaatgagattgttgtatttgaccaaaactcaaatatttcatttttaggctgtggtatggcactttggattggtgagcaaattgctggaccagaaggacttttctattcagataaagaagaattagagtctttaggggctaaagtttacatggaatcacctgttcaatcaatcgactacgatgccaaaacagtgacagcgcttgttgatggtaaaaaccacgtggaaacttacgacaagttgatttttgcaactggctcacaacctatcttaccaccgattaaaggtgccgaaatcaaagaaggatcacttgaatttgaagcaactcttgaaaatcttcaatttgtgaagttataccaaaactcagctgatgtgattgcaaagcttgaaaacaaagacattaaacgtgtagccgtagttggtgctggttacattggtgttgagttagctgaagctttccaacgcaaaggcaaagaagtggttctgattgatgtcgtggacacttgcttggcaggttattacgaccgtgatttgactgacttaatggctaaaaacatggaagaacatggtattcaactagcctttggtgaaacagttaaagaagtagctggtaatggtaaggttgaaaagatcattactgacaaaaatgagtacgatgtggatatggttatcctcgccgttggtttccgtccaaacacaactcttggaaatggtaagattgatcttttccgtaatggtgctttccttgtcaataaacgccaagaaacttctattccaggtgtttatgctatcggtgactgtgcaactatctacgataatgctactcgcgatacaaactacattgctttagcttcaaatgccgtccgtacaggaattgtagcagcacataacgcttgtggtacagaccttgaaggtattggcgttcaaggctcaaacggtatttccatttacggattgcacatggtttcaactggtttgacacttgaaaaagcaaaacgtcttggttttgatgctgcagtgactgagtatactgataaccaaaaacctgaatttatcgaacacggtaacttcccagtaaccattaagattgtttacgataaagactcacgtcgtatcttgggtgctcaaatggcagcccgtgaagatgtgtcaatgggaattcacatgttctcacttgctatccaagaaggcgtaaccattgaaaagttggcattaactgatattttcttcttaccacatttcaacaaaccttacaactacatcacaatggcagcacttggtgccaaagac

SEQ ID NO: 4666 - protein, 456 aa, Streptococcus pyogenes
MSKIVVVGANHAGTACIKTMLTNYGDANEIVVFDQNSNISFLGCGMALWIGEQIAGPEGLFYSDKEELESLGAKVYMESPVQSIDYDAKTVTALVDGKNHVETYDKLIFATGSQPILPPIKGAEIKEGSLEFEATLENLQFVKLYQNSADVIAKLENKDIKRVAVVGAGYIGVELAEAFQRKGKEVVLIDVVDTCLAGYYDRDLTDLMAKNMEEHGIQLAFGETVKEVAGNGKVEKIITDKNEYDVDMVILAVGFRPNTTLGNGKIDLFRNGAFLVNKRQETSIPGVYAIGDCATIYDNATRDTNYIALASNAVRTGIVAAHNACGTDLEGIGVQGSNGISIYGLHMVSTGLTLEKAKRLGFDAAVTEYTDNQKPEFIEHGNFPVTIKIVYDKDSRRILGAQMAAREDVSMGIHMFSLAIQEGVTIEKLALTDIFFLPHFNKPYNYITMAALGAKD

SEQ ID NO: 4667 - DNA, 171 bp, Streptococcus agalactiae
ttgctcaaaagtggtaaatggctaccgataactgctaaactttgcgataaaccaaagaatagactagcaagcattgcaccaattggattccacttaccaaaaatcatcgccgctaaggagataaagcccggtcctaatatagttgtcgctgcaaagttaacagaaatagat

SEQ ID NO: 4668 - protein, 57 aa, Streptococcus agalactiae
MLKSGKWLPITAKLCDKPKNRLASIAPIGFHLPKIIAAKEIKPGPNIVVAAKLTEID

SEQ ID NO: 4669 - DNA, 966 bp, Streptococcus agalactiae
gtggtaagtaaattgagtttaacaacgatttttgcattgctattttcatcaatgctaatttacgcaacacctcttatctttacaagtattgggggaaccttctctgaacgtggtggtatcgtcaacgttggtttagaaggaattatggtaattggagctttctcaggcgttgtatttaatttagagtttgcttctgtttttggtgatgcgactccatggatttctgtactagttggtggtttagttggtttaattttttctgttatccatgcagttgcgacagttaattttcgtgcagatcatattatcagcggaaccgttcttaatttaatggcaccttcattagctgttttcttgattaaggttctttataataaaggtcaaactgataatattcaagaatcatttggaaaatttaatttccctatactatcagatattccttttgttggtgatatcttctttaaaggaacaagcttagtcggttatattgctattcttttctcattccttgcttggtttattctatataaaactcgctttggattaagattacgctcagttggagaacatcctcaagcagcagacaccttaggtattaatgtttatcttatgcgttactctggtgtcttgatttcaggtttccttggtggaataggaggagctgtatatgctcaatctatttctgttaactttgcagcgacaactatattaggaccgggctttatctccttagcggcgatgatttttggtaagtggaatccaattggtgcaatgcttgctagtctattctttggtttatcgcaaagtttagcagttatcggtagccatttaccacttttgagcaatattccaacagtttatctacaaattgctccatatgtcctcactatcattgtattagcagctttctttggacaagcagtagctcctaaggcggatggtattaattatattaaaacgaaa

SEQ ID NO: 4670 - protein, 322 aa, Streptococcus agalactiae
MVSKLSLTTIFALLFSSMLIYATPLIFTSIGGTFSERGGIVNVGLEGIMVIGAFSGVVFNLEFASVFGDATPWISVLVGGLVGLIFSVIHAVATVNFRADHIISGTVLNLMAPSLAVFLIKVLYNKGQTDNIQESFGKFNFPILSDIPFVGDIFFKGTSLVGYIAILFSFLAWFILYKTRFGLRLRSVGEHPQAADTLGINVYLMRYSGVLISGFLGGIGGAVYAQSISVNFAATTILGPGFISLAAMIFGKWNPIGAMLASLFFGLSQSLAVIGSHLPLLSNIPTVYLQIAPYVLTIIVLAAFFGQAVAPKADGINYIKTK

SEQ ID NO: 4671 - DNA, 966 bp, Streptococcus pyogenes
gtggtaaataagatgagtttagtaacaatttttgccttattgatgtcatctatgcttatttatgcaacaccactcattttcacaagtattggaggaactttctcagagcgctcaggcgttgttaatgttggtttagaaggtatcatggtcatgggagcgttctctgggattgttttcaacttagagtttgctgaaacatttggaaaagcaacgccttggatagccgttttagtcggtggtattgttggtttgattttttctttgattcacgctgtagcaaccatcaactttcgagctgaccacattgtcagtggtacagtgttgaacttgttagcaccttcttttgctgtcttcttggttaaagctatgtacggtaagggacaaacagacaacattcaacaatcttttgggaagtttgatttcccaggtttatcacaaattcctgtgattggtgatattttctttaaaaatactagccttattggttacttcgccattgctttttcgttctttgcttggtttttgctttataaaaccaggtttggtctgcgtttacgatcagttggggaacaccctcaggcagctgacacacttggtattaacgtctatttgatgaaatactatggtgtgatgatctcaggttttcttggtggaataggtggagctgtttatgctcagtcaatctccgttaactttgctgtaacaactatcttaggtcctggatttattgctttggcagctatgatctttggtaaatggaatccagttggcgccatgctatctagtcttttctttggcttatcgcaaagtttagccgttattggtgctcaattaccattactagaaaagattccaacggtttacttacagattgcaccttatatggtaacgattattattttagctgctttctttggtcaagcagttgcaccaaaagctgatggaatcaactatattaaatctaaa

SEQ ID NO: 4672 - protein, 322 aa, Streptococcus pyogenes
VVNKMSLVTIFALLMSSMLIYATPLIFTSIGGTFSERSGVVNVGLEGIMVMGAFSGIVFNLEFAETFGKATPWIAVLVGGIVGLIFSLIHAVATINFRADHIVSGTVLNLLAPSFAVFLVKAMYGKGQTDNIQQSFGKFDFPGLSQIPVIGDIFFKNTSLIGYFAIAFSFFAWFLLYKTRFGLRLRSVGEHPQAADTLGINVYLMKYYGVMISGFLGGIGGAVYAQSISVNFAVTTILGPGFIALAAMIFGKWNPVGAMLSSLFFGLSQSLAVIGAQLPLLEKIPTVYLQIAPYMVTIIILAAFFGQAVAPKADGINYIKSK

SEQ ID NO: 4673 - DNA, 1086 bp, Streptococcus agalactiae
gtggaaaaattgaaaaggaggagagagatgtctaagaaggcgcaaaaaattgcagttcctctgatttcagttgtactaggaatcattctaggagctattattatgctgatatttggttatgatccactttggggttatgagggattgttccaaacagcattcggtagtataaaaaatattggtgaaattttccgtgcaatgggaccattaattttaattgctctaggtttctcagttgccagtcgtgcaggtttctttaatattggacttccagggcaagccttatcaggatggattgccgcaggttggttcgctctttcacacccagatatgccacgtccagcaatgattctttgtactattattattggtatcgttgctgggggaatcactggagctattccaggtattctcagagcataccttggaacaagtgaagttattgtaactattatgatgaactatattgttctttattcaggaaatgctattgtacaacgtgttttcccaaaaagcattatgcgtacaagtgactcgagtgtatatgtttctgccaatgcatcataccagacagattggttatctagtttaacgaataattcacgtatcaatattggtatcttcattgctattattgcagttgtgttagtttggttcctattaaataaaacaacgcttggatttgaaattcgttcagttggtttaaatccaaatgctagtgagtacgctggtatgtctgcaaagcgtacaattattctatcaatgattatttctggagcttttgcaggacttggtggtgttgttgaaggactaggtacatttgagaatgtatttgtacagccatcctcgttagctattggctttgacggtatggcagtaagtctactcgcagcgaatagtccaataggtattttatttgcagcatttctatttggtgttctaagtgttggtgcgcctggtatgaacattgcaggtattccacctgagttaattaaagttgtaacagcttcaatcatcttcttcgtaggtgtccattacattattgagtatgttattaaacctaaaaaacaaatgaaaggtggtaag

SEQ ID NO: 4674 - protein, 362 aa, Streptococcus agalactiae
MEKLKRRREMSKKAQKIAVPLISVVLGIILGAIIMLIFGYDPLWGYEGLFQTAFGSIKNIGEIFRAMGPLILIALGFSVASRAGFFNIGLPGQALSGWIAAGWFALSHPDMPRPAMILCTIIIGIVAGGITGAIPGILRAYLGTSEVIVTIMMNYIVLYSGNAIVQRVFPKSIMRTSDSSVYVSANASYQTDWLSSLTNNSRINIGIFIAIIAVVLVWFLLNKTTLGFEIRSVGLNPNASEYAGMSAKRTIILSMIISGAFAGLGGVVEGLGTFENVFVQPSSLAIGFDGMAVSLLAANSPIGILFAAFLFGVLSVGAPGMNIAGIPPELIKVVTASIIFFVGVHYIIEYVIKPKKQMKGGK

SEQ ID NO: 4675 - DNA, 1560 bp, Streptococcus agalactiae
atgaatttttctgaaagggagaaccacatgacacagaatgtcattgaaatgaaagaaatcactaagaaattcggtgattttgtggcaaatgatcatatcaatttgacggttgaaaaaggtgagatacatgctctgcttggcgaaaacggtgcagggaaatcaactttaatgaacatgttagcaggtttactagaaccaacagacggtcaaatttttattaatggtcagcctgtaactattgattcaccttccaaatcgtcacaattggggattggtatggtacatcagcatttcatgcttgttgaagcatttactgtagctgaaaatattgttctaggaaatgaaaccacccaaaatggtgttttagacattaagacagcagctaaagaaataaaggaactatcagagaaatatggtttgtcagtaaatccaaatgctaaaatatctgatatttctgtaggagcacagcagcgtgttgaaattttgaagacactttatcgcggtgcagatattttaatttttgatgagccgacggcggtgcttacaccatcagaaataaaagaattgatgacaattatgaagagccttgttaaagaaggcaaatccattatactaattacccataaattggatgaaattcgggcagttgctgataaagttactgtgattcgccgtggtaaaagtattgaaacagtccctgttgcaggcgcaagttctcaacaactggcggaaatgatggttggacgatctgtttccttcagaactgaaaaaaaggaagctaatccgactgacataatcctttctgtaaaggatttagttgtagaagaaaatagaggcggcgttctagctgttaaaaatctgtcgttagatgttcgagcaggtgaaattgtaggtatagctggtattgatggtaatggacaaagtgaattaattcaagctattacaggtttaagaaaggtaacttctggtcaaattgtaattaaaggtaaagatgtcacaaaattttcaagtcgacaaattacagaattaagtgtaggtcatgttccagaagatcgtcatagagatggtttggttctagatatgacgatggcagaaaatttagctttacaaacttattataaagagccattgagtcataaaggtatccttaattttgctaaaattaaagagtatgctcgtcaattaatgacagaatttgatgtgcgtggtgctggtgaacatgttttagcaagaggattttctggtggtaaccaacaaaaagcaattattgctcgtgaagtggatcgcgatccagacctactcattgttagccaaccgactcgtggtctagatgttggtgctatcgagtatattcataaacgtttgattgaagagcgcgataaagggaaagcggtcttagtagttagctttgagttagatgaaatcttaaacttatcagatcgtattgcagttattcatgatggtaaaattcaaggaattgttaaacccgaccaaaccaacaagcaagaattgggtattttgatggctggtggaaaaattgaaaaggaggagagagatgtc

SEQ ID NO: 4676 - protein, 520 aa, Streptococcus agalactiae
MNFSERENHMTQNVIEMKEITKKFGDFVANDHINLTVEKGEIHALLGENGAGKSTLMNMLAGLLEPTDGQIFINGQPVTIDSPSKSSQLGIGMVHQHFMLVEAFTVAENIVLGNETTQNGVLDIKTAAKEIKELSEKYGLSVNPNAKISDISVGAQQRVEILKTLYRGADILIFDEPTAVLTPSEIKELMTIMKSLVKEGKSIILITHKLDEIRAVADKVTVIRRGKSIETVPVAGASSQQLAEMMVGRSVSFRTEKKEANPTDIILSVKDLVVEENRGGVLAVKNLSLDVRAGEIVGIAGIDGNGQSELIQAITGLRKVTSGQIVIKGKDVTKFSSRQITELSVGHVPEDRHRDGLVLDMTMAENLALQTYYKEPLSHKGILNFAKIKEYARQLMTEFDVRGAGEHVLARGFSGGNQQKAIIAREVDRDPDLLIVSQPTRGLDVGAIEYIHKRLIEERDKGKAVLVVSFELDEILNLSDRIAVIHDGKIQGIVKPDQTNKQELGILMAGGKIEKEERDV

SEQ ID NO: 4677 - DNA, 1548 bp, Streptococcus pyogenes
ttgaaaggaaatgatcctatgacacagcatgtcattgaaatgagagaaatcacgaaaaaatttggtgattttgttgcaaatgaccacattaacttaaatgtcagaaaaggtgagattcatgccttattgggtgaaaatggggcaggtaaatcaactttgatgaatatgctagctggtctcttagagcctactagtggagaaattgtcattaatgacaagccagttcaaattgattcgccatctaaatcagctaagcttggtatcggaatggtacatcaacatttcatgttagtagaagccttcacggttgctgagaatattattttaggaaatgaagtagtaaaaaatgggtgcttagatcttaaccaagcatcgaaagatattaaggtactatccgaaaaatatggccttgcaatcaatccatcagctaaagtttctgatatttcagtaggagcacaacaacgtgttgagattttgaaaaccttgtatcgtggtgcagatattcttatctttgatgagccaactgccgttttaacacctgcagaaattaaagaattgatgactatcatgaagaatctcgtgaaagaaggaaaatcaattattttaattacccataaactggacgagattcgtgctgtcgccgaccgtgtcacagttattcgtcgtggtaagagtatcgaaacagttgatgtggcaggagcaacttcacaagatttagctgagatgatggtgggacgctcggtttcctttacaactagcaaaaaagctgctgaaccaaaagatgtggtcttatccatcaaaaatcttgaagtagatgaaaatagaggggttccagcagttaaggggctatctctagatgtccgagctggtgaaattgtagggattgctggaattgacggaaatggtcaatctgagttaattcaagctattacaggtttacgtaaagtcaaatctggaagtattatgattaaaaacaatgaagtcactcatttgtcttcacgcaaaattactgagttatcagtgggtcacgtgccagaagatcgtcatcgagatggtttgatactagatctttctttagctgaaaatacagccttacaaacctattacaaacaacctctaagtcaaaatggaatcttaaattatactaaaattaatgactatgctcgtcaattaatgaaagaatttgatgttcgcggagccaatgagctagtaccagctagaggattttctggtggtaaccaacaaaaggccattattgctcgtgaagtggaccgtgatccagatttacttattgttagccaaccaacacgtggtcttgatgtaggagctattgaatatatccataagcgtttgattaaagaacgtgataaaggtaaagctgtcctcgttgttagttttgaacttgatgaaatattgaatttatctgatcgaattgctgttattcatgatggtaaaattcaaggtatcgtatcgccagaaaataccaataaacaagaattgggtattttaatggcaggtggttcaattcataaggaggaaggtcatgtc

SEQ ID NO: 4678 - protein, 516 aa, Streptococcus pyogenes
LKGNDPMTQHVIEMREITKKFGDFVANDHINLNVRKGEIHALLGENGAGKSTLMNMLAGLLEPTSGEIVINDKPVQIDSPSKSAKLGIGMVHQHFMLVEAFTVAENIILGNEVVKNGCLDLNQASKDIKVLSEKYGLAINPSAKVSDISVGAQQRVEILKTLYRGADILIFDEPTAVLTPAEIKELMTIMKNLVKEGKSIILITHKLDEIRAVADRVTVIRRGKSIETVDVAGATSQDLAEMMVGRSVSFTTSKKAAEPKDVVLSIKNLEVDENRGVPAVKGLSLDVRAGEIVGIAGIDGNGQSELIQAITGLRKVKSGSIMIKNNEVTHLSSRKITELSVGHVPEDRHRDGLILDLSLAENTALQTYYKQPLSQNGILNYTKINDYARQLMKEFDVRGANELVPARGFSGGNQQKAIIAREVDRDPDLLIVSQPTRGLDVGAIEYIHKRLIKERDKGKAVLVVSFELDEILNLSDRIAVIHDGKIQGIVSPENTNKQELGILMAGGSIHKEEGHV

SEQ ID NO: 4679 - DNA, 1047 bp, Streptococcus agalactiae
atgaacaaaaaaattgccgggatcggcttggcttcgattgcagtacttagtttagctgcatgtggacatcgtggtgcttctaaatctggtggtaaatcagatagcttgaaggttgcaatggtaacagataccggtggtgttgatgataaatcatttaaccaatctggttgggaaggtatgcaagcttggggcaagaagaatggccttaaaaaaggagctggttttgactatttccaatcggcaagtgaatctgattatgcaactaacttagatacagctgtgtctagtggttataaattgattttcggtattggattttctcttcatgatgctattgataaagcagcagacaataacaaagatgttaattacgtcatcgttgatgatgttattaaagggaaagataatgttgcaagtgttgtctttgcggataatgaatcagcttacttagcaggtattgcagccgctaaaactaccaaaacaaaaacagttggctttgtaggtggtatggaatctgaggttattacccgttttgaaaaaggttttgaagcaggtgtcaaatcagttgataaatcaattaaaattaaagttgactatgctggttcattcggtgatgctgctaagggtaagacaattgcagccgcacaatatgcttctggcgcagatattgtttatcaagtagctggtggaactggtgcaggtgtattcagtgaagcaaaatcacgcaatgaatctttaaaagaagctgacaaagtttgggtattaggtgtagaccgtgaccaagcagcagaaggtaagtatacttctaaagatggtaaggcttctaactttgttttggcttcatcaattaaagaagttggaaaatcagttgaattgattgctactaaaacaagtaaaggtaaattcccaggtggtaatgtaacaacttatggtttgaaggatggtggagttgatatagcaactacaaacctttcagatgacgccgttaaagcgattaaagaggctaaagctaaaattatttcaggagatatcaaagttcctagcaaa

SEQ ID NO: 4680 - protein, 349 aa, Streptococcus agalactiae
MNKKIAGIGLASIAVLSLAACGHRGASKSGGKSDSLKVAMVTDTGGVDDKSFNQSGWEGMQAWGKKNGLKKGAGFDYFQSASESDYATNLDTAVSSGYKLIFGIGFSLHDAIDKAADNNKDVNYVIVDDVIKGKDNVASVVFADNESAYLAGIAAAKTTKTKTVGFVGGMESEVITRFEKGFEAGVKSVDKSIKIKVDYAGSFGDAAKGKTIAAAQYASGADIVYQVAGGTGAGVFSEAKSRNESLKEADKVWVLGVDRDQAAEGKYTSKDGKASNFVLASSIKEVGKSVELIATKTSKGKFPGGNVTTYGLKDGGVDIATTNLSDDAVKAIKEAKAKIISGDIKVPSK

SEQ ID NO: 4681 - DNA, 429 bp, Streptococcus agalactiae
ttgccagtaaacattatgaagcgaaaggtgcagctactaaaaatgggaaatatagagttgaaaaaattggctgtaaaagcgagtgaaaatgcatacgttccttactcgaaatttccagtaggcgcagcattgcgtacagcagaaggaaaaatatttacaggatgtaacgttgaaaatatcagttatggattagcaaactgtgctgagcgtactgcaatttttaaagctgtttcagaaggttataaagatttttcggaaattgctatttatggaaatactgaagaaccaatttctccttgcggtgcatgccgtcaagtgatggtggaattttttaataagaatgctaaagttacattgattgctaaaaatggtaagacggtcgagacgacggtcggtgagttgttaccatactcgtttgttgatttaaaa

SEQ ID NO: 4682 - protein, 143 aa, Streptococcus agalactiae
MPVNIMKRKVQLLKMGNIELKKLAVKASENAYVPYSKFPVGAALRTAEGKIFTGCNVENISYGLANCAERTAIFKAVSEGYKDFSEIAIYGNTEEPISPCGACRQVMVEFFNKNAKVTLIAKNGKTVETTVGELLPYSFVDLK

SEQ ID NO: 4683 - DNA, 387 bp, Streptococcus pyogenes
atggggactactgatttagttagttgtgctgtacaagctagtgagtatgcttatgtcccttactctcattttccagtaggagcagctttaaaaacaaaagatggaacgatctatactggctgtaatattgaaaatgttagttttggtctgacaaattgtggagagcgaacagctatatttaaagccatatctgatggtcataaagaattggttgaaattgctatttatggagaaactatgcaacctgtatctccttgtggggcttgtcgtcaggtaatggcagaattttttgatccttcttctttagtcactttaattgctaaaaatggtcaaactgttgaaatgactgttggagatttactcctctattcttttacagatttaata

SEQ ID NO: 4684 - protein, 129 aa, Streptococcus pyogenes
MGTTDLVSCAVQASEYAYVPYSHFPVGAALKTKDGTIYTGCNIENVSFGLTNCGERTAIFKAISDGHKELVEIAIYGETMQPVSPCGACRQVMAEFFDPSSLVTLIAKNGQTVEMTVGDLLLYSFTDLI

SEQ ID NO: 4685 - DNA, 588 bp, Streptococcus agalactiae
atggctaatatgtattatacagagaatcctaatgttgaacatgatattcatgagctaaatgtcaaattattaggagaatcattcagttttttaactgatgcaggagttttctctaaaagaatgatagattatggtagtcaagtccttctaaatagtttacattttgaaaaaaataaatccttgttagaccttgggtgtggatacggtccgctgggaatttctctagccaaagtgcaaggagttaaagcaactatggttgacattaatacgagagcattggaattagctaagaaaaatgcaacacgcaatggagtagtagttgaagtctttcagtcaaacatttatgaaaatatttctaaaactttcgactatattataagcaacccacctattcgtgctggaaagcaagttgttcattctattatcgaagaaagtatctgttaccttaatacaggcggtagccttaccattgtcattcaaaagaaacaaggcgctccaagtgcaaaagctaaaatgctagatacttttggtaattgcgatattttaaaaaaagataagggatattatatattgagaagtgaaaaagtc

SEQ ID NO: 4686 - protein, 196 aa, Streptococcus agalactiae
MANMYYTENPNVEHDIHELNVKLLGESFSFLTDAGVFSKRMIDYGSQVLLNSLHFEKNKSLLDLGCGYGPLGISLAKVQGVKATMVDINTRALELAKKNATRNGVVVEVFQSNIYENISKTFDYIISNPPIRAGKQVVHSIIEESICYLNTGGSLTIVIQKKQGAPSAKAKMLDTFGNCDILKKDKGYYILRSEKV

SEQ ID NO: 4687 - DNA, 624 bp, Streptococcus pyogenes
atgaaaaagtaccttaaaaagataggaaaaatgatgacaaagatgtattatgatgaaaatccagatagcctacacgatattcatgaagtaaaagtagagctgcttaatcatccctttacttttttgacggattcaggtgtcttttcaaagaaaatggttgatttcggtagccaagtattattaaagacactaaatttcaaggagaacgaacgtgtactggacttaggttgcggctatggccctcttgggattagtctagccaaggttcaaagggtagacgcaaccttagtggacatcaataatcgtgctcttgatttagctagaaaaaatgcaactaataaccaagtggcagtaactatttttcaatcaaatatttatgaaaatattagtggccattttgagcatattattagtaatcctcctattagagcaggaaagagagtagttcatagtattattgaaaaaagcatagattttttagtggttaatggtgacttaacgattgtgattcaaaaaaaacaaggagctcctagcgctaaagcaaaaatggcaactatttttggtaatgttgagatattaaggaaagataaaggttattatgtattaagaagtataaagcaagcc

SEQ ID NO: 4688 - protein, 208 aa, Streptococcus pyogenes
MKKYLKKIGKMMTKMYYDENPDSLHDIHEVKVELLNHPFTFLTDSGVFSKKMVDFGSQVLLKTLNFKENERVLDLGCGYGPLGISLAKVQRVDATLVDINNRALDLARKNATNNQVAVTIFQSNIYENISGHFEHIISNPPIRAGKRVVHSIIEKSIDFLVVNGDLTIVIQKKQGAPSAKAKMATIFGNVEILRKDKGYYVLRSIKQA

SEQ ID NO: 4689 - DNA, 918 bp, Streptococcus agalactiae
atgaataatgaatttattaatttcgaccgtatttccagagaaaattggaaggacttacatcagcaatcccaagctttactaactgaaaaagagcttgaatctatcaaaagcttaaacgataatattaatattcaagatgttattgacatctaccttcctttaattaaccttattcaaatctataaacgtagtcaagaaaatttatctttttctaaagcaatatttcttaaaaaggaaaattatcaacgtccttttattatcggcatatcagggtcagttgctgttggaaaatcaactaccagtcgcttactacaattactaatttcacgaacttttaaagatagtcacgtcgaattagtcactactgatggctttttatatcctaacgagaaactcatacaaaatggaattttaaaccgtaaaggtttcccggaatcctatgatatggagtcacttctaaatttcttagatactataaagaacggtataaccgcgaaaatcccaatttattctcatgaaatctacgatatcgttccaaatcaattgcaaactattgaaacaccagattttttaattttagaaggaataaatgtctttcaaaaccaacaaaaccatcgactttacatgaatgattattttgatttttcaatatacattgatgctgaaaataaacaaattgaagaatggtatttacaacgatttaacagtcttctacaattagccgaagcagaccctagtaattactatcataaattcacacaaataccgccacataaagctatggaactagctaaagatatttggaaaactattaatttagtcaaccttgaaaaatatatagaaccaaccagaaatagggctgattttattattcataaagggaaacatcataaaattgatgaaatttatctcaaaaag

SEQ ID NO: 4690 - protein, 306 aa, Streptococcus agalactiae
MNNEFINFDRISRENWKDLHQQSQALLTEKELESIKSLNDNINIQDVIDIYLPLINLIQIYKRSQENLSFSKAIFLKKENYQRPFIIGISGSVAVGKSTTSRLLQLLISRTFKDSHVELVTTDGFLYPNEKLIQNGILNRKGFPESYDMESLLNFLDTIKNGITAKIPIYSHEIYDIVPNQLQTIETPDFLILEGINVFQNQQNHRLYMNDYFDFSIYIDAENKQIEEWYLQRFNSLLQLAEADPSNYYHKFTQIPPHKAMELAKDIWKTINLVNLEKYIEPTRNRADFIIHKGKHHKIDEIYLKK

SEQ ID NO: 4691 - DNA, 918 bp, Streptococcus pyogenes
atgtcaaatgaatttattaactttgaaaaaatttctagagagtcttggaaaacattacatcaaaaggcaaaagctctcctcacacaagaggaacttaaaagtattactagcttaaatgataacatcagtattaacgatgtcattgatatctaccttccattaattaatctgatccaggtttacaaaattgcgcaagaaaatctttctttttctaaaagcctttttctaaaaaaagacattcaattaaggccttttattattggaatttctggttcagtagctgttggtaaatcaacaactagtcgtcttttacaacttttattatcacgaacgcaccccaatagtcaagtcgaactggtaacgactgatggttttttatatcctaatcagtttcttattgaacaaggactgttaaatcgtaaaggatttccagaatcttataacatggaacttctcttagattttctagattccatcaaaaatggtcaaactgcttttgcacccgtctattctcatgatatttacgatattatcccaaatcaaaaacaatcatttaataaccctgacttccttatcgtcgaaggtattaacgtttttcaaaatcaacaaaacaatcgtttatatatgagtgattactttgatttttctatttatattgatgcagacagcagtcacatcgaaacctggtacattgaacggtttctaagcattttaaaattagcaaaacgtgaccctcataattattatgcccaatatgcacaattacctcgatctgaggctatagcatttgcgcgcaacgtttggaaaaccgttaatttagaaaatcttgaaaaattcattgaacctacacgtaaccgtgctgaattaattttacataaaagtgctgatcataaaattgatgaaatttacctcaaaaag

SEQ ID NO: 4692 - protein, 306 aa, Streptococcus pyogenes
MSNEFINFEKISRESWKTLHQKAKALLTQEELKSITSLNDNISINDVIDIYLPLINLIQVYKIAQENLSFSKSLFLKKDIQLRPFIIGISGSVAVGKSTTSRLLQLLLSRTHPNSQVELVTTDGFLYPNQFLIEQGLLNRKGFPESYNMELLLDFLDSIKNGQTAFAPVYSHDIYDIIPNQKQSFNNPDFLIVEGINVFQNQQNNRLYMSDYFDFSIYIDADSSHIETWYIERFLSILKLAKRDPHNYYAQYAQLPRSEAIAFARNVWKTVNLENLEKFIEPTRNRAELILHKSADHKIDEIYLKK

SEQ ID NO: 4693 - DNA, 246 bp, Streptococcus agalactiae
atggaggtgaaaacattggcaaatattaaatcagctatcaaacgcgctgaacttaacgttaaacaaaacgaaaaaaactcagcacaaaaatcagctatgcgtactgctattaaagcatttgaagctaacccttcagaagaactttaccgcgctgcttcttcaagcatcgacaaagctgcttctaaaggtttaattcacacaaacaaagcaagccgcgataaagcacgtcttgcaactaaacttggt

SEQ ID NO: 4694 - protein, 82 aa, Streptococcus agalactiae
MEVKTLANIKSAIKRAELNVKQNEKNSAQKSAMRTAIKAFEANPSEELYRAASSSIDKAASKGLIHTNKASRDKARLATKLG

SEQ ID NO: 4695 - DNA, 246 bp, Streptococcus pyogenes
ttggaggtgaaaacattggcaaatattaaatcagctattaaacgcgctgaacttaacgttaaagcaaacgaaaaaaactcagcacaaaaatcagctatgcgtactgctatcaaagcatttgaagctaacccatctgaagagcttttccgcgctgcttcttcaagcatcgataaagctgaatcaaaaggtttgattcacaaaaacaaagcaagccgcgataaagcacgccttgctgcaaaacttggc

SEQ ID NO: 4696 - protein, 82 aa, Streptococcus pyogenes
LEVKTLANIKSAIKRAELNVKANEKNSAQKSAMRTAIKAFEANPSEELFRAASSSIDKAESKGLIHKNKASRDKARLAAKLG

SEQ ID NO: 4697 - DNA, 903 bp, Streptococcus agalactiae
atgatcttcaatttgctgaaagtatatctgatacgattctcaaaattaatcctaagtagacttgggggtagattgttgactcacaaaaatatattattaaccattatatttggattatttatgattatattatcagcatgtggtatgtctaataaggaaatggctggtattgataattgggaacattatcaaaaggaaaagaaaattactattggatttgataatacttttgttcctatgggatttgaaagtcgttctggtgactataccggctttgatattgatttagctaatgctgtttttaaagaatacggtatttcagtgaaatggcagcctattaactgggatatgaaagaaactgaacttaataatggtaatatagaccttatttggaatggttattcaaaaacggcagaacgtgctaaaaaagtcgcttttacaaacccatatatgaataatcatcaagtaattgttactaaaacttcatcacatattaatagtattaaggatatgaaggggaaaaaactaggagcccagtcgggttcatctggttttgatgcttttaacgctaaacctgatattttaaaaaagtttgtaaaaggaaaagaagcagttcaatacgatactttcactcaggctttgattgatttaaaaaataaccgtattgatggtcttttgattgatgaagtttatgctaactattatttaaagcaagaaggaaatataaaagcttattattttgttaaaactgcttatcaaggagaaaattttgtagtaggagctcgtaaagttgatcgtagactaattgaaaagattaacaaagctttcaaacagcttcataataaggggagatttcaaaaaatctcttacaaatggtttggtgaagatgtttatagtaaagaa

SEQ ID NO: 4698 - protein, 301 aa, Streptococcus agalactiae
MIFNLLKVYLIRFSKLILSRLGGRLLTHKNILLTIIFGLFMIILSACGMSNKEMAGIDNWEHYQKEKKITIGFDNTFVPMGFESRSGDYTGFDIDLANAVFKEYGISVKWQPINWDMKETELNNGNIDLIWNGYSKTAERAKKVAFTNPYMNNHQVIVTKTSSHINSIKDMKGKKLGAQSGSSGFDAFNAKPDILKKFVKGKEAVQYDTFTQALIDLKNNRIDGLLIDEVYANYYLKQEGNIKAYYFVKTAYQGENFVVGARKVDRRLIEKINKAFKQLHNKGRFQKISYKWFGEDVYSKE

SEQ ID NO: 4699 - DNA, 834 bp, Streptococcus pyogenes
atgattataaaaaaaagaaccgtagcaattttagccatagctagtagctttttcttggtagcttgtcaagctactaaaagtcttaaatcaggagatgcttggggagtttaccaaaagcaaaaaagtattacagttggttttgacaatacgtttgttcctatgggctataaggatgaaagcggcagatgcaaaggttttgatattgatttggctaaagaagtttttcaccaatatggactcaaggttaactttcaagctattaattgggacatgaaagaagcagaactaaacaatggtaaaattgatgtaatctggaatggttattcaataactaaggagcgtcaggataaggttgcctttactgattcttacatgagaaatgaacaaattattgttgtcaaaaaaagatctgatattaaaacaatatcagatatgaaacataaagtgttaggagcacaatcagcttcatcaggttatgactccttgttaagaactcctaaactgctgaaagattttattaaaaataaagacgctaatcaatatgaaacctttacacaagcttttattgatttaaaatcagatcgtatcgatggaatattgattgacaaagtatatgccaattactatttagcaaaagaagggcaattagagaattatcggatgatcccaacgacctttgaaaatgaagcattttcggttggacttagaaaagaagacaaaacgttgcaagcaaaaattaatcgtgctttcagggtgctttatcaaaatggcaaatttcaagctatttctgagaaatggtttggagatgatgttgccactgccaatattaaatct

SEQ ID NO: 4700 - protein, 278 aa, Streptococcus pyogenes
MIIKKRTVAILAIASSFFLVACQATKSLKSGDAWGVYQKQKSITVGFDNTFVPMGYKDESGRCKGFDIDLAKEVFHQYGLKVNFQAINWDMKEAELNNGKIDVIWNGYSITKERQDKVAFTDSYMRNEQIIVVKKRSDIKTISDMKHKVLGAQSASSGYDSLLRTPKLLKDFIKNKDANQYETFTQAFIDLKSDRIDGILIDKVYANYYLAKEGQLENYRMIPTTFENEAFSVGLRKEDKTLQAKINRAFRVLYQNGKFQAISEKWFGDDVATANIKS

SEQ ID NO: 4701 - DNA, 627 bp, Streptococcus agalactiae
atgttagaattaaaaaatatttctaaatgctatgggcaaaaagaaatctttaaagatttcaatctgactgtagaagaaggtaaaattctctctttagtaggaccttctggaggtggaaaaacaacactattacgtatgttagctggattggaaaagattgattcagggactattgttcacgatggtaaagaagtatctgttgatcatttggaaacactaaatcttttaggattcgtcttccaagactttcaattattcccacatttaacagtattagataatttgatcctctctcctgttaaaacgatgggattatcaaaagaacttgctaaagaaaaagccttagtattacttgaacgcttgggacttaaagaccatgctttagtctatccattttcattatctggggggcaaaagcaacgtgtcgcactagctcgtgcgatgatgattgatccacagattattggttatgatgagccaactagcgctcttgatccagagttgcgtcaagaagtagaaaaactaattttacaaaatagagaaacaggtatgacacaaattgtagtaacacatgatcttcaatttgctgaaagtatatctgatacgattctcaaaattaatcctaag

SEQ ID NO: 4702 - protein, 209 aa, Streptococcus agalactiae
MLELKNISKCYGQKEIFKDFNLTVEEGKILSLVGPSGGGKTTLLRMLAGLEKIDSGTIVHDGKEVSVDHLETLNLLGFVFQDFQLFPHLTVLDNLILSPVKTMGLSKELAKEKALVLLERLGLKDHALVYPFSLSGGQKQRVALARAMMIDPQIIGYDEPTSALDPELRQEVEKLILQNRETGMTQIVVTHDLQFAESISDTILKINPK

SEQ ID NO: 4703 - DNA, 627 bp, Streptococcus pyogenes
atgttagaactcaaaaatatttccaaacagtttggtcaaaaaaccatttttgatggctttaatctaaccgttcaagacggagaagtgctctctttggtaggcccatcaagtggcggtaagacaacactcttacggatgttggctggtcttgaatctattgattcaggtcaagtcttttacaatggcgaagatgttggtattgatcatttggaaaatcgtaacttgcttggatttgttttccaagattttcaattgtttcctcatcttaccgttttagacaacctaacgctgtctccaacaattacaatgggcaagcaaaaggctgacgctaaagaaaaggctttggatttactggcacgtttaggattaaaagaacatgcccaagtttatccctattctttatctggaggtcaaaaacaacgggttgctttggcaagagccatgatgattgaccctcaaattatcggttacgatgaaccgaccagtgctctagatcctgaactacgtcagacggtagaagccttgattgttcaaaaccgtgaaatgggaataactcaaattgtagtcactcacgatcttgtttttgccgaagccatctcagatcgtattattagggttaatcctaaa

SEQ ID NO: 4704 - protein, 209 aa, Streptococcus pyogenes
MLELKNISKQFGQKTIFDGFNLTVQDGEVLSLVGPSSGGKTTLLRMLAGLESIDSGQVFYNGEDVGIDHLENRNLLGFVFQDFQLFPHLTVLDNLTLSPTITMGKQKADAKEKALDLLARLGLKEHAQVYPYSLSGGQKQRVALARAMMIDPQIIGYDEPTSALDPELRQTVEALIVQNREMGITQIVVTHDLVFAEAISDRIIRVNPK

SEQ ID NO: 4705 - DNA, 390 bp, Streptococcus agalactiae
atgccagctgcgattattgcttttacgatgaattatgcagcttattttgcagagatttttcgaggaggtattgagtctattcctaaagggcaatatgaagctgcaaaggtattaaagttttctaagtttcaaacggtttggtacatagtattacctcaagtcttcaaaatagtcttaccgagtgttttcaatgaaacgattactttagtgaaagattcctcattggtttacatacttggtgtgggcgacttacttctagaaagtaagacagccgcaaatagggatgcaacacttgcaccaatgtttatagcaggtggtatttacctattattaattggtcttttaactattttatctaaacaagttgaaaagcgttttaactactataaa

SEQ ID NO: 4706 - protein, 130 aa, Streptococcus agalactiae
MPAAIIAFTMNYAAYFAEIFRGGIESIPKGQYEAAKVLKFSKFQTVWYIVLPQVFKIVLPSVFNETITLVKDSSLVYILGVGDLLLESKTAANRDATLAPMFIAGGIYLLLIGLLTILSKQVEKRFNYYK

SEQ ID NO: 4707 - DNA, 639 bp, Streptococcus pyogenes
atgacctatattcagcaagttttacccagcttattagatggtgccttggtgactttacaagtattctttattgttatcattctttctatacccttaggggctattttagctttcttgatgaagattccctttaaaccgctacagtggtttttgaccctatacgtgtggatgatgcgagggacaccattactacttcaattgatttttttctattatgttttgccaagtgtggggattagttttgatcgaatgccagctgctattttggcgtttactttgaattatgctgcctactttgctgaaatttttagaggtgggattgaggctattccaaaaggtcaatatgaagcagctaaagtattaaagttaaaacctcttcaaaccattcgttatattattttgcctcaagtgtttaaaattgtgttaccaagtgttttcaatgaagtcattaatttggtcaaagattcttcccttgtctatgtactcggtgtaggagatcttttattagcaagtaagacggcagccaatagggatgcaaccttagcccctatgtttatcgctggtcttatctatttgcttttaattggactggtcacgattatttcaaaacaagttgaaaaacggtttaattattatcag

SEQ ID NO: 4708 - protein, 213 aa, Streptococcus pyogenes
MTYIQQVLPSLLDGALVTLQVFFIVIILSIPLGAILAFLMKIPFKPLQWFLTLYVWMMRGTPLLLQLIFFYYVLPSVGISFDRMPAAILAFTLNYAAYFAEIFRGGIEAIPKGQYEAAKVLKLKPLQTIRYIILPQVFKIVLPSVFNEVINLVKDSSLVYVLGVGDLLLASKTAANRDATLAPMFIAGLIYLLLIGLVTIISKQVEKRFNYYQ

SEQ ID NO: 4709 - DNA, 480 bp, Streptococcus agalactiae
  misc_feature (1)..(480): n = a, c, g, or t
atggagaatcataattctattaaacagacctatggattaatgactacaattgctatgattgtaggtgtagtgattggttcaggcatttattttaaagttgatgacatccttaaatttactggtggagatgtctttttaggcatggtaattttagtactaggttctttttcgattgtttttggaagtttgtcaatttctgagctagctattagaacgagtgaaagtggtggtattttttcttactacgaaaaatatgttagcccagctttagcagcaactttaggcttgtttgcgtcttttttgtatcttccaactttaacagcaatcgtttcatgggtagctgcattttatactttaggtgaatcatcaagtttggaatcacagattattttagctgctgtttatattttagcgcttagtctcatgaatatctttgctaagcgtattgcagggggattccaatctttaacgaccnnnnnt

SEQ ID NO: 4710 - protein, 160 aa, Streptococcus agalactiae
  MISC_FEATURE (1)..(160): Xaa = Any Amino Acid
MENHNSIKQTYGLMTTIAMIVGVVIGSGIYFKVDDILKFTGGDVFLGMVILVLGSFSIVFGSLSISELAIRTSESGGIFSYYEKYVSPALAATLGLFASFLYLPTLTAIVSWVAAFYTLGESSSLESQIILAAVYILALSLMNIFAKRIAGGFQSLTTXX

SEQ ID NO: 4711 - DNA, 120 bp, Streptococcus agalactiae
ttggcgaagtgttcaactgaagttgcatttggaaattctatggtattagcgatatattgtgctgctaacaattcagggttgacaactgaagagaagccaagaaagtttttatctttgaag

SEQ ID NO: 4712 - protein, 40 aa, Streptococcus agalactiae
MAKCSTEVAFGNSMVLAIYCAANNSGLTTEEKPRKFLSLK

SEQ ID NO: 4713 - DNA, 1359 bp, Streptococcus agalactiae
ttggaggtaaaaatgagaataattgttgtcggcggaggtaaagtcggaaccgcactttgtcgctcacttgttgctgaaaagcacgatgttgttttaattgagaaaaaagaaaacgtccttaaacgtgtcactaaacagcatgatattatgggaattgttgggaatggagcaaactataaaattttagaacaagccgaagtcaaaaattgtgatatttttatcgctatcactgatcgagatgaagttaatatgatttcagcagttcttgccaaaaaaatgggggcaaaagagactgttgttcgcatgcgtaatcctgagtattctaatccttacttcaaagataaaaactttcttggcttctcttcagttgtcaaccctgaattgttagcagcacaatatatcgctaataccatagaatttccaaatgcaacttcagttgaacacttcgccaacgggcgtgtgatgttaatggaatttaaaattttagaaggaaataaactctgtcatacttcaatgagtcaaattcgtaaaaaatttggtaatattgttatttgcgcaattgaacgcgatggcaaattgattattcctgatggcgatgcaactatccaagtcaaagataaaatctttgtaactggaaatcgtattgaaatgatacttttccataattacgttaaaaataaagttgtcaaaaacttgatggttatcggtgcaggacgcatcgcctactacctactcaatatccttaaaaataccaatacacacgtcaaactagttgaactcaaccaagagcaagctgaatattttagtcaagaatttcccaatgttcctgtcgttcatggggatggtactgctaaaaatattttgttagaagaaagcgttacaagttttgacgcagttgctactttgactggtgttgatgaagaaaatatcattacctcaatgttcttagaaagtatcggtatccctaaaaacattaccaaagttaatcgaactagcctactagaaatcattgacgataaacaactatcaagcattatcacacccaagcgtattgccgtagaccatgtgatgcactttgtacgcgggcgtgtaaatgctcaggattccaacctagaagctatgcatcatattgctaacgatcgcattgaaaccttacaatttgaaataaaagaaactagcaaattagcaaatcgtagccttgcatctttaaaattaaagcaaaatattttaattgcagcgattattcgcaataataaaacgattttcccaactggtgaggatgttttaacagtgggtgatcgtatcgttgttatcaccttattaaaaaatattactagaactagtgatatgttagcgagg

SEQ ID NO: 4714 - protein, 453 aa, Streptococcus agalactiae
MEVKMRIIVVGGGKVGTALCRSLVAEKHDVVLIEKKENVLKRVTKQHDIMGIVGNGANYKILEQAEVKNCDIFIAITDRDEVNMISAVLAKKMGAKETVVRMRNPEYSNPYFKDKNFLGFSSVVNPELLAAQYIANTIEFPNATSVEHFANGRVMLMEFKILEGNKLCHTSMSQIRKKFGNIVICAIERDGKLIIPDGDATIQVKDKIFVTGNRIEMILFHNYVKNKVVKNLMVIGAGRIAYYLLNILKNTNTHVKLVELNQEQAEYFSQEFPNVPVVHGDGTAKNILLEESVTSFDAVATLTGVDEENIITSMFLESIGIPKNITKVNRTSLLEIIDDKQLSSIITPKRIAVDHVMHFVRGRVNAQDSNLEAMHHIANDRIETLQFEIKETSKLANRSLASLKLKQNILIAAIIRNNKTIFPTGEDVLTVGDRIVVITLLKNITRTSDMLAR

SEQ ID NO: 4715 - DNA, 672 bp, Streptococcus pyogenes
atgttaaaacgtaaaactgtcggcgttcttggccttggtatttttggccgtactgttgccagagaattaagtaactttgatcaagacgttattgctattgatatcagagaaagtcatgtcaaagaggtggccgacttggtcactaaagccgctgttggagatattactgacaaagaatttctattagctgtagggattgaacattgtgatactgtcgttatcgcttcagggaataacttggaatcttctgttcttgcagtcatgcactgtaaaaaactcggtgttccaaccattattgccaaggctaaaaataaaatttttgaagaagttctatatggcatcggagcaactaaagtcatcacccctgaacgtgattctggaaaacgtgtagcttcaaatctgttaagacgtcatatcgaaagcatcatctatttggaacatggtatttcgatgattgaatttgtcattcctaaaagctgggaaggacaatctctttccgaactagatgttcgtcgtaaatatgagttaaatgtgattggcatgcgtcaaaaagaagttaaaaccttagatactaatgtcaaaccttttgaacctttagaaccgaatactatcattgtggccatcgctaatgaccacacctttgaaaaatttgattatcttggctatcttaaa

SEQ ID NO: 4716 - protein, 224 aa, Streptococcus pyogenes
MLKRKTVGVLGLGIFGRTVARELSNFDQDVIAIDIRESHVKEVADLVTKAAVGDITDKEFLLAVGIEHCDTVVIASGNNLESSVLAVMHCKKLGVPTIIAKAKNKIFEEVLYGIGATKVITPERDSGKRVASNLLRRHIESIIYLEHGISMIEFVIPKSWEGQSLSELDVRRKYELNVIGMRQKEVKTLDTNVKPFEPLEPNTIIVAIANDHTFEKFDYLGYLK

SEQ ID NO: 4717 - DNA, 234 bp, Streptococcus agalactiae
atgactttaaagcccccagctgtagagccagcagaaccaccgataaacatcaagaatagcaaaataacctgtgaaaacaaaggccaacgagtgatatcagtcacgccaaaaccagttgtcgtaataatagctgatacttcaaagaaaatatgttcgaggccttgtcgaaaattatcatacataccgatgacgtttagagcaatcatgaaagttgctattgccacgatgcggaga

SEQ ID NO: 4718 - protein, 78 aa, Streptococcus agalactiae
MTLKPPAVEPAEPPINIKNSKITCENKGQRVISVTPKPVVVIIADTSKKICSRPCRKLSYIPMTFRAIMKVAIATMRR

SEQ ID NO: 4719 - DNA, 1437 bp, Streptococcus agalactiae
atgaataaaagtatgattcgtttccttctctcaaaacttttgctaattgaagctgctcttctagcgattcctctaactgttggacttatttaccgtgaaccgcaaagtgtcatgatgagtatagtcattaccatgattattttaatcatccttggattactgggttctctctttaaacctaaaaattatcatatctacactaaagaaggcatgttaattgttgcactctgctggatactttggtccttctttggcgcccttccatttgttatttcagggcaaatccctaatattatcgatgctttctttgaagtatcttctggttttacgacaacaggagcaactattcttgatgacgtcagtgtcttatcacccgcgctcttattttggcgtagctttacccatcttatcggtggaatgggggttttagtatttgcccttgccatcatggaaaattctaaaaatagccatttagaggttatgagagctgaagttcctggacctgtatttggtaaagttgtctcgaaacttaaaaaaactgcacaaattttgtatttgttatatcttcttatgtttgcagtatttgcagtaatattatattttgcaggtatgcctttctttgatagtattatcatagcgatgggaactgcaggtacaggtggttttgcagtttacaatgatagcattgctcattataatagtcctctgataactaacttagtttctattggtatgcttatcttcggggttaactttaatctttactatcttcttttactccgaaaaattaaagcattctttggtgatgaggaactaaaaacctatctccgcatcgtggcaatagcaactttcatgattgctctaaacgtcatcggtatgtatgataattttcgacaaggcctcgaacatattttctttgaagtatcagctattattacgacaactggttttggcgtgactgatatcactcgttggcctttgttttcacaggttattttgctattcttgatgtttatcggtggttctgctggctctacagctgggggctttaaagtcatgcgtagcttaatcctagcaaagattgcacgtaaccaagtattgtctacactctatcctaatagagtcatgtcactacacattaataaaagcgttctagataaaaatacacaacatggtgttttaaaatatctaactatctatttagctatcttcatggcactcgttcttgttttaacgcttgatactaatgattttttggttgttatcagtgctgcagcctcatgttttaacaacataggcccactcttaggtagcaatgaaactttctcattctttagtccattctcaaaactccttctttcatttgctatgatagcaggacgtttagaaatataccctgttttattgatgtttattcctaaaacatggtcaaaacta

SEQ ID NO: 4720 - protein, 479 aa, Streptococcus agalactiae
MNKSMIRFLLSKLLLIEAALLAIPLTVGLIYREPQSVMMSIVITMIILIILGLLGSLFKPKNYHIYTKEGMLIVALCWILWSFFGALPFVISGQIPNIIDAFFEVSSGFTTTGATILDDVSVLSPALLFWRSFTHLIGGMGVLVFALAIMENSKNSHLEVMRAEVPGPVFGKVVSKLKKTAQILYLLYLLMFAVFAVILYFAGMPFFDSIIIAMGTAGTGGFAVYNDSIAHYNSPLITNLVSIGMLIFGVNFNLYYLLLLRKIKAFFGDEELKTYLRIVAIATFMIALNVIGMYDNFRQGLEHIFFEVSAIITTTGFGVTDITRWPLFSQVILLFLMFIGGSAGSTAGGFKVMRSLILAKIARNQVLSTLYPNRVMSLHINKSVLDKNTQHGVLKYLTIYLAIFMALVLVLTLDTNDFLVVISAAASCFNNIGPLLGSNETFSFFSPFSKLLLSFAMIAGRLEIYPVLLMFIPKTWSKL

SEQ ID NO: 4721 - DNA, 249 bp, Streptococcus agalactiae
atgcttaaatcttttttgattttcttagttcgcttttaccaaaaaaatatttctccagctttcccagctagctgtcgttatcgtccaacttgctctacgtatatgatagaagctattcaaaaacatggtctaaaaggtgtgttgatggggattgcacgtattttgcgatgtcatcccttagcccacggaggaaatgatcctgtccctgatcattttagcttaagacgtaataaaacggatatatcagat

SEQ ID NO: 4722 - protein, 83 aa, Streptococcus agalactiae
MLKSFLIFLVRFYQKNISPAFPASCRYRPTCSTYMIEAIQKHGLKGVLMGIARILRCHPLAHGGNDPVPDHFSLRRNKTDISD

SEQ ID NO: 4723 - DNA, 261 bp, Streptococcus pyogenes
atgatgaaaaaactattaatagtatctgttaaagcttatcaaaaatacatttctcctttatctcctcctagttgtcgctacaagccaacctgttcagcttatatgttaactgctattgaaaaacatggtactaagggaatattaatggggatagcaagaatattaagatgtcacccttttgttgctggtggtgtcgatcctgttccagaagattttagcctaatgagaaataaaaacacgtctaaaaacgctgaaaaggca

SEQ ID NO: 4724 - protein, 87 aa, Streptococcus pyogenes
MMKKLLIVSVKAYQKYISPLSPPSCRYKPTCSAYMLTAIEKHGTKGILMGIARILRCHPFVAGGVDPVPEDFSLMRNKNTSKNAEKA

SEQ ID NO: 4725 - DNA, 720 bp, Streptococcus agalactiae
atgagaattaataaatatattgcgcatgcagggattgcaagtcgtagaaaagctgaggaattaatcaagcaaggaatggtcacgattaatggtcaagtggttaatgaattggcgacccaagtaaaggctggtgatctggttgaaattgaaggaagtccaatttacaacgaagagaaggtatattatctcttaaataaaccacgtggtgttatttcaagtgtctcagatgataaaggacgtaagacagttattgacttgttgccacaagtcaaagaacggatatatcctgttggtcgcttggattgggatacaactggacttttaattttgactaatgatggtgattttactgataaaatgattcatcctcgtaatgaaattgataaagtttatttagcacgtgttaaaggaatagctactaaagaaaaccttcgaccattaacgcgtggcgttgttatcgatggtaagaaaacaaaacctgctcgctatactatcataaaagtggatcatgaaaaaaatcgttcagtagttgaattaactattcatgaaggtcgtaatcatcaagttaagaaaatgtttgaacaagttgggttattagtggacaagctatctcgtacacaattcggtaccttagatttaacgggtctccgtcctggggaagcacgacgattaaataaaaaagaaattagtcagttgcataatgcggctattaataaatct

SEQ ID NO: 4726 - protein, 240 aa, Streptococcus agalactiae
MRINKYIAHAGIASRRKAEELIKQGMVTINGQVVNELATQVKAGDLVEIEGSPIYNEEKVYYLLNKPRGVISSVSDDKGRKTVIDLLPQVKERIYPVGRLDWDTTGLLILTNDGDFTDKMIHPRNEIDKVYLARVKGIATKENLRPLTRGVVIDGKKTKPARYTIIKVDHEKNRSVVELTIHEGRNHQVKKMFEQVGLLVDKLSRTQFGTLDLTGLRPGEARRLNKKEISQLHNAAINKS

SEQ ID NO: 4727 - DNA, 744 bp, Streptococcus pyogenes
ttgctcaaaagaaagaagaatataatgcgaattaacaaatacattgcccatgcgggtattgccagtcgtcgtaaggctgaagaattgattaagcaaggcttagtaaccttaaatggtcaggttattacggatttagcaaccactgtaaaatcgggagacgtggttgaaatagaaggaagtcctatttacaacgaggaaaaggtttactatttgcttaataaacctcgtggcgctatctcaagtgtgtcagatgacaaaggccgtaaaacggtactggatttactacctcaggttaaagaacgcatataccctgttggacgattggattgggacacatcaggggtccttattttaacgaatgatggtgattttacagatactatgattcatcctagaaatgaaatagacaaggtttatctggcgcgtgtcaaaggtattgcaacgaaagaaaatcttcgtcccttaactcgaggaattgttattgatggtaaaaagaccaaaccagctcgctacaatattgttcgtgtagaagctgataagagtcgatcgatcgtagaattgactatccatgaagggcgaaaccatcaagtgaaaaaaatgtttgagtctgtggggcttctggttgataaattatctcgtacacgttttgggaccgtcgacttaaagggactaagaccaggagaagcaagacgcttaaataaaaaagaaataagtcaactgcataacttagctaatacgaaaaaa

SEQ ID NO: 4728 - protein, 248 aa, Streptococcus pyogenes
LLKRKKNIMRINKYIAHAGIASRRKAEELIKQGLVTLNGQVITDLATTVKSGDVVEIEGSPIYNEEKVYYLLNKPRGAISSVSDDKGRKTVLDLLPQVKERIYPVGRLDWDTSGVLILTNDGDFTDTMIHPRNEIDKVYLARVKGIATKENLRPLTRGIVIDGKKTKPARYNIVRVEADKSRSIVELTIHEGRNHQVKKMFESVGLLVDKLSRTRFGTVDLKGLRPGEARRLNKKEISQLHNLANTKK

SEQ ID NO: 4729 - DNA, 582 bp, Streptococcus agalactiae
atgacttatttaggctcaatagaagctcttctttttgttgcaggtgaagatggactgagtttgcgtcaaatggcagaattattgtctttgacaccatcagcattaatacagcaactagaaaagttggctaaacgatatgaagaagatgacgattctagtctattattgcttgagacagcacaaacttataaattggtaacaaaggatagttatatgactttgttgagagattatgcgaaggctccgattaatcagagtctatctcgggcaagtttggaagttctatctattattgcttataaacaacctattactaggattgaaattgatgatattcgtggcgtgaattccagtggagctataacgagactgatagcttttggtttaattaaagaggctggaaagaaagaagtgttgggacgtcctaacctttatgagacaactaattatttcttagattatatgggaattaatcagttagatgacttaattgacgcctcttcaattgaattagttgacgaagaagtatcgttattttcaatggattcaattaatacagaagataaggaaaacaatgagaat

SEQ ID NO: 4730 - protein, 194 aa, Streptococcus agalactiae
MTYLGSIEALLFVAGEDGLSLRQMAELLSLTPSALIQQLEKLAKRYEEDDDSSLLLLETAQTYKLVTKDSYMTLLRDYAKAPINQSLSRASLEVLSIIAYKQPITRIEIDDIRGVNSSGAITRLIAFGLIKEAGKKEVLGRPNLYETTNYFLDYMGINQLDDLIDASSIELVDEEVSLFSMDSINTEDKENNEN

SEQ ID NO: 4731 - DNA, 549 bp, Streptococcus pyogenes
atgacgtatttgtcacagatagaagcgctgctatttgttgcaggtgaagaaggattaagtttgcgacatctagcgtctatgttatcattaacgccaacagctcttcaacagcaattagaaaaactctctcaaaagtatgaaaaagatcaacattctagtctttgcttgatagaaacagctaatacctacaggctagtaactaaagaaggttttgcagaactcttgcgtgcttatgccaaaacaccaatgaaccaaagtttatctcgtgcgagtttagaggtcttgtctattgttgcatacaaacaacctattacacgaatagaaattgatgacattcgaggggtaaactccagtggagctttgagtaaattattggcatttgatctcattagagaagctggcaaaaaagatgtggttgggcgtcctcatttgtatgcgacaacagattattttctggactatatgggaattaatcatttagacgaattgattgaagtatctgccgttgaaccagcagatgaagagattgctctttttaggacacaagac

SEQ ID NO: 4732 - protein, 183 aa, Streptococcus pyogenes
MTYLSQIEALLFVAGEEGLSLRHLASMLSLTPTALQQQLEKLSQKYEKDQHSSLCLIETANTYRLVTKEGFAELLRAYAKTPMNQSLSRASLEVLSIVAYKQPITRIEIDDIRGVNSSGALSKLLAFDLIREAGKKDVVGRPHLYATTDYFLDYMGINHLDELIEVSAVEPADEEIALFRTQD

SEQ ID NO: 4733 - DNA, 705 bp, Streptococcus agalactiae
atggatattaagttaaaagatttcgaggggcccctagacttactcttgcacctcgtatctaaatatgaggttgatatatacgatgtaccgattgtggaagttattgagcagtaccttgcttatatagcaacattacaggcgatgcgtctagaagtagctggtgagtatatgcttatggcaagtcagctgatgttgataaaaagccgtaacttattacctaaagtagtggagtcaaatcctattgaagatgatccagaaatggaattgttgagccaattagaggaatatagacgttttaaagtgctaagtgaagagttagctaatcagcatcaggaacgcgccaaatatttttcaaaaccaaaacaagaagttatctttgaagatgcaattcttctacacgataaatcggtgatggatctttttttgactttttctcaaatgatgtcccaaaaacaaaaagaattgtcaaatagtcaaacggtaattgagaaagaagactaccgtattgaagatatgatgatcgttattgaaagacattttaatcttaaaaagaaaacgacattacaagaagtgtttgcggattgccaaacaaaatctgaaatgataactttatttttggcaatgttagagttgataaaattacatcaaatcacagtagaacaagacagtaattttagtcaagttatcttaagaaaggaagagaaa

SEQ ID NO: 4734 - protein, 235 aa, Streptococcus agalactiae
MDIKLKDFEGPLDLLLHLVSKYEVDIYDVPIVEVIEQYLAYIATLQAMRLEVAGEYMLMASQLMLIKSRNLLPKVVESNPIEDDPEMELLSQLEEYRRFKVLSEELANQHQERAKYFSKPKQEVIFEDAILLHDKSVMDLFLTFSQMMSQKQKELSNSQTVIEKEDYRIEDMMIVIERHFNLKKKTTLQEVFADCQTKSEMITLFLAMLELIKLHQITVEQDSNFSQVILRKEEK

SEQ ID NO: 4735 - DNA, 699 bp, Streptococcus pyogenes
atggatataaaacttaaagattttgaaggtcctcttgatttactcttacacttggtatcacagtacaaagttgacatctacgaggttcctattgttgaggttattgagcagtaccttaattatattgaaaccttacaggtaatgaaacttgaagtggctggtgactacatgctgatggcaagtcagctcatgttaatcaaaagtagaaggctattaccaaaggtggtagaacacatcgaagaagatttagaacaagatctgttagaaaagatcgaagaatatagtcgctttaaagcagttagtcaagcgttagcgaagcaacatgaccaaagggcaaaatggtattcaaaacctaaacaagaattaatttttgaagatgctatcttacaggaagataaaacggtgatggatctatttctagctttttcaaacataatggcagctaaaagagcagttttaaaaaacaaccatacagtcatcgagcgtgatgattataagattgaagacatgatggcttctattaaacagcgactggaaaaagaaaacgttattagattatcagcgatttttgaggaatgccaaacattaaatgaagttatcagtatatttttagctagtctagaattgattaagcttcacgtggtatttgtagagcagctctctaattttggggctatcatactacgaaaggagaagaaa

SEQ ID NO: 4736 - protein, 233 aa, Streptococcus pyogenes
MDIKLKDFEGPLDLLLHLVSQYKVDIYEVPIVEVIEQYLNYIETLQVMKLEVAGDYMLMASQLMLIKSRRLLPKVVEHIEEDLEQDLLEKIEEYSRFKAVSQALAKQHDQRAKWYSKPKQELIFEDAILQEDKTVMDLFLAFSNIMAAKRAVLKNNHTVIERDDYKIEDMMASIKQRLEKENVIRLSAIFEECQTLNEVISIFLASLELIKLHVVFVEQLSNFGAIILRKEKK

SEQ ID NO: 4737 - DNA, 777 bp, Streptococcus agalactiae
atgattttacagacgaatatactatcactcctaaaaacaatgataaatgatattaataattttattgagagtaagaaattatctctcaattcgcgtaagtcctatcactatgatttaaagcaattttataaaataattggtggacatgtaaattctgaaaaactggcattgtatcaacagtctctaagtgaatttaagttaacagctcgtaagcgaaagttatctgcagtcaatcaatttcttttctttttatataatagaggaacgctgaaggaattttacagactacaagagactgaaaaaatcactttggctcagacaaagtctcaaataatggatttatcaaatttctatcaagatactgattatccgagtggtcgtttgattgctttgttgattttatctttaggtttaactccggctgaaattgctaatttgaagaaggctgattttgatacaacttttaatatcttaagtattgaaaaatcgcagatgaagcgtattttaaaacttccagaagacttgcttccttttcttttggaatctttagaggaagatggtgacttagtctttgagcataacggtaagccttattctagacaatggttttttaatcaattaacagatttcttaaatgagaagaatgagcaacaactaactgcacaacttctgcgagaacaatttattctaaagcaaaaagaaaatggcaaaacgatgacggagctcagtcgccttctaggcttaaaaactcctatcactttagagagatattataga

SEQ ID NO: 4738 - protein, 259 aa, Streptococcus agalactiae
MILQTNILSLLKTMINDINNFIESKKLSLNSRKSYHYDLKQFYKIIGGHVNSEKLALYQQSLSEFKLTARKRKLSAVNQFLFFLYNRGTLKEFYRLQETEKITLAQTKSQIMDLSNFYQDTDYPSGRLIALLILSLGLTPAEIANLKKADFDTTFNILSIEKSQMKRILKLPEDLLPFLLESLEEDGDLVFEHNGKPYSRQWFFNQLTDFLNEKNEQQLTAQLLREQFILKQKENGKTMTELSRLLGLKTPITLERYYR

SEQ ID NO: 4739 - DNA, 744 bp, Streptococcus pyogenes
atgaagagttatattgaaccttttattgctagcaaggctttatctcaaaatagtcaaaaagcttatcgatacgatttgcaacagttttgtcaactgattggtgaacgtgtcaatcaagacaaactattactttatcaaaatagcatagctaacctaagtttatctgcaaaaaaacgcaaattatcaacagctaatcaattcttatattacttgtatcaaataaagtatttaaatagctattttcgattaacagacaccatgaaagtgatgcggactgagaagcagcaagctgctattattaatactgatattttctatcaaaaaaccccttttgtgtgggggcaattaatcagcttattaatattggagctgggtttaactccgagtgaagtagctggtattgaagtagctaacttggatttaaattttcaaatgttgacgctaaagactaaaaaaggtgtgcgtgtattacctttatcgcaaatactaatcccttttttagaacaacaactcgttggcaaagaagtctatctttttgaacatcgaggcatccctttttcaagacaatggttttttaatcacctaaaaacctttgttcgaagtattggttatgaaggattgactgctcaaaaattacgagagcaatttattttgaaagaaaaactagctggtaaatcgataatagaacttagcgatattcttgggctgaaaagccctatgaccttagaaaaatactacaaatca

SEQ ID NO: 4740 - protein, 248 aa, Streptococcus pyogenes
MKSYIEPFIASKALSQNSQKAYRYDLQQFCQLIGERVNQDKLLLYQNSIANLSLSAKKRKLSTANQFLYYLYQIKYLNSYFRLTDTMKVMRTEKQQAAIINTDIFYQKTPFVWGQLISLLILELGLTPSEVAGIEVANLDLNFQMLTLKTKKGVRVLPLSQILIPFLEQQLVGKEVYLFEHRGIPFSRQWFFNHLKTFVRSIGYEGLTAQKLREQFILKEKLAGKSIIELSDILGLKSPMTLEKYYKS

SEQ ID NO: 4741 - DNA, 471 bp, Streptococcus agalactiae
atgattgctaaagaatttgagtcgtttttgctaaatcatttggaccactatctaattccagctgaagacgttgctatttttgtggatacacacaatgcagaccacgttatgttactattagcaagtaatggtttttcacgtgtaccagttatcactaaagagaaaaaatatgtaggtactattagtatctcagacattatgggctaccaatctaaaggtcaattaacagattgggagatggcacagactgatattgttgagatggttaatacaaaaatcgagccgattaatgaggcagctactctgacagcaattatgcataagattgtagattatccatttttacctgttatcagtgatcaaaatgattttagaggcattataacccgtaaatcgattttaaaagctattaatagcctcctacatgattttacagacgaatatactatcactcctaaaaacaatgataaa

SEQ ID NO: 4742 - protein, 157 aa, Streptococcus agalactiae
MIAKEFESFLLNHLDHYLIPAEDVAIFVDTHNADHVMLLLASNGFSRVPVITKEKKYVGTISISDIMGYQSKGQLTDWEMAQTDIVEMVNTKIEPINEAATLTAIMHKIVDYPFLPVISDQNDFRGIITRKSILKAINSLLHDFTDEYTITPKNNDK

SEQ ID NO: 4743 - DNA, 459 bp, Streptococcus pyogenes
atgatcgcaaaagaatttgaaacatttttaatgagtcatttagataattatcttatcccggaacaagacttggctatttttatcgacacacataatgcagaccatgtgatgttactattggtgagcaatggtttttctagagttcctgttatcacacgggagaaaaaatatgtgggaaccattagcatctcagatattatgatgtaccaatctaaaaggcagctgacagattgggaaatgagtcaaacagatattggcgagatggttaataccaaaattgaaaccattagcattacttctagcctaacagaaattatgcacaagttaattgatttcccattcttaccggttgtagatagagcgaatcgctttgttgggattattacgcgaaaatctatattaaaggctgtcaacagtcttttacatgattttacagatgattacacgattataaaaaaa

SEQ ID NO: 4744 - protein, 153 aa, Streptococcus pyogenes
MIAKEFETFLMSHLDNYLIPEQDLAIFIDTHNADHVMLLLVSNGFSRVPVITREKKYVGTISISDIMMYQSKRQLTDWEMSQTDIGEMVNTKIETISITSSLTEIMHKLIDFPFLPVVDRANRFVGIITRKSILKAVNSLLHDFTDDYTIIKK

SEQ ID NO: 4745 - DNA, 519 bp, Streptococcus agalactiae
atggcaattagaaaattagttgtaatgagtgattctcacggagatcgtgacattgtaaaagatataaagaatcattatttgggaaaagtggatgctatttttcacaatggggattccgaacttcctagctcagatcctatatgggaaggcattcatgtggtcacaggaaattgtgattatgattcaggttatccggaagttttggttacaaaaatagataatgctgttattgttcaaacccatggtcatctccatcagattaattttacctgggataaattggatttattagctcagcaagaagacgcggatatttgtttatatggtcatcttcatcgtgcagatgcttggaaaaatggtaaaactatttttatcaatccaggtagtgttttgcagccaagaggaccaataaatgagaagctttacgctgttgtaactataacagatagtaaggttttggtagagtattatactcgccaacaccaaccctatcctaacttgacaaaggaattatcaaga

SEQ ID NO: 4746 - protein, 173 aa, Streptococcus agalactiae
MAIRKLVVMSDSHGDRDIVKDIKNHYLGKVDAIFHNGDSELPSSDPIWEGIHVVTGNCDYDSGYPEVLVTKIDNAVIVQTHGHLHQINFTWDKLDLLAQQEDADICLYGHLHRADAWKNGKTIFINPGSVLQPRGPINEKLYAVVTITDSKVLVEYYTRQHQPYPNLTKELSR

SEQ ID NO: 4747 - DNA, 519 bp, Streptococcus pyogenes
atggcaagcaaaacaatcatagtaatgagtgactctcatggtgaccgagatatcgttcaagccattaaagacaagtatcttggtcaagttgatgctattttccataatggggattctgaattaaacagctcagatcctatttgggctggtatttatgtcgttggcggtaattgtgactatgatacaggttaccctgatcgtttagtaactcaattaggcacagttacgattgcccagacacatggtcacttgtaccatattaatttcacttgggataaactggactactttgctcaagaagtagtagcagatatttgtctatatggacacctacaccgtccagctgcttggcaagttgggcaaaccctctttatgaatcccggatcagtaacacaacctcgcggagaaattaacgagaaattatatgctcgtgttgaactaactgatactcaaattaaagttgattactttaccagagatcataaactttacccatcactgtctaaggaatttaaacga

SEQ ID NO: 4748 - protein, 173 aa, Streptococcus pyogenes
MASKTIIVMSDSHGDRDIVQAIKDKYLGQVDAIFHNGDSELNSSDPIWAGIYVVGGNCDYDTGYPDRLVTQLGTVTIAQTHGHLYHINFTWDKLDYFAQEVVADICLYGHLHRPAAWQVGQTLFMNPGSVTQPRGEINEKLYARVELTDTQIKVDYFTRDHKLYPSLSKEFKR

SEQ ID NO: 4749 - DNA, 972 bp, Streptococcus agalactiae
atgacaaaaacaatttttgaaagtaaaactgaaggcaattggtttttaggtagtttccaagcttttaattattttacttgttttggtaatgatgaatcttacgaagctatccaagatgtttttcatcgtctattatcaactttgaaagttgaaggtctacagcttcacgttgtgcagatgacttcggattttcaattattagcattcctcgttgatatgattaatcaagagtattcaaggcatatcaaagtgactcaacataaaggggccatcttagttagtgaagatgatcagttgttcttagttcacttacctaaagagggcacttctttagaaaaattctttgatttaaagaatgataataattttggggataccatattaattgcgactcacaatgaaggaaaaacgaaggaatttagagaattatttgggaaattaggactcaaagttgaaaatttaaatgattacccagatttaccagaagttgaagagactggtatgacctttgaagaaaatgctcgacttaaagcagagactatttcaaaattaactggaaaaatggtaatttcagatgattccggattaaaagtagatgctttaggtggtttgccaggggtatggtctgctcgtttttcaggtcctgacgcgacagatgctcgtaataatgccaaattattgcatgaattagccatggtatttgacaaagaaagacgttcagcacagtttcatacaaccttagtcgtgtcagctccaaataaagaaagtttggtagttgaagcagagtggccaggttatattggtacggaacctaagggggaaaatggctttggttatgatccgctctttattgtcggagaaggtagtaggacagcagctgaattgagcgcacaagaaaaaaataatctatcacatcgtgggcaagctgtccgtaaattgatggaggtatttccaaaatggcaattagaaaat

SEQ ID NO: 4750 - protein, 324 aa, Streptococcus agalactiae
MTKTIFESKTEGNWFLGSFQAFNYFTCFGNDESYEAIQDVFHRLLSTLKVEGLQLHVVQMTSDFQLLAFLVDMINQEYSRHIKVTQHKGAILVSEDDQLFLVHLPKEGTSLEKFFDLKNDNNFGDTILIATHNEGKTKEFRELFGKLGLKVENLNDYPDLPEVEETGMTFEENARLKAETISKLTGKMVISDDSGLKVDALGGLPGVWSARFSGPDATDARNNAKLLHELAMVFDKERRSAQFHTTLVVSAPNKESLVVEAEWPGYIGTEPKGENGFGYDPLFIVGEGSRTAAELSAQEKNNLSHRGQAVRKLMEVFPKWQLEN

SEQ ID NO: 4751 - DNA, 1023 bp, Streptococcus pyogenes
ttggctgaaacaaaaaataaatgtggagcatgtcaccttatgagtgaaaaaatttacgaatacaaagatgaaaataactggtttatcggaaagatgactggtcataatttaatatcgggctggggagtcaaacacacgacaatcaaaaaaatagatgaccttttagacggtattgccgcaacgttagattgggaaaatcctaaaggttacgatgtttcggtggtgcgtcatcagtctcctttatctctcatcacctttattatcgacatgataaatcaagagacccagcgtgagattaaggtaactccccatgcaggcacgattttattaatggaaaatgcgaaactgcttgcagtttatctcccagaaggtggagtttcaacggctacattttttgcgactagtgaacagggatttggggatattattttaatcgctacacgaaacgagggaaaaaccaaagagttccgcaatctgtttggccagctaggttatcgtgtggaaaatcttaatgattatccagaattgccagaagtagcagaaactggtactacttttgaagaaaatgctcgcttgaaagcagaaacgatttcacgcctcacaggaaaaatggtattagcagacgattcaggactaaaagttgatgccttgggtggtttacctggtgtttggtcagctcgtttctcaggaccagatgccacagatgccaagaataatgccaaactcttacacgaattagctatggtgtttgaccaaaagaagcgctcagctcaatttcatacgactttggtagtggctgctcccaataaagatagtttggttgtggaagccgattggccaggctatattgctacgcagcctaagggagaaaatggttttgggtatgatcctgtctttatcgtcggagagactgggcatcatgctgcagaattagaggctgaccaaaaaaatcagttgtcgcatagaggtcaagcagttcgaaaattaatggaggtctttccagcatggcaagcaaaacaatca

SEQ ID NO: 4752 - protein, 341 aa, Streptococcus pyogenes
LAETKNKCGACHLMSEKIYEYKDENNWFIGKMTGHNLISGWGVKHTTIKKIDDLLDGIAATLDWENPKGYDVSVVRHQSPLSLITFIIDMINQETQREIKVTPHAGTILLMENAKLLAVYLPEGGVSTATFFATSEQGFGDIILIATRNEGKTKEFRNLFGQLGYRVENLNDYPELPEVAETGTTFEENARLKAETISRLTGKMVLADDSGLKVDALGGLPGVWSARFSGPDATDAKNNAKLLHELAMVFDQKKRSAQFHTTLVVAAPNKDSLVVEADWPGYIATQPKGENGFGYDPVFIVGETGHHAAELEADQKNQLSHRGQAVRKLMEVFPAWQAKQS

SEQ ID NO: 4753 - DNA, 870 bp, Streptococcus agalactiae
ttgactgattggttattgtatagagaggctaggactgttgtccagcctcttttagtcactaatattggaggaataaaaatggatagtaggcctattggctttctagattctggtgtaggtggtttaacggttgttaaggaaatgttccgtcaacttccagaagaggaagtaatcttcattggagatcaggctagagctccgtatggtcctagacctgctcaacagattagagagtttacctggcagatggttaacttcttattgactaaaaatgttaagatgattgttatagcttgtaatacagcaactgcagttgcctggcaagaaattaaagaaaaactagacatccctgttttaggcgttattttaccaggagctagcgcagctatcaaatcaactaatttagggaaagttggtattataggtactcccatgactgttaaatcagatgcttatcgtcaaaaaattcaagctttgtctccaaatactgctgtggtatcccttgcttgtccgaaatttgttccaattgtggaatcaaatcagatgtcttctagtttagccaaaaaggtggtttatgaaacgttgtccccattagttggtaaattagatactttaattttaggttgcacgcattatcccctattacgtcccatcattcaaaatgttatgggggctgaggttaaattaattgatagtggcgcagaaaccgttcgtgatatttctgttttattgaactattttgagataaaccataattggcaaaataaacacggtggtcatcacttttacacaaccgccagcccaaaaggttttaaagaaattgcagaacaatggcttagtcaagaaataaatgtggagcgtatcgtatta

SEQ ID NO: 4754 - protein, 290 aa, Streptococcus agalactiae
MTDWLLYREARTVVQPLLVTNIGGIKMDSRPIGFLDSGVGGLTVVKEMFRQLPEEEVIFIGDQARAPYGPRPAQQIREFTWQMVNFLLTKNVKMIVIACNTATAVAWQEIKEKLDIPVLGVILPGASAAIKSTNLGKVGIIGTPMTVKSDAYRQKIQALSPNTAVVSLACPKFVPIVESNQMSSSLAKKVVYETLSPLVGKLDTLILGCTHYPLLRPIIQNVMGAEVKLIDSGAETVRDISVLLNYFEINHNWQNKHGGHHFYTTASPKGFKEIAEQWLSQEINVERIVL

SEQ ID NO: 4755 - DNA, 792 bp, Streptococcus pyogenes
atggatacaagaccaattgggtttttagattctggtgtgggaggtctgaccgtcgtttgtgaattgattcgtcagctccctcatgagaagattgtatatattggtgattcagcaagagccccctatggtcctagacccaaaaaacaaattaaggagtatacttgggagctagtcaattttttgctgactcaaaatgttaaaatgattgtttttgcatgcaataccgcaacagcggtggcttgggaagaagtaaaagcagctttagatattcctgttttaggagttgtcttaccgggggcaagcgcagctattaaatcaacgacaaaaggccaggttggggtcatcggaaccccaatgacagtggcttcagacatttatcgcaaaaaaatccagctattagcaccatctattcaagtaaggagtcttgcttgcccgaagtttgtaccgattgtggaatcaaatgagatgtgttcgagtatagctaaaaaaatagtttatgacagtctagcaccattagtcggtaaaatagatacccttgtactaggatgtactcactatcccttgttacgaccaattatccaaaatgttatggggccatctgttaagctgattgacagtggagcagaatgcgtccgagatatctctgtcttattaaactattttgacattaacggtaattatcatcaaaaagctgtcgaacaccgcttttttacaacagcaaatcctgagatttttcaagaaattgcctcgatttggctgaaacaaaaaataaatgtggagcatgtcacctta

SEQ ID NO: 4756 - protein, 264 aa, Streptococcus pyogenes
MDTRPIGFLDSGVGGLTVVCELIRQLPHEKIVYIGDSARAPYGPRPKKQIKEYTWELVNFLLTQNVKMIVFACNTATAVAWEEVKAALDIPVLGVVLPGASAAIKSTTKGQVGVIGTPMTVASDIYRKKIQLLAPSIQVRSLACPKFVPIVESNEMCSSIAKKIVYDSLAPLVGKIDTLVLGCTHYPLLRPIIQNVMGPSVKLIDSGAECVRDISVLLNYFDINGNYHQKAVEHRFFTTANPEIFQEIASIWLKQKINVEHVTL

SEQ ID NO: 4757 - DNA, 237 bp, Streptococcus agalactiae
atgtcaataactatttggattttattaattatcgtcgctttgtttggtggtctcgtgggaggcatttttattgctcgtaaacaaattgaaaaagagattggagagcaccctcgtttaacaccggatgctattcgtgaaatgatgagtcaaatgggacaaaaacctagtgaagctaaagttcaacaaacataccgtaatattgtaaaacacgcaaaaacagctatcaaaactaaaaaa

SEQ ID NO: 4758 - protein, 79 aa, Streptococcus agalactiae
MSITIWILLIIVALFGGLVGGIFIARKQIEKEIGEHPRLTPDAIREMMSQMGQKPSEAKVQQTYRNIVKHAKTAIKTKK

SEQ ID NO: 4759 - DNA, 240 bp, Streptococcus pyogenes
atgtcaacagctatttggattttattacttattgttgcccttggggtaggtgtttttggtgggatttttattgcccgtaaacaaattgaaaaagaaattggtgaacacccacgtttaacaccagaagctatccgtgaaatgatgagccagatggggcaaaaaccaagtgaagcaaaaatccaacaaacttatcgtaatatcatcaaacaatcaaaagcagccgtatccaaaggcaaaaaa

SEQ ID NO: 4760 - protein, 80 aa, Streptococcus pyogenes
MSTAIWILLLIVALGVGVFGGIFIARKQIEKEIGEHPRLTPEAIREMMSQMGQKPSEAKIQQTYRNIIKQSKAAVSKGKK

SEQ ID NO: 4761 - DNA, 315 bp, Streptococcus agalactiae
atgttaatagctacagcaaataacaatgtttgccatttactcatcaataaagagggctttgacttaatcaagaaagccgcaattaatgcaaatccgatatgtgataaagctctaagaacgattacaatcggaaaaccagctagtagaaatccaagtcctgtccctaaagctaccaatattgcaactggaacagatataaaaatacttaaaaataaaggtacatggcttgctaaggtgaaagaagcaggcccaataattattttagcaggcatgattataggaatcatgattgcaaaagctactaaaatagaagta

SEQ ID NO: 4762 - protein, 105 aa, Streptococcus agalactiae
MLIATANNNVCHLLINKEGFDLIKKAAINANPICDKALRTITIGKPASRNPSPVPKATNIATGTDIKILKNKGTWLAKVKEAGPIIILAGMIIGIMIAKATKIEV

SEQ ID NO: 4763 - DNA, 573 bp, Streptococcus agalactiae
ttgttttgtataatagcttcaaaggagataaaaatgtcaaaaaaaacaacacaaatggtttcttatacttctattttagtagcttttgcaatcatgattcctataatcatgcctgctaaaataattattgggcctgcttctttcaccttagcaagccatgtacctttatttttaagtatttttatatctgttccagttgcaatattggtagctttagggacaggacttggatttctactagctggttttccgattgtaatcgttcttagagctttatcacatatcggatttgcattaattgcggctttcttgattaagtcaaagccctctttattgatgagtaaatggcaaacattgttatttgctgtagctattaacataattcatggtctgctcgaatttattactgtttatataatcacaatgacttctaacagtagttcaacttatttatggtcactattttctttgataggactaggctctttgctacatggattggtagatttttacatagctctcttcatttggaaatggatgacacaaaagttggggaaaacacttaggataaga

SEQ ID NO: 4764 - protein, 191 aa, Streptococcus agalactiae
MFCIIASKEIKMSKKTTQMVSYTSILVAFAIMIPIIMPAKIIIGPASFTLASHVPLFLSIFISVPVAILVALGTGLGFLLAGFPIVIVLRALSHIGFALIAAFLIKSKPSLLMSKWQTLLFAVAINIIHGLLEFITVYIITMTSNSSSTYLWSLFSLIGLGSLLHGLVDFYIALFIWKWMTQKLGKTLRIR

SEQ ID NO: 4765 - DNA, 540 bp, Streptococcus pyogenes
atgactaaaaaaccaacacaactaatagcttatacctctattttggtcgcatttgcgattttgattccgataatcatgcctcttaagcttattattggaccagcttcctttactctggcgagccatgttcctttgtttttggctatttttatgtcgattccagtagcaattttggtcgctcttggtaccacattaggttttttattagctggactacctttaattattgttttaagagcactctctcatttattgtttgctattttggcagcgtggtggttaagtagaaaaccacaattgatgacatcggcagtaaaatgttttagttttgcgtttttcattaatgtcattcatggcttggctgaatttttagttgtctatattttaacagcaaccacagcaacttctatgtcttatttttggtctatgctaggcttgattggcttaggttcgcttattcatggcatattggatttctatcttgctttagttctatggcgttttttagcaaaaaacttaaaacttcccaccataaatgcc

SEQ ID NO: 4766 - protein, 180 aa, Streptococcus pyogenes
MTKKPTQLIAYTSILVAFAILIPIIMPLKLIIGPASFTLASHVPLFLAIFMSIPVAILVALGTTLGFLLAGLPLIIVLRALSHLLFAILAAWWLSRKPQLMTSAVKCFSFAFFINVIHGLAEFLVVYILTATTATSMSYFWSMLGLIGLGSLIHGILDFYLALVLWRFLAKNLKLPTINA

SEQ ID NO: 4767 - DNA, 519 bp, Streptococcus agalactiae
atgaaggcacaggagcgtcgagaaaatattttaacgactttaaaaggaacaaaagaagctatatcggcaagcacattagcaaagatttttagtgttagtaggcaggtgattgttggagatattgccttattgcgtgcacaacaatgtgatattatttctaccccaaaaggataccttatgtccagtgctctaagtactcatcaattcacagctagattggtttgtcagcatggcatagaacagacagaagaagaactggaaattattttgcggtatcaaggaatcattatgaatgtggaggtagagcaccctatttatgggatgctgactgctcccttaaacattcaaagccaaaaagacattgataattttactgctaaattaaaagtttccaatgcagaattgctatcctctttgacagatggtctacatacacatatgatttcttgtcaagatcagtcagtttttgaccaaatatgtgaggctctaaaaaaagcaggaattttatacatagacaaa

SEQ ID NO: 4768 - protein, 173 aa, Streptococcus agalactiae
MKAQERRENILTTLKGTKEAISASTLAKIFSVSRQVIVGDIALLRAQQCDIISTPKGYLMSSALSTHQFTARLVCQHGIEQTEEELEIILRYQGIIMNVEVEHPIYGMLTAPLNIQSQKDIDNFTAKLKVSNAELLSSLTDGLHTHMISCQDQSVFDQICEALKKAGILYIDK

SEQ ID NO: 4769 - DNA, 519 bp, Streptococcus pyogenes
atgaaagcagaagatcgtcgtcaaaaaattattgagtgcttaaatagtgaacaaaaagctgtatctgctactcgtttaggtaagttattaggagtgagtcgccaagtaatcgttggagatatagctcttcttcgagctcagcagattgatattatttcgactccaaaaggttatattatgtcaacagcactttatagtcaccaattttgtgcacgtattgtgtgccaacataatgtagaagaaactaaaaaagaattagaaattattttagctcatcaagggattattacgacggtagaggtagaacatcctatttacggtatgataacagcccctttaaatattaagacacactctgatgtaactaatttcatgtccaaactcagtcaatctaaagcagagttattgtcttcgttgacagaaggactacatagtcacttaatttcgtgtcctagtcaagaagcctttttagctattaagcatgatttagaattagcaggtatcttatacaaaggaata

SEQ ID NO: 4770 - protein, 173 aa, Streptococcus pyogenes
MKAEDRRQKIIECLNSEQKAVSATRLGKLLGVSRQVIVGDIALLRAQQIDIISTPKGYIMSTALYSHQFCARIVCQHNVEETKKELEIILAHQGIITTVEVEHPIYGMITAPLNIKTHSDVTNFMSKLSQSKAELLSSLTEGLHSHLISCPSQEAFLAIKHDLELAGILYKGI

SEQ ID NO: 4771 - DNA, 687 bp, Streptococcus agalactiae
atgaatgataacgtcatttacacacaatctgattcagggctgaatcaattttttgctaagatttacggtcttgtagggataggagtaggtttgtcagctgctgtttctgcgattatgctgtatatgtttccacaaaatatgattgccatcatgcaaaaaatgccagggttgtattttggagcaatcatcttagaattggttttagtctttgttgctagtggagcggcgcgtcgaaacacaccagctgcattaccattatttttgatttattcagctttgaatgggtttactttaagtttcattatcgcaaggtacacgcaaactacagttcttcaagcttttataacatctgcggctgttttctttgcaatggctttgattggagctaagactaaaaaagatttatcaggtatgcgtaaagcgttaatggctgctttaattgggattttaattgcaagtcttgttaatttatttatcggtagtgggggtatgagttatatcattagtatcgtatgtgtcatcatcttttctggattgattgcttacgataaccaaatgattaaatatgtctacaatagccaaggcggccaagtcgcagatggttgggcagtttcgatggcactaagcctttatcttgattttattaatctattcttaaatattcttcgtctttttgcacgaaatgat

SEQ ID NO: 4772 - protein, 229 aa, Streptococcus agalactiae
MNDNVIYTQSDSGLNQFFAKIYGLVGIGVGLSAAVSAIMLYMFPQNMIAIMQKMPGLYFGAIILELVLVFVASGAARRNTPAALPLFLIYSALNGFTLSFIIARYTQTTVLQAFITSAAVFFAMALIGAKTKKDLSGMRKALMAALIGILIASLVNLFIGSGGMSYIISIVCVIIFSGLIAYDNQMIKYVYNSQGGQVADGWAVSMALSLYLDFINLFLNILRLFARND

SEQ ID NO: 4773 - DNA, 687 bp, Streptococcus pyogenes
atgaacgatcacgttatttatacacaatcagatgtgggattaaatcagttttttgctaaaatttatagtctagtgggaatgggagtgggtttgtctgcttttgtttcttatttgatgctttatccatttagagaaaatttaatctctattcttgttaatcagccgatgatttactatggtgctgcgattattgaacttattttagtttttgtagccagtagtgcagcacgaaaaaacacaccagctgcattgcccatttttcttatctattctgcgctaaatggctttaccctaagctttattattgtggcatacgctcaaacgacagtttttcaagcatttctttcttcagcagctgtgttttttgccatgtcaatcattggtgtcaagactaaacgggatatgtcaggtcttagaaaggctatgtttgctgctttgattggtgttgttgtggctagtctgattaatctttttattggtagtgggatgatgagttatgtcattagtgtgatttccgtgctaattttctcaggtctcatcgcatcagataatcaaatgattaagcgcgtttatcaagcaacaaatggccaggttggtgatggctgggctgttgctatggccttaagcttgtatttagattttattaacttatttatcagccttcttcgtatttttggaagaaatgat

SEQ ID NO: 4774 - protein, 229 aa, Streptococcus pyogenes
MNDHVIYTQSDVGLNQFFAKIYSLVGMGVGLSAFVSYLMLYPFRENLISILVNQPMIYYGAAIIELILVFVASSAARKNTPAALPIFLIYSALNGFTLSFIIVAYAQTTVFQAFLSSAAVFFAMSIIGVKTKRDMSGLRKAMFAALIGVVVASLINLFIGSGMMSYVISVISVLIFSGLIASDNQMIKRVYQATNGQVGDGWAVAMALSLYLDFINLFISLLRIFGRND

SEQ ID NO: 4775 - DNA, 510 bp, Streptococcus agalactiae
gtgattataatgaaaaagtatcaagacgataaggacttcatggatttggtcggtcaccttattgaccatccacgtttccaaaaactcgaagctattgtccaacatcatcactcaactcgcttagagcattctataaatgttagttatacaagttataaaattgctaagaagtttggttgggatgcgagtagtactgctcgaggtggtttactacatgatttcttttattatgattggcgtgtaacgaaatttaacaagagccatgcctgggttcatccaaggatagcggttcgtaatgcgcgaaaattaactgatttaaacgctagagaagaagatattattttgaagcacatgtggggagcgactattgcaccgccacgttataaagaaagttatattgtgactatggttgataagtattgggcagtacgagaggcttctcgtccactcaaacgtatttttaagaaacctatccgttttagtcgcaaattcttaggtagtcataatcat

SEQ ID NO: 4776 - protein, 170 aa, Streptococcus agalactiae
MIIMKKYQDDKDFMDLVGHLIDHPRFQKLEAIVQHHHSTRLEHSINVSYTSYKIAKKFGWDASSTARGGLLHDFFYYDWRVTKFNKSHAWVHPRIAVRNARKLTDLNAREEDIILKHMWGATIAPPRYKESYIVTMVDKYWAVREASRPLKRIFKKPIRFSRKFLGSHNH

SEQ ID NO: 4777 - DNA, 498 bp, Streptococcus pyogenes
atgcattatacagaagataaagaatatatggaacacgtcggtcatttgatcgctcatcctcgctttcaaaaattgagtcatattgttcagcaccaacattcaacgcgtcttgaacattctatcaatgtttcttattcaagttataaattagccaagcgattcggttgggatgctaaaagtacagccagagggggcttacttcatgatttcttttattatgattggcgcgtgaccaagtttaataagggtcatgcctgggttcatcctcgtattgctgtacgaaatgcgaaaaagttaacagaactcaataaaaaagaagaggatatcattctaaaacacatgtggggagcgaccattgcttttccgcgttacaaggaaagttatattgtgacaatggtagataaatactgggctgtcaaggaagcagtgacgcctttgagacaaaaatggtctaatcgacggtttcttcgccgcaagaccctccaaagtcataatcgt

SEQ ID NO: 4778 - protein, 166 aa, Streptococcus pyogenes
MHYTEDKEYMEHVGHLIAHPRFQKLSHIVQHQHSTRLEHSINVSYSSYKLAKRFGWDAKSTARGGLLHDFFYYDWRVTKFNKGHAWVHPRIAVRNAKKLTELNKKEEDIILKHMWGATIAFPRYKESYIVTMVDKYWAVKEAVTPLRQKWSNRRFLRRKTLQSHNR

SEQ ID NO: 4779 - DNA, 687 bp, Streptococcus agalactiae
ttgttacaaaaaaaatatcggaaatcttcatatcttattgaaggctggcatttatttgaggaagctgaaaaatatggtgcacaatttttaaatatttttgtgacagaaacggcaatagatcgtttgagaaaacccgagagagctattgttgttacagatgatgttttgaaagaattaactgactcacagactcctcaagggattgtagctgagattgcctttcaagagacaagatggacagatattaaaaaaggacgttttcttgtattagaagatgtgcaggatccaggaaacctaggaacaatggttcgaactgcagatgcagcgaattttgatgctgtttttttatctcagaaatctgctgatttgtataaccaaaaaacacttcgttctatgcaaggcagtcactttcatttaccagtatttagggtagaaatagagcagtttgttaacttttgtaaagcagaagggataactatgattgcgacaactttatctgaacaatcggtaaattataagaatctccctaaatatgattattttgctttaatcatgggaaatgagggacagggaatttccaaaactatgacagaagaagcagatgttttagcacatattgaaatgcctggacaagcagaaagtcttaatgtagcagtagctgcgggagtagtcattttcagcttaatt

SEQ ID NO: 4780 - protein, 229 aa, Streptococcus agalactiae
MLQKKYRKSSYLIEGWHLFEEAEKYGAQFLNIFVTETAIDRLRKPERAIVVTDDVLKELTDSQTPQGIVAEIAFQETRWTDIKKGRFLVLEDVQDPGNLGTMVRTADAANFDAVFLSQKSADLYNQKTLRSMQGSHFHLPVFRVEIEQFVNFCKAEGITMIATTLSEQSVNYKNLPKYDYFALIMGNEGQGISKTMTEEADVLAHIEMPGQAESLNVAVAAGVVIFSLI

SEQ ID NO: 4781 - DNA, 735 bp, Streptococcus pyogenes
atggttattacatcaaaagcaaatcaactaattaagcaaacaaaaaaattattgcaaaaaaagcatcgaaaacagtcctatttgattgagggctggcacctttttgaagaagcccaaaaatcaggacaagtttttcgccacatctttgttttagaggaaatggtggagcgtctagcaggtgagcaagaactcgttattgttagcccacaagtgctcaaggagttgactgactctcctagtccacaaggcattgttgctgaggtggagatacctaagttagcctttccatcagattacaaagggaaatatttggttttagaggacgtccaagacccaggaaatcttgggaccatcattcgtacagcagacgctgcacggtttgatggggtctttctttctgaaaaatcagcagatatttacaaccaaaaaaccctacgttccatgcaaggtagccattttcatttaccaatttggcgaacagatgtctatcagctttgtcgagagctccaagagtatgaaactcccatcctagcaacaactctgtcaaagaaatctgttgattataaaagcctcacacatcatgaaaggttagctttggtgttgggaaatgaaggccagggcattagtgctgaaatggcagccctagcagaccaactggttcatattacaatgcctggtcaggcggaaagtttgaatgttgccgtagcagcaggaatcctcattttcagcttgatt

SEQ ID NO: 4782 - protein, 245 aa, Streptococcus pyogenes
MVITSKANQLIKQTKKLLQKKHRKQSYLIEGWHLFEEAQKSGQVFRHIFVLEEMVERLAGEQELVIVSPQVLKELTDSPSPQGIVAEVEIPKLAFPSDYKGKYLVLEDVQDPGNLGTIIRTADAARFDGVFLSEKSADIYNQKTLRSMQGSHFHLPIWRTDVYQLCRELQEYETPILATTLSKKSVDYKSLTHHERLALVLGNEGQGISAEMAALADQLVHITMPGQAESLNVAVAAGILIFSLI

SEQ ID NO: 4783 - DNA, 345 bp, Streptococcus agalactiae
atgagattatttgattttgaagttataatagtagtcataaacctattatatcagaaaagaggtcaagttatgaaaaaagttcatttaattgtctcagggcgcgttcaaggagtcggatttcgctatgcaacttattccttagctttagaaataggtgatatttacggtcgcgtttggaataacgatgatggaactgttgaaattttagcacaatctacagattcaaataaaatgacacaatttattcagaaaattcgaaaaggaccttcaaaatggtctaaagtaacttatgttgatattaaactagataacttcgatgattttaatgactttaaaatgagtaat

SEQ ID NO: 4784 - protein, 115 aa, Streptococcus agalactiae
MRLFDFEVIIVVINLLYQKRGQVMKKVHLIVSGRVQGVGFRYATYSLALEIGDIYGRVWNNDDGTVEILAQSTDSNKMTQFIQKIRKGPSKWSKVTYVDIKLDNFDDFNDFKMSN

SEQ ID NO: 4785 - DNA, 309 bp, Streptococcus pyogenes
atgtgctataataaaagcaaggaggcccttcttatgcaaaaagtacgtttaattgtttctggacgtgtacaaggtgttggttttcgatacgctacccatactttagctctagatataggagatatttatggtcgtgtctggaataacaacgatgggaccgttgaaattctggcccaatcaaaagattcagataaaatagccacatttattcaagaagttcgtaaaggaccatccaaatgggcaaaagtcacttatgtggatgtcaccatggctaattttgaagactttcaggactttcaaataggcaag

SEQ ID NO: 4786 - protein, 103 aa, Streptococcus pyogenes
MCYNKSKEALLMQKVRLIVSGRVQGVGFRYATHTLALDIGDIYGRVWNNNDGTVEILAQSKDSDKIATFIQEVRKGPSKWAKVTYVDVTMANFEDFQDFQIGK

SEQ ID NO: 4787 - DNA, 930 bp, Streptococcus agalactiae
ttgaaaaaaacattgaaacgtatcttattctctagcttatctttgtctatgttattattattgacaggatgtgttagcgttgataaggctggaaaaccctatggagttatctggaatactcttggagtgcctatggccaacctcattacttatttcgctcaacaccaagggcttggttttggtgtcgctatcattattgtaaccgtcatcgtacgtgtcgttatcttaccacttggactttatcagtcttggaaagctagctatcaagctgaaaaaatggcatactttaagcctttatttgaacctattaatgaacgactacgcaatgctaaaacacaagaagaaaaattagcagctcagacagaattaatgacagctcaacgtgagaatggccttagcatgtttggcggtattggctgcttgccattactcattcagatgccatttttctcagctattttctttgctgcacgctatactcctggagtctctagtgcaaccttcttgggacttaacttaggtcaaaagagtctgacacttactgtcattatcgccattctttattttgtacaatcttggttgtcaatgcaaggtgttccagatgaacaacgtcagcaaatgaaaacaatgatgtatctgatgccaataatgatggtattcatgtctattagtttacctgctagtgttgcgctttattggtttattggtggtattttcagtattatccagcagctagttacgacttatgtacttaagcctaaactacgccgaaaagtagaagaagaatatactaaaaatcctcctaaagcctacaaagctaataacgcacgaaaagatgttacaaattcaactaaagccactgaatctaatcaagcaattattacatctaaaaaaacaaatcgtaacgccggaaaacaaaaaagacgggga

SEQ ID NO: 4788 - protein, 310 aa, Streptococcus agalactiae
MKKTLKRILFSSLSLSMLLLLTGCVSVDKAGKPYGVIWNTLGVPMANLITYFAQHQGLGFGVAIIIVTVIVRVVILPLGLYQSWKASYQAEKMAYFKPLFEPINERLRNAKTQEEKLAAQTELMTAQRENGLSMFGGIGCLPLLIQMPFFSAIFFAARYTPGVSSATFLGLNLGQKSLTLTVIIAILYFVQSWLSMQGVPDEQRQQMKTMMYLMPIMMVFMSISLPASVALYWFIGGIFSIIQQLVTTYVLKPKLRRKVEEEYTKNPPKAYKANNARKDVTNSTKATESNQAIITSKKTNRNAGKQKRRG

SEQ ID NO: 4789 - DNA, 921 bp, Streptococcus pyogenes
ttgaaactaacattaaatcgcatcctcttttcaggactagcactgtcaattctactcaccttgacaggctgtgtgggaagagacgctcacggaaatcccaaaggtatgatttgggaatttcttggaaaacccatgtcatactttatcgattactttgcaaacaatgctggactaggttatggactggctatcatcatcgtaaccattattgttagaacacttatcttaccactaggtctatatcaatcttggaaagcaagttatcaatctgagaaaatggccttcttgaaacctgtttttgaaccaatcaacaaacgtatcaaacaggcaaatagtcaggaagaaaaaatggctgcccaaacagaattaatggctgctcagcgtgctcatgggattaaccctcttggaggtattggatgtctacctcttctcatccagatgccattcttttctgccatgtattttgccgctcaatacactaaaggagtatcaacaagcacctttatgggtattgatcttggtagccgtagtttagtgttaacagcaattatcgctgctctttacttcttccaatcatggttatcaatgatggccgtttcagaagaacaacgtgagcaaatgaagacgatgatgtacaccatgcctatcatgatgatcttcatgtccttctcactccctgctggtgttggtctttactggctagttggtggtttctttagtattattcaacagttaatcacaacctacctcttaaaacctcgattgcataagcaaattaaagaagaatacgctaaaaacccgcctaaagcataccaatcaacttcttctcgtaaggacgttacgccttcacaaaacatggaacaggctaacttgcctaaaaaaataaaatccaatcgtaatgctggaaaacagcgaaagcgt

SEQ ID NO: 4790 - protein, 307 aa, Streptococcus pyogenes
LKLTLNRILFSGLALSILLTLTGCVGRDAHGNPKGMIWEFLGKPMSYFIDYFANNAGLGYGLAIIIVTIIVRTLILPLGLYQSWKASYQSEKMAFLKPVFEPINKRIKQANSQEEKMAAQTELMAAQRAHGINPLGGIGCLPLLIQMPFFSAMYFAAQYTKGVSTSTFMGIDLGSRSLVLTAIIAALYFFQSWLSMMAVSEEQREQMKTMMYTMPIMMIFMSFSLPAGVGLYWLVGGFFSIIQQLITTYLLKPRLHKQIKEEYAKNPPKAYQSTSSRKDVTPSQNMEQANLPKKIKSNRNAGKQRKR

SEQ ID NO: 4791 - DNA, 663 bp, Streptococcus agalactiae
gtgataaactgggatgccatttttaatttggaactagctgttaaggcttttccaagtgttattcaggggttaccatataccattggattatccttggttggctttattttaggagctatcgtaggattctttgtagctctaatgaagatgtctcatttccgcttactgaggtatctagctaatattcatatttccttaatgcgtgggattcctttaatggttctactctttcttatctactttggtttgccttttatagggatacagttagatgctgtgactgcttctatcgtaggttttaccatgatgtctagtgcatatatatcagaaattatcagagcagctcttttagctgttgatcatggtcagtgggaagctgctagagctttagggttaaaaacaccgacgatttatagaggcattattattccgcaagcaacaagaattgcactcccttctttaagtaatgttttgctagatatggtcaagagttcctcattgactgcgatgattacggtacctgatatctttaataatgctaaaatagttgggggaacctactccgactatatgaccgcctatatcttagtagcccttatctattgggtaatttgtacgctttatgcaattattcaagactggtgggaaaaacgattactttat

SEQ ID NO: 4792 - protein, 221 aa, Streptococcus agalactiae
MINWDAIFNLELAVKAFPSVIQGLPYTIGLSLVGFILGAIVGFFVALMKMSHFRLLRYLANIHISLMRGIPLMVLLFLIYFGLPFIGIQLDAVTASIVGFTMMSSAYISEIIRAALLAVDHGQWEAARALGLKTPTIYRGIIIPQATRIALPSLSNVLLDMVKSSSLTAMITVPDIFNNAKIVGGTYSDYMTAYILVALIYWVICTLYAIIQDWWEKRLLY

SEQ ID NO: 4793 - DNA, 648 bp, Streptococcus pyogenes
atgattaatatcccattaatgaaagatagtttaggatttgtgttatcgggattaccttatacccttggtatttcgttgctcagtttttttacgggtctgtttttaggtttaggcctagcccttctgggaaggtcacgtcagccgttgattcattatcttgttagagcgtacatctctattatgcgaggtgtgccgatgatcgtggtgctctttgttctttatttcgggttgccttattatggtttagaattgccagctttactttgcgcttatcttggtttttctatggttagcgctgcctatatttctgaagtttttcgctcttctatagaagctattgacaagggacaatgggaagcagctaaggctttagggttgccatatgctcttatggttaagaaaattattcttcctcaagcctttcgaattgcagttcctcctttaggaaatgtcattattgatatggttaaaagttcgtcgctagctgccatgattaccgtaccagatatttttcaaaatgccaaaattattggcggtagagagtgggattacatgtccatgtatattttagtagcctttatctattggcttattgcttttttgttagaacgttaccaagaattcttagaaaataagctagcacttgtt

SEQ ID NO: 4794 - protein, 216 aa, Streptococcus pyogenes
MINIPLMKDSLGFVLSGLPYTLGISLLSFFTGLFLGLGLALLGRSRQPLIHYLVRAYISIMRGVPMIVVLFVLYFGLPYYGLELPALLCAYLGFSMVSAAYISEVFRSSIEAIDKGQWEAAKALGLPYALMVKKIILPQAFRIAVPPLGNVIIDMVKSSSLAAMITVPDIFQNAKIIGGREWDYMSMYILVAFIYWLIAFLLERYQEFLENKLALV

SEQ ID NO: 4795 - DNA, 855 bp, Streptococcus agalactiae
atgaaaaagacaattttacttggtttagtcggtttatctgcaatgacattagcagcttgctcaaatggtcaatctagcaaagaaacaacatgggacaatattaaaaaagatggtgtccttaaggttgctacccctgcaacgctttatccaacaagttattatgatgaccataaaaaattgactggttatgagattgatatgatgaaagcgattgctaaaaaacttaagataaaagttaagtttgttgaagttggagttgctgaatcatttacttctgtagatagtggtaaggtggatgttgctgtcaataactttgacacaactcccgagcgtttgaaaaaatacaatttctctcaaccttataaatattctgttggaggtatgattgtacgtgcagatggttcttcaaagattacagcaaaagatttatctgactggaaaggtaaaaaagctggtggtggcgctggaacgcaatatatgaaaattgcaaaacagcaaggtgctgaacctgttatttatgacaatgtaactaatgacgtttaccttcgagatgtatcaactggacgtacagatttcattccgaatgattactacacacaagtcattgctgtaaaatatgtaacaaaacaatatccagatatcaaagtaaaaatgggtgatgtgaagtataatccgactgagcaaggtattgtgatgagtaaaaaagataagagcctcaaaacaaaaattgatgcagctatcaaggatatgaagaaagacggttctttgaaaaaaatctctgaaaaatattatgctggtcaagatctcacaaaagaacctgctggaacggataaaattccagtaattaaagttaaa

SEQ ID NO: 4796 - protein, 285 aa, Streptococcus agalactiae
MKKTILLGLVGLSAMTLAACSNGQSSKETTWDNIKKDGVLKVATPATLYPTSYYDDHKKLTGYEIDMMKAIAKKLKIKVKFVEVGVAESFTSVDSGKVDVAVNNFDTTPERLKKYNFSQPYKYSVGGMIVRADGSSKITAKDLSDWKGKKAGGGAGTQYMKIAKQQGAEPVIYDNVTNDVYLRDVSTGRTDFIPNDYYTQVIAVKYVTKQYPDIKVKMGDVKYNPTEQGIVMSKKDKSLKTKIDAAIKDMKKDGSLKKISEKYYAGQDLTKEPAGTDKIPVIKVK

SEQ ID NO: 4797 - DNA, 1458 bp, Streptococcus agalactiae
atggtttttaaagatgctaccgctatggtacaagcgataaaacagcataagatttcgtcgcaagaattagtagagcaagcaatctacaagatcgaggaacagaatgtaagcgttaatgctgttgtcagcaagcaatataatgaggcgcgtcaagcagccaaatacgcaaatgaatcaaatgctccttttgcaggagttcctattcttctgaaagatttgggacagaatcaaaaaggacaactctcaacctcaggttcacaattatttaaacactatcatgctaaacaaacggactatttagtgcagtcctttgaaaaattagggtttattattttaggaagaacaaatacccctgaatttggttttaagaatattagtgatggtcaacttcacgggaatgttaatcttccatttgaccattcaagaaatgctggaggctctagtggtggtgcagccgcagctgttagttcaggaatggttccaattgcaggagctagtgatggaggagggtcaatcagaattccagcaagttttaatggtttgattggtttaaaaccgagtcgaggacgtatacctgttggaccttcatcctatagaggttggcaaggggcttctagtcattttgctttaacaaagtcagttagagatacaaaacgactattatattatttacaatcatatcaagtagaaagcccatttcccctgaaaaaactcagcaaagagagtcttttcgagtttagcgttagtaaacccctaaaaatagcagtattgatggattctcccttaaaaacaaaggtatcaagtgaggctaaagcagctattaaagaagccgcagattttctgtctcaaaaagggaatcatttagaattagtagaacaacctttagatggtattcattctatgaaaacttattgtatgatgaatagcgttgaaacagcagcaatgtttgatgacatcgaaaagagtttagggcgttcaatggaatttagcgatatggaattaatgacctgggctatgtatcagagtggacaaagggtattggctaaagattacagtaaactcttagattcatgggatcaatttgcagctaccatggcgaggtttcatgaaaattatgatttaattttaacagcagcaactaatcaaccagctccttttcatggacaatttgatttagacgagacactccagaaacaattgaggcatatgggagaattctcagtaagtgaacaacaggatttaatttggaaaatgtttgaagactcaatggcctggacaccttttacacatcagccaaacttgacagggcaaccttctttagccataccaactcatctaactaaagaggggctacctttaggtgtacaattgacagcggctaaagggagagaagatttattgcttgctgttgcagagttgtttgaaaaagagaagcaattcaaagggcctgtttaccat

SEQ ID NO: 4798 - protein, 486 aa, Streptococcus agalactiae
MVFKDATAMVQAIKQHKISSQELVEQAIYKIEEQNVSVNAVVSKQYNEARQAAKYANESNAPFAGVPILLKDLGQNQKGQLSTSGSQLFKHYHAKQTDYLVQSFEKLGFIILGRTNTPEFGFKNISDGQLHGNVNLPFDHSRNAGGSSGGAAAAVSSGMVPIAGASDGGGSIRIPASFNGLIGLKPSRGRIPVGPSSYRGWQGASSHFALTKSVRDTKRLLYYLQSYQVESPFPLKKLSKESLFEFSVSKPLKIAVLMDSPLKTKVSSEAKAAIKEAADFLSQKGNHLELVEQPLDGIHSMKTYCMMNSVETAAMFDDIEKSLGRSMEFSDMELMTWAMYQSGQRVLAKDYSKLLDSWDQFAATMARFHENYDLILTAATNQPAPFHGQFDLDETLQKQLRHMGEFSVSEQQDLIWKMFEDSMAWTPFTHQPNLTGQPSLAIPTHLTKEGLPLGVQLTAAKGREDLLLAVAELFEKEKQFKGPVYH

SEQ ID NO: 4799 - DNA, 480 bp, Streptococcus agalactiae
atggcagaaaaaacttacccaatgacacaagtggaaaaagatcaacttgaaaaagaacttgaagagttaaaattagttcgtagaccagaagttgtagagcgtatcaagattgctcgttcttatggtgacttatcagaaaatagcgaatatgatgcagcaaaagacgaacaagcatttgttgagggtcaaattcaaattttagaaacaaaaattcgttatgctgaaattattgatagtgatgcagttgctaaagatgaggttgcaattggtaaaactgtccttgtccaagaagttggtacaaatgataaagatacttaccatatcgttggtgctgctggagctgacattttttcaggaaaaatttcgaatgaaagcccaattgctcatgctttaattggtaaaaaaacaggagacttagctacaattgaatcacctgctggtagctatcaagttgaaatcattagtgttgaaaaaacaaat

SEQ ID NO: 4800 - protein, 160 aa, Streptococcus agalactiae
MAEKTYPMTQVEKDQLEKELEELKLVRRPEVVERIKIARSYGDLSENSEYDAAKDEQAFVEGQIQILETKIRYAEIIDSDAVAKDEVAIGKTVLVQEVGTNDKDTYHIVGAAGADIFSGKISNESPIAHALIGKKTGDLATIESPAGSYQVEIISVEKTN

SEQ ID NO: 4801 - DNA, 528 bp, Streptococcus pyogenes
atgtttgtgtttctgattcgttcaaaaaagaaaagagagaaaacaattatggcagaaaaaacgtatccgatgaccctaacggaaaaagaacaacttgaaaaagaacttgaagaattaaaacttgtgcgtcgtccagaaatagtggagcgtattaaaattgcacgttcgtatggagatctttcagagaactctgaatacgatgccgcaaaagatgagcaagcttttgttgaaggtcaaatttcaacgcttgaaactaagattcgctatgctgaaatcattgacagtgatgctgttgcaaaagatgaagtcgctatcggaaaaacagttatcgttcaagaagttggaacaacagataaagatacttatcatattgtaggtgctgctggagcagatatcttctccggaaaaatttcaaatgaaagcccgattgctcaagctttgattggtaaaaaaacaggtgacaaggttagaattgaatcaccagcagctacttatgatgttgaaatcatcagcgttgaaaagacaaat

SEQ ID NO: 4802 - protein, 176 aa, Streptococcus pyogenes
MFVFLIRSKKKREKTIMAEKTYPMTLTEKEQLEKELEELKLVRRPEIVERIKIARSYGDLSENSEYDAAKDEQAFVEGQISTLETKIRYAEIIDSDAVAKDEVAIGKTVIVQEVGTTDKDTYHIVGAAGADIFSGKISNESPIAQALIGKKTGDKVRIESPAATYDVEIISVEKTN

SEQ ID NO: 4803 - DNA, 1800 bp, Streptococcus agalactiae
ttgaccgaatttaatgacgatcagcattctaaccatgatcagaaaagttttaaagaacaaattctggcagagttagaagaagctaaccgtttgagaaagttgcgtgaagaagaactctatcaaaaagagcaagaagccaaagaagctgctcgcagaacagcacaattgatggcagattatgaagcgcaacgtttgaaagacgaacgagaagctagagcaaaggcgctagagactaagcaacgcttagaagagcaagagaaggctcggattgaggcgaaacttctggcagaagctgctcgagaagaagaaagacgtcaggcggaacaagcattagcttcccaagaagaacaagttatcaatcaagggatggaaccttcaagagagcttgatagcggctccaaatctagtgaatttaggacaactgaaaatgtacctgacatagatttaaaagcagataagactgatgttgcaactgctgtgcctaatcaagaaacggaagaaatctttcttgtgagagcaacagatattcctacagaaggtgaaaatgtaaaacttggtgagatatcagagttagagcccgtagcaaaggaacctatccgagtagaggatttgtcaaaagaagaagagggtatagctttgtcagccaagaacaaacataacaagcgtgaaagacgtcagaaagcagataatgtggcaaaacgaattgcacgtattctgatatcaattatcatacttgtattgctcttgacagcatttgtaggttatcgttttgtagatagtgctattaaacctgttgattccaattcaaataaatttgtacaagttgaaattccgataggatctgggaataaattaattggtcaaattttagaaaaagcaggagtcattaagagcgccacagtctttaattactattccaagttcaaaaactatagtaattttcaaagtggatactacaatcttaaaaaaagtatgactttagatcagattgctgctgaattggaaaaaggcggaactgcagaaccgacaaaaccagctttaggtaagatattaattaccgagggttacactattaaacagattgctaaagctattgagtctaataaaattgatacaaagactacaagtacaccttataaagctgatgatttcttgaaacttgttcaagatgaaacgtttattaaaaaaatggtagctaaatatccaaatttactaggaagtttacctgataaatcaaaagctatttatcaattggaaggatatttattcccagctacctacaactattataaagatacaaccttagaaggacttgttgaagatatgatttcaacaatgaatactaagatggcaccttactataacactattaaagcgaagaatatgtctgtaaatgatgttttgacattatcatctcttgttgaaaaagagggatcaacagacgaagatcgccgtaaaatagcaagtgtcttttataaccgattatcagccggtcaagctcttcaaagtaacattgcaattttgtatgctatggggaaattaggtgataaaacaagtttagctgaagatgctcaaattaatacttcaattaaatcaccatacaacatctatactaatactggtttgatgcctggaccagttgatagtccaagtatctcagcaattgaagcgactataaaacctgcttcaacagattacctttattttgtcgctgatgtgaagaccggaaatgtatactacgctaaagattttgaaacacacaaggctaacgttgaaaaatatatcaatagtcaaattaac

SEQ ID NO: 4804 - protein, 600 aa, Streptococcus agalactiae
MTEFNDDQHSNHDQKSFKEQILAELEEANRLRKLREEELYQKEQEAKEAARRTAQLMADYEAQRLKDEREARAKALETKQRLEEQEKARIEAKLLAEAAREEERRQAEQALASQEEQVINQGMEPSRELDSGSKSSEFRTTENVPDIDLKADKTDVATAVPNQETEEIFLVRATDIPTEGENVKLGEISELEPVAKEPIRVEDLSKEEEGIALSAKNKHNKRERRQKADNVAKRIARILISIIILVLLLTAFVGYRFVDSAIKPVDSNSNKFVQVEIPIGSGNKLIGQILEKAGVIKSATVFNYYSKFKNYSNFQSGYYNLKKSMTLDQIAAELEKGGTAEPTKPALGKILITEGYTIKQIAKAIESNKIDTKTTSTPYKADDFLKLVQDETFIKKMVAKYPNLLGSLPDKSKAIYQLEGYLFPATYNYYKDTTLEGLVEDMISTMNTKMAPYYNTIKAKNMSVNDVLTLSSLVEKEGSTDEDRRKIASVFYNRLSAGQALQSNIAILYAMGKLGDKTSLAEDAQINTSIKSPYNIYTNTGLMPGPVDSPSISAIEATIKPASTDYLYFVADVKTGNVYYAKDFETHKANVEKYINSQIN

SEQ ID NO: 4805 - DNA, 1572 bp, Streptococcus pyogenes
ttggctttgaccgattttaaggataaagaccaacaagatcagcagcgaagctttaaagagcagattcttgctgagttggaaaaagcaaatcaaatcagaaaagaaaaagaggaagaactttttcaaaaagagttggaagctaaagaagcagctaggagaacggcccagctatatgctgaatataaaagacaagatgcttttcaaaaagagtctatagcacataacaataagacagctaaacactttcaagctataaaaggtgcggtaatgacttcagaagcgcttaaaccgactttactttctgaaaaagaaaactcatctttaaaaacgacaaataagagagtcgtgcaggcaaatgagcttcaagagactgcctctaaagaatctcaagtaccgttaactattgagaaaggtcattcagtgagacgaaaattaagcaaacgccaacagactgagcgagctgctaaaaagatttcaaccgttttgattagttctattattataacccttttggctgttactctagcaggagcaggctatgtttatagtgctttaaatcctgttgataaaaatagtgatgcctttgttcaagttgagattccatctgggtcaggcaataaattgattggtcaaattcttcaaaaaaaaggtttaatcaagaatagcactgtttttagtttttatacaaaatttaaaaactttacaaattttcagagcgggtattataatctgcaaaaaagtatgagtctagaagaaattgctagtgctttacaagaaggtggtacagcagaacctaccaagccatctcttgggaagatcttgattccagaaggatacacgattaaacaaatagctaaagctgttgagcataatagcaagggaaagaccaaaaaagctaaaacaccttttaacgagaaggattttttggatttagtcacggatgaggcttttattcaagatatggtaaaaagatatccaaaattattagcaactatcccaactaaagaaaaagctatttaccgtttggaaggttaccttttcccagcaacctataactattacaaagaaactaccatgagagaacttgtagaggacatgctggcagctatggatgctactttggtaccctattatgataaaattgctgctagtggtaagacagtcaacgaggtattgaccttggcctctttggttgaaaaagaaggttcaacagacgatgacagacgtcaaattgcaagtgtcttttataaccgccttaatagcggaatggcactacaatctaatatagctattttgtatgcgatggggaaacttggtgagaaaacaaccttggctgaggatgctactattgacaccaccattaattctccttataatatttataccaatacaggtctgatgcctggtccagttgctagctcgggggtttctgcaattgaagcaaccctaaatccagcctcaacggattatttatactttgtggccaatgtccatactggtgaagtttactatgcaaaaacatttgaagaacactctgcaaatgttgaaaaatatgtgaatagtcaaattcag

SEQ ID NO: 4806 - protein, 524 aa, Streptococcus pyogenes
LALTDFKDKDQQDQQRSFKEQILAELEKANQIRKEKEEELFQKELEAKEAARRTAQLYAEYKRQDAFQKESIAHNNKTAKHFQAIKGAVMTSEALKPTLLSEKENSSLKTTNKRVVQANELQETASKESQVPLTIEKGHSVRRKLSKRQQTERAAKKISTVLISSIIITLLAVTLAGAGYVYSALNPVDKNSDAFVQVEIPSGSGNKLIGQILQKKGLIKNSTVFSFYTKFKNFTNFQSGYYNLQKSMSLEEIASALQEGGTAEPTKPSLGKILIPEGYTIKQIAKAVEHNSKGKTKKAKTPFNEKDFLDLVTDEAFIQDMVKRYPKLLATIPTKEKAIYRLEGYLFPATYNYYKETTMRELVEDMLAAMDATLVPYYDKIAASGKTVNEVLTLASLVEKEGSTDDDRRQIASVFYNRLNSGMALQSNIAILYAMGKLGEKTTLAEDATIDTTINSPYNIYTNTGLMPGPVASSGVSAIEATLNPASTDYLYFVANVHTGEVYYAKTFEEHSANVEKYVNSQIQ

SEQ ID NO: 4807 - DNA, 585 bp, Streptococcus agalactiae
ttgatggtaagggctgagagaagtttctcagtcctctatctgactttatcaagagaatttcataaagaaattaaggagatgagtatgattattagaaatggttgcctagaggatttacagcaagtcattagtattgaacaaataaatttttcagaagcagaggctgcgagtaaaaaagcaatgcaagaacgtttaacgataatgactgatacttttttagttgcagagattaatggtcgtttagcaggttacattgaaggaccggttattaaaggtcggtacttaacggacgatttattccataaagtttctgaattccctgtaagggtaggtggtttcataggaattactagtctatcaatacatcctgattttaaaggtcaggggattggtacagcattattagcagcgatgaaagacctggttgtttctcaagaacgagatggtataagtttaacttgccatgatgatttaatttccttctatgaaatgaatggatttaaagatgagggagaatctgactccaaacatggtggttcgctttggtataatatgatttggaataatccaacacgatcaatttgt

SEQ ID NO: 4808 - protein, 195 aa, Streptococcus agalactiae
MMVRAERSFSVLYLTLSREFHKEIKEMSMIIRNGCLEDLQQVISIEQINFSEAEAASKKAMQERLTIMTDTFLVAEINGRLAGYIEGPVIKGRYLTDDLFHKVSEFPVRVGGFIGITSLSIHPDFKGQGIGTALLAAMKDLVVSQERDGISLTCHDDLISFYEMNGFKDEGESDSKHGGSLWYNMIWNNPTRSIC

SEQ ID NO: 4809 - DNA, 480 bp, Streptococcus pyogenes
atgttgattagacaggttcaaggatccgatttggaagttattgctaccattgaaagtgacaatttttcaccacaagaagcaacgacaagagcagttcttgaagagcacatacggctgataccagatacttttttagtggcacttatcgatcaggaaattgttggctatatcgaaggtccagttgtcactactcctattttggaggattctttgttccacggggtgactaaaaatcctaaaactggaggctatattgctattactagtttgtccatagctaaacattttcagcaacaaggggttgggacagctttgttggcggcactaaaagatttagtagtagcgcagcaaagaacaggtcttattttgacttgtcatgattacttgatttcctattatgaaatgaatgggtttattaaccaaggaatttcagagtctcaacatggtggaaccctttggtaccaaatgatttggaaactt

SEQ ID NO: 4810 - protein, 160 aa, Streptococcus pyogenes
MLIRQVQGSDLEVIATIESDNFSPQEATTRAVLEEHIRLIPDTFLVALIDQEIVGYIEGPVVTTPILEDSLFHGVTKNPKTGGYIAITSLSIAKHFQQQGVGTALLAALKDLVVAQQRTGLILTCHDYLISYYEMNGFINQGISESQHGGTLWYQMIWKL

SEQ ID NO: 4811 - DNA, 1329 bp, Streptococcus agalactiae
atgtcaaaaacttatcattttattggtattaaaggatccggaatgagtgccctagcactgatgcttcatcaaatgggacataacgtccaaggaagtgacgttgacaaatattattttacccaacgtggtttagagcaagcaggtgtaactatattacctttctcaccgaataatatcagtgaggatttagagattattgcaggaaatgcttttcgtccagataacaatgaagagttggcttatgttattgaaaagggctatcaatttaaacgatatcatgaatttctcggagattttatgcgtcagttcactagtctaggtgtagctggggcacatggaaaaacctcaacgacaggtttattagctcatgttttaaaaaatattacagacacttctttcctaattggagatggtacaggacgtggttctgctaatgctaattactttgtgtttgaagctgatgaatacgaacgtcattttatgccgtaccatccagaatactcaattattaccaatattgattttgaccatcctgattattttacaggcttagaggacgtattcaatgcctttaatgactatgctaagcaagttcaaaaaggtttattcatttatggagaagatccaaaacttcatgaaatcacttctgaggcaccaatatattattatggttttgaagattcaaatgattttatagcaaaagacatcactcgaactgttaatggttctgactttaaggttttctataaccaagaagaaattggtcagtttcatgtaccagcatacggtaaacataatatcttaaatgcaactgctgttattgctaacctttacataatgggaattgatatggcattagtagctgagcatttgaagacgttttcaggggtaaagcgtcgttttactgagaagattattgacgatactgtcattattgatgactttgctcaccatcctactgagattattgcgacattagatgctgctcgacaaaaatacccgtcaaaagaaattgtagctattttccaaccgcatacgttcactcgtacgatagctcttttagacgaatttgcccatgccttgagtcaagcggatagcgtttatctcgctcaaatatatggttctgctagagaagtagataatggtgaggtgaaggtagaagatttagctgctaagattgtcaaacactcagatttagtgacagtcgaaaatgtctcgcctttactcaatcatgataatgctgtctatgtctttatgggtgctggagacattcaattgtatgagcgctcttttgaagaattattagctaacctaactaaaaatacacaa

SEQ ID NO: 4812 - protein, 443 aa, Streptococcus agalactiae
MSKTYHFIGIKGSGMSALALMLHQMGHNVQGSDVDKYYFTQRGLEQAGVTILPFSPNNISEDLEIIAGNAFRPDNNEELAYVIEKGYQFKRYHEFLGDFMRQFTSLGVAGAHGKTSTTGLLAHVLKNITDTSFLIGDGTGRGSANANYFVFEADEYERHFMPYHPEYSIITNIDFDHPDYFTGLEDVFNAFNDYAKQVQKGLFIYGEDPKLHEITSEAPIYYYGFEDSNDFIAKDITRTVNGSDFKVFYNQEEIGQFHVPAYGKHNILNATAVIANLYIMGIDMALVAEHLKTFSGVKRRFTEKIIDDTVIIDDFAHHPTEIIATLDAARQKYPSKEIVAIFQPHTFTRTIALLDEFAHALSQADSVYLAQIYGSAREVDNGEVKVEDLAAKIVKHSDLVTVENVSPLLNHDNAVYVFMGAGDIQLYERSFEELLANLTKNTQ

SEQ ID NO: 4813 - DNA, 1326 bp, Streptococcus pyogenes
atgtcaaaaacgtatcattttatcggaattaaagggtcaggaatgagtgccttggcccttatgttgcatcaaatggggcataaggtgcaaggtagtgatgttgaaaaatactatttcactcaaagaggattggaacaagcgggcatcactatcttaccttttagcgaggacaacattacgccagatatggaacttatcgttgggaatgcctttcgtgaaaacaacaaagaagtggcctatgctttgagacaccagattcctttcaaacgttatcatgactttttaggtgattttatgaaatcatttatcagttttgcagtagcaggtgctcatggtaaaacttctacaacgggtttattgtcacatgtcttgaaaaatatcacagacacatcttatttaattggtgatggtactgggcgtggatctgctaatgcacagtattttgtttttgaatcagacgaatacgaacgccattttatgccttatcacccagaatactctatcattactaatattgattttgaccatcctgattatttcacaggaattgctgatgtgcgaaacgctttcaacgattatgctaagcaggtcaagaaagctttgtttgtttatggtgaagatgacgaactaaaaaagatcgaagcacctgcacctatttactattatggttttgaagagggcaatgattttatcgcttacgacattacgcgtactacgaacggatcggactttaaggtaaaacaccaaggagaggtcattggtcagtttcacgtacctgcttatggaaaacataacattttaaacgctacagcagtaattgcaaacttgtttgtagccggcattgatatggctctagtggcagaccatcttaaaactttttcaggtgtgaaacgtcgttttacagagaaaattatcaatgacactattattattgatgactttgctcatcatccaaccgaaattgtggcaacaattgatgcggctagacaaaaatacccaagtaaagaaattgtagcaatattccagccacatacttttactcgcactattgccttattagaggattttgcttgtgctttaaatgaagctgacagtgtttatttagcccagatttatggttctgcacgtgaagtagataaaggtgaagttaaggttgaagatttggctgctaagattatcaaaccatcacaagtagtaacggtggaaaatgtctctcctcttcttgatcacgataatgctgtttatgtttttatgggagctggagatattcagctatatgaacattcttttgaggaattacttgcaaatttaactaaaaataaccaa

SEQ ID NO: 4814 - protein, 442 aa, Streptococcus pyogenes
MSKTYHFIGIKGSGMSALALMLHQMGHKVQGSDVEKYYFTQRGLEQAGITILPFSEDNITPDMELIVGNAFRENNKEVAYALRHQIPFKRYHDFLGDFMKSFISFAVAGAHGKTSTTGLLSHVLKNITDTSYLIGDGTGRGSANAQYFVFESDEYERHFMPYHPEYSIITNIDFDHPDYFTGIADVRNAFNDYAKQVKKALFVYGEDDELKKIEAPAPIYYYGFEEGNDFIAYDITRTTNGSDFKVKHQGEVIGQFHVPAYGKHNILNATAVIANLFVAGIDMALVADHLKTFSGVKRRFTEKIINDTIIIDDFAHHPTEIVATIDAARQKYPSKEIVAIFQPHTFTRTIALLEDFACALNEADSVYLAQIYGSAREVDKGEVKVEDLAAKIIKPSQVVTVENVSPLLDHDNAVYVFMGAGDIQLYEHSFEELLANLTKNNQ

SEQ ID NO: 4815 - DNA, 615 bp, Streptococcus agalactiae
gtgaatagaggctctagacgatttccgttgatagcagatgatgaaccagtaatgtctccgcttgtaaagatgaatctttatgataatgaagatttaattaacaacattcgagacttttatcaagaaaaaacatatcaaagcatggtcaaaagcaattatgaacatgaagaaatatcacatcctaaggtaattgaaaatgatcctgtaccaccgcagagttttgtaaaaaaagcgacagagttgagcaaatctcgacaagaggcaaagaggtctgttcgggagaaacgacaagcttactatgcgaaacaggaatttaaggcgccatcaaaggaagcttttcagcaacaattgaaggcaacagtaccgaaaaaacaaactcagcgaaaggtgactgaactaagtcatctttctgatcgtttacagcaggaaagctatatattagcagaaattccaatcatatttcaagaacctgataatacaccgaacccaaaaacaaagaaaaataattttgattttttgaaacgcagtcaagtttacaataaacaagacaatcagtttcataaagaaagagccaaggctcaagaattaaatctgacacgttttaaagacattaat

SEQ ID NO: 4816 - protein, 205 aa, Streptococcus agalactiae
MNRGSRRFPLIADDEPVMSPLVKMNLYDNEDLINNIRDFYQEKTYQSMVKSNYEHEEISHPKVIENDPVPPQSFVKKATELSKSRQEAKRSVREKRQAYYAKQEFKAPSKEAFQQQLKATVPKKQTQRKVTELSHLSDRLQQESYILAEIPIIFQEPDNTPNPKTKKNNFDFLKRSQVYNKQDNQFHKERAKAQELNLTRFKDIN

SEQ ID NO: 4817 - DNA, 600 bp, Streptococcus pyogenes
atggtaaaaaatcagtttcctttagttgcagatggcattgctattagtgatccagcaaagcaaatggctctgtatgaaaatgaagatctcattaccaacatccgtggctattaccaggacaaggagtatgatgatattgctagaaatgaggagtttactgctaaagcaacttctcggcagaccccttctagtaagcgcttttgtagcaatgatgaaaaacaccattatgtcaaagaggcgcgtcaaaaagcaaagcaagatctcaaggaaaaaagacaggcttatcttgccaaagaaatggcctatgttcctaaacaggtttctaaaaagcaacagcctgcggattcttctccttctcaaaagcaagcaacaacagaaatgagtcgttttacaaaaaagcttcatcaagacaactatattttagctgagttgccaaaagaatataaagagccaaaaaatcttcctcaacaaggaactacaaaaaaaaataattacgattttttaaaatccagtcaaatttacaataataaagaaatgagacaacaacgagaaaaaacaattgcgcaagagcttaatcttagtaggtttgaggatcttcct

SEQ ID NO: 4818 - protein, 200 aa, Streptococcus pyogenes
MVKNQFPLVADGIAISDPAKQMALYENEDLITNIRGYYQDKEYDDIARNEEFTAKATSRQTPSSKRFCSNDEKHHYVKEARQKAKQDLKEKRQAYLAKEMAYVPKQVSKKQQPADSSPSQKQATTEMSRFTKKLHQDNYILAELPKEYKEPKNLPQQGTTKKNNYDFLKSSQIYNNKEMRQQREKTIAQELNLSRFEDLP

SEQ ID NO: 4819 - DNA, 96 bp, Streptococcus agalactiae
atgaatgaaaaataccaatctgataagctttacttagttgaaaactttgaaaaaacagaaaaattagtttataataggtctgttgtagaaaggaag

SEQ ID NO: 4820 - protein, 32 aa, Streptococcus agalactiae
MNEKYQSDKLYLVENFEKTEKLVYNRSVVERK

SEQ ID NO: 4821 - DNA, 3096 bp, Streptococcus agalactiae
atgagtagaatgattccaggacgtattcgaaatcaaggtatagaactctacgaacaaggtttggtgtccttgatttctcaagaaggtaatctattaaaagctaaagttggggattgtcagattgaatattcattagtaacagaagaaacaaaatgttcttgtgatttttttgcaagaaaaggctattgtcaacatttagctgctctggagcatttcttgaaaaacgatccagaaggtaaagcaatcttatctaaagttcaagttcaacaagaaagtcaacaagaaactaagaagaaaacctcttttggtagtgtttttttagatagtctaattattaatgaagatgatactataaaatatcaattatcggctcaaggagaacaaaatccttatgctaatgatatctggtggactttaaaaattagacgactgcctgatgatagaagttatgttattcgtgacatcaaagcctttttaaatactgttcgaaaagaagcttattatcagattggaaaacaatactttgaaactttgtctttaatacagtttgatgagaccagtcaagaattgatagaatttttatggaggctcattccaagtcattcaagcaaaattgatctagagtttattttaccaaatcaaggtcgtcaccttagtctcactcgtggtttttttgaagagggtgttactttgatgaatgctttagaaaatttttcatttgaaagtgattttcatcaatttaatcacctctactttaaggaattagaaggtgaggatcatctttatcaatttaaggttattgtccataggcaatcaattgaattagaaatcaaagagaaagacttaaaaccactatttgcgaattcttatttgttttatcgcgatactttctaccatcttaatttgaagcaagaaaagatggtaacggctattcgtagtcttcccattgagggagatttagcaaaacatatccattttgatttagatgatcaagataagttagcagctcatttactggattttaaggagattggactagtggatgctccacggagcttctctattcatgattttaaggtaaattttgagttcgatattaatagtcaaaatgaaattttattgcaaatggtatttgattatggtaatgatttaactgttcataatcgtcaagaactagaacagttaacatttgctagtcacttcaaacatgaagaaaaagtatttaaactcttagaaaaatatggctttgcaccccacttttcaaccagccatccagcatacagtgcacaagaattatacgatttttatacctatatgcttccacaatttaaaaaaatgggaacagtgagcttatccgcaaaattggaaagttatcgtctcatagaacgaccgcaaattgatattgaagctaagggaagcctgctagatatttcttttgatttctctgatttactggaaaacgatgttgatcaagctctggtagctttgtttgacaataatccttattttgtgaataaatcagggcaattagttatttttgatgaagaaactaagaaagtaagtgcaactttgcaagggttgagagctagacgagcaaagaatgggcatattgaattagataatattgcagcatttcaattatcagaactgtttgcaaatcaagataatgttagcttttcacaacatttttaccaattgattgaagatttgagacacccagaaaagtttaaaatacctggtctatctgtttcagcttccttgcgcgattatcagcttacaggtgtccgttggttaagtatgttagatcattatggctttgcagggattttagctgatgatatggggcttggaaaaacacttcaaacgatttcatttttaagtacaaaactaactagagattctcgtgtgcttattttatcaccatcaagtttaatttataattggcaagatgaattccacaaatttgcgccagacgtagatgtagcagttgcctatggttctaagattcgtagagatgaaattattgctgaacgtcatcaagtaatcattacaagttattcatcatttaggcaggattttgagacttattctgaaggaaattatgattatttaattttggatgaagcacaggttatgaaaaatgctcaaactaaaatagcccatagcttgagatcttttgaggtcaaaaactgttttgcattatcgggaacacctattgagaataaactgttagaaatttggtccattttccagatcattttacctggtttattacctggtaagaaagagtttttgaagttgaaccctaaacaagttgctcgttatatcaaaccatttgtgatgagacgtcgaaaagaagaagttctcccagaattaccggatttgattgaaatgaactatccaaatgaaatgacagacagtcaaaaagttatctatttggcgcaattacgccaaattcaagaaagtatccaacattctagtgacgctgacttaaatcgtcgtaaaattgaaattttatctggcatcacacgattacgtcaaatttgtgacactccacgtctttttatggattatgatggtgaaagcggtaagttagaaagcctacgtcaacttttaacacaaattaaggaaaatggacatcgtgctctgattttttctcagttcaggggtatgttagatatcgcagaacgtgagatggtagctatggggcttacaacttataaaattactggttctacaccagcaaatgaacgtcatgaaatgaccagagcatttaatgcaggatcaaaagatgctttcttgatttctttaaaagctggtggcgttggtctcaaccttacaggagctgataccgttgttctgattgacttgtggtggaatccagctgttgaaatgcaggcgattagtcgcgcacataggttggggcaaaaagagaatgtcgaggtttatcgcttgattactagaggcacaatcgaagaaaaaattctagaaatgcaagaaactaaaaaacatttggttacaacagttctggatggaaatgaaacccatgctagcatgagcgtagatgatattcgagagatacttggagtttctaaa

SEQ ID NO: 4822 - protein, 1032 aa, Streptococcus agalactiae
MSRMIPGRIRNQGIELYEQGLVSLISQEGNLLKAKVGDCQIEYSLVTEETKCSCDFFARKGYCQHLAALEHFLKNDPEGKAILSKVQVQQESQQETKKKTSFGSVFLDSLIINEDDTIKYQLSAQGEQNPYANDIWWTLKIRRLPDDRSYVIRDIKAFLNTVRKEAYYQIGKQYFETLSLIQFDETSQELIEFLWRLIPSHSSKIDLEFILPNQGRHLSLTRGFFEEGVTLMNALENFSFESDFHQFNHLYFKELEGEDHLYQFKVIVHRQSIELEIKEKDLKPLFANSYLFYRDTFYHLNLKQEKMVTAIRSLPIEGDLAKHIHFDLDDQDKLAAHLLDFKEIGLVDAPRSFSIHDFKVNFEFDINSQNEILLQMVFDYGNDLTVHNRQELEQLTFASHFKHEEKVFKLLEKYGFAPHFSTSHPAYSAQELYDFYTYMLPQFKKMGTVSLSAKLESYRLIERPQIDIEAKGSLLDISFDFSDLLENDVDQALVALFDNNPYFVNKSGQLVIFDEETKKVSATLQGLRARRAKNGHIELDNIAAFQLSELFANQDNVSFSQHFYQLIEDLRHPEKFKIPGLSVSASLRDYQLTGVRWLSMLDHYGFAGILADDMGLGKTLQTISFLSTKLTRDSRVLILSPSSLIYNWQDEFHKFAPDVDVAVAYGSKIRRDEIIAERHQVIITSYSSFRQDFETYSEGNYDYLILDEAQVMKNAQTKIAHSLRSFEVKNCFALSGTPIENKLLEIWSIFQIILPGLLPGKKEFLKLNPKQVARYIKPFVMRRRKEEVLPELPDLIEMNYPNEMTDSQKVIYLAQLRQIQESIQHSSDADLNRRKIEILSGITRLRQICDTPRLFMDYDGESGKLESLRQLLTQIKENGHRALIFSQFRGMLDIAEREMVAMGLTTYKITGSTPANERHEMTRAFNAGSKDAFLISLKAGGVGLNLTGADTVVLIDLWWNPAVEMQAISRAHRLGQKENVEVYRLITRGTIEEKILEMQETKKHLVTTVLDGNETHASMSVDDIREILGVSK

SEQ ID NO: 4823 - DNA, 3096 bp, Streptococcus pyogenes
atgatggctagattaattccaggacgagtaaggaatgaaggtattaagctttatgagcaaggtttagtttcattccaagatgataataaaggcattcttcaaatagaagtggagacttatcaggttcaatatggagcagatgatgaggatatcacttgtcaatgcgacacatttcatatgaaacattattgcaagcatattgcagcagtcgagtattttttaaaaaatgatcaaaaaggtaagctttttttaaaacagttaacaaatcaaacaaaaatcaaagaaacaacaaagaaaatgacatcttttggtagcctctttttagatagcttagccatgaatgaagatgattctgttaaatacaggctgtctgctcttggtagtcgaagccctttttcgtcagattactggtggagtctgaaaatcaatcgtttaccagatgatcgttcttatgtgattcgggatattaaaggctttttgcagcttattaaaaaagaaggcttttatcagattggaaaaaattattttgaacaactttcatggctgcagtttgacccatctagtcaggcccttattgagtttttatggcgcttagcatctgatactgacaaaggggacaacgagaacatttttccaaatcatgcaaggcatttgcgcttacctagtggtttttttgaagaaggtattcactatttgacgtcactttatgactttacttttgaggggccttctcaaacttatcatcatctttttgtccgttctttggaagcagaggcaggcctttatgagtttaaagtggaagtgcatcgcaaatctattgaattgcaaattgctgaaaaaaatgtgcaatacctctttgataatgactatcttctttatcaagataccttttatcacttgacgttaaagcaacgaaaaatggttcaggctattcgtagtctgcccattgaggccgacttggctaaacatattcattttgatttggatgatcatgcgaaattagctgcaagcttatcagattttaaacagatcggtctagtagaggctcctaaaagctttgctattagagactttgaggtgacttttcaatttgatttgttaaatcgagatgaaatcagttgtcagcttatgtttgattatggcaattaccaagttagtgacaaagcaagtttagaagcacttccttttgctagtcatttaaaaaaagaagaaaaaatcaatcgttctttacttgcttttggcttctcgccacaattttactcaaaaaagcgactaacaagtgcaaaagagctctatactttttttgaagaaacagttccatgttttgagcgcttaggtaatgttgcgttgagtacagctatccaagcattacaagtgaaagaaatgcccaagatcgctattagacgcaatcagggattactagatatttcgtttgatttttcaaccattattgaaaatgatattgaccaagctgttacagctctttttcaaaataatccttattttgtgagtcaaacgggtcaattagtggtttttgatgatgaaactcaaaaagttagcaaaagtttacaagaattaagagcaagacagctaaaaaatggtcacttgcaactggatggcattagagctctacaagtatccaaactttttgaaggcatgacatctgttcatttttcaaaggaattagaagagttagcctatcatttgcagcatcctgaaactttttcaataaaaccgttaccagttaaggctcaaatgcgagattatcaacgcaacggtgttcagtggttatcaatgctcaatcattatggctttggtggcattttagcagatgacatgggacttggaaaaactctccagacacttgcttttttagctagtcacctgaaatcagatagtaaagtgctcattttatctccatctagtcttatctataattggtttgatgaatgtcaaaaattcacacctcagctagatgttgtggtttcttacggacttaaacaaatcagagatcaaatcatcgaagaaggtcatcaaataaccataaccagctattcctcctttagacaggattttgagacctatcaagcgtttcactacgattatcttatcttagatgaagctcaagtgataaaaaatgcacaaactaagatttcacactgtttacgtgcgtttaatacagccaattgttttgcgctttcgggcactcctattgaaaataaaatgcttgaaatttggtccattttccaaattgttttgccagggttgctaccgactaaaaaagagtttttaaaattaacagctgagcaagtatcacgctatatcaaaccctttgtgatgcgtcgtaaaaaagaagatgtcctaccagaattacctgatttaattgaaattaattattcaaacgagatgacagatgaacaaaaagctatttacttagcgcagttaaggcagatgcaagatcaaattcgaaattctagtgatgtggatattagccgtcaaaaaattgagattttatctggtatcactcgattgaggcaaatctgtgacactccaagtctctttatggattaccaaggcaaaagtggtaaactagatagtttgcgaatcttattgacacaaattaaagaaaatggtcatcgggctttgattttttctcaatttagagggatgctggacttggccaagcaagagatgactgctctagggttgacctcttatcaaatgacgggatctacccctgccaatgaacgtcaagaaatgactagagcctttaataacggttccaaggatgcttttttgatttccctcaaggcaggtggagttggaatcaaccttacgggagcagacacagtgattttaatcgatttatggtggaatcctgctgttgaaatgcaggcaatcagtcgcgcctaccgtattggtcaaaaagaaaacgttgaagtatatcgcttaatcactcgagggacgattgaagaaaagattttagagcttcaagaaagtaagcgcaatttggtgactacagttttggatggcaatgaaagccgagcaagtatgtccattgaagaaataaaagaaattttggggctaaacactcat

SEQ ID NO: 4824 - protein, 1032 aa, Streptococcus pyogenes
MMARLIPGRVRNEGIKLYEQGLVSFQDDNKGILQIEVETYQVQYGADDEDITCQCDTFHMKHYCKHIAAVEYFLKNDQKGKLFLKQLTNQTKIKETTKKMTSFGSLFLDSLAMNEDDSVKYRLSALGSRSPFSSDYWWSLKINRLPDDRSYVIRDIKGFLQLIKKEGFYQIGKNYFEQLSWLQFDPSSQALIEFLWRLASDTDKGDNENIFPNHARHLRLPSGFFEEGIHYLTSLYDFTFEGPSQTYHHLFVRSLEAEAGLYEFKVEVHRKSIELQIAEKNVQYLFDNDYLLYQDTFYHLTLKQRKMVQAIRSLPIEADLAKHIHFDLDDHAKLAASLSDFKQIGLVEAPKSFAIRDFEVTFQFDLLNRDEISCQLMFDYGNYQVSDKASLEALPFASHLKKEEKINRSLLAFGFSPQFYSKKRLTSAKELYTFFEETVPCFERLGNVALSTAIQALQVKEMPKIAIRRNQGLLDISFDFSTIIENDIDQAVTALFQNNPYFVSQTGQLVVFDDETQKVSKSLQELRARQLKNGHLQLDGIRALQVSKLFEGMTSVHFSKELEELAYHLQHPETFSIKPLPVKAQMRDYQRNGVQWLSMLNHYGFGGILADDMGLGKTLQTLAFLASHLKSDSKVLILSPSSLIYNWFDECQKFTPQLDVVVSYGLKQIRDQIIEEGHQITITSYSSFRQDFETYQAFHYDYLILDEAQVIKNAQTKISHCLRAFNTANCFALSGTPIENKMLEIWSIFQIVLPGLLPTKKEFLKLTAEQVSRYIKPFVMRRKKEDVLPELPDLIEINYSNEMTDEQKAIYLAQLRQMQDQIRNSSDVDISRQKIEILSGITRLRQICDTPSLFMDYQGKSGKLDSLRILLTQIKENGHRALIFSQFRGMLDLAKQEMTALGLTSYQMTGSTPANERQEMTRAFNNGSKDAFLISLKAGGVGINLTGADTVILIDLWWNPAVEMQAISRAYRIGQKENVEVYRLITRGTIEEKILELQESKRNLVTTVLDGNESRASMSIEEIKEILGLNTH

SEQ ID NO: 4825 - DNA, 135 bp, Streptococcus agalactiae
ttggagaaagaggctaagcagatcattgatttaaaaaggaatcttttcaaaattgatgtccgggcacaaaaggatgaagagaaagttttcatgcgtacggcgtgtcaatttagtatttttacaagaaattggact

SEQ ID NO: 4826 - protein, 45 aa, Streptococcus agalactiae
MEKEAKQIIDLKRNLFKIDVRAQKDEEKVFMRTACQFSIFTRNWT

SEQ ID NO: 4827 - DNA, 1308 bp, Streptococcus agalactiae
atggtattacctacagttgctattgttggtcgtccgaatgttggaaaatcaacattatttaacagaattgcaggagaacgtatttccattgttgaggacgttgaaggagtcactcgtgatcgtatctatacaacgggtgagtggctaaatcgtaagttttcattaattgatactggtgggattgatgatgttgatgcaccgtttatggagcaaattaagcaccaagcagacattgctatgacagaggctgatgttattgtgtttgttgtgtcgggtaaagaaggtgtgactgatgcagatgagtatgtctcacgtattctttataagaccaataaaccggttattttagctgttaataaggtagataatcctgagatgcgcaatgatatttacgatttctactctcttggtttaggggatccttatcccttgtcatcagttcatggtattggtactggtgatatattggatgctattgtggaaaatcttccggtagaagaggaaaatgaaaatccagatattattcgttttagtttgattggacgtccaaatgttgggaaatctagtttaattaatgccatccttggggaagaccgtgttattgctagcccagttgctggtactacgcgcgatgctattgatactaatttcgttgatagccaggggcaagagtatactatgattgatactgctggtatgcgtaaatctggtaaggtatatgaaaacacagagaaatattctgttatgcgttctatgcgcgccatcgaccgctcagatgttgttcttatggtgattaatgcagaggaaggtattcgtgagtatgacaagcgtattgcagggtttgcacatgaaactggtaaaggtattattattgtagttaataaatgggatactatcgaaaaagacaatcatactgtcagtcagtgggaagctgatatacgtgataacttccaattcttgtcttatgcgccaattatctttgtttctgcagagacaaagcaacgtttgcacaagttaccagatatgattaaacgtattagcgaaagtcaaaacaaacgtattccgtctgctgtattaaatgatgtgattatggatgctattgctattaatccaacaccaactgataaaggaaaacgtcttaagattttctacgcaactcaagttgctgttaaaccaccaactttcgttgtttttgttaacgaagaagaattgatgcacttttcatatcttcgtttcttagaaaatcaaatccgtgaagcatttgtttttgaaggaacaccaattaatctaatagcacgtaaacgtaaa

SEQ ID NO: 4828 - protein, 436 aa, Streptococcus agalactiae
MVLPTVAIVGRPNVGKSTLFNRIAGERISIVEDVEGVTRDRIYTTGEWLNRKFSLIDTGGIDDVDAPFMEQIKHQADIAMTEADVIVFVVSGKEGVTDADEYVSRILYKTNKPVILAVNKVDNPEMRNDIYDFYSLGLGDPYPLSSVHGIGTGDILDAIVENLPVEEENENPDIIRFSLIGRPNVGKSSLINAILGEDRVIASPVAGTTRDAIDTNFVDSQGQEYTMIDTAGMRKSGKVYENTEKYSVMRSMRAIDRSDVVLMVINAEEGIREYDKRIAGFAHETGKGIIIVVNKWDTIEKDNHTVSQWEADIRDNFQFLSYAPIIFVSAETKQRLHKLPDMIKRISESQNKRIPSAVLNDVIMDAIAINPTPTDKGKRLKIFYATQVAVKPPTFVVFVNEEELMHFSYLRFLENQIREAFVFEGTPINLIARKRK

SEQ ID NO: 4829 - DNA, 1308 bp, Streptococcus pyogenes
atggttttacctaccgttgccattgtgggccgtccaaatgtgggcaagtccaccttatttaatcgaatcgcaggagagcgcatttcaattgtagaagacgttgaaggggttactcgtgaccgtatttatgctactggggagtggcttaaccgccaattctcattgattgatacaggtggtattgatgacgttgatgccccgtttatggagcaaatcaagcaccaggctcaaattgccatggaagaagctgatgttatcgtttttgttgtttctggtaaagaaggggtgaccgacgctgacgaatatgtgtctaaaattctgtatcgaaccaataccccagtcattttagctgttaataaggttgataatcctgaaatgcgtaatgacatttatgatttttattcacttggtttgggtgatccttatccagtttcttctgttcatggtatcggaacaggggatgtcttagatgcgatcgttgaaaacttgccagtagaagaggctgaagaaaatgatgatattattcgcttcagtttaatcggtcgtcctaatgttgggaaatctagcttgattaacgctattttaggtgaggaccgtgttatcgctagccctgtcgcagggacaacacgtgatgccattgacacgcattttacggatgctgacggtcaagaatttaccatgattgacacggctggaatgcgcaaatctggcaagatttacgaaaatacagagaaatattctgtcatgcgtgccatgcgtgccattgaccgctccgatgtggtcttgatggttatcaatgctgaagaaggtatccgtgaatacgacaagcgtatcgctggctttgcacacgaagctggtaaaggaatgattatcgtggttaacaaatgggataccattgacaaggataatcataccgttgctaagtgggaagccgatattcgtgaccaattccaatttttgacatacgctccgattatttttgtgtcagctttgacgaagcagcgcctcaacaaattgcctgacttgattaaacgtatcagtgagagtcagaataaacgtatcccatctgctgtcctcaatgatgttatcatggatgctattgccattaatccaacgccaacggataagggtaaacgtttgaaaattttctatgccactcaagtgtcagtaaagccaccaacatttgtcgtctttgttaacgaggaagaattgatgcacttctcttatctacgcttcttggaaaaccagattcgcgcagcctttacctttgaagggacaccgattcatctaattgctcgcaaacgaaaa

SEQ ID NO: 4830 - protein, 436 aa, Streptococcus pyogenes
MVLPTVAIVGRPNVGKSTLFNRIAGERISIVEDVEGVTRDRIYATGEWLNRQFSLIDTGGIDDVDAPFMEQIKHQAQIAMEEADVIVFVVSGKEGVTDADEYVSKILYRTNTPVILAVNKVDNPEMRNDIYDFYSLGLGDPYPVSSVHGIGTGDVLDAIVENLPVEEAEENDDIIRFSLIGRPNVGKSSLINAILGEDRVIASPVAGTTRDAIDTHFTDADGQEFTMIDTAGMRKSGKIYENTEKYSVMRAMRAIDRSDVVLMVINAEEGIREYDKRIAGFAHEAGKGMIIVVNKWDTIDKDNHTVAKWEADIRDQFQFLTYAPIIFVSALTKQRLNKLPDLIKRISESQNKRIPSAVLNDVIMDAIAINPTPTDKGKRLKIFYATQVSVKPPTFVVFVNEEELMHFSYLRFLENQIRAAFTFEGTPIHLIARKRK

SEQ ID NO: 4831 - DNA, 900 bp, Streptococcus agalactiae
atgaaatcagtgggacaagcattagaaaatcaagggagagtgcctcgtaatacaaatgatgagcttattcaaatgattttagcagatgctcaggtagcggagttcattaaaacccaccaactttctcagcgtgaaataaatatcagcatgtctaaatttaatcaatttttgattgagcgtcagaaatttaaaaataaggatagtcaatatattgctaaaggctatgagcctattttggttatgaatgaaggttatgcagatgtttcttatttagaaacacgagagttaattgaagcacaaaaaaaacaagctatcagtgatcgtattaatttagttaatctacccaagtcctatcggaatatcagaatgactgactttgatattaataacgagagtcgaatgaaagctatgtcacaactgcttgattttgtagagacttatccttcatataatcacaaggggctttatttatatggagatatgggggttgggaaatcctatttaatggcagcaatggcgagggaattatcagagagaaagggtgtgtcaacgactcttcttcatttccctagttttgctattgatgtcaaaaatgctatttcaagcggaactgtaaaagatgaaattgatgctgtgaaaagtgttccgattttgattttagatgatattggggctgaacaggcaacgtcctgggttcgtgacgagattttacaagttatattacaacatcgtatgctagaagagttgcccactttctttacgtcaaattatagttttaacgatttggaaagaaaatgggctaatataaaaggaagcgacgaaacttggcaagcaaaacgagttatggagcgcgtacggtatttagcgatagaattccacttagaaggaccgaatcgccgt

SEQ ID NO: 4832 - protein, 300 aa, Streptococcus agalactiae
MKSVGQALENQGRVPRNTNDELIQMILADAQVAEFIKTHQLSQREINISMSKFNQFLIERQKFKNKDSQYIAKGYEPILVMNEGYADVSYLETRELIEAQKKQAISDRINLVNLPKSYRNIRMTDFDINNESRMKAMSQLLDFVETYPSYNHKGLYLYGDMGVGKSYLMAAMARELSERKGVSTTLLHFPSFAIDVKNAISSGTVKDEIDAVKSVPILILDDIGAEQATSWVRDEILQVILQHRMLEELPTFFTSNYSFNDLERKWANIKGSDETWQAKRVMERVRYLAIEFHLEGPNRR

SEQ ID NO: 4833 - DNA, 900 bp, Streptococcus pyogenes
atggaaaagattggagaaaccatggcgaaattgggtcaaaacactcgtgttaatagcgaccagttgattcaaaccattttagcggatcctgaagtagcaagcttcatcagtcaacatcacttatctcaagagcaaattaaccttagcttatctaagttcaatcaatttttggtggaacgccagaagtatcaactcaaagatccctcttatattgctaagggctatcagcctattctagctatgaatgagggctacgctgatgtgtcttatttggaaaccaaagaattggtagaagctcaaaaacaggcagctatctctgaacggattcaactggttagtttgccaaaatcctatcgccatattcatttatcagatattgatgttaataatgcgagccgtatggaagccttctctgctattttagattttgtggaacaatacccatcagcagagcaaaaaggcttgtatttgtacggagatatgggaattggcaagtcttacttgttggctgctatggcccatgaattgtctgagaaaaaaggtgtgtcaacgacccttctacattttccgagctttgccattgatgtaaaaaatgccatttcaaacggctctgttaaagaagaaatcgatgcggtcaaaaatgtaccggtgctcattttagatgatattggtgcagagcaagccacttcttgggtccgtgatgaggtgttgcaggtgattttacaataccgtatgttagaggaattgccaaccttctttacctctaattacagctttgcggatttggagcgaaaatgggcaaccatcaaaggaagtgacgaaacttggcaggccaaacgtgtcatggaacgcgtgcgttatttggctagagagtttcatttagaaggggctaaccgccgt

SEQ ID NO: 4834 - protein, 300 aa, Streptococcus pyogenes
MEKIGETMAKLGQNTRVNSDQLIQTILADPEVASFISQHHLSQEQINLSLSKFNQFLVERQKYQLKDPSYIAKGYQPILAMNEGYADVSYLETKELVEAQKQAAISERIQLVSLPKSYRHIHLSDIDVNNASRMEAFSAILDFVEQYPSAEQKGLYLYGDMGIGKSYLLAAMAHELSEKKGVSTTLLHFPSFAIDVKNAISNGSVKEEIDAVKNVPVLILDDIGAEQATSWVRDEVLQVILQYRMLEELPTFFTSNYSFADLERKWATIKGSDETWQAKRVMERVRYLAREFHLEGANRR

SEQ ID NO: 4835 - DNA, 1176 bp, Streptococcus agalactiae
gtgatgagtccaatagatgagtttacatatattaagcaaaataagattgtttatgatagtaatagtttaatacaattgtatttcccaattatgggaagtgatgccatggcactctatgattattttgttcatttttttgatgacggaatacgacgtcataaattttcagaggttctcaatcatctgcaatacgggatgccaagatttcaagatgcattggtaatgttaacagctttggatttgttgactgtttaccaagccacaggtacttaccttgttaagttgaatcaagctatgtcaaatgagttatttttatctaatcccatctatcgtcgtttgttagaaaaacgtataggagaggtagcagtggcagaattagatatgaaaatacctaaaaatgctagagatatctctaaaaaatttacagatgttttctcggatttaggacaaccaaaacaagaggtaaaccggagtaaaaatgtttttgacttggaaagtttcaaacgtttgatgatgcgagatggcttacgttttaacaatgaaaaagatgatgtcttaggtatttatagtgtatcagaactttatcatttaaattggtatgatacctatcaattagcaaaacaaacagctatcaatggaatgattgcgcctcagcgaatgaaagttcaacaaaatgaggggcagcatattaaagataatcagagttttacaaataatgaaaaggtcatactaagggaatctaaaaatgatagtgctctagtgttccttgaaaaaatcaagagaagccgtaaggcagtgacaacaagtggtgagaagactttacttgaggatttggcaaaaatgaatttcctagacgaagtcattaatgttatggttttatataccttgaataagacaaaatctgctaacttaaataaggcctatatcatgaaagttgctaatgattttgcttttcagaatgttatgacggccgaagatgctgtgcttaaaattcgtgatttttcagatcaaaaagtaaggactaaaacagaaacgaagaagaaacaatcgaatgttcctgaatggagtaatcctgattataaagatgaggttagcccagaaaaagaaattgaattagaacagtttaaaacagatgccctcaagcgtttagaacgattaggaaaggatggtgaatca

SEQ ID NO: 4836 - protein, 392 aa, Streptococcus agalactiae
MMSPIDEFTYIKQNKIVYDSNSLIQLYFPIMGSDAMALYDYFVHFFDDGIRRHKFSEVLNHLQYGMPRFQDALVMLTALDLLTVYQATGTYLVKLNQAMSNELFLSNPIYRRLLEKRIGEVAVAELDMKIPKNARDISKKFTDVFSDLGQPKQEVNRSKNVFDLESFKRLMMRDGLRFNNEKDDVLGIYSVSELYHLNWYDTYQLAKQTAINGMIAPQRMKVQQNEGQHIKDNQSFTNNEKVILRESKNDSALVFLEKIKRSRKAVTTSGEKTLLEDLAKMNFLDEVINVMVLYTLNKTKSANLNKAYIMKVANDFAFQNVMTAEDAVLKIRDFSDQKVRTKTETKKKQSNVPEWSNPDYKDEVSPEKEIELEQFKTDALKRLERLGKDGES

SEQ ID NO: 4837 - DNA, 1173 bp, Streptococcus pyogenes
atgatgaaaccaattgatacttttacatatctaaaacgcaacaaagtaactcttgattcggtgactttaatacagttgtactttccaattattggaagtgacgcggtctctatctaccaatactttattcacttttttgacgatggtttacaacgtcataaattcagcgatattttaaatcacctacagtttggtatgaaacgttttgaagatgctcttgctatattgacagcaatggaattagtgagtgtgtatcagctatcagatacatatcttattacgttgcaccagccgcttagccgtgacttgttttttcaacatccagcttattctcgattattagaacaaaagattggagaggtagctgtctctgagttgcaggtaactgtcccaagtcaagcaagaaatatttctaagcgattttcggatatttttggggtgcaaggagatttgacgaacgtacctcaaaagccacaaaagaattttgacctttcaagtttccagcaattaatggttcgtgatgggttacaatttgaagataatcaaaaagatatcattagcctttacagtattgctgaacagtatgatatgacgtggtttgatacttatcaaatagctaaggcgacggctgttaatgggaaaattcgacctgaacgcttattggctaaaaaaaatcaaagcatgacaaaaccaagcaaagaaaatttttcacaggctgagcaaattattttgcgagaagcaaagcaagacagtgctttagtctttttggaaaaaattaaaaaggctagacgtgcaacgattactaaggatgaacgcattttattgcaaacattggccaaaatgaattttcttgatgatgttatcaatgtcatggtgctttatacctttaataagacaaaatctgctaatttacagaagagttatgtcttaaaaatggccaatgatttcgcctaccaaaaggtgtcaacggctgaagaagctatagtggttttgcgagccttcacggatcgtcaaagtcgtcggcaatcaaaagtaaaaacaagtcaaagtaatgtgcctaagtggagcaatcctgattaccaagagacaacaagtcaagaagagcaggcgaaactagatcagttcaaacaggctgctttgaagaggttagaaaacctaggaaaagggggtgac

SEQ ID NO: 4838 - protein, 391 aa, Streptococcus pyogenes
MMKPIDTFTYLKRNKVTLDSVTLIQLYFPIIGSDAVSIYQYFIHFFDDGLQRHKFSDILNHLQFGMKRFEDALAILTAMELVSVYQLSDTYLITLHQPLSRDLFFQHPAYSRLLEQKIGEVAVSELQVTVPSQARNISKRFSDIFGVQGDLTNVPQKPQKNFDLSSFQQLMVRDGLQFEDNQKDIISLYSIAEQYDMTWFDTYQIAKATAVNGKIRPERLLAKKNQSMTKPSKENFSQAEQIILREAKQDSALVFLEKIKKARRATITKDERILLQTLAKMNFLDDVINVMVLYTFNKTKSANLQKSYVLKMANDFAYQKVSTAEEAIVVLRAFTDRQSRRQSKVKTSQSNVPKWSNPDYQETTSQEEQAKLDQFKQAALKRLENLGKGGD

SEQ ID NO: 4839 - DNA, 477 bp, Streptococcus agalactiae
atgcgttgtccaaaatgtggctataataaatctagtgtggttgatagccgacaagctgaagaaggtacgactatcagacgccggagagagtgcgaaaaatgtggcaaccgctttacaacatttgaacgtttggaagaattgcctcttttagtcataaagaaagatggtactcgcgagcaattttctcgagataaaattttgaatggtattattcagagtgctcaaaaacgccctgtttcgagcgaagatattgaaaattgtatcttacgtatcgaacgtaaaattaggagtgagtatgaagatgaggtttctagtatcactatcggaaatttagtgatggatgaactcgccgaattagatgagattacttatgtgcgctttgctagtgtttataaatcttttaaagatgtagatgaaattgaagaactacttcaacaaattacaaagcgcgtacggagtaaaaagagtggtagcgtg

SEQ ID NO: 4840 - protein, 159 aa, Streptococcus agalactiae
MRCPKCGYNKSSVVDSRQAEEGTTIRRRRECEKCGNRFTTFERLEELPLLVIKKDGTREQFSRDKILNGIIQSAQKRPVSSEDIENCILRIERKIRSEYEDEVSSITIGNLVMDELAELDEITYVRFASVYKSFKDVDEIEELLQQITKRVRSKKSGSV

SEQ ID NO: 4841 - DNA, 492 bp, Streptococcus pyogenes
gtgcgttgtccaaaatgtaattaccataaatcgagtgttgttgacagtagacaagctgaagacggcaacaccattcgtcgtcgaagagaatgtgaacagtgtcatactcgctttactacctttgagcgtgttgaagaactccctttattagtcatcaaaaaagatggcacacgagagcaattttctagagataaaatattaaatggggttgttcaaagtgcgcaaaaacgacctgtctcgagcacagatattgaaaatgtcatttctcgtattgaacaagaagttcgaacaacctacgaaaatgaagtgtcaagtactgctattggtaatttagtgatggatgagttggccgaactcgatgaaatcacatatgtacgctttgctagtgtctacaagagtttcaaggacgttgatgaaatcgaagaacttttgcaacaaattacgaatcgcgtacgcggaaagaaaaaacgtttaaataatgatgaaaccaat

SEQ ID NO: 4842 - protein, 164 aa, Streptococcus pyogenes
VRCPKCNYHKSSVVDSRQAEDGNTIRRRRECEQCHTRFTTFERVEELPLLVIKKDGTREQFSRDKILNGVVQSAQKRPVSSTDIENVISRIEQEVRTTYENEVSSTAIGNLVMDELAELDEITYVRFASVYKSFKDVDEIEELLQQITNRVRGKKKRLNNDETN

SEQ ID NO: 4843 - DNA, 1503 bp, Streptococcus agalactiae
gtgaaaaataaaaaagatcagtttataggggtaaaacaacctctgtcaaaaaaattatcgcaattagtttttatcttattttttagcctatttacagtattttctgttttagtttatacttcggcaacaagatacgtccttcacagggaaaaaattaatgtcggtaggtcattagaaaaaactagagttcgtttgtcgcaagcgaactctagtttgacatccgatgatattttagagatcctgtacaaccaggtttttgcggatgacatctatcctcataagcgtcaaaatggaattgttagaacgggcgagtcaatcgatagtattctttatgttaatcaagaaatgaccctatacgatgtcaacaggaaaccagttttttctacactgagaacgggtatgccaactattggtaaatccatgggaaaagttatcatctctaaagttgcagatatggaaggttttgttggtacaaaagcaatctactctcaaaaaacaggacagttgcttggatacgttcaaattttctataatttaggtcgttattatagtatgaggcaaaacatcattgttttcttgattatgatggaagttttagggactgttttagccttggtcgttattaatagtgctactaagcgtattgttcgtccggttaaaaatttacacgacttaatgcatcagatatctgaaaatcctagtaatttagaaattagaagtaaggtccgttcagaagacgaaattggagaattgtctaggatttttgatgggatgttggatcagttggaagactatactcgtcgacaatcacaattcattagtgatgttagtcatgaattaagaacgcctgtcgctgttgtaaagggtcatattggtttattacaacgttgggggaaagatgatccagaaattcttgaagaaagtttagcagcggcataccatgaggcagatcgtatgtccttaatgattaatgacatgttaaatatgattcgcgtccaaggaagcttggaacttcatcaagatgaagtgacagatttatcaagctctatatcagttgttattgaaaatttccgtattttgagagaagattttcaatttatttttgaaaataatatttcagatatcgtttggggaaagatatataagatacattttgagcaagctctcatgatcttaattgataacgctatcaagtactctcctagttataaagaagtcagtgttgttttatcagtagacaatgattttgcgacagtagttgtaaaagataaaggagaaggtatctcagatgaagatattgagtttatctttgatcgtttttatcgaactgataaatcacgtaacagagaaagtacacaagctggtttaggtatcgggctttcagtgtttaaacaaattatggatgcttaccatttaaaggtggatattaaaagtgaactaaatcaagggactgaattcattgttcgcattcctataaaaaaatttgaagaaactaaagaaata

SEQ ID NO: 4844 - protein, 501 aa, Streptococcus agalactiae
MKNKKDQFIGVKQPLSKKLSQLVFILFFSLFTVFSVLVYTSATRYVLHREKINVGRSLEKTRVRLSQANSSLTSDDILEILYNQVFADDIYPHKRQNGIVRTGESIDSILYVNQEMTLYDVNRKPVFSTLRTGMPTIGKSMGKVIISKVADMEGFVGTKAIYSQKTGQLLGYVQIFYNLGRYYSMRQNIIVFLIMMEVLGTVLALVVINSATKRIVRPVKNLHDLMHQISENPSNLEIRSKVRSEDEIGELSRIFDGMLDQLEDYTRRQSQFISDVSHELRTPVAVVKGHIGLLQRWGKDDPEILEESLAAAYHEADRMSLMINDMLNMIRVQGSLELHQDEVTDLSSSISVVIENFRILREDFQFIFENNISDIVWGKIYKIHFEQALMILIDNAIKYSPSYKEVSVVLSVDNDFATVVVKDKGEGISDEDIEFIFDRFYRTDKSRNRESTQAGLGIGLSVFKQIMDAYHLKVDIKSELNQGTEFIVRIPIKKFEETKEI

SEQ ID NO: 4845 - DNA, 687 bp, Streptococcus agalactiae
atgggtaaaaagatcttaataatcgaagatgagaaaaatttagctcgcttcgtctcgttagaactactacatgaaggatatgatgttgttgttgaaacaaacggtcgtgaaggattggacacagcattagaaaaagattttgatttgattctactggatttaatgcttccagagatggatggtttcgaaatcacacgtcgcctgcaggctgaaaaaacaacctatatcatgatgatgacagcacgtgattctgttatggatattgtagctggtcttgatcgtggagcagatgattatattgttaagccgtttgcaatcgaagaattattagcacgtgttagagcgattttccgacgccaagaaattgaaacgaagacaaaagaaaaaggtgatagtggtagtttccgtgatttgtcattaaatactcataatcgttcagcgatgcgtggtgatgaggaaatttcactaacaaaacgtgaatttgatttgttgaatgtcttgatgacaaatatgaatcgtgttatgacacgagaagagttgctagaacatgtttggaaatacgatgtggcagcagagacaaacgttgttgatgtttatatccgttacctaagaggtaaaattgatatcccaggtcgtgaatcatatattcaaactgttcgcggaatgggctatgtgattcgtgaaaaa
